United States Patent 9,029,523 (PROMOTER, PROMOTER CONTROL ELEMENTS, AND COMBINATIONS, AND USES THEREOF) - sequence listing, part 14

SEQ ID NO: 18331 - DNA, 3003 bp, Unknown
  misc_feature (1)..( 3003): 2750-1469P.txt file - cDNA_ID_1816826; gDNA_ID_1621129; Annot_ID_56427
agaggagcaagacggcgccctcatcagctaaaaacctacattgccagattgcgttattacacagtagcatagaaagcattgaattaagaatttgatacaggatgcatctctatcaatacaaaaataaattattgtagagaaaaagctcaagaaaatataacttacatgccgagagtatcaaatagtgaagcaaatggtatccgaacatgtggaccagcagggtgggcatttccctccacatctgagcggtcaactgcaatcagagtaatagtttagataaacacatcgaattcttcttattcagaataatgaagaaaaaaaaatctcacattcaacatctctagcatttgctagagccttgctaaaagtattgtcagaggaaaatacatggactttagaaactgattctgaggtcgcactgtcatcacttttatccgtcatagactcatcactcatgatagacttgtgatagttaattaggataagtaaaacatgcaggctgcactccgctagtggatttttagatccgccactgttacttacaagatagttcaaaggcaagagcactaaacttgctgtatatgcaacagaaaagttttcatgagtacatggactgtttcatgtagctagttaggaaaacataattgaacggaaagtcggaaaggcaatagaaaaagatcaacatttacaagttagtacaataatacatcatatatgaagtaatatacgaacacctaccagctgcagaaccaactctctctaaaatgccttgtgaatctccatcagaatacatataggattttgcatttggaggagtacggtgtcgggaaatataattaagtagcaaccttctgactactagagaaactagagacttttcctgaaaatcgttgaaccaaaggaaatggcggaaattgatatgaggtaatatctatgctaaagacaaagaaaaaagtaattaatttggttacctgagtcattgctgcatcaataaaagggttcgcatctgttggtccatgtgaaggtccagagagaagctgtgtcgacattgtaacaagcatgaagttgagaagttcctgatgtagaacatacgagttgggacttgccaaataaatgatgaaaatcaggagaatgaaacatctaatactgaaacatataaggaataggtgatatagagaatcagcattggcatacctcacttcatttgatccaatgaagctcagaacactatgcatgacaaaattttggatgtcttgatctgccatcaaaacactcttaattagccagcttagaaataccttaacgctggaaataactattatgagagtcattacccattacaaatccatgtggaactggttcactttcgtccagagaaagatgcaactcctgaagactgtcactttttccattctcaatcaaatactttaaaaagacggatgaaatatatgttgcattaacagctttcttatagagagaagactgatcatctgaagcttgaagaagctcttgcaaacaccaggacagatgaatcaatagttttgcaaggtgcctagtgtagccattactttgtgctgaaacaaaaaaagaaaataagatcatcctcctactttcactaggtcatcatcaacattcaatttcattagctcaaagtgaattcgacaacacatcctttacaatttcaacactaaccgaaaagttcacaggcttgttgaacccgatcactaggccagcgagaactcaacggaagctcaagtagcttgttccagaaatcagacgctaaaggaaacgatttctccccaacaaaagtggcaatgaggtactcggccaccgaaacatcatcaccaccggtttttcgcggcgttgaaggcacacctcccatgtctcctaagccaagctcgccgagtcaacaaggatccaaaagagaacgagtcaattgatcgcgtccaccgagtcggttacgatgaagaacaacggcattacaaagcaagagatgaacaatgcaaagatcttgctctcaatttggtctctctcgatctaaatctgagattaattgaagattcaaactgttaaaccaaatgcttcgataccaagggtttagacttttgagcaaaaaaaaaaaagagaggacgcgttattttatttgtttatttatattataatctttttcttttaatgttggaaaactattattcctgcgtaagtttatttccaaattgattttttgatacaaataatttagcgactaaatgtgacaatttttgattattcattccatcagcacttgtaattaatgaagttaaataagtgttttcctaattttgaaaaatacaggctacgtgctaccaaattaattcccaccaaactctcataaatatgattcgaatactttatgggttcttacgttttctcttttacaagagcttatataatattttctgtatagattaacctcaaaccaaatcttgactttttttttgaagttaacagatgacttgttctattctactagagaaatgaaattattatttactagtctacgtggaataaaaacagagataatggatttgggataattcaaacgaaatggagtcaaattgatgctagctactaccgtctttgaaccgtcggttgtcggtggagtgggatgtggccgaatcttttttactgtatttacaaatttgaggcccatttattttcttgggcttttcatttcttcaatgattctagaactgaaattgctcaaggtattagttcaaacttaatcgttattgggcttttccatatgttcaatattcttagttatgtttaattaaaaatatatgcacaagtgagagaactcaaatgatgaacaaaaagtaataatatttagagaaaaaactaaaagaggaacagagcagaagtggaagtctcttgtccctctgtaaaccctaaaatagaaaagcaaatcacacttgggggattcatgttctttggctttcttacaaacctctagaaataatg

SEQ ID NO: 18332 - DNA, 3000 bp, Unknown; identical to SEQ ID NO: 7144
  misc_feature (1)..( 3000): 2750-1469P.txt file - cDNA_ID_1816834; gDNA_ID_1621129; Annot_ID_56425

SEQ ID NO: 18333 - DNA, 3003 bp, Unknown
  misc_feature (1)..( 3003): 2750-1469P.txt file - cDNA_ID_1816846; gDNA_ID_1621130; Annot_ID_56467
ctgcggttcgtttaacggtaaaaacttaacgatcattgtaactgctggcgttattggagctgttggttcattgtgtgttggatttgggatgttttggtggttctttattagagataggaggaagatgaataactacggttatggcgccggaaaatgtaaggatgatagtgattggattggtttgttgagatcacataagcttgtgcaagttactctgtttcagaaacctattgtgaagatcaaattggttgatttgattgaagctacgaacggttttgattccgggaatatcgttgtttcgtcgagaagtggtgtctcgtacaaagctgatttgcctgatgggtctacattggaggttaagaggcttagtagttgttgtgagcttagtgagaaacagtttaggtctgagattaacaagttaggtcagatcaggcatccgaatttggttccgcttctcgggttttgcgttgtggaagacgagatattgttggtgtataagcatatggctaatgggacgttgtattctcagctgcagcaatgggatattgattggccaactcgggttagagtcgctgttggagcggctagagggctagcttggttgcaccatggatgtcaaccgttgtatatgcatcaatatatcagctcaaatgtgattcttcttgacgaagatttcgatgctcgtgttattgattacggtttggggaagttagtgagttctcaagactctaaagatagctcgtttagtaacggcaagtttggttacgttgcgcctgagtattcgagcactatggttgcgtctttgagtggagatgtgtatgggtttgggattgtgcttcttgagattgttacaggacaaaagcctgttttgattaacaacggtgaagaagggtttaaggagagtttagtggagtgggtgagtaagcatttgagtaatggtagaagcaaagatgctattgatagaaggatttttggtaaaggatatgatgatgagataatgcaagttttgagaattgcgtgtagttgcgttgtatcgaggcctaaagaaagaccgttgatgatccaagtttatgaatctttgaagaatttgggagatcaacatggtttcttctctgagtatagcgatgagtttccactcatctttaacaaacaagaacacttaaaatgaatgaaaaggttttattactttcgtactccaatttgataccacttacttatctaccgttctcacttttaaccgcatttttttgtttttttctgttttgtttttgtgtgctgtataattctgtacatcatgtgatgcatccaatgaaaatgagaagaattgttttatatagatcaaactttgaagattctgattcaaaaagtctatcaagtgttagtgtttctatgagattctagttgtagttgttatcgaacgatttgaaattcgatttcaagcgaaaagacattatccaacgatgtttctgtttcttctaatgattctatggataattataatcttttctgataggagaaaaaattaatgtttcccaagtcgctaatgaaaaatttgataaaattttataagataataggataatattttttgaaaatctttgtgtaaatatatagtcccttaatatttaaattgataatcatataaattacatatatataaattgatatattaatgtactttatgcttttagtgtgtgtttttaattaaaattaaattttttgttacagcttatctctaatttttattgtataaaaaaattattatgttgtgtttttaaaatattgaatcgtaatatactttataaatatgatagcattagtttgaaaaacttggtttggagtgaaacattctctatagtttttaaattttgaatatatctcatttttgcgtgttctaaaaaatagaatatatatcattttcattttaatagttttatttttaagaaaaaaaatacgacaaatgaagtcaaaagagtatgtagaactgaattcatctaaagagtttgtatttttttttttaatttacatctatcgtttgtataagtgaattcatctaaaagatttgtaatttattatcaaaagatggttttcctaaatattaaaattttacaatatatcaaaactataaaaaaatgataacatgcacaacactaattttgtttagataaaaatttcttaattcatcttttaataaaaatttaacaattaattcttttaaaaattattaaataatagtagataaactaataatactataaattaataaaatatcacatgatctcaacatttttattttatagaggttttactgtatatggaaataagaaaggtaaaatattagtagaaaatttggaaagaatgaaacaaagtagaaaaactggaaactagatatatgtatattaaaattttggcatgcatgatattacattatacatttttataatcacattttttcaattctctgtatagtaaattttccgtaaatctcagtaattaacttttatttctatgtatctagttatatatacacgctctttgtttattttctctgtcaacagtaaaaacaacacacaagataagaagctaagttaagatctttgaataagaagaaagaagtatgtcgaaaattttgctcctcataggacttgctctccttgtaatccttgcaattgctgttatgggatacttaataatgaagcgtggtcaagaatagaagccggatgtttaatttaacggttatgtagtttttttttttttcttctttctccttagagtgttggggtgaaactataaaactttttgattttctatttgtgttgctccatattgttatcagtggatagaagtaggaatgatttctagctatttcatgtgtgtttgtgtcataatcacctaagaattatgattttttctaaatcttatggatgtcatctgacccccttaccctccatgtaaatcttaatgactaactttgaaaacaaaattttatacaataagataatg

SEQ ID NO: 18334 - DNA, 3003 bp, Unknown
  misc_feature (1)..( 3003): 2750-1469P.txt file - cDNA_ID_1816870; gDNA_ID_1621130; Annot_ID_56459
atgctgcttccttgtaacggtgctgatgcaaagaagataacttgtttcatccatacgcttgttagtctgggagtctcttaccattttgaggaaaagattgttgagttcctgaaggacgctttcgagaatatcgaggacatgatcatcgattgcaaggaagatgatctctacacggtttctattatattccgggttttcagattatatggtcattacataactccaggtgaggatctttcatctttattacggaactaactgacttggttggtttatgctccgttccgttgtttttaagtggatgtgtgatgtgaacattttgaacatgtttcagagttgcatataactatttcatactacttttttttcttaatatttcatacttgcatgtgtgtagatatattcaacaggtttaaaggagacgatggaaattttaagaaatgtctgaatgatgatgtaagaggtatgctaagcttctatgaagcgtcacactttgggacaacgacagaagatatccttgaagaagcaatgagtttcacacaaaaacacttggagttatttttggtaggcgagaaagccaaacattatccacacatcaccaagctcatacaagctgctctttatatacctcagaatttcaatttggaaatattggtggcaagggaatatattgacttctacgaactagagactgatcacaatgaaatgttactaaagttggccaaactcaactttaggttcctccagctgcaatacattcaagatctgaaaacactaaccacgtatgtatattcatttatatagatgcttcatatatatgtatattttctgaaagttttatcgattaggtgtatgtatgcagatggtggaaggagctagatttagtatctaagataccagtttacttcagagagagattggcagagccttatttctgggcgactgggatttattacgagccacaatattcagctgcacgaatcatgctggccaaatccatcattttagtggacattgtggacaacacttttgatgtatatggtactattgatgaagttaagagcctcgttcaagccattgaaaggtacgaactatatacgatcatttgttaggtgctttgtaatcacactcatggtataaacgaaaaacgaaaaaagttacaaagtggaatgaatttaaaggattaaaaagtcatatttaaaggatataaaagctcaacatctaggtctctttatattgttggaatgttggtgttctatttaattataaatcattagatgtgatccctaataattgtatggatccaatattaagtaaaggtgggactccgacgccgtagatgtcctaccggactatctcaaagtcgtcttcagaacaacgtttgacttgtttaaagaactcgaagaatatgtgagctctgaagcaagatcttttactatgcaatacgcgtatgagcaggtactgtttcttcatctatttcttaaatctaagccaaattattgcatctataaaaatagttactatacaactaatgttttaaaatgtctccaaacaacaccattctcttatatgagtaaaacaataaggagagcatttggatgttggaaatgttcattttctacgtggtatttttttcctagatcatttagctccacaaattcagccaaaaaataaaatatatatctctatattaaacgaagaattgaaggttatatatagttcgtatttaatataatgttttgcagctaaggatactcatgaaaggatacctgcaagaagccgaatggtcaaatagagggcacctgccaagccatgaagaatacatagaggtcggggtagcttcgaccgcaggtgaagtgctgctagcaatgaccttcatccctatgggagatgctgcaggagtcggagtttatgaatggctgaggtcaagaccaaaactgacccatgctctttttgtgaaatctcgtctcagagatgatattgctacctataaggtaacagaagtcctatatatatatatatatatatatatatatatatatatatatgtatattttaaatgcaaattataaaaataaaatgctaataaatcttatcgtatagtatttcacgtcataaactactttttagttatttgattgataattttgacatgatcgaaatatatgatgaatttgcatcaggaggagatgaagagaggagatgtttgtaatgggatcaactgttatacgaagcaacacaaagtaagtgaggaagaagcgtgtattgagtttgagaaaaagactaatcacatgtctaaggtcatgaacgaagagttcttgaaggcagccaaatttataccgcttcatattctaaggcctgttttgaattacggacgcttagcagatgtgtgctataagtatggagatgggtacaccttcgctggagagaagatcaaagattatatcacctctttgtatgtcgatctcatcactctttaagagtcttcagagtttgggatcacgtgaatggccaagccaaatttgtatccgcagccgcaacccaaaaataagttgtttcagtttaagttgtctttgttttcttggttgttagtctgtcttgaaaaccatcttttaatcagtaataaagcttgtcattagactatcaaaactaacaataatccgaataacaatctatgaatacgtagttaacacttatagtagtgggatttggctttctctgcagatgtgcaattatctatttttttattagcaccgataagaaaaaaaaaatattaattttttctttgttattcgcttagttaataatattaaaacgggcattcttcgaaatatattgtgtacgtaagtgacatcaagcgggtcaataggaacttttcgtagaaaataatccgtttttacatcagacaaaaaaatattcatttatctgagaaaataataattaattgggtgtaatatccaaaagccaaaaaaaaatcaaatcttgaaatgccctgaaaacatg

SEQ ID NO: 18335 - DNA, 3000 bp, Unknown; identical to SEQ ID NO: 7178
  misc_feature (1)..( 3000): 2750-1469P.txt file - cDNA_ID_1816878; gDNA_ID_1621130; Annot_ID_56456

SEQ ID NO: 18336 - DNA, 3000 bp, Unknown; identical to SEQ ID NO: 7168
  misc_feature (1)..( 3000): 2750-1469P.txt file - cDNA_ID_1816898; gDNA_ID_1621130; Annot_ID_56451

SEQ ID NO: 18337 - DNA, 3003 bp, Unknown
  misc_feature (1)..( 3003): 2750-1469P.txt file - cDNA_ID_1816909; gDNA_ID_1621130; Annot_ID_56447
gaatagtgacatttttcacatacactgtgcacacagtaactaaagatcattgctttctcatttccactttggtcttggttgaagtaattttatttagtttctgaaggttgaattgtttggaaaaaaaaaaaatgatctccaaaacatgttattttgcatggattgaaaaaagcatataaccatagcaaaatagctgttaatataaaaatgtatggttttgagtttcttttgactataatttatagctcagttttcacaatctccataatattgatcacaatctccacaatcaaactttttattattagagtgtatagttaagcaaaatcccaaaaataaaaaacctagctaggaaaatattcctctaaattaatattacacactagttctaaacaatctgatacgagttgccatcgagatttgcacacgaaaaatgttcaaagggacccttttttcatctttaatctttttggactttggtcggcgttggctgattatgactcgctataccacgatttctgtcccttgttacaaataattctattagctagtctcgattctcttttttctttcttcttttgtttaagtaacctccttatctttcttgtttagtggaatacaggctccgatcaaattcagtcacatgtcatcatttctctaagatatatgtttccacgtcaacaattaatttcagttagtttgtttttatgtgtttatataatacgtaataaatacataaactataatttaaacaagatgaggatttaaaccagcccctagtaataatctaacattaaaacaaaaagtaataacataacaacgatacaaaaaaaaaaaaaatataattacaaattttggtattaaaattattttttctatacattaaatatggaaaaaatatttctcataaaaatatatgtaaatatgtaaaaattcaatcatccttatatattatgttaatttcctttagagtttaaggaaatagttttcgatggttcatgtatttctcattttatatcatattatcacttcgtcaaaactatataaaaagttaaatggtacgaaaataattcgtacttaaaacacataataatgggacatacaccacatatcaccaaaaatattaataataatgggacatgcatagaaggaaaaaaaacataaaaactgaggactgttttgatgaaaacaagaagaagcctaaaatggaattcgtaggatattacattgaaaaatatgactgtaataaatttaagaggatatcacttcaaacacttagttaaaaaccgactatagtacatcctattctttgactttatctagttatatttagtatttacatttgtataccgtctatatatgcccaaaacatgtgaaactatttttaatatagaagtgaagatgtgtccccaataattaatgaatcacatatacgtttttcaacctaaatgtgaattatttcgttaattttgggaaatcaagtttttttctgtttccaaagcatatcttataaactcactttttgttttgataatatataggcacctatttgcgaacaaatttttattatgtacacagtacactcaaaagctttatgtagttattatcattgttatagtgcctaagttgctgcttatctaactatccactaagttttttagtttggtctatatcttagctattaactttagtcgagatcatttaactactatggcggcttgacagactgaggctattctttaatgaaaaactctataatgtaaaattctttttcttagtcatatagaattatagatatctatcgtggtttcaaactttcaatctatatagtatataagtgtataagtgacattatctaaacatgtttatatcctcaaagttgtaaagttactaaacttccgaaaagatgatagaaatagcaaccagaaaaactatattgtattgacttttgactgactttagaactcaatagtgtaggccaactcaacctaacattaaatatttatgaagactaattaacaacaatcatagggagcctattaaaatgttaaagtcttgcgcatgtttgactatataatactaacgtatagttgcatttatttcaatgatataaatattttatatctcattgtactacttaagttatagattgattattcgttggtgatatttaagaccaaatcctaagacgacatatatatgtaagtgtaacccaaaaaaatctaaaagtcataaaccgtatgattataagtatatataagatacgtattatactacagaaacacacacatgtgtaacggaccaacatggatgaagaaatggtcccattgagaagaagagatctaatgacttcaaatcaagaatggtccattttccaaaatagacacgtaaatatatacaaagcttaatccccatccctctattgggtctacacacagcctagcatttttgtattttctgctctgtttttatttttttttaactttacaaattactttttaattcttattatcttcagcttttgttctgtctttttttttattttcctgataaattctcacaacttccattcatgactcgagctgggtcctttgatttgtcacagctaatcaaaacagtattagcacaaaaaagtgtatatcaatatgaccatgaagttcataaaaacatgggacctttgaaagatgttgtctcacatattcatacatatttcaataaaatccattacgtacgattccatataaattattggtcagtcatgctaaatgtaagcaagcaaacatatcatttatggtgttacatcaagttatgacagagtatgattgaggccagaaagtaacttatgggtctaatggatcgtattccaaagtaatgggctttttattaaggccgtaagaggcccatttatgtgatttctttgaagtcgctttgtttgcaagttgcgactactcagtttcttctccggcgaagaagaggataacgaaaagaaaacacatagctatg

SEQ ID NO: 18338 - DNA, 3000 bp, Unknown; identical to SEQ ID NO: 7198
  misc_feature (1)..( 3000): 2750-1469P.txt file - cDNA_ID_1816933; gDNA_ID_1621131; Annot_ID_56481

SEQ ID NO: 18339 - DNA, 3000 bp, Unknown; identical to SEQ ID NO: 7190
  misc_feature (1)..( 3000): 2750-1469P.txt file - cDNA_ID_1816945; gDNA_ID_1621131; Annot_ID_56478

SEQ ID NO: 18340 - DNA, 3000 bp, Unknown; identical to SEQ ID NO: 7190
  misc_feature (1)..( 3000): 2750-1469P.txt file - cDNA_ID_1816945; gDNA_ID_1621131; Annot_ID_172502

SEQ ID NO: 18341 - DNA, 3003 bp, Unknown
  misc_feature (1)..( 3003): 2750-1469P.txt file - cDNA_ID_1816954; gDNA_ID_1621131; Annot_ID_56474
gatcaattacaattttcttgggtagttttataccaataaacaagtctatacatgaccaataaacgccaatccaaagtacattgtccatttttctttgaccatttattcacttgtgtataaacaatcccatcagtaggacaatgtcagttacatagcttttataaaaaaaattaacgaagatcttatttgtattacactctcaatgaagaccattagttcacttggatacacccgtctatactaattatttgtaataggtagaagacagaaggatatgtcaattcccaaaaattactgatttttattcaatagaaattcaacaaatatacatcgattgtataacgtcataaactcacaaaagttactttgattttcatcatgtctcaacctctcgtttctttcttcatcttgactttgaattagaagtgattaatctcaggaaatcaaacaatcagaaacaatactttcaaatttacagatctgatgtggaataagattaagaactttctaattttgtagatcagagataccagagtcattaggagcagagaggcaccaaacaaaacgacgaataaggcataaagctccctccgccaccgctactaccaactacgccatcatgtcttgattagctttttaaaaacaatcatagcaaggagtcaaagcaaatatgtcggagattagaagataaagccctcgtttttgaactttgatttttcgtaaaagatttgattttggttttggaaatagaaaaataaaatcgatggagaagcgctgagaagatatgacaaagagaatgagtttgcagttaaaaagggtaaattggacaatttagtttgacaaagtgctttatcattttaaagtgtctaaatccgtacatagttttttaaaagtgtcctagaatgtaatattctttttatttattttgggtaaggatcatagaagaagaataagagaaattgagaattaaaaacataaatattaaattgagggtaaaaaagtctaagaaaaaaagaattagtagaaaaagtgtctattccctataaagtgcctcaaatggaaaaacattctctaaaagtgcctcatagtggaacattcccttcaataattagagggcaccattttttttttttcttctaaatattaaaaaaaaattagtaacacaaaaatgaaatttagaatggacctataatttttttaatgtattgttttttgtttttaactaaatctttaacaaaattatcatagaatggacctataatttggcctccttagaaaaattgaaagaaacattttaagaaaatgtagtgaagattgacaacatagttggccgagtttccggatctgcttgttaatacgataaagcaatttccaccatttttgtgagcttctctctattttttccctgtgaaactaatacacgttcatcggaaatgcttctcagtgacagagtttcttcgggagacgatgataaactcgaaaccaaatctctcggatgtttcccaattatcacttccaatatcaaaaccccgaagctatacaagataaataaactctgtttatcctcaaaacaaatagttgaaaaattattaataactaaaacatatttcgtatattttgaatacatcgacaaccaaattttctttttgaaatttatactaatattttgtatttattatattttaactttttctaaattttgaattctgttttaatttattaagaaaataacttttgttttaaatctggataaaactgtcattttcaatattaaaaataatgtttttattaaaaatggagaacaatatattttcaaatgaaaacttaaaatagggtagttttttttttcaagtttttttcatgtttttttttctaattcgttctaaaataccgaaaataacaagattgataatttttgtttcataaaagatttagatatttgaaaattagccgccgaacttttctctagtattacctttaatgtgagtggttggtttaattgcatatatagatatttaactttctcgaataacaaaaaaaaaaactcaaaatataagagaagaaaatgcaaaaatttagaaaaacataagcaaaaataaaaaaataaatataaacaaaatttgatctaattattttaataatgagtttttgagcgcactaattgttatttcatatattaacaatagatgttttgtattattgtggagatatagtatattgttggataaataaataacccagaaaaaatgtatgaaaaaaagctataataaacatgtggcaccaccgcaccgaaggtaaaccaaagccagattaatttgtctcgtctcgggttcctataacacaatgatatgataccatcgatcgtatcaagaagccttgaactattgagaccgttttgttaggaaactaggtctgcgaggaagaagaagaaattgaggtatgagggtagaacgaggaacatgacaaacagctataagaagaagtaacggagaagagtgagtcctaaggttaaatataagtgcatcacacaaaatgatgaaatttctaaatatttgtgtgttttgtataagtctttccttcattcttcatgttgtcactctaagtaatcaaaacaattattagtatgttatatgttatggtgccaaaacaaccctacagcagttggtttcggtttagttgatgcggttcagttttgaaaaagacaaaaaaaaaaaaactgaaacgaagaaaccgagaaaacgaaaaagagaataacggagagattgagagagaatcagaaagcgaaacgaaattcagtatccattgcttcaaaattcgacataacttcgaattgttgggtagttgaattgtgccactgaactcccacatccggtgaagtgaaagttactgtttttcccggcgaagccaagagaaagttactgtttttcccggcgaaaccaagagaaagttactgttttttccggcgaaatttgaacctccggcgagatagcatctttagctatg

SEQ ID NO: 18342 - DNA, 3003 bp, Unknown
  misc_feature (1)..( 3003): 2750-1469P.txt file - cDNA_ID_1816958; gDNA_ID_1621131; Annot_ID_56473
accagacatacttgcagcttctcactggaattcctgttcagtagctttcaaggcggcaaatggccagatcttccacatctccttaatcaccaagcccatctacatccaactctttccaggatacatgatcaaagcaaagtatataggtctgaactccctggaaaagatttcatacttggagttgatgtccttcatagccttaagaaagtatcttggaatccaaaaagacttaagcacaagaaccaactgctaccatggactaatgtctcccatctctaccccatggaatatgaaattctatcaaagacgagattatcaaggcttcttgtgctacttcacattcagagttcctcaccaaattttcatcacctttatgaaagaatccggactttttcatatcattacccttcaagaagaatgaggatgtcatccaacaaaagcaagccttccaggaatgaatccaaaccactataatcttgctctcgaagaagtcgaccaactccaaagagaagacctcattgagaagaccacctccccatgggcatgtgaaaccttctatgttaacaaaagagctgaacaagtacgaggaaaactgaggttagttatcaactaccatccgctcaaccatttccttgcagacaacaagtttcctctaccaaagcgagaatttctattccatctaaaaacctctcaaattaattacaaactctaacaatcgagaatgggaaaaatgtcaaaaaaagcacgaactttcaaatttgggaagaaaaaacataaactttcaaaatgccattaaaatcgtaaagttttgtttgacttttgattaaatagtcaagtttcgttgactttgccatttcgggcatctcgttaagtttccgttaacaaaaaaatcacagaattaacactccgttaccattttctgttaaaagtgaaacgacgtcgttttgaaattctaaataaaagaaaaaagtaaacccacaaggattcgaacctatggtcttttgcctttcaaagaatcattaaaccactgagccacgagaacatattaacaaaatgaaaaacacatatatatataagatataaatatacaattaattaaaaataaccaaacaaagatctatattaatgcatttaatttaaattattctttcttaaattatataaaaaaagaaacatatgaaatagagaaaatgaaatatattgcctaaataaatggtttcttatattgtttccatctaattatgaacatcacatttaattatttgaagatggaatgattatattttatgtttatcttatatatatatatatatatatatattacaagttaatttatcgaatagatatgtttttataattaaaaatatttataaaattaaattgaataaaattctatgtgcatgtataaattaatcctatatttatttgagaaggattgtataaattttagcctattttctaatttcataagtttcaatttttttcataaaataaaatgaagaaaaaataaattttcagataaaaattcaatgcatttagaagaaatctctatatgtaaaattaaaaatatgatatttcgaaatgtatatttatggtatgtatatttaatatttgtacatatttggttatttttaattaattgcatacgtatatgttatatagatccgtttgcaatctgtactagaataatatcgtggccccaatggttgagtgcatctgaggaaaacaatacgtatctggatcgacgtcgttattttattttagattttcgtggactcacaatcgttattttattttagattttcaaacgacgtcgtttcgtctgtaacagaacatattaaacggaaaattaacgctgtattttttttgttaacggaaacttaacgacatgtctaaaatggcgaagtcaacgaaactttactattttattaaaagtcaaacaaaactttacgattttagtggcatttttgaagttcatgttttgttcatcccaaatttgaaagtttatgtttttttgacatttttcccgttctatatttcacaagttatttttaattagttttgtgtatatatataaatatttcagtttacaataatatcaaaacgttatcgtagcatatttggttgagcgcttgtaataattctggagagtcatgagtttgattccttcttggcacatattgtgtaatatattttcattttgaaacgacatcgtttcgcttctaacggaaaatgttaacgaaaagttaactccgttgttttgttgttaacgaaaacttaacgacatgtccaaaatagcaaagtcaacgaaacttaattattttatcaaaagtcaaacgaaactttatgattttagtggcatttcgaaagttcacgtttttttatcccaaatttgaaagttcatgatttttttgagaatgctaattaatgatttcaagagttttctttaattgagaatgacgtcgtttagcaaatgaatggatacataacatgtctgattactctcttaaaccagttaacaatatttaaatcatattgaaaacaagaggacaaagccagagcgactctgcttttaagacacggcaaaaaagtcaaccaacgaacccaataacaaggaaagagatttgtttttcatttctaatggaaaaaaaacagcaaaaattgaagtctactcgtcgtagtagtcgtcgtcttccactaattccgtggtttttttatcgaagacttttgaataaagtacatttgcagagtctgtcaataaccctttcttcacggtattgctctcaagccgcgtactggtaggctccaaaattatcccttctttatggtttttggaacctgggttctccgattttgaggtaatccttatgtgggttctttctgatttcgtgttttgttttattaaaaggacttctatgtttttttgggggtttctgaaaagttcggtttttgcaggttgttgaaatctttgagtagatttttgtggaacatctgactctcatg

SEQ ID NO: 18343 - DNA, 3003 bp, Unknown; identical to SEQ ID NO: 18342
  misc_feature (1)..( 3003): 2750-1469P.txt file - cDNA_ID_1816958; gDNA_ID_2214458; Annot_ID_182714

SEQ ID NO: 18344 - DNA, 3003 bp, Unknown; identical to SEQ ID NO: 18342
  misc_feature (1)..( 3003): 2750-1469P.txt file - cDNA_ID_1816958; gDNA_ID_1621131; Annot_ID_172493

SEQ ID NO: 18345 - DNA, 3000 bp, Unknown; identical to SEQ ID NO: 7186
  misc_feature (1)..( 3000): 2750-1469P.txt file - cDNA_ID_1816966; gDNA_ID_1621131; Annot_ID_56471

SEQ ID NO: 18346 - DNA, 3000 bp, Unknown; identical to SEQ ID NO: 7186
  misc_feature (1)..( 3000): 2750-1469P.txt file - cDNA_ID_1816966; gDNA_ID_1621131; Annot_ID_172490

SEQ ID NO: 18347 - DNA, 3003 bp, Unknown
  misc_feature (1)..( 3003): 2750-1469P.txt file - cDNA_ID_1816968; gDNA_ID_1621131; Annot_ID_56470
atccaaaggtgagcaatcaaccctactttagcaaatcccagtttattccttttttatcaattaattattatagccctctttaatcttctttgtggggattcaaaaatagaggaacatacatgttgtggccttgaatgggaactccaagcaatgagagttgcaacatattgcaagccgagtatgttagcaaagctacatatttgatcgaaactaccaaaatttcgaattcggcacaaaaatcttactctacttgaaggtaatctttcacaaaatttgttcatataatcattgttcttggttaaaatgttacacaatcttcttaatatgtcttcttttgtgtctttagtattgctgaaataacaaaattattctcacaagtaaaatacatcgttggaaattagtgtcaaggtatgtgtcttttttatttagacctttgagcatgaacgaactaattttttcacacatacagcttcatcgatttctttacaattatgactctacttcagtattggtaatcctctcactttttttattaatcaatctaagattctgtaacaattttaatttgtttgaaaagccacgaagtgatcaatatgttttgtttaaacacttccgtttcggattcatgtctagttttataaatctatgctcttgatgctagtcccaactaggaagatcgattggttctggagctgataccctggtttggaatgcaccatggatctctctctcatcatccgtaaccccaatgggtcctcctactcaagagacacaactcatgactgttaaggacttaatatgtcctatttccaagtcttggaatagagaaaagattgcaacttacctccctcaataccaatcagagatctttcagttcagaccaagtaggtttgttgctagggataaatttatctggcttcccacgaaatctggtgattatagcaccaaaacaggctactacgcagctaagactttgcggaatcttcatacacaagttccacctcaacctgtgacctcaattggaactcagagatatggaaaaagaaatgctccccgaaaattaagtttctcttattgaaagtattgaagaatgctttacccctaggtgccaacttgaaagctcgaggcatcaaccctacaactgcttgcccacattgtagtgcagaggaatcaggtcttcatctgtttttcctttgtctatttgctgcacagatctgggagcaagccccattcaaaaataccctttcgaccttcacttttaccaatcttcagatgggttttgaagcggctaaacatctgatttgcttaccactggtggaaattggctcaaaccctcttttcccctggattatttggacaatctggacctgcagaaacaagaaaatatttgagtagaaacatctatctagtcgggatgtcatatctcaagcaatttcggctgcaaaagaatggttattggctcagcctttacctcagggacaccagactctgctttcaagaccaattgtgccggaatttgaatcggatgcaatcttgtgtttcacagatgcagcgtggcgagaggattcacatgatgcgggattgggatggatttttgtagataactcaaatcactctgagatccaggatcacgcagtggcgagagaggtatcttcccctttaatggcgaaggcgatcgctctcttctctgccatccaacaggcgtcaaatcgaggattcaaaaaacttgttgtagcttctgactcgcagcagcttgtcgaagcaatcgtgggggagcttcatccaaaggagcttcaagggattctacatgacatcctttttatctctctcagtttcgctgatattagctttcattttgtcaagagagaaaacaatcgtaaggcagatgcagctgctaaagctgctttactcgcaatcaattctgtaccggtttaacatttaatgaaaaccagaattttcgacaaaaaaaaaaatgctcttgatgctctgttttctttacttatattctaaaataaacatttctaattattacatggtaaaaatgtgactacaaaacatcgaaggtacattgaaacatatattcacttgatgtttttcttctaccttgagaggattccaactctaagtacacttcaggacttagacaatcaccacatcaacaaattgtatacaagaattactctttcattgggaaataaaaacaaagcatgatatggtgggaaaaaaaactgtatataaagactttgcggaaaaactgtattgaagaagacttgaactctgcaaaagggagagatattatcgtattgtgcataaggaaccaaccgaattgtgtttataatgctaatttattaagaccattatggtcaaatataaacagtgtcgataacttaatatgtttcaatgctcatattaataaaaacataaaaaaaaaaacaatctcaaataacaattaactgtattgagtaaacaatataatttttaattaaagaaacactagtagtcaataatactctttcttcccacgtgttgaaatatccaaatattagttgttcatatagtaatattttttataaagaaaagacctaaaccaaaatcgaaatcaaaatcgtattgaagcaaaaattctgagtttactaaaaaaaaactccggtttattaaaaattctggtttagatttttttttttttctaattttgtcatgactttgtaagattttttttttttgcttaattgctttgttcctacgagcaataacccagtacccagcagcaaccacaacctcttcttcttcttcaatatctccctcaaataacagattccattaccgctgcataaatatctcttcagtaaagaaacatcattgattcaattcccagaaacatcaacctctcacctgtttccaatttgtcggcaacaacaacaaatttctattctgggttctgtgaatttcgtagggagagaaatagagatagagagagagagagcttctgggtattttttaatg

SEQ ID NO: 18348 - DNA, 3003 bp, Unknown; identical to SEQ ID NO: 18347
  misc_feature (1)..( 3003): 2750-1469P.txt file - cDNA_ID_1816968; gDNA_ID_1621131; Annot_ID_172489

SEQ ID NO: 18349 - DNA, 602 bp, Unknown; identical to SEQ ID NO: 7242
  misc_feature (1)..( 602): 2750-1469P.txt file - cDNA_ID_1816972; gDNA_ID_1621133; Annot_ID_56518

SEQ ID NO: 18350 - DNA, 3003 bp, Unknown
  misc_feature (1)..( 3003): 2750-1469P.txt file - cDNA_ID_1816976; gDNA_ID_1621133; Annot_ID_56517
tcattgaccaaacaaagattcgtcgattgatagttacggtatggttaaaattatcaataaagatcaatctcttaatatatagtttcacatcatgcaatcaaattttctttcaccgtggactcgtgagagagaaaaaaaaagaagaagctgtggttacttatttgtacagtctaaatttttttttcatatattaaatgatccatgcgtacgttaaaatttgtcccaaaaaaaaaatgtcataatcttttttatttattaatataaataattttttatcgcgccttatcgtcggtaaatatatacgttttatttgatttttgttttaagccctaagattttcaggataatataaaccaagatgattagagccaaatgagaaaactgctctggcttaatttttttctttaaaatcactgaactaggttttggttgtgtaattcattgaaattttttcatatctgtccgaattgttatcatggttgtggatctttctttttagtatatagcctaagagtaatctattatagtaattctagttttacgcttaattagaccatctatatatattatttctagttacgtcacctaatcataaaagactctacaacagcaagctagggaaacacagtagcaaagaaagttttttcttactgattttcaaaggtttgaaacacatgtgtttgtttggactcactagtgtcttctggcgtggaatcaattatttatgtctccacctaatcagaatatgacaaatgaatactcgcaacataaacataaaaataacgctctaatgataattctttttttttattgttttatgtcggaaaaagaagagtccaccgagaaaaagagccctcaaacaaatttgaacatggcaattatggagcggcagaatttaattattagtcctatagtcgatatattattgcattacctaatgtgtacacacacaatataaggttggttaatttggtaatcaaactaaagatttagaatgaaaatttccttttaaaaaaatagccatttgttttgttttaagataagagctaagacatataactacttcctaattaactttggaaaaaagtatattgtcgcaagttgcaactcttgtgccataaaaagcaagtgttcaacacatgtttatagtgatgcctcatcaacagctcaattaaattgaaacgtaagtataatacacaatcatctacatatttttgcagacattttagcaaataaatcgtagagttgaacttatttacaactcaatgtcattagcattaaatcttttttccaaaataattcattttactttaaattcttaatttaaattgtcaatcacattatcaatcaaatttaatccaaacaaacttcccatcaatcctttaaaattagcataaacgtatttgttaacaatatttaaaacaaagtttttgtttaaataaatattattcttactaaacgttttttgtttaaataaataaatcctgtatttgaacttatttacaatttcatgctactggcattaattatttaggaatgaaaatatttaattaaagatttaaatcttctaaatccttgcttttagatttattatgtcattacctaaaaggcaaaaactattagttttttaaatattattatttatattttaaatttttttaacattactaatatttaaacttataaaaagtttaatatatcaaaaaatcttaacatcattatataatatatagagtttttaaaaatctcaaatttttttccgtcatattttgtgattcaaaatttaaaaaatgaacatatattaaccaattggcgaaaaatatgtgagttcaacgtcccattttgactaaaatatttagagaatgattcataaacatatcataaataagatcaacattaacaaaataaatggtttttttttttgcgggacgagtttggcaggacgttacttaataacaattgtaaactataaaataaaaatattttatagatagatataatatataaatttttatatatattaacttaaaaaaataaattgtcctgcggtatactgcagattaaaatgtatattaatacttacgacggacgtgtacaaaatattatatagccccaaaaatagcgctgcatataaaaaccacatctacctaagcctaccatgtagtgtagttgcatataagacaactataaattaataatgtagtttaatattttttttggattggtttctttgtttttggttaagtttttttttcttgggggtataatgattttagttaagttttgtttaagtttcctcaatgacaaaggtacaatttcggcgttacgtctagtctaaaataatctattaacaaaagaatgtacttaattagtcaatactctactcaatagtaggatatcgtttcagttttgtatgtggatttttttttaaatttttgaaaaattctattcaatttcaataaaaaatttctgaggatagtcaatgaaaaccaaaaaagccataataataataattataaagtaatatatcaaaacgctcatataatattccacatacatttactgtataatcagaaaactaaatagtatagttatcaagggtccctcttaataaaaccaatattattcaactaagatatactttatttatttggagataatttaattttcgtaagcaccatataaaaaaacaatgacgcaaattattattttgtttatgtgataaataaagaaatataaaacgagagaaaacaaaaagagtgagtgatagtgattacaaaggtaagccaaaatttgaatatttaatggataccaccagataagaagaactttgcttcaaagcggcaaagcttaagcttttttctcgcgcccgcctctctctctctctctctctctctctctctctctctctctctctcttctcctctaaccaaatttcccgatgtgaaaaaacaagtttccgatcaactcaaaccaccgtcaccacttcttctctccgacatg

SEQ ID NO: 18351 - DNA, 3003 bp, Unknown
  misc_feature (1)..( 3003): 2750-1469P.txt file - cDNA_ID_1816980; gDNA_ID_1621133; Annot_ID_56516
tcgccgacccataaaataagtttagcgtaggagttaaaccacggtgggcagaagaaagtgaaaacgttgtccccggcgagggaaacggaggcgaatttctcttggtagtattgaagacagtgagatagaaactgggccacgagagattgttgttcttcgagagagatacgattagtttcatccaaggaagaagcacacataagctgttcaacgaaatacctgtgacggattaaccaaccatcaacgaagatagtgaagctttgagagctgctagtgtttggcatgtttcttatgtttggagtactcactaagtaagtatggactgtgagtgtacgttgtgcaagaatgtttatatactactacattgggcttgaccaagaaaaatcttttaggaattaatttacgatatgtcggtctatcgacgatgtgtcggcgggcgaaatggatttttgtgacttttgtcttgtcggagtgaagtgtaatcagagcagcgtcttatcatcatttgctgttgttattcaactctggttttagaatcaagttgggttaaacaatagtataaaattttaatatggatgaaaataaaatataaattatccttggtaattattgattataacctatagaatcgacaaaaagaaagactataacctagagaatttttttttttttttaaaacaagtgttcattaaaaatctttaaaatatttagtctgttttataattaaaatgtttatatctgaaattgtatctatcactactagttccagttggaattatatatctgtcagggtcgcatctcgatattatggaatgacctaaaataacatctgaagaggaaaccgacacatgttggtaaaataagaaggcacacgtcatgtaaagaagatgacatatgtcaggaaaggaacatgtccttacaaaatagaaaccaaataaaccaacagttcataaatgctccagttatgccgcgagccatcttttcttctttactaagaaaatttctacattattttaagatttttcttttccatgtagttgtctcatacttccttcgaaaagatctttctctaacttcaaccttggggatcgagcaaccatatttcaatcaacagattctttcatcactctaataacggacaaaaaaagaaaagatgtcaaaaaaaaaaaaattggaatatgcacgttgatactataagttcatttaaatcagtcgttagagtaaaccttattgagagttcaaattcatttaaaaacctgatgagataattatataatttcttataagatttttttttcttgtaagaatttaacgaatagaatttttctctctattacttaaaattcctcctcgtcaaaaattgcaaatgcttggcagttttaccattttctcagaactaccgtatgagaaataaagtacgtattaaaaaacaatacaagctttaaagataaaagaggcaacaaatttttttgacaaaaaaattagatgaaaagaagtgacgacaaataactgagaaaacacgttttgcaaaactaaaaaaaaaaaaaaaaagagagagttggaaaatgtttggagctggtgggcattagttggctatgcaacgcacggacgcggatacttttcaactcgttgcttacgcggccacgttttcgtcacaaaccgtgtttcttttgcggccttttaagttttaatcaaacatttttgttttcatttgaatcttttttttaaggcggttatacgaataaaatcattaaaaggagaaacgggccttcatgtttaggtttttgttcttcctcatttgggttatttagcttattggttcagcccacaagagtttccttcaatggatagggccttcagttgcatgccatcatcctttcttgtttctctataagccatttttgcaatgagaatttctcaatttcttatttttgcaataaaatcattttgccttagatgatggtggaatcatccgtttttctttattttgacccggtgagtaattgaacgcaaaaaatagtccaattattcaaaaccttacaatttcatatcgccataataaacctaaacatgattcgagtgagcaactacataaaaaggggaacgaaatgttggtacaaaactgaattccaacccaatcaagtgcatactaaactattgagcaaaaacaaagataaaaatcagttcacctaccctaattaaaacatgattaggcctaaaagactataagtaaagataaaaaagatgccattttagagtacgttttggtaaattggcgccatcgtgttatacgtttaaaccgtataacctgaatcatgcagcacgtgtacggctcacattggcccaagcttgattaacaaacaataacgtcattttcgtatttcaacaattttgatcgctcaatcctttcgacctaatttccatattaagtaatttattagttaaaacaacggactcaaccaaattacatattaagagaatatttgaaaattgtctatgtagatgaacatgtatttgaaaattgcgtaagcacactctttctctctctcttttttttttttttttttccccctcttctttctttgaataaagatgacatttttttctgttccaaacacaaaactgcatattgatagtgttattgaatactcaacgtctcttcttccagcttacgtaagtggaacttactttttgccccgtgatccaacagaaaatgacgaatgctccctcaaaatcatttcgtttcaacaaaaatatgtattttatccatagagaaacaacaaaccttacactatataccctcttttaacgtgcccacttttcattatttacacaatttccccaacaaatttaaaacaatttacaaaaagcactcaactttcctaaagtagattcctttagtccaatggaattcttacaacatcttcttcttcgccacctttttctctccactttaagctttttcactctctctacgccacgacgactgtgaagcgagaaatg

SEQ ID NO: 18352 - DNA, 3000 bp, Unknown; identical to SEQ ID NO: 7228
  misc_feature (1)..( 3000): 2750-1469P.txt file - cDNA_ID_1816988; gDNA_ID_1621133; Annot_ID_56514

SEQ ID NO: 18353 - DNA, 3000 bp, Unknown; identical to SEQ ID NO: 7228
  misc_feature (1)..( 3000): 2750-1469P.txt file - cDNA_ID_1816988; gDNA_ID_1621133; Annot_ID_172571

SEQ ID NO: 18354 - DNA, 3003 bp, Unknown
  misc_feature (1)..( 3003): 2750-1469P.txt file - cDNA_ID_1816996; gDNA_ID_1621133; Annot_ID_56512
tttaggtaaatgaaaacagggccatagactttcttccaaggctcaccgtgttcaaaacgaggcatcatggtttttccagcataatgagtactgtgaaacacctgaaataaccattacggaaattaacacttctaagtattatactgaaacattcaccacatatgtcacagggacacttactgcaagagtggttgggccaacatgtgaagtcaggttttgtttgagtggtccgcctgagcggaactcattactgggcgtaatttgccaaaatcctactggtggatcgaaggatatccatccatgtactctcagatccttattctcacacgaatattggtatttatcatctacctgtcagagaagaaaaatgatttagttatctgtgaaacagtatttaccggattcattatttgaagttgtaatacatcacaaaacgagcataagttcataatatacgcattcatgtatcagtaaatgggagaataaacagctcaacaacgcatgagaaagaacaaaatgttgtaatttctaaacgatggaaaaaatatggaactcatacttcgccttgtaggcgtggatcacaaggagcagtgagcagagaagcttcctggtaatctagagtttggcatcttcctttgcatagatcatctggaaaaggcattatcctttttctgtcatctgccacagccatgtaatggaatctgtaaaaaaagaatcgcaacaggaaaatatatgagtatcaaacaactacacacttttgtgtttacgaacaattaaacccaataaatagatatctgacatattgcacaattcttttgcttggaatctatggtactcttcacatggacaggcaatcactaacatttctaactttcttctcttaaggagattagacattacataagatagagaatggggataatattacttgtcttttctgagcttgaaggcaattctagtttctccaagttcaaagccaggccaatccttaagatgttcataaatgccgtatgagtacactccagaagagccacggagcattataaacctgaaagaaagagcaactagtcaatgtctttctctacttttgtttctcgccaaaggaaatatattatgtaagatagaccttttatcgatattcaagggaatgtacttgccctcaagggatggatcccatgttcttagaaatgagatctcaacctgttcttcggtctcgactatgaccctgaaagtcactccactgatgctgcatatatgatatcaaacaatccaacgattagtacacatcatataccatccaacaattagtaccgattatataacatcatatacacaagagaaaaaaagagaaaagcattaaaagagaggattctgatgcagcagtgacagctgacaacttcagttaagcagaggaaacttgttttgagtatacatcaacttaactccaccaatatcgaaaaatcccactaacagatgttgcaatcaatagcacgatgaagacctatagaataacattcctgagctcctaatcctagtgaatgttaaggtaaatgcatagagtgcatacacatcaaatattcccttgcctccaggttcattccagtgcaggtcccagtacctatacattcatttatattatcgattaacttggcttctcacagaatttgaaggaaaaaaagacttttgttctcctctgaagaaagcagtataactaaaatcatatattaaaacatgattcataccctctgttagtctccttgttacgaacttcgagcacattgtcaataccgttatactctatcccagtgataattccacctggctttgacagtgtaacttggaggatcccattgtccatcacaacctgcaccatttccgtctatagtcaaaacacattcaataaaagacacatgaaagggcacattgtcgactgaggacgttgcattacatatcgatcatggacatgcaggtggacaccatgagaggacatcctgtgatccttcctatgactaagaccacttgtaccttgatctgtcccctctgagcctgatattagtgtaaggaaaaaaatcaacacttttgaatgtagaaaaactaaagagattaatatgagaactcctctttacgcagaatgcagcagcacgagatactcaaagtttcataagtgcttgtgtaaaacaagagttttgaaatggtcatagatataggatctgtagaacaggtcttaaaacaaactgaaaaggcgtttatttccgatagtcaagcaaaatggtttatttccgatattcaatcaattgtaactctgtgatcgtttaaagtcccttcctttctggatttatacgtagacccagtgaagggaaatcatctttcaacaaagaaacaaacccaatttgatgaaacaaggaaagaaaaacagtttacagtgtcataaaaaatgaagtaaacaacaaatttaagcttatttactaatccgggctaaaaatacaaactttgctgtcacaatttcgttgagcagcctaaaaaccattctcaagtgagagaaattcaagaggatgaagaaaccatgagaagagaagggtagacgagaaatcacagtggtggccggcgtttaaagcggtttcatgattagtaaaacgatgaaggagccgatcagccagtttcttcatcagtattcgacccaagtgatcaccaccgaagcccagagagagagagagagagagagagagagagagagagagagagagagactgcgttagcgtttgttaaagcgcttctgtgccttggtttaggcacgactgcgtttgtcaactctcaaggcattgcctttgcattcagttttaattcttatcaaccaaaccgaatgtaatttgattttagtttggttttaactccaaaaagaaatctgaaatctcttttattgaaatcaaatataaaagcaagtctcatggtgatcagctcaaacaatcttttggggtttctcttgtctgggtaagctttaaaatg

SEQ ID NO: 18355 - DNA, 3003 bp, Unknown
  misc_feature (1)..( 3003): 2750-1469P.txt file - cDNA_ID_1817011; gDNA_ID_1621133; Annot_ID_56506
ctccctgttcttgtagcgtttgtcttgtagaaccttcttgatggcaacaacctccccagtttccctacatttagcctaccaaaaggaaacataaatgtgcaggggaatggagccaaatcaatagaacgaacatcatgggtcttatgttaaattagctcacttggaaaaccatgccaaaggaaccagtaccaacaacatgttctgatatgtaactgactgtctgccaatccaaaaaaaatctatatgagaaacagttagataaactacattaccaactaacacatacaattatccataaccatccaacctgtcttgattgaccatttcgaccacggagtgtggttctaatcacatgaccaggctcagcaccagccccatcaataatatctggttcactatcctgcaacgtaacgaaaacctcagacactgtaaccaactccataacatatataagctcaggataaagaagtgaagctaaaaaacagttgaataaacatgaaaaaaagaagaagcaatgcaagacttactctctcatcatcggtctctactttgtcccttatcctcgtctcagccaaatctctggtcaaccaatcgacagaactagaagagctctttaaacctttggcagatctcgaagtgcctactccatttcccagtccagaggatgccatgatatatattcagaagataacacgtactactagtaattgatagcatcataaacccatggtgatttcttggtgtcccatcccatcaaagagccgatcttcctagtagaatttgtaggcccatttgcattaaataaggtgtgttattatatctcaagtatcttgatcattagctaaatcatgaacacatacaaaaaaaagtaaacttgtgtaagcactgatgaactttgaactagtggtgaattgatacactgtaaaacctagcccaatagagacagatcagatctactgccgactagaattgatttgaaatcgacaaggtttggtttgaaaactgaaattctatagccaaaagcagctcagaaaatcagcaaaacagttactagtacccagaagaaccctagttcaacaacaactcagaaaaaaagcacattgagagaataaagagcgaaactttggaaaagattcgcagtgatatgattaggtagaagagtaaaataaaaatgatcatcaccttgagctgtcgtgaagaagaactgaaaccaaagtcaagcatttgacgattgtcttttcttcttctttcttcaattgaagagcttcacataaatatataaaatagaatatttctcggtgaatgatcggattgagaaaaaagctaaacctttagattcttcaagcgttaattttgttttcccaacttcttcacaccttctttgtcgatttctatcgttttgaatcaaacgagaatatgagacgacagctcatcattataagcatcatatattaatctttttcttatatttatgtttctataagatttttatttatgcttagttatatattttttccttcaaaaaattaattagaccttgttaaaatttcatactatactttttaatggatgtccccaaatatcataacaactggaactcaattttcaaacctcagcctacctaatttttgtaaccggatattcaaactttttggtgtacaacttatttcaactatagtggaaaatttacaaaagaaaacaacattttgtgattactagaaatcgcttcaaatgtatgtttttgtcaacacattcgagcctccactccaaaatgcatctatatgggatttatattctaatatgtgccttttgatttttgagatacgataaaacaacaatatattcttggaattttctagtgaattaaaatactgttgtagggcaaaaaataatttcaaaaaaataaagccactttcgtatttgctggttattatatagtaaaagtcgcctttacttgtcgacagttaggtaaggcttaacacatcacacttctttttgtgtgtgtggcgatggagattttgtatcgggttttattagtgatattaaagcttaaggatgtattttttttatctgcaattggttttatcataatataagccttctaaatacgaaaagattgatcaaatacattcccgttttcacaaaagtgaagttaattatttttgctttggtgagctctctcgaaaatacacgttaggcatgcacattgctttggttactactactctctggtctccgcgtgatcttatttactaattagaataagcaaaaaagggctaaatgcaataaagtcgtaagtaggtccaaagtgtactgctcatcagcctacacaaatagggagtggtggtcttataacctaaaaaggctaaagttgctttcttttgcttaataaagtatcgtagatatattacccatttaacaatgattttagtgttgaccaaacaacaacaaaacaatgatttacgatagtactgtgtgtatgtagttggattggaagctaaatgtgttaggcttttgattgccattggcctctccggcccggtcctgagcccgtgaatgatgaggataatactgacaagtccgcattttttttattaaacaaacattcaaattttgataatgatcgtttttttatgttaaaaggctttcatgataatgaacgtacttattaacattacattatgtttgtaatgcatatttcacaatatgtataattaaatttagcaatttaaaattttctggtggcaaagttgtggataattctagctacatccctcctatttacacacgtggttcacttcttctgcctcaatcattttgttcggcaatttttcaacgccaaacgctttttgtttaaaacgccaacgcaaaaccagcgttttgtaatcttattggctaaatctcaaaagaaatgggaaaaaacaaatctccaggctattccttatttctaggccaaaactatctccacgattctaacaaacaaaaattacagaaatgtcaatg

SEQ ID NO: 18356 - DNA, 3000 bp, Unknown; identical to SEQ ID NO: 7216
  misc_feature (1)..( 3000): 2750-1469P.txt file - cDNA_ID_1817015; gDNA_ID_1621133; Annot_ID_56505

SEQ ID NO: 18357 - DNA, 3000 bp, Unknown; identical to SEQ ID NO: 7215
  misc_feature (1)..( 3000): 2750-1469P.txt file - cDNA_ID_1817019; gDNA_ID_1621133; Annot_ID_56504

SEQ ID NO: 18358 - DNA, 3000 bp, Unknown; identical to SEQ ID NO: 7215
  misc_feature (1)..( 3000): 2750-1469P.txt file - cDNA_ID_1817019; gDNA_ID_1621133; Annot_ID_172558

SEQ ID NO: 18359 - DNA, 3000 bp, Unknown; identical to SEQ ID NO: 7214
  misc_feature (1)..( 3000): 2750-1469P.txt file - cDNA_ID_1817027; gDNA_ID_1621133; Annot_ID_56502

SEQ ID NO: 18360 - DNA, 3000 bp, Unknown; identical to SEQ ID NO: 7212
  misc_feature (1)..( 3000): 2750-1469P.txt file - cDNA_ID_1817037; gDNA_ID_1621133; Annot_ID_56499

SEQ ID NO: 18361 - DNA, 3000 bp, Unknown; identical to SEQ ID NO: 7210
  misc_feature (1)..( 3000): 2750-1469P.txt file - cDNA_ID_1817041; gDNA_ID_1621133; Annot_ID_56498

SEQ ID NO: 18362 - DNA, 3003 bp, Unknown
  misc_feature (1)..( 3003): 2750-1469P.txt file - cDNA_ID_1817045; gDNA_ID_1621133; Annot_ID_56497
tttacgttcttcgtacgttttgatttgaagaggtgcttaatggcgcttgaccttctacatatactttgtatgaacggctatcttcactacgcataacatggcctgcagtttcatctcttgcttcagcgatgtgatttcttttctaaattagtttctcggtaattgatgatattgagtgacaagatacaaaatactaagaagaaattctaatgcgaaaagagcataagcaaattctgtgtgcaccctcgctctccatgccaatgcagagacttaaaaagactacaatcctctttggcattctttttaagggttcaaaacagatgcctcgagcagtaaatagtttacaggttccaactgttgcgcatgagttcctaaggaagtgacagaaaccgtacaggattgccagagaaaacaattgctgtgagcattctggagcagtagctacaacgattggaggggcaacagtcacgctttctattcctgtaaagacaatatgcaagagatttgtcggtcacactgaatttagctatccagatttcttgaacaaggagcaaaattaaaaagataagcaaatacctccatgggagcagagtcatttgtggccggatcaggaattatcaggccagcaggaacctgtccaaacttcaaagcctatatatccacaagccaaaaaaaaagaagactgtcaaaatcaatcaaaaacaacatcatcaggcacaaatttgatattcaaaagaaaaagcaagggacctgttcgagtctggcaatttcttctatcgtctgagaattgataattgcagcctggaacatcatggaaatgaaatacagaaattactatcaaccacacagcgttgacctacttattataaagacaacaaaacagtgaatatgtttggtcctatataatttccagtttcgcaccttgatagctaatatttgctccgctgttggcgccaccactttcggagtctctggattttctgcagtttctgacacttttttaacctcctcccgagaaacctttttaacttcctcttctgcttctttggatgaaaacaaagatgcagcttcagctctctcctgttaggaaccaataatgtcaggtaaaaggtcttgctataaccattgtaaaatttagatatacaacagtgggctaaaggataaagccaaactattatccgatccaaggctacaaggttataacacgaggaaattaaataaaaacaccacaccctacatcaagtctggtttatatttatgccctaaatacaaaaaactttaagataatcaggcaaccaagtcatcaagacccaaactatatatactttaagcaaacccttttagctaaatgttgttaatattagtgaaatttcttatttcagcatacagatataactgtgcacaagaatcttaaacaacgtaagacaaaaggcagaccaatttcttgctctcagatattctatttttcagatgatattaaggttagctcccggtgacttgtagcatataaaataacattaagttggcatctagggtaagcaaaaatgaacagttgataaagcatatgataaggtccttaccttggctttgattttaatgaaatccagtactcgaagtgattttagcttgtgaatcacataaaggcgataatttgcctttttggtgatattattatccaacaaactaaggtactgcagcttgggaatggaggcaaggggatcaatctcaaccaaattcacaagcctgttatttgtaagaaccaaagagtgaagcttcggtaggaattctgcagatgtacaaccatacgataaatacaacacaggtaaccaacaaagcaaacaatgtgtttgaattgacatttcttacaacacacagatagatgttacctccaaggttaggatttatccgggtgatacgattgttattgatgagtaaagttcctaaacggttgaggtatgggaagttttctagcttaactatctcgttatcagacagatcaatggtatcgaactggtcctgtaagcaaaccaagacaagttaattagagaacctcaaacctgcaaataatctacctaagccaaacacaaaatttatgggaggcctttcttagagaagactggctctcaaaagtaaagaatccacagtaagaaaaaggtactattacacgaagccacatatactcctaaagagctagaaaacagatactaactaagacaaaggagcaatagctacttcaacaatgtttctgtcaatgattttcaaaatacttgaatgccgaaacccaacaggcagacttaagaacatacaatacaaccgcatcaacaaattcttcagctaacagacaaagaggaaacgaaaatcgatagaaaaaagaaatacctcagtagcacccaagttttcgattacaggaatcttgttacctgcaacaaattaacccagaaaaacgaacgattaaccagagcaggtgcgtttagggttacaaaaccctagaaaatgtaatgggaaagagaagaagtgtacctcgtagatccaattctcgctccttgatagcattgaagaagtgaggacttttccagatcaaatcagccgtgagcttcaccattattctactagggttttactgcttcgtcgagctctgtcgctgctaagcattcagaggaaagagacaacaacagtggctagagatgacataaaaacgcagcaaaatgacctttgctattaatttatcacttaaataaacggcccattgaattggcccagtcggttaggcccataagtgtatcccgatatttatgattttggaaattaaaaagaaaaaacaaataaaaagaaaaggactagtgaacgattgaatcttttcttcttcgttggttccaaccctaatctagggttactctctctctcgcttccttctgttcttcgttcttaccgagttccacgagcattagcttcagagaccttgaattggagtgcggttggatcaaaaacagttgagcgaagatg

SEQ ID NO: 18363 - DNA, 3003 bp, Unknown; identical to SEQ ID NO: 18362
  misc_feature (1)..( 3003): 2750-1469P.txt file - cDNA_ID_1817045; gDNA_ID_1621133; Annot_ID_172549

SEQ ID NO: 18364 - DNA, 3003 bp, Unknown
  misc_feature (1)..( 3003): 2750-1469P.txt file - cDNA_ID_1817049; gDNA_ID_1621133; Annot_ID_56494
aggatttggtccagttttccctcaagaagtcaaaattatttccattcatatgcagattgcttttcacttaatgctttgtctattttttaagctttaaaggcttacagtcgaatttccttattaagtttatattctcatagtgttctaaccaaatgaatcatactcataatgtagttcacaatttcccagatatcagacatccagcaaagaatatttttccttataagagcatgcaaatacatcttctaaatgaaaatgggcagaaaaaaaagtaatttttagttagcacttcataataatataagcttactcgaggtcagtattccacacagccgggtatttcacatgcagcgagtttatcttttgttgcttattaggccaattatgttcttttaccgcaatctttaactcctccatgtctggaaaccacatgaagcaatataaaaagttagaagagggaacctctatgttggaaagagtagatgcttaaaaagacagactcttcgttttgcagaaatgaaattcaataagacatctctctcttaaaactcttagccatcattaaacatgaacatacatgaagcggcaattagaaagacactatctgttcggcaaacaagcgaaatcgctaatatagatccatttaaagaattgcatgtaaagaagaattaaatatatctcactaggatatcagttcactttatattctcctttctatttaccatttttctactaaattaaaccaaaatcgaatgaaagcatgttctcgtagaatcaatagataacaaccgacaatgaaaaaaccacagtatcaggtgtctaagatgactaaccaaaaatcgtaatggtacttacaactaacaagtccgctttttacaggaagaattttatgataacctaaatggcaggtatacataccttcatggcaattttcatccttcagtagaactcgaattctgagaatgatcaatccaacctacaaaattgaccagcaaatattgtcagagtgatagaacctatgcccataaagtatccttcaaaataaaaaagtcgacataatgaataactcacattttggtaccaattgtattgaatactaactatgtcttcaactccaaattcacaagaaaatggcacttcttcattatttgcgaggaaactctttattttgatgccattgcatgaaaagattactagggatgcagcacaatgcatatccttaagtataacatactccgaagtcattataacagcggtgcttaagtcaatctgcgaagtggaaaactggaaatcattatctttttgcaaaaaagaatcattaatatcttttggcaaccacatcgttgccaaacaaattctggcagtagttttttaagccattggttaagaaactagaaaactcgttaccttttcctcatcgttgaagcaatgttcagtcatccaatctttcagcgcatataacattgaaatcaagacacggtcagacataggagatccaagcatatctataaggaaatatagagagaaggtgtagcatgtaccttcttcatcatcttctgaatcagaagcttcactcaacgcagatcgatcactcaagctttcatcaatagctgacatcatatcaatttgctcctcctgcaaatgtgaaggggttaaaaatgcaaggtaaaacttataaagtctttagcatacattaaaaacaagatagattaacatacactggatgaagaatctgaaaagggtgagtttagctggcgttgactataagatgaagtttcagcgtaaaaactatttccgcctagctggcaagagaaactctccactctatgatccacatctgtttcttctatgtcgtcttcgctattcaaaccaaacatcaatccatggttatcgtgatctatatctgtttcctttgccaggtcttcagtttttaaacctaacatcaatccctgattaacgtgctctgcatctgtttcttctaaatggtcagtggtttccaaaccaaatgtgagaatcgttctggactccttagcttctgttaccaaagtcgaatcatcttcacattgatgatcgtcagactctacagcagtagcaggctctgcacaacttggaccttccatttcttcttcctcaacacgtttttcattgcagactggcaacaattaaccatttccataagaactcactcatatatgataaaaattatttgcttctgaacaatatagtacaaatcattatagtgcctcccataaaattgtagtatcacaacagcattagtatcattatttctcacatactgcagaaacaaagcaatgttcattcaactatatacaagagtctggaaaactaaaataaacagaagaattccaaggttagcttaacttctctccgtttacaaatatctcaaccccaaaattatttttccacaactgaaactgaagcgagaatttaaatcagcatttgaagtttagagatgaatcagagtaataacttacagctttggatgcgttggcgttgcagaaccggagaattgcaaggactagggtttgtgaatttttccaataactttccagctgcagactcagcgagctcgtcctcttctttgaaatcgaatacttcaaagtttttcttcatcgctagggaaatctgaggaaaagccccaccggaaaacggagaatccaagccggagatcggcgatcagaaatcgagggggtcgagtgagggagaaggagagagagaaacgtctaaacgaaataagtcaacaacgaatgccagcgcgtctgaaactcacgcgcggacgtaagtttactctatttataatagtacgtaaataatttaatattttcattacataattcggctatggaatgacaggtatacccttttgtaagccgcgaatttaaaaatgggagacgtgaaagccatcgtcctcttgaactttccaagagttgaagaaaatcacagaaagccttagcacagagaagagagattgaagaagtcatg

SEQ ID NO: 18365 - DNA, 3003 bp, Unknown
  misc_feature (1)..( 3003): 2750-1469P.txt file - cDNA_ID_1817056; gDNA_ID_1621133; Annot_ID_56492
cagatttggcgttgtctcaattttctctgtctccacactcccaaatgctgcctcctttaacccgttcatgcatgaagaaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaagaaggttccagatttggcgttgtctcaattttctctgactgatcgttttgacaatgatcagtaggttgaggagggatgataatatcttcaggatttttagctactgtgcgttttcctttctgagctttcttcttgaactgagccttcctggctttaagagtcttgacggtttctttaagcgggatagctgcctgtattgtcttcttctcacaaggaagtacagtaagctgagtgttgtagttggcaaggttgtttttagtgtctgactggatcgctaaaagagcagttctcccagcgctaatctcagcatcttttttagttcttgttgcagctcctgtgtactttatgcctccaatctctacagtacatgtgaattgtgtaactctcccaagagtttcgaccttctggcactgatacaatggaatcgcgtaattcatcttttgagcgtattcttgaagtaggttcttgcataatcccgtttcgtgctgcattaataagccattcaaagttagacaagagcaataacttacagaaacagcctaagaatcttccctctagaagttggcaatacacataaatccgataagacagaagacactttattaatgagtggattctttaaactcttgaatctcgatcattgtccaaccaagagcctagacaaatacagaatgccccctaacgtattctcacagctcccctttaaaccttcaactctgaaactaaccatgagcttccctttaaaccttcaacgctcaaactaagcataaggactactgctgagatggcaaagctacaattcgctgctaaacccctaggctaggttcaatagttttgcagtgaacttaacaataatcacgagcgaaataagaaagatgaggtgcttacaacaggttgtgaaacacattggcttagctcactggattttgctaattcccggagagcaacctcggcagctgattgctctgcagccttacgattgaagaatccaggcaaagaattatatctgacaccatccagtatcacagtcgattgaaataaagatttgtgtgaagggccttctttaacgatctcataaacaggcgttgggagcttgtacttctgagcatactcctgcaaccgacttttgaaaacatagcaattggaaacacctgagcaggaaaaaaacttcaaaatgaggcaaaagataaaacagaaacagtgatgatgctatccactacagcataaattgcaaataaactcaaaacgacaacagggaacagcagtgaacgagttctgaataaagctgacgactttcacaaagaaactatacttatccaaaaggggagagacagttttaaaccaagcttctatgttccctaacaaattgagtcaataaatcatcatctcaaaagagtaaacttgccaattgccagagagatctacgcttaaacccacaagggacagatacacttgtaaattctaactaatcaaaacactgcaatccaatttccaagaagaaagaagtgagtaaagaacagaagaaaggggaaaaagcatgatctggtttcaaaattaaaacccggaaaaaacaacccatgaatgttgaattagagataatgcagacatgatggtgaagaagaagaagaagaagaagaagtaattcaccagaggaaacatcagtggaggtcattttcacgagcagaatgtagctgaagagacgaataataggttagtagggcacggcgaagagcaagaaagaaacgtgctgctgctgcgaagaagcagagagagagagatgattcttcttcaccaaaaaccctctcccctcgacttcctcctctttactgatttttatttttgtttttttttcacaagggcaaacgaaagaaggtggttcttaattgttatgttacaaatgttaatattgaatttaatttcaaacctttataaattatattatattccataaatttacctttttggtcaaattttccataaatataatttacttgtgaatattatatgaaagcaaaatgtttttatctttgaaatatttaatttaattaaaaaactaattacatatagcctaatttcgtatttcatatgtagttaactaatgtatatatccacaattgattaacctttttatggctaactttattcactagtaatccctttgttatattcacacagtttttgtattcacaaataattaatttgttctccaagtaaacatcaataatgataataaccgtttaataaaaaataaaaacaatttgagcccatatttgagcccacttgagcctatgtcccttaacagaaaagaaaaatatttgagcccatatttgagcccacttgatcctatatccctttaccagaaaagaaaaatatttgagcccatacttttcgcttctgataagcgtagaataataatagtcgaatttaccaccttccttttcgttccttttttttcttctctcttccgaaacacctctgccacgcgagtactctccacgctcttcgacagtcgtgaccatcttcttctccgatcgtcttcaccggttttcttgggcattccctcgtgcgtaagtctctgtcgtttcgtttcgtctataactccctcgggttttggtgaaatttgattcctttgtcctgttctctgcagaattgttgcaataaatacgacgaagatg

SEQ ID NO: 18366 - DNA, 3000 bp, Unknown; identical to SEQ ID NO: 7204
  misc_feature (1)..( 3000): 2750-1469P.txt file - cDNA_ID_1817060; gDNA_ID_1621133; Annot_ID_56491

SEQ ID NO: 18367 - DNA, 3000 bp, Unknown; identical to SEQ ID NO: 7204
  misc_feature (1)..( 3000): 2750-1469P.txt file - cDNA_ID_1817060; gDNA_ID_1621133; Annot_ID_172542

SEQ ID NO: 18368 - DNA, 3000 bp, Unknown
  misc_feature (1)..( 3000): 2750-1469P.txt file - cDNA_ID_1817067; gDNA_ID_1621133; Annot_ID_56488
atgaagtgttatttattacaaaggtgaaagttattgaatcagtgaagaaatcatattttgttaacgactacaaagaaataagccaagtcatcgttttcaactcttacatctttagccatttatgtacatctggacccatttgtttgttctgttaacgacaaccaaaagggaaaccgacaactgaaaaatgtcgcaatattagattagggatgatgagtaagctaaggtaccttttgtcgcctaacgttaagcccaccttgtcagaaacagactctaaagcttccttccatttcttgatttgttctccactcgaagtcttagccaacctccagaagttgcgaccaaactcagccttttgatatctaacagactctgccttcactttaaagaagataggaaccactcgtagcttgcatttatcggctcttttcttgatccttgcaagctcgtccaggcaccagcttgactctgcgtatcttttggaaaatatggtgagagccatcctcgattgcttgatccttgcaaagagatgtttgaggtctttccctttttgttcgtctttgtctatgaagaagttgattccatgtcttttaaaagcgtcaacgaggtggctcacaaagctgcagcgtagctcctctccccggaaattgatgaacacttggatcttcctattactactactccttttcatgttgtttaatttcctttagttgtgagcgtgagcaatgaagagaagttggttagactttgttccactcttatacaattttgtttggacagaagacaagttttgtaatgtaatatggaacaatggttactaagatgtttagcaagagcttaatttatagtatatgatattgggatttgggagggtttaggtacattgttaatgttaggtttatcgatattactggagggaaggcgtcgttaggaactttgtcattaactttcttgagttaacatgcgtaaatgcagtggcggacccagaatttgattattccaaaaattggacagaggaggaagaaaagtcacaatcccaaacagttaatacaagatcgtagaaaagcgtttttggcgcacgtgcgcggagagagaaagcagaagcagacctcacttttctttttttcttggttttttcttgtctctggatcctcattgttgttctcaccaccacctactagctactacccacatttttccccaatgtcgaacttctatccgttttcttctttggttttaggtctttctttttggtagttgtactacaacatgtatacttttaatttgcagcaaacatgaaacttctcctttgtcagcactcagccttacggaacaacatgtacccctaaacaaaactctacatgacctaggggatttgaaacatcccaagaaatggatttttttttttttttttttttttgggctgtgattgttaatgaaaacctttttatgtatacatttgataaagtaaatactacatatattctagtagaataataccatttacctaatatactgaaatttcttgggatgtttcaaatcccctaggtcatgtagaattttgtttagggttacatgttgttccgtaaggctgagtgctgacaaaggagaagtttcatgttggctgcaaattaaaagtatacatgtgtagaacagctaacaaacagaaagcatagaaagaagggaaccctaggataaagaattaaaaaggggaacaaagatttatgctgtttcttctttatttctcattggcaaaacggcagaatcttcattaagttgcgttttattattttttccatttcttatagtagccaacttccaactacaccatttaacccggccgtttttttttgttgctaagtaataggtaaatatcctattaatgaaaattatgatttacatgaacaatagctaagatttaggatacaaacaaggaagacgatcaaggatcttgaagatagaagtaggcgcaaatgtgttgtgaattatgcagcatcttatttctttgcttccaagttgtatataaatcacggcttgagtaactagcttccttagtgtatatgtgactgcatctatcatatacagtatgtgtgtaaactgcgtttggtgtaaaatgtaattataatttatagaaaataaattaaagtagtggaacatggaaatcaccgttcagatattctaactgattcactatagacggaattcttgttttcgtccattgtttttactttttagaatttttaagtaaaataaatcatccattacatcactgaggtgacatcatcgctcaggggacatcactaactacgttcccactaaaaatataggcaaatgcaatcaagtgaatgatgatgacctttcaagagttcgtagagataaataaaataataaatatttggcatgttgaggatcaaatgaattagatgcataagaaaggtactaggtagaccaggcccggcccaatgtgttttgttgtctaaagcaaaacaaaaaaaattaagcccattaaagaatagttatattgcctcggaagggctcgaatccatcatcttcatttttttagtttacacggattggaagtaggctacaatgtccctgagggaaggtaggcccattattagtgacctgaagcccaataataatgaaaacgcaaagaaccttttaagaagaagatgacagaatctctagagaataaaaaactaaacacaaaaatagaaaatatcgaaaatgagatgagagagagaggaggagtctctcatcgtgagtagggcttttgactccctccctactttgcctacttcttcttcttcctctgtggccactctacacagtccacacctacttcaagacacctttctcatccttgagatcggcgtcagatcctccgccgcttctcctcttcactatctccggtcacaacttgtttttctctgtttttctttatctctactttatgcacaatctgactttctaagtggatttacagtgttaaagatgatg

SEQ ID NO: 18369 - DNA, 3000 bp, Unknown; identical to SEQ ID NO: 7211
  misc_feature (1)..( 3000): 2750-1469P.txt file - cDNA_ID_1817074; gDNA_ID_1621133; Annot_ID_172530

SEQ ID NO: 18370 - DNA, 2300 bp, Unknown
  misc_feature (1)..( 2300): 2750-1469P.txt file - cDNA_ID_1817082; gDNA_ID_1621134; Annot_ID_56532
ttctcaatctgaaaagtgccatcaaaatgtttcaaaaaccaaatcgagaagcaaaacaaaagaaatatatatagactcacgagctcgatgtgcccttgaggaaagtaataaactttttctccaggtttcggaagaacacacaaaggtccagcacatatgttccataatttctcatacatataagtcttggttatatcaactagtaaaacgaaacaaaatatatggttgtttcatatttaatatataaaataagttcagacaaaatatatataaaaaaaaatctttacttatgcctgataattcaggctgtgcattcatttctccattattttccatgagctcttattgcaaagatcgatattctgtgaatcataaagcaagaaaatcatcaaaatctttttttttgttaagagtacacttattgacaggataaaagataaaaagtaatttttgtaatagaaaattatatctttccatcacaaatgagaagaaattactacaaactattaaactattttaaaaatcgtatatgatttgagtgaaaaaatttaaattagggattaaaataccaggcagactatttttctctagatccggctaccaatcacagagtaattttttaatttgatgtgtagttgatgtatacaataagcatgtatttatagagaattaagaccttattaagtcaccaaaagatatacataataaagctaccatattacacgcaagaaattaatgtattttgggaaattaagaacctactaaaactccacggtcaaagaagcccaacagttgtttaatgagttttacaaaaagtaattagggttataggttattattaattttgactcgattagatggaaagtggaaacctcgtaaatattgattctattgaattaatatatatctataactatatatattctatctttgttcatgctactatctttttggcttaatctgataatttctctattgttttaattagttcttagtgtccagaatcttttgatttcgacgatgttgtttatttctctttttgttttccattgtttgtaattaagattaatttttttttagcgtgtttgcttggatgcttattactagttgtcgaataactcctcattttgggatgaatccttctctaatgttgtttaccagtgatcagaatccctcacaaaagctctctggagaattgaacgagttcttcatggatttttcgagaattttccacatgacaagaggtgaaaattaaaacatcttctacaactgcatagagaacgttgattcacatgtcgatttttcttttttctcatccttgatcttatagatttgtgagtcttcataactaaataaatccatatgtttttgccacatttaggtttagatgtcttgtaatttttgtccttttttgtttgtctcctagtttttgtttagaataagaataaagttctatatgcataggttgttcattccattaatcgaatagatcgtttgccgatattcggtcctatatagctatctcgtcttcaaagcttactcttcccgtctttggattattcactctcttcatgggagctgcaagaattgcactctattatgggattttttaattttttcggttggaaaatatattaacaattgtaaaaaaaaaaaaaaaaatcttataatgaaaaatatgttactttctacaataatattaagactttcataacttctaagcactatttatatactttcaatacctttatcaaatactaactaatatatcaaatattattaagttattatgaataatgtaatagtaaattatgttatcttacaaaatgtaatcagtcacataaaatttattgaagtgaattgatgctacaaatttatattgtacaagtttttactctacaaaatttattttatttgattttatacgattattttattgtaagtttgaaaaatagtagtgagtggtggattcaacatttagttcctttgtaacaacaacaaattaacgaatattaaaatttatcagtttggcccctttgggcgtgtaattccaaaagcccagtaagattctcggaaacttcgttagtcagaaaaaagctgacacatataatcacaaacaaaatcatttttttgactctatccaaaatctatctaccgccgatcaaaaaaccctagaatttcttccactgttatgtaagtttgatcttgttgtctccactaagaggcgaagagagaaagagggttttaggttgtgtgttctgtttcaaagggtttacttctcgttgaccccgatcgagatg

SEQ ID NO: 18371 - DNA, 3000 bp, Unknown; identical to SEQ ID NO: 7246
  misc_feature (1)..( 3000): 2750-1469P.txt file - cDNA_ID_1817086; gDNA_ID_1621134; Annot_ID_56531

SEQ ID NO: 18372 - DNA, 3000 bp, Unknown; identical to SEQ ID NO: 7246
  misc_feature (1)..( 3000): 2750-1469P.txt file - cDNA_ID_1817086; gDNA_ID_1621134; Annot_ID_172611

SEQ ID NO: 18373 - DNA, 3000 bp, Unknown; identical to SEQ ID NO: 7245
  misc_feature (1)..( 3000): 2750-1469P.txt file - cDNA_ID_1817106; gDNA_ID_1621134; Annot_ID_56526

SEQ ID NO: 18374 - DNA, 3000 bp, Unknown; identical to SEQ ID NO: 7250
  misc_feature (1)..( 3000): 2750-1469P.txt file - cDNA_ID_1817106; gDNA_ID_1621134; Annot_ID_172600

SEQ ID NO: 18375 - DNA, 3000 bp, Unknown; identical to SEQ ID NO: 7244
  misc_feature (1)..( 3000): 2750-1469P.txt file - cDNA_ID_1817125; gDNA_ID_1621134; Annot_ID_56521

SEQ ID NO: 18376 - DNA, 3000 bp, Unknown; identical to SEQ ID NO: 7243
  misc_feature (1)..( 3000): 2750-1469P.txt file - cDNA_ID_1817132; gDNA_ID_1621134; Annot_ID_56519

SEQ ID NO: 18377 - DNA, 3003 bp, Unknown
  misc_feature (1)..( 3003): 2750-1469P.txt file - cDNA_ID_1817134; gDNA_ID_1621135; Annot_ID_56557
ggacgaaccaagggctcaaatctctcttttgagaaatcaaaactctgtactgaaacgggtttatgatttgacttattgtaagctatccaataaggagttccttgtaaacacacactcgactatggttatcaatataaaccattagaggtcttatcaacagccgtcttccaagaatcagatttgaatgagtaaacttcaaccgttgaacttaaatcagattcaaactcataaaatgtaattcctatctgtttcttgaatttgaaagtaaaaaaaaaacataaaatatccaaagatagaaactgagaaatccttaaaagaaaaaccgaaaatgttccaaacaatggagccagcttctttgttcttattctcatctcgaaaagcctggaatctgaagcaagctctgaatatagcagcaatcactgagcatgggaccaagaccagtgaagtattcaaatcttttgaattcttgattctctcccccaatgtagatgctaatattcctgcttttgatcaataatgcaagcctaccatttctctcaatgaaggaactgaaatattttccatatatcgcatcttgaggtacatcaactgtcatcagcctgctccaatgctgcttcttcatcacccataagtgtaacttacatgtttcgtggcattcaagtaacaaagaaagttgatctcctctgaaaatccctaaagagatatactttaccaaattacgtgacccaatggattgaggaggaagaaacaagggctcaaatctctcttttgagaaatcgaaactctgtatcgacatgagttcattaccagatttattgtaacctagccaataaggagttcctcgcaaacaaacacttgacaatggcaatccatcgaatccaccaaagtttgtatcaacaacaaccttccaagaatcagacttgaatgcgtagacttctacccttgatgaatttttaattccacaacgaaatcttacaactttgtaatcataaaaacctgatgattggttaaaaaggtatccaagaccatacgcgtccatggaatggtcaaacccttcgctacatttaatccatctcttttgactcaacaacggattcgcaaccaaaagcatacttttagtgacgtatagcaatagaccgtcacaatgagatatattgatcgctggtgaaagagctattggaaaaggcaatttcacaccacaattttctggtttgttgaaatcgatacctacataagaagttgtggaaccgaacaaaggagaaactatgtgttcgttgttaaagactgtgaattgttgctcacggtaacgcatgtgagacaagtgcttgttgacgaatctcggctctgcgattagggcttcccactgcttgcatgtggatctcaatcgtacaagagatctcgctggaacccgtgagagtatctcctctaccaaatcagacgaaagatccattgtagccatcgtgatcagtagttttttattcttctttaaaagggagtttgatgggatcggccatacgaagatctaggagattatgatatttgttaatatcttcgtttatgaatcatgattattcatatttatctctaatttttttatttttatattatgtttattttaattagtaaaatgatttgacatttaaatatgtaaagtcttggataaatccaaaatttaacaacaagtacaatgatcctactatattatttgggaagtacattttaaatataaccttaatttttgtaagtaattacataggtatgccattagaaataaaattttaaagagtaaattaatttatctctttaaagattaaaaagtcaaatactaatttaattaatgaaatttaattaaaaacgaaatacattattaattttcaaaaataataaccaatcaaaatcaacatataagatttgatatctaaatttaattctaaaactaacttcagtatattattattttcttacagaagtacaatccaattcattattactacattatcattatcatctaaactgattctaataaaactgatggttcttattcataaatacaaaagtcaaaaggtatatatcaaattagtaaaactttacgattttaatattctaatacgagttgttaaaaagaacgtctagttccaaacactatagtttgtatactattttctaagtaaacaaaaatacagtcaaaattataactactatcatatgtcagctagctaaacttattctcatgattataatgaaacaattaaatatgatttttttttttttttttttgtcgtaacagttaaatatgaattaacaaaaaataactgtagtgttatatattactaacgtacacaaacattttttttccccattaaaaaggggtaattgcaaggccgaatggcttatgacggctacaagcccaaacacaaaagaaataatccagagcaaaaatcagaaaaggcctcaggcccaacaagctaaggtaagagcagagaataaaatgaagaaatgaaatgaccaaaatgcaaggattagttgttcaaaaaagacgactagatatagttgcccactggcactgagccactgactatagtacttttttactcttcaacgtatggacaattcctatttgaaaagtagccactgacgatagccactgactataggaatcatactatggacaatttctcactattcatgctttgtttgttcacaaaaaacgatgagttccaataaaccctattaaataacaagtagaactagttccaataaacccaaaatgcaaggacaagttgttcaaaagagacgactagatatagttacagaaaactgactataatatttttcacgtttcaaatattttttgtttcaagtattttttacttttcaacgtacacaattatgcaatcaaactattcacgctccaataaaccctataaataaccagcagaagatgagttaaaaatcacaaatcatacactttcattttcatacatgagcaatattcaagaaatg

SEQ ID NO: 18378 - DNA, 3000 bp, Unknown; identical to SEQ ID NO: 7261
  misc_feature (1)..( 3000): 2750-1469P.txt file - cDNA_ID_1817144; gDNA_ID_1621135; Annot_ID_56552

SEQ ID NO: 18379 - DNA, 3003 bp, Unknown
  misc_feature (1)..( 3003): 2750-1469P.txt file - cDNA_ID_1817148; gDNA_ID_1621135; Annot_ID_56551
aattaatggtttctgttagagttcgattgcagaaaggttgatagaaataaagattcatataaaaggcatcggaaaattatttgattaacgtttgtttcgatacgagtatactataagtttgatagaaatgtgccaattgatttaaactcattagtttcattttcatactaaaagtaaaagcattattagttaacataatttttgctttacaactttagttgatgtgacgctcttcttaaatcttaagcatgtaccaagagttgtcaatttcctcttttaacatgtttcaattttgatcttgtagttggagttggtatttctataggatacacatattggataaaataagagatacaaattgcaagttacgtgctgtgcaaaccatatccacatactaatctttgtaataaccagaatcttatgttggtagtcagtagtctatattttttctcgatctcatccatattcggtcaaagaacactcaataaatcatttacttgcatataaagatcaatgatttccctttttcaaattagatattaacagaaattattattgttatattattacaagcttaatattttggtatgcttacgtatgtattattatgtacctaatcggctaagatctttgtaagaaaattagttgagtacgtatattctttttcttcaaaatattaaatatatccatgtcaccatgtgacatcgcagacgaaatgactcgttgtttttcataattgccacgatacgactgccatatttccaacatatcttaactgttagcattggcacgaatttaatgcaatatcttcaaaatctgtaaacaaaaaaaaaaactacatactataatgtagtgttctttatctacgccaacaaacccaaaagatatctttgatttttatttttttggttggtttcccatccgtttatcttcaaatgaaactcgtaagagatttaatttaaaagtagtattgtgatagattcttgttgagatttaaagaagggttaaattgtaaattagtcactttttcaaacttaattagaaaagtagtcactttactattcataatttgcaaaatagtcatttttcactgtttgatttgtaaatttagattgtacatcacttttagtgtacaaatatatataaaaatacacagtgtacactttacatttgtacactaaaagtgatgtacaatccaagtgtacgaatcaaacagtgaaaagtgattgttttgcaaattatgaatagtaaagtgactactttcctaattaagtttgaaaaagtgactattttgccaacacaccctttcaaaaatcggggaggtttataataaaataaaatatatctaagagacataattaataactacagttgctttaagaatacataatgatacacgtacgtcgaccaaaaataagagcttttttacccacacagtcgcagaagatacttagaacgaaactaaaatattaaacgtaacaaagtgtcaaaattggaaaggttacttttaattgctctgtgattgtgtagtagtgtctggacttaatttccgggaggaagtacgttaaactcacgtgttctgctttgatttccgcgttcggcgtttcattccacaagtgttgtcaaaaaaaagacaagatgtaaatttttcaattatcattatcattattgttatcgttactaatttatgactagttttctattttctaattaatatttttgttgagaaaattttgcgacaaacaattgtcaaaagaacataattagtaaactgtgacaacgaactttttcaataataaaaaaaaaactgtgacaaccaagagtgaaatgctgtgattagaacttgtatgattgttgatcaaaaagaacttgtatgaaaactgttgcttaattagagaaaaagaactgaaatatctgttttggcaaaaaaaaaaataaaaaaaaaattgaaatatacttctctgtttctttttatttgatttttcagaaaaaaaaattgttccaaaagattgtttttttaggtttttaatgcaatacttattagttataattgataaattataaaattcaatacaaattattgaatattattggtttatagttattgaaaattgtaaaccagaaagaataatatatttaaaagtaatatttaatatgatttcttaatatttctgtttttcctaaaagatcaaacaaaaaataacaaaggaagtatatcatttgttgtgtgaatacttaacaagacctatatttaaggaaaagagaagtttgtgtaaaaaatttataaatatgtaatatctttatacgttatatatatatatatatagatatgtatgtatttataactagttttatagttgcattaaagtatatgctacaccatacgtttttaattaagtttatgatttaaggataaatgattaatttgtgtatttgttgaagttcgtggatatcaagccggtggtcctgataaataaggttatgaatttataatcgcactttgcaaattatcgggtacaatctgctaaatgattcaatccggcacatcccatcacaaggcttatctggagtaacttgtttccatgtacgtactagctagtcatatcggtaggactcatatgactctatatatatattgatccaactattcaattttagttactttttagcctaaagagtaagatacgattaggatcggttcaccacatgccaaacatgcaaacgcctattttgtgtaaacattttatataattttcacgaaacggatgttatgattaaaaaaagaaacaaggcttattttcctctttttcagctttgttttttcttcaataatttaaaaaatagcagacacggcaaaatcgcctttatattacacctactctctgagccaagtcgcagaaagatacagacttaaacgaagatagagatagagagagagacgaagttttgtttttattttttcataaatatttgttttctttttggatatttaaaaaaaaaatg

SEQ ID NO: 18380 - DNA, 3003 bp, Unknown; identical to SEQ ID NO: 18379
  misc_feature (1)..( 3003): 2750-1469P.txt file - cDNA_ID_1817148; gDNA_ID_1621135; Annot_ID_172641

SEQ ID NO: 18381 - DNA, 3003 bp, Unknown
  misc_feature (1)..( 3003): 2750-1469P.txt file - cDNA_ID_1817171; gDNA_ID_1621135; Annot_ID_56542
ggcgtcggtgacgtaatcaacggagagtccgtattttcggatcatgtttccgtagccaccaccgctaatgtgacctccggctccaaccgtgggacaaactccggcggggaatccatgacttttggttttttcccaaatcctgtagtaaacttcaccgagtgttgcaccggcaccgacccatgcagactctgtggcggggtcgacggtgatgttacggagatttgacatgtcgaggacgaagaaaggaacgtgagagatgtaggaaacaccttcgtagtcatgaccaccgcttcgagttttcagttggatgtttagcgatttcgtgcagatgacggcagcttggacgtgactctcggaacgcgccgcgattacgatcgcgggtttcggagtcgctgtggtgttgaaacgcgcgttacggatgtaagcgcgtaagacgggggtgaaagcggcagcggtttttggtaaaacgacgtcggctaatgagttaggaggagcttttgtttggtttgtgaaacattggagaaagttttggtagattgtttcaggcggaggttcgacggcaagagaagtagagatgaaggaggagattaagaagagaattaaacaaaagatcttcatttttttttttttgattggattctatttggtgttttctgtagtataaatagttacatgtagtctttaaatttctgttgtgattcttatcgttggccatttttaggatttgttgtattggtcaaggtttctcctgttttttttttttttaatggtttaattgctcaagattttaatatagtcaagttaactatagaaagatcacaagtttcagaagtcaagttaactttagagattttaatatagtcaagttaactatagaaagaacacaatttgtttgaaggcattgtgagaaagataaatttttagaggtattggattaggttgttttgggaagagaataacatgtctttcaacctttatcttccttttttttgagggatcagttatttttgttttcatattagaacttgagatattaatgttctataaaacggtgaataaaagaccaaaaatgttttatactacaaaacaaaattatttttgattcaatctagagaatgaaaaaaaagagttacgaccatgacaagttatttgttattcaaaataaattttgttgaaaataatttaatgttcagaatatttgttctaaaatacatttagaataacaaatcttgaagcgattttacacttcgttctaatgacattaacaaactgaaaagatatacaaatataacgtttagcaatctttttacaaaaacataaggttatacttttcagctaataagagtagaagttattgtaatgatttgagaacaacatgtattttcgtgatgctactaaattaatatgttttgagagtttatgaattttgagagtagtgttgttatatgggatctgaagcatccaacatagcgaaacatcattcgttccatttttttcggtggcattctttcgaatttgcgtcgagtgtcacttttctatctacataaaccaaaattctaggcactgaatgtcaaaaaaaaaaaaaaaaaaatctaggcactataataaatgcaaggaggatgtatagctgatatatgatcttacaaacaaaaacacttcgaacaaaggcgagaacaagtaattaagcaatgtcaagagcttgtggcgcaaacgtaatgtttttttaataatggcatgttattttttgttcttgacgaattccttaaattgacatgaggataacatgcacataaacaaattgtccttctttgaatcattctgaaacttctcccttacacttttctttgaatgtaaagagtgattcttacatgaaaacaaagagtaataataatactttacaactatatcaaatcaaagatttgaataagcattttataaatattggataaacataggagagttttatcaacatccctaattccaatcatacatcttccgcatacggtgtatcaaagtactgtgatagatcccatcttcttgagcaacataattatacgagccaccatgaggcattctcttgtcttgaacatatgcgtcaaacttcttttgtaccttgtaatcagctcctttatacattgtacaccagaaaagtgtttctcccataacgtcatcgtggaaactaaaaccccaatcttctccaggtttcatatatctttcacgaacatcattgtccccagatttacaacgtaccttgagccatttgttgtgagaaagactgttcctgaataacaacgacgtcttttttcctttaaatggattcgaatggccatatgcattgctaatcatgcatagggcaaagacaactagaaagattgaagtatttttcattttttctttctagatgcttagaggttttgtcatcggagtaattttttatttacggtattgtatatatagacatatatgtatgctatttttgaatttacgttcttattatatattgctctcttattattagtattttctattaatgatttgcggtatcaaatcgtttcaaacacaacaatagatatggatggttgagtggagaacaatatatggatttagatctttgagtaaatatttccaaagaacatttgttttcaacacggacagtaatttgacgtgatacatttaccaaatactacctattatattctgccaattcgttacaaacagataaataattcgattagtatatacatatctatcgtttaattgtgataactttattattatattaacactaaagttgattaaaatcgtcttgatttcgattagatgttttattttataacattaaacacacatatttaaaagatgagaaattaaattgtatgtatatggaattttaacattaaaaaaaaaatccaaatgaccaatccggtttatgtcggtccggtttgtattaaccaatcttaatttcaatttttaccatataaacctaaccagactattacaatg

SEQ ID NO: 18382 - DNA, 3003 bp, Unknown
  misc_feature (1)..( 3003): 2750-1469P.txt file - cDNA_ID_1817171; gDNA_ID_1621135; Annot_ID_172628
ttaggaggagcttttgtttggtttgtgaaacattggagaaagttttggtagattgtttcaggcggaggttcgacggcaagagaagtagagatgaaggaggagattaagaagagaattaaacaaaagatcttcatttttttttttttgattggattctatttggtgttttctgtagtataaatagttacatgtagtctttaaatttctgttgtgattcttatcgttggccatttttaggatttgttgtattggtcaaggtttctcctgttttttttttttttaatggtttaattgctcaagattttaatatagtcaagttaactatagaaagatcacaagtttcagaagtcaagttaactttagagattttaatatagtcaagttaactatagaaagaacacaatttgtttgaaggcattgtgagaaagataaatttttagaggtattggattaggttgttttgggaagagaataacatgtctttcaacctttatcttccttttttttgagggatcagttatttttgttttcatattagaacttgagatattaatgttctataaaacggtgaataaaagaccaaaaatgttttatactacaaaacaaaattatttttgattcaatctagagaatgaaaaaaaagagttacgaccatgacaagttatttgttattcaaaataaattttgttgaaaataatttaatgttcagaatatttgttctaaaatacatttagaataacaaatcttgaagcgattttacacttcgttctaatgacattaacaaactgaaaagatatacaaatataacgtttagcaatctttttacaaaaacataaggttatacttttcagctaataagagtagaagttattgtaatgatttgagaacaacatgtattttcgtgatgctactaaattaatatgttttgagagtttatgaattttgagagtagtgttgttatatgggatctgaagcatccaacatagcgaaacatcattcgttccatttttttcggtggcattctttcgaatttgcgtcgagtgtcacttttctatctacataaaccaaaattctaggcactgaatgtcaaaaaaaaaaaaaaaaaaatctaggcactataataaatgcaaggaggatgtatagctgatatatgatcttacaaacaaaaacacttcgaacaaaggcgagaacaagtaattaagcaatgtcaagagcttgtggcgcaaacgtaatgtttttttaataatggcatgttattttttgttcttgacgaattccttaaattgacatgaggataacatgcacataaacaaattgtccttctttgaatcattctgaaacttctcccttacacttttctttgaatgtaaagagtgattcttacatgaaaacaaagagtaataataatactttacaactatatcaaatcaaagatttgaataagcattttataaatattggataaacataggagagttttatcaacatccctaattccaatcatacatcttccgcatacggtgtatcaaagtactgtgatagatcccatcttcttgagcaacataattatacgagccaccatgaggcattctcttgtcttgaacatatgcgtcaaacttcttttgtaccttgtaatcagctcctttatacattgtacaccagaaaagtgtttctcccataacgtcatcgtggaaactaaaaccccaatcttctccaggtttcatatatctttcacgaacatcattgtccccagatttacaacgtaccttgagccatttgttgtgagaaagactgttcctgaataacaacgacgtcttttttcctttaaatggattcgaatggccatatgcattgctaatcatgcatagggcaaagacaactagaaagattgaagtatttttcattttttctttctagatgcttagaggttttgtcatcggagtaattttttatttacggtattgtatatatagacatatatgtatgctatttttgaatttacgttcttattatatattgctctcttattattagtattttctattaatgatttgcggtatcaaatcgtttcaaacacaacaatagatatggatggttgagtggagaacaatatatggatttagatctttgagtaaatatttccaaagaacatttgttttcaacacggacagtaatttgacgtgatacatttaccaaatactacctattatattctgccaattcgttacaaacagataaataattcgattagtatatacatatctatcgtttaattgtgataactttattattatattaacactaaagttgattaaaatcgtcttgatttcgattagatgttttattttataacattaaacacacatatttaaaagatgagaaattaaattgtatgtatatggaattttaacattaaaaaaaaaatccaaatgaccaatccggtttatgtcggtccggtttgtattaaccaatcttaatttcaatttttaccatataaacctaaccagactattacaatgaagaagaagaagaaagaaagtgacacaaatcggactctccgttcatcgccggtaagtttctcctctttatctccggcggttttgggctgatttttttagattctgtctaaaactgctctaatgattcaattccttcacgagtttacggattctatgccgtgaatttgaaccctaggtttgcgaaagcaatcgcgagttttgcaatttcgttaaatttctgtctcaaagatgtaatctttttgatcatttagcttccattgctaccgtagcatcttattctttccctgaggttttgagttctctcattctatgtgtagcgttaacgagaacgaattaagattttttgaggtttttagggtttcttatttccagatacttttgctgggatcttacttgattccttttgcagttttttcttgtttaacttgaaatctcatgattgatacttggtttgagcagttatttgaaggggagggatcaaatg

SEQ ID NO: 18383 - DNA, 3003 bp, Unknown
  misc_feature (1)..( 3003): 2750-1469P.txt file - cDNA_ID_1817179; gDNA_ID_1621135; Annot_ID_56539
taatgtcaaaggacatttactaatcttggatccaagaacacaacatagccacagacattattaatgtcaaggggcataatttagtactcaatcatttcttaatttcaacaatcaacagaacaaaagttcaagatattttaatacaagtgtaataaactataacagaaatcagcaaagactttctgtaaaaaccatgcaaggacataatcattgtaattcttcacacaaaatctaggctatcagtaagaatctatcagccacattatctctgagcgtatataccccaacaaaggatcctacagatcaaaattcagctaaacaagatccaaaatttacaaatttcgaaagtgaaatgatcgtcagaacacaagaaccaatcagcatttccataaaccaacatgttcgatgaaatcgagaagggaaaggagatgactcactaggaagcatacttaagtctctgtgaaaagaaagagattgagtctcctgagtcaaacccaattcatcagaggactttttgagctcgcggctaaaaggaatctcgccttcaatggcagtgacagctctctgagaagctgaagaagagcactcccagagacagaaacgacggcgtttatcagcgtcgaattcagcgagacccatgagaggagaacgatgatgagtcgtttggggacaaacccaaatgggaaaacacctcagagccatagcaaagcagggagattttttcagaggactgaaatcgagcaatgtgaaggtgagattttggaggaattaggtcaacaaaagtctcaatggggaaatggggttggtgagaaagaatggagagtcatagagataacgtcaagtcacaacaaaaagtctggatttctggaaggtctttcaaagaagagcaaaactcagaatactcttactcagacggaaaggtccacactttgcaagacgttacttacatttcatacacacatatatcatttttttattaattaatttcaccgacaaaaaggtctgttgtttgttttttttctgtcaacaataaatagttttgatgacgcgtggatatttatttgggtgaattagctgtgtagccatatttcgacaaaaaattaagattataaccatataatttacgtaattcagcaagtaaccaaaaactctaactaattacaagtctattcctgtattatttccctattttccaatttgccatgactcatcatcttcttcgttttgttgatcagatattgatctaaaggtaatattccatatgttctaaaggtaatggattgtgaatcagatattgatctaaaggtaatgtttttttaacaaacctttttcattcatcatcttcttcgttgcttcttctcttctctccaatccaacagaaaatttccagaaaatttaactttttttatatcaattcattctaatttaaaacatctattgatttaagaaaactaaaccctaagatactatatatagaacccaaacaaaaataattaaactaaataaaatcatctcaagtttcagtttttagaaatctgacaaaatcatgtttatatacttttaatctcttttctcctttccttaagcgaattgaaatcgattcgattttgggtttaaatttgtgttaggaattttcaattttagatattgatcaaaccagaaaatattcaataagatcttgtgagtctttgttttcatttttcttcgttctaactagcaaatagaatggtacaaaattgaaagtaaaatagaaaactatagttcggttctgttttaattaagttaaagtagaaaaaaaaagatgagaggcgagagagatgaaacaagcaatggaagagaggaagaagtgattaaggtggtggtggtgtgtatggtgtgtatggtgtaggtcgtagtaatatttgtgttggtggttgcagtggtcgtgtgtcaattgcggccgcaataatggtgatggtggtagagatgacagcgtaatggttgtttctatggtggtgacgattgcagtggtgatggtgatgatggtatgacatttgtggaaataatggtggatgcgatgatgacgacggttgcaagggtaatggttgtaatagcatagaagagatggtgattgtgtagataagggtactttagtatatattatagtttatatacaaaatatcatctctgttttttttgttggttagtttcttaattatagttattttgttaatcaattttgcaaatttccctatttattttgttgtaaagtaaatggagtcctttcacaattgtttcaaaggatttgggccaaaagagttcctaaattttttaaaaccttcttgagaaaagttttgtggtaaatttggaaatttgttatagactatggtatatgtaattaatttcttgataaatggtgaatgaaaaaggttcaaaataattatctccaatattgttatcatctctatttatgaaaaaaaatattttgatgtccacatttgctatacatgaattggccaccaagatcaagggtaggtctaaagctgaccattaatcaagtgtaggtcttagataatgtaagcaatgaatttctcttacatatatgatatatttttacaaaaattagcaaattatttagatgactaagtttcacaaattaacaccattgatttaatagcttatgagagtgtttttgcatccttagaattaattaataccattgacatttaattttatcagtttttagatgaaagtgttacaccttagatttttcttttatttttttgtaaactttccaactctgattatgtccaatggccaaaaactagaaatgcagggttcaaatgttcaatttttcaaaataaattattggtctatttatacacaaaaaggtattataggtctaaaaaagaatttaggaaagactagtgatttttattgcaaataaaagaaaataaaaaaataaactcgggttggttgctcccccagccggagaataatcgtcgactggtgaagaagaagatg

SEQ ID NO: 18384 - DNA, 3003 bp, Unknown; identical to SEQ ID NO: 18383
  misc_feature (1)..( 3003): 2750-1469P.txt file - cDNA_ID_1817179; gDNA_ID_1621135; Annot_ID_172624

SEQ ID NO: 18385 - DNA, 2264 bp, Unknown; identical to SEQ ID NO: 7284
  misc_feature (1)..( 2264): 2750-1469P.txt file - cDNA_ID_1817193; gDNA_ID_1621137; Annot_ID_56577

SEQ ID NO: 18386 - DNA, 2264 bp, Unknown; identical to SEQ ID NO: 7284
  misc_feature (1)..( 2264): 2750-1469P.txt file - cDNA_ID_1817193; gDNA_ID_1621137; Annot_ID_172724

SEQ ID NO: 18387 - DNA, 3000 bp, Unknown; identical to SEQ ID NO: 5900
  misc_feature (1)..( 3000): 2750-1469P.txt file - cDNA_ID_1817193; gDNA_ID_1620824; Annot_ID_169620

SEQ ID NO: 18388 - DNA, 3003 bp, Unknown
  misc_feature (1)..( 3003): 2750-1469P.txt file - cDNA_ID_1817197; gDNA_ID_1621137; Annot_ID_56576
taatttttttttttttttttttaattatattcctgtataattatattttgattgtttattttaggatttcacccatgttatacatcttgtattaatatcgaccaacccgtgctaccatataatatgtcccgtcaaattgaacaccatattttttttttttttttttttgaagattagctgaagatataacatattaatttggttttttttttgaagattagctgaagatataacatattaatttgtcttatttaaatatagatatatatctatgtattatttagtgtatgattagtattgtttaggtttcaatatttaaaatttagatacgaaacatacagttcattaagtaacgatgtagcagattttaaaaattgattttttttggttttaggattttagtatgaaaatattaaaagtatataggaaatggtatgtacgtgaaataaagaattatttgttttttttttgttccatatatactaaatattattaaaaatctgtataatatcttgtatttaaaatttaaaatctaaataattagtgcattattctagctgagattgatccgcaatatacgacgggctgtttcttaaaaatttttgttatttataaacttatgattttgttgtatataaaattaaccaatttattgtgtatgatttttaattcgatgtaactcttatatttaaagtatagtattatttagctttattatggctgaatatttatatgaatatgtttttgacctgatccatcaaaatcaagaggttttaacccccatggcaaatatttagtttttgtactttagattttaaaaataaaatttaatatatgattattatttttagatcaaagtaaatatagtaattttaggttctattttatagtcaaagttctaaaccattcacgtttgtttaactattattttatttttttcaacgaaaaaactttattgaataaagattattaggtccgatcataatacaacatatcataaatctaaatcaaaggactcaaacaatccgagaaaaacatagaatctatctaacctttttctgccaacaaatgagctaactgattacacgatattttagtaaaagagaaaaagatatttctaaacttggttgcccaaaagtgaatatttttgcgtaaggcttcggtaatgaagtccaccgtaagaaccttgatgatgttgatgagcgcttcagagtctctatttttgataaattgatgtatagcagtcagaccacacttgatgcattgacattagtagagctttagcttcagcttccggtggggtacgtacggctccccatctttttgcttcaccttgacatgtatatttaattttttacttacataaacttctttacaaaataaaaaaaaacagaaccgcaaatacaacaaaattaaacacacgtatatatacacacaaacgttcatatatgaatatctaaatagtttggaacaataatacacaggtcgttaccaaaaagaaaaaagaaatacacaattctcaagtattgtgttctttaatacagaaatcaacatcaatacattgacatcacattcataaagaagggtaatacgtacaaaaaaataaaaaaaaaataaaaagaatgcccatgatgtgtgtgtttgataatgtgatgggagataaacatatgtagtatatataggcttggaatgattaggtcaatattttggtgagcaagcaaaattaatttgcgatcttaactaaaatggaatcaaatatacgtaattagaatattttaggtatatgctataaatgcgatttgtcataataattaaaattttctataaaatcttatgtataaatattttgtagtgtatagcaattagttatgtcgagatattttagaaagatttttccgagaatattggcaaagatttgggaaataatttgatgtggtaagattatgatattgtgaggcactaatattccttaaaatcaagtatatgcttattttaaataaatagaaatgtagatatgagtagttgataaaaaatcaaattgttgatattctcatatatttcgaaatgaatgtatattattgataatagtggaaagttttaatggcaattgtttagcgttaatcgttttgtattatacatttttggatttactaatcaaaccggaattattgttgtaattgataacaaaagaataaattttggtaagatttcattagcatttaaaactataatgatttccgaatctaagtaattatagatatggttagttaggatttagtatcaaatttagtaattaggaattaatgatttgcgaattacgtagagtttatagggattgatttgtgcaatttattagggtaataattaacaatatctatgtttaggcaagtagttagtgcaatatcataatagttaaacaaaagtttggtcattgtcctaaataaaatatcttgtttgattgattttatagggactaaacatacaatatcaaaattgaaaaagaatttttctacacaaatcgttccaaaaatgtatatgtagattcttaatataaacaacaattattcacttggccctaattaaaccatcagcccattaagcctcttattaccaaaacccttcaaacccaacttctttccttcttgttgactttccttcttactctgtcgttgactctctttgcgacttcttcttctcttttcttcatcttcttctccctgattcctttttcttttgttgcaggactaaaatcccaacacctccctcctgagttctttgattaaatccccaatttcaattttagggttttgattcccattgtttcttttgatttatcttcattccggaaattgctccggtgaaacagcagccaccgccacatctttctccttctccggcaagcaacttcattccggattttcgtctgagacttcattcttgtctccctcttcgaccaaactgacacttattccgacaaaaccctctgattagaccgtcggaatg

SEQ ID NO: 18389 - DNA, 3003 bp, Unknown; identical to SEQ ID NO: 18388
  misc_feature (1)..( 3003): 2750-1469P.txt file - cDNA_ID_1817197; gDNA_ID_1621137; Annot_ID_172723

SEQ ID NO: 18390 - DNA, 3003 bp, Unknown
  misc_feature (1)..( 3003): 2750-1469P.txt file - cDNA_ID_1817208; gDNA_ID_1621137; Annot_ID_56573
ggaatttaatatccttgtacgacttcgtcttgcagggttaatctctcaagcagcaaagctaggtgcacaaggtgtgccctcattccggtcattttcttttgaagagttaaaggaagccacagacgatttcgattcatcacgtttcttagctttggaattatgcaggaaaatggctaaaacagagggcgatgtgtacaactttggattcatacttctggaatctctgataggaccagtacctactacaaaaaggagaggcctatcttctcaacgaaatggtatcatatagggtaaagaaaagaagcaaatcttcatcattgttaatagctgttgctgcaatgttgtatttgcagacgtcatttgggagccaagactgtcgacagaaaataggaagtccaacggtcctaacaacaagctcgcaggagtctttacccaattgccatctcaatcgccaataaatgtgttttgcttgaaccttctgcaagacttcctttaaagatgttctctggaacttaccatatgcagctcaaatgcagtctgccgcagacgctgaacgcaaatctgataagtcgtcgtgaatccaaaggctaacctgatgattgatagttgttttcggatttataaatgttatgttttataagtttggtttttcagtagaaaaatgtaatactctagcggctaaaaaacatagtttcttgtctctcttgaaactttattcgtttaacaaatattgattgaagaagatgttgagttttgtagttggcgagaacttctcaatcttcaagaacaaggtactgaggcaggagacttgtcaaatgttcttggagaattttgtctttgaattgcagaatcgatcccaaatattttattattataaaagctacaagaatacagtttctaatacatgtattagcaaaaaagtaacagtaaaaccaagggctacacacttttcttaaacaggaactttggagtccactgatttgagaacctcctcacccatttccttgcatcccaccagtttctgcattttcaaaacacaaaaagacttctttaagtatattgtcattaacttatacaaaacaaaagacagaaatcatcatacacatacatttccgggggagtagatgtctccggttctgaaacctttgttcagagcatccacgaccgcgtcttcaatcatctttgcagccttttcttctccaagtccatacttgagaagcatcgccgcactgagaatggtggccaatgggtttgccttgtcttgtccagctatatctggtgctgaaccatgtataggttcaaagagtccaggtccctagttttcatcacaagtttaacaatcaatatatgataataataaacagaggaaccttgaaatattagatttagtcttacttaccgattcaccaagacttgcagatggaagcatcccaatgctaccagtgatcattgaagcttcatcagacaatatatcaccaaaaatgttattggtgacgattgtgtcaaactgcaataatgtttttaaaaatgccgtgagtactacaagttccacttctgtgttagcttaatcaacggctaagctttatatatgcgcgaagatcacctgtttcgggtcacggacaagctgcatcgcagcattatcgacatacatatgtgatagttcaacatctggatattcagaggctaaagctgttactcttttcctccacaatattgatgcctatacgaaacaaaacaaaaaaataattgtataacgaaaaacacacaagagtggagtggaaaaacaattcaaaacatacatccaagacattggctttgtcaacagaacacagcttgccacgccttttcctagcagtctcgaatgcaacacgagcaattctgtcaatctgaagaagataaagcaatgcattaatacacatacattgtcacagagcagcagattgtgaagagtaagtagtacctcgtgagcagcgtagatctctgtattaaaaccgacttcttcgccattttcgttgatcgtaatgcctcttggctctccaaagtaaatacctccagtgagctcccttacaatcatcatatcaacaccttgtgctacttctttcttcagtgtggaagcatcaactagctgaacaagcaaaaacagaaaaatttgagtatatttacaactagaaagcaaagtgataagcaaatcaatacctgtggtaaaactgtagcaggtctcaaattagcaaagacattgagatctcttcgaatgttaagcagacccatctcaggtctcagatgtttctcattcttgtcccatttgtacctgaacaaaaaatcatcataaagagaataaatttgctgaagaaacaacacacacacgcattacacataccctccgatagctccaagaagaatggcatcagactgtttagcagcagtggaagtttcctccggcaatggaactccgaccaaatccaaagctgctccgccgaaaggcatctcctggaaatcaaactctagtccttggagaaatccagctttctgaagcacattcttagcaacagatataacttctggaccgataccatcgccgggaagcagagtgatgttataccgttttttcaccggtgaagcggcggcgcacctaattcgatacggcgcacgaaacttatgatcggtgagagaactgtatcttcccggtatgatctccagacggatgttagtttgcaaaaacgccgccatctttttttcgagtttagggcaccaccatcggcaaaaactaaccatttgagtatactacagagaccggttatctctggttatttgttaacctgattttggttcaatgttctcattaatttcaattttaagttctatcagctttttggactctctcatgtccaccatccgttcacttggccgcgttcatataaaccaaaaaccgaacaacaacaaaaattcgaaaattctccggcgacaccaacaatgggaaggtctctaatattctctggaaacatg

SEQ ID NO: 18391 - DNA, 3000 bp, Unknown; identical to SEQ ID NO: 7281
  misc_feature (1)..( 3000): 2750-1469P.txt file - cDNA_ID_1817235; gDNA_ID_1621137; Annot_ID_56563

SEQ ID NO: 18392 - DNA, 3003 bp, Unknown
  misc_feature (1)..( 3003): 2750-1469P.txt file - cDNA_ID_1817265; gDNA_ID_1621138; Annot_ID_56590
caagcgtttgttactcacttcaagctccttagctttgttctcatgatgcaacttaatagcctcataagcttcctcagcatgcttaatcctctcctgaagactctcataatctttcaacagagtctcatgattctccttcagaatttcatgctccaaagtcatcgttttctctaaaccaaacatcatcttcttctctgatttgtcctaaacccaaacctgaaacaacatcaaccaatttctacagattattaccaaactcataagcttaatcaaaaattctgcaaaaaccctaaatatccaagctttatgttctctttatgactgaaatgcaacgaagatgagaattaaaccagatttatgagctcagattgtggaaatcgaaatgggtttcggaggattcagagagaaaatggtgagtaacagggaagagagagtgtggttaaaactcagattctttcaagcattcaacaatgtaaacagaatcagatagaaagaaatggaattttctcgagaaaatcttaccaggattgcgaacttgaagaacctaaagagagaagaagacgaagaagcaaagtcctcctaaacgttggttaatgataacgtaatcgaagatgacagataatgtttgtatgtatttaagtaatattattcaaattaattaattgtttattccatgtgaccaaaaaaataattaataaattgttcattcttaagctaatttaacccaaacctttttttaatttaatccaaaccttgtaactgatgcgatgttttttttactagaactttaattttctgtttttaccgttttatatatggcattcagtaggtctgggtacgaaacggatatccggaaaaattgtgatatttgttattcgattcgttttaaacgaatacttgattttgtgatttgctttgctttgcttcgaaaatttccggatatccggaatttcgaatatccagaattttttgtgatatttgcggatatccgctttgatatatttaaatattaaaaaaaatctatatactatataactatatcagatattcaaagtttttatttaacatgctttcaaaataaaaactaaatacttgttggtaccaccagtctacaaaatgttatcaaactaattccgaaaactaaaacccgatagtttttgatgtcgttgatcaaaacataacatgagaaaaatgatcaaacaaacattttaacataaaaacgtaaaatagcaacaatacacaaactattatgatatatatatagatataactatattttctaatatatatataaaaagatacggatcgaagcggatattcggttttttttttttaaaatttgttatttgattcggtttttacgaatactacattttcctatttgctttggtccaaaatcttacggatattcggatttttcgaatcaaaccaaatcatataccgaatcaaagcggatcgaacgaatattttgcccagccctaacattcaggttaacaacagaaattaaaggtattctaacattgtaacattaatgtatgttttcgtataaaaatgaaagtttaaatatcaaattgaagtttaggttaaatcaactgtggtataatacgtgtataaatgcagcatagttcaaactaaagatatgaaaaaaccaattttccgttttttacataacatttgtgcaaattcctatactattaaaagagaaatataaatttgtttcaatttgaattggatcgggttatgttaaaaaattaacataaattgacctgaaatttaagtaattggatttttggcaaaacaaaattcggaatataatatgaaaatcaatgtttttaaacccgatctggacagtgaaccggacaacagttttttttcttctacgcatcgtttgtttgtattatttatatatatatatatatatagtgatatgataacttccctaaaattagctgaataattaaatgaaaaaaatttcagttgatttaacattgaatttttttccttgttttttttaacccatttctccacatttttttgtagtagtttagtttcgtaatttctgcagtcacaacttttagtaatgagttataaacaattacaatcaaggtttttatagtaaacacatcttttactaaaaccacgtagaataattggaaatcaaacataatttttctaaagctcctaaatttttttagtttgtccttagaaatcaaatatatttttgaatcttttttatctaattaaccgcaatatctataatctgaaagtgttaggaccgattggtaacaagtgttatttctaactatatcaattttggttgtagaaaattttggtgtaaggaatttgaccgtagaaaatatagagacttttgcagttaaaattgcagatgtgaaaattttgaaacaattggtaaaaattatgagtttagaaattaaaactttaaataatataaacgattagattagttgtgacatatgcgatacaattttttttcatctctactgaagagatcgtttttattgatattgacacaattgatgacggtttcatatcattaaaaatgataatttagagaatgttttttccgattttaaatgatgctttcaactttcaatataaaagttaaatgtatttaatattttttgaccaataatattctatagtatattttttattggttgacttagatatagttacttatgcaaaaaaaggtaaattaaactaaacttttgtaatatgtgtaaaaaaccttaaacattacttaaaatcagagagagaataattacggttgtttagaatcctcattaatcattctctgtttcatttattaactttctgtatatcattaaccccacaagcattaaattactcactaatctttttggattctattattcattggtttatcgcttaggcaataagtacggaatcaaaaacattccactttctgaccaaaaaaaaaaaatcgtatatctctcagcgcgagggaagaagaagaagatg

SEQ ID NO: 18393 - DNA, 3000 bp, Unknown; identical to SEQ ID NO: 4539
  misc_feature (1)..( 3000): 2750-1469P.txt file - cDNA_ID_1817265; gDNA_ID_1620713; Annot_ID_49052

SEQ ID NO: 18394 - DNA, 3003 bp, Unknown; identical to SEQ ID NO: 18392
  misc_feature (1)..( 3003): 2750-1469P.txt file - cDNA_ID_1817265; gDNA_ID_1621138; Annot_ID_172749

SEQ ID NO: 18395 - DNA, 3000 bp, Unknown; identical to SEQ ID NO: 4539
  misc_feature (1)..( 3000): 2750-1469P.txt file - cDNA_ID_1817265; gDNA_ID_1620713; Annot_ID_165525

SEQ ID NO: 18396 - DNA, 3000 bp, Unknown; identical to SEQ ID NO: 4539
  misc_feature (1)..( 3000): 2750-1469P.txt file - cDNA_ID_1817265; gDNA_ID_2926152; Annot_ID_139340

SEQ ID NO: 18397 - DNA, 3000 bp, Unknown; identical to SEQ ID NO: 4539
  misc_feature (1)..( 3000): 2750-1469P.txt file - cDNA_ID_1817265; gDNA_ID_2926152; Annot_ID_198129

SEQ ID NO: 18398 - DNA, 3000 bp, Unknown; identical to SEQ ID NO: 7300
  misc_feature (1)..( 3000): 2750-1469P.txt file - cDNA_ID_1817277; gDNA_ID_1621138; Annot_ID_56585

SEQ ID NO: 18399 - DNA, 3003 bp, Unknown
  misc_feature (1)..( 3003): 2750-1469P.txt file - cDNA_ID_1817277; gDNA_ID_1620713; Annot_ID_49056
gttggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaaatggcgtttgctagagcagtgagaagaccaattggagtcttttattatagtgttagtagtagatttagttctggaaatgagtattctactgtggcaagcaaattcgaaactttgtctcagtacaaaagctctgtaccgtctggttacacaagccttgttcgtggttttgggaatttcatacggagttttagttcggaagctcctcctgctgtatctgaccaaatgagtcttattaagcaacttagggaaagaactagtgctcctattaaagatgttaaggcttctttagttgaatgcaattgggatcttggtaagaatttggtttaggttttttgttttggtgaaggttgtgtatgttttgttgtgttttgaagtgggtttttttggatttgacacagaggctgctcagaaggatttgagaaagagagggaaagttttggcttcgaaaaagtcgtcacggactgctgcagaaggaatgcttgccgttgctcaaaatgaagggaaagttgctgttattgaacttaactgtgagactgattttgttgctaggaatgagattttccagtacttggttagtcccatagcaatttcacattggttgttgctgaatgatgggctttttgtttattttactgttccttgtcttctaaaattgacatgtcttgcaggctttagctatggcaaaacatgctttgctggttgagagtagttcgcagcaagtttctggtgtcttcccctttgggccggagctttttgaggtcagttttttatgtactcgcttgtttccttttttgttatttaaatttatggatttatgttgtttcctttgcactgtctgagatattgatatcaacttttcatttctaatcactctaatggatgctatcaggagttcaagcttaacctcgatcatccaaaagttaatggtgaaacaacggtttcaaacgctgttacagaagtagctgcaatcatgggagagaatgtaaaatttaggagaggtttcttgatgtcaaaatcttcagcaggcgtcctttctgcatatcttcacacaagtcctcaaccaggtacaatttgttcaatatacttcccattgtttctaatctctttttttatgatatttctgtgcatttctaactttaaaaaaaaaaatgagaatagggttgggtcgtatagctgggattgtatctctcgaagtagaaggtgaaaatactcaactagaggctattcagcgtgtaggctcagaactggctatgcatgttgtagcagcaaagcctttgtttttaagcaaagaccttgtttcttctgaagcaatggcaaatgaacgcgagattctaaagtctcaggttagtgtcactttatgttatgaaattgaactgtaatttgtaaaaagtacacaacctgcgttagaaaagtttgcttatcaaatgttgtatatgacaggcagaaagtacaggcaagaatcagatggcgatagagaagattgtggaagggcgtctccgtaagtattttgaagaagttgctctaatggagcaaaagtttattgtgaacgatgctataaacattaaggtatgtgggtcttagcttaaaacacctagtttaccgttttattacctctgcatcgcttgttgaattcaactcttgggctcctattccacagacactggtggataatttgtccaaggaggtaggttctccagtgaaggttaccgattttcttagagtcgaggttggggaaggaatcgaaaggtaaactaaccgtcacccgtatgtccagtacggcttatcattgttgtaagattagtcgcttatgaattttgttttttttgaaggcttgaagcatctgatgaaccagttgctcaaactgcttgaagacaaagaatcaacgacatggttttagatttacagaactctttccttctttggttcctttagagttcatggcttcaacgccttcttgagattatagaatctttctcatgattttgtttctcacacaatatggcaataagagtgattgtgcctaggaagctatgaccagaaaaaaaaaacatgtttgtgttctcctactcctactaagatcattatacaaaaaccttcacttatgtgtttgattttaaggtactcaagtatttgaataagcagatagtgagttcttggctcctccggttaccaacggtcgaaattgacggtttaatataattcatagacaaaaccggtcaactttatattatccacaatcaacgatcaagatcaacgagaactaatcttacggttgatatcatacatctgtattgagttacagtacaccacaaaacactcaataaacactaagcactcttcttctaccttttgattttcgaaaaacgcaaactttctgaaaaagcaaaaacttctgattctctcgagaatcatttactcttcacactgtccccgtctctctttctcttgggttaatcatg

SEQ ID NO: 18400 - DNA, 3000 bp, Unknown; identical to SEQ ID NO: 7300
  misc_feature (1)..( 3000): 2750-1469P.txt file - cDNA_ID_1817277; gDNA_ID_1621138; Annot_ID_172743

SEQ ID NO: 18401 - DNA, 3003 bp, Unknown; identical to SEQ ID NO: 18399
  misc_feature (1)..( 3003): 2750-1469P.txt file - cDNA_ID_1817277; gDNA_ID_1620713; Annot_ID_165531

SEQ ID NO: 18402 - DNA, 3003 bp, Unknown; identical to SEQ ID NO: 18399
  misc_feature (1)..( 3003): 2750-1469P.txt file - cDNA_ID_1817277; gDNA_ID_2926152; Annot_ID_139344

SEQ ID NO: 18403 - DNA, 3003 bp, Unknown; identical to SEQ ID NO: 18399
  misc_feature (1)..( 3003): 2750-1469P.txt file - cDNA_ID_1817277; gDNA_ID_2926152; Annot_ID_198134

SEQ ID NO: 18404 - DNA, 3000 bp, Unknown; identical to SEQ ID NO: 7297
  misc_feature (1)..( 3000): 2750-1469P.txt file - cDNA_ID_1817285; gDNA_ID_1621138; Annot_ID_56582

SEQ ID NO: 18405 - DNA, 3003 bp, Unknown
  misc_feature (1)..( 3003): 2750-1469P.txt file - cDNA_ID_1817285; gDNA_ID_1620713; Annot_ID_49059
acttgttatgatccatcactcactgtctaggtttacttttttactttggttctctgattcactcattgttgttaacagatccgtaagtcgttgttcggccaagttactgcctgatgaaagaaaggaaaagagaaaagagattattcaaaccggtttgcgtttggttatttacctattttgggagagatttctctttgttgtgattctttgtattttgcaaaatcttactttggtgccaaacccatcgaacgcttctttttttcgaattcctttttttcattcctcctcgaatgtgtgttatcatggctatacaaataaataaaatgaaagacttcttttctttttcttcactttttctattcaatgtctatgctttatactagtggtttttcgtcatcatagataaacacttaattcataaaaagacccttgaatttttattataaggttagcaatttatccaacacgatcctgaaaatcgtccatcctagtatttttttcgtctaaacacctttaattgcggagttttgataagtttttaacagaaaaaaactcgaataagatatttttttggtttgggctaaaattgttatagacttggcccttgggttttatcccaaatacattttaggtatcacaaacaagaaaaacatagaagtaaaaaactagaagttttttgcgcttttgatctttgtccttttttctacaagttttttctccagactaatctcctcacgattgtctgaagacaagagtctacaagaccggagattcaccgttcgacaataatttccgtacctttcaaggttagatgttcttgcgcttaatttgacttgtgttctttttgtgaattttggatgcgcgcacaaggtgtttgttcatttgcctagacaaagtaaaattgatttagttattcttctcattcatcttctatagtatttgtacttgagccaatcattattcatctttggtgcaatctgaatctgacccatttgagctgttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatgaatgacgtcgaggcacttaggcaagaaggtgctctttttatactctttaccttttttttttagtgaatttcgtcgagtgtttctgaagaatttcagcgaaaagtttgtagctttagcttccatttcgttactattttctggtatttttcccaagatatgcatagctttaatgcaaattcttggtgtatttatgtttgctggtttgattagaagttatggatgatggatgattattaaatgttgtattcttagttctcatgctgtttatttattggggtttaggcctttagcttggatttaaaagtctatctgacattttatagtgaagcaaatttgcatatgtatgaatgtgactagacatacgagtatgcgtttatcattgtctaagctattggtattttaaattcttgatgtgaaatattactatttcggctgtctttcgaattgttgattctaaaaatcgttagacgctactctgccggtgaagtagcgcttagcgcctagacggtcgaaacggggattaatcggggcctaggcgttaaagtaaactataatgaatttatattgttttataagaaattttatgaaatttattatattataagtgaagttgtgatgtgaagttatgttggtcctgtggctttctgctcaaattttattgctacagcccttggttcgatacttttcacgctaaaaaaatcgaatttcccccacttaaatgataggggcaaaattgtaatttaaaaatgttggggtcatcttcttcctcaaaaccctattcgcttgtttgatcgttttttcgcttatactcaatttttttcgtttttatccgcttgtttgatcgttttctcacgtaatcaaaccaaaataacacagatctaccactaaaatacatattcatgatcaaaaagaagataattaagtagattctcatgaacgccgatttgttcaccgattgagccaaaatcgcggcggtccacgcagaaatagcgcttttttcgacgcctagtcgaccgattagtccgatgtttagaagcgtttgttttagagaataattatgccttcatttttgtcaagtttgtttggtttggtgagtagtagttacacaatgttcttattgctttgcatatgtttatggatgtctcaagaaactttatgaaatttgcagggcattcaagcctcttttagaataggtttggttcttcctcgagtagtagcatctacagagagacagatttcctctacggttttaaaaagagcttctgaaagtgtctctttttcattcgctccgtacataaatggtaagtgtcactcacaggcgattacaatttttcttagattgttagaaaatgaattagaataacgagtaatctcacccttttgttcatgtttagggtttggttttagttcgttatcaaattggtctcgtagttatgaatctttccctactgaaacatccataaggtaaaccattcgcctagacttttctgtcatttctctcttaaatttcatcctcagagcactcactatgtgaatgtttgctggcttgggttgtgtttcttcttgaacaggtattttcatgcgagtcgagaaacattggcgaaaagaaaagaggatgctgatcgactgctgagtcatcgtgaacgcaagaaacagactgtgaaaacgaaaggaaagttctcaaaacgggagaaaaaaacagataagccacctgttgaagctccttatgtgcctcctaggctgaaaagattggcaaagggattgcctgggaagactgtcgacatatttgaagggatg

SEQ ID NO: 18406 - DNA, 3003 bp, Unknown; identical to SEQ ID NO: 18405
  misc_feature (1)..( 3003): 2750-1469P.txt file - cDNA_ID_1817285; gDNA_ID_2926152; Annot_ID_139347

SEQ ID NO: 18407 - DNA, 3000 bp, Unknown; identical to SEQ ID NO: 7296
  misc_feature (1)..( 3000): 2750-1469P.txt file - cDNA_ID_1817289; gDNA_ID_1621138; Annot_ID_56581

SEQ ID NO: 18408 - DNA, 3000 bp, Unknown; identical to SEQ ID NO: 7296
  misc_feature (1)..( 3000): 2750-1469P.txt file - cDNA_ID_1817289; gDNA_ID_1621138; Annot_ID_172736

SEQ ID NO: 18409 - DNA, 3003 bp, Unknown
  misc_feature (1)..( 3003): 2750-1469P.txt file - cDNA_ID_1817289; gDNA_ID_1620713; Annot_ID_165538
ctttttgctatttagtcatttaattagaaagtttttgatgttttacaataacttaagttcaaaattttaataaaaatcataaattttgtcttaaatctatagttttatgtatctatattattaattgggaagcattgtgtgaactataaaattgtaagggtagtttaaaattaactaaatgaatttttgcatgggtaatttagtaaattaacaactagtacaactaaataaatatcttggattttgttcttttaaaaaattaaatttaaaatcaataaatttgtaactacccaatattttcagaaatcatttaaaaacgtttccataacatatcagactattttaattcgaattgtatatatgtaaatttatttattttggtaatatgttattagataattcaaaaatttcaatctaatttaataacaaataatcatttagtttagattttaaacaatttccttaacaaaactatgttaattgtttctcattagtacacttaaaaagaagattttaaattatgatttagcatattcaaaagataatttttggattttagatttgtaaatatctagaagatattatgagtatagattaaaatatttaacattttaattagaatttaaatcatataaacttttcaagtatttttttaaacatgtaattttcattatttttaaacaagtaattttcattatttttaatgctatgcatatattcacattgcctcacaatcaatctagaatatcgattctttaaaacaatagatagagattcataagtaaattacttcatgttctaatgagtttatctcctaatattactatctatttatgcgtattcttatggatttttctttcaggctaaacactagattacaagaaactagattatagttatacaatcttaaacaataaacaaaacaaatataacttaatttaattttttatttttaactaaaatcaacaaatttattagtttataaaaaaccaaaaactattactcaaccatataaaaaccaaatactattatactttaattataagaactacatcttatggaaaggtatacactaaaaatcggttttatatactagaatatcataaatatataaatcacaaattatttttaaatatattaatctaacatgtaccacatgtcaacccctcgatttttttatatattacaataacaatatttaaaaataacaaaatagtttttcattttacggaataaagttatatggtggaactagtttgggttgatattaatacgggacaataatctacaagtgaaatcttagaattaataattataacataattatacaatcttaaacactaaacaaaataaacaatatttacaaaacaactatatcttaaaatttgagtttttagttacaaacaaatcgaccaacggtgtaccgcggagtaaattttacattatatcatctaattgatcaaaaatttcaaacaaaaataatcaatttatatatacatcaaactaacaaaaatacacaaattttccaaatatctctatattattccgcaactcgaaacaaatataacaatctatttactatgctaaatacaaataaaatataaataatataaattaattaaaaaaattagctattttatcataaataacactatacactttctatgcatattataatttgtacactataatatctttcactaaaaatgtattccaatacatttcttaaaatatgaaaccccgcacgtatgtgcgggtcagaatctagtttactataattttgaaaacaatactagattaatatgtttttaaaacattaatataatcctaaaactaatctcgtttaatctccgattttaatctccgattttaatccgatttatcgattaatagctagtcccataccgagcgcccgattaacgcctaacgcgattttttaacaataatgatatatatatatatataaatgtatatatgatttatatattctagtgaattttacttgtaaactaaatctacaatttaaaagttaattaataaagtagtttagaagaagaagaagaaattgggttgtcttccctaaagattttttctacatatgttcgtagagaactattttttctaatgacaaaaaaatatttatatttaatatttttaatataggtttcaaaatgtatcattcataaactgcaatactaaatttaactaaaatgaatgaatttttaatttcatgctcaagtctaccgaaaaagataaacaaaccacaaaaaataaaagaatattatgggggtgattggggaggaggactttgaaaactgtaaattctattaacaatttttacagttttaatttatccgatcacacttttttgcttttaataatttaaaaattctcacaaccttttttctcattttgttctttgatttcatgtttttgtttaaatcgcataaatctggctttaaaatgataataaacaaaagtcaatagtttttccttttcgttcttctccatatttatgaaaactcccatagatgaattattcctttttaatttttttttacgtttatttacaattgaagtctttttcttgttttattaagttccatattttcaataattatttaaaatcataatttatgttgtcacaacctatagtatatagttatagtttttaaaatattaaaaattttatagcaaaaatttatgcagcaaaagtctttacagccaaaagtaactttcgagatgcatgttttaatttgtcttatttacttgatgatatacaaaagtcagcctaggcgacctttaatgagatgcatgttttgttgtctacaagggtctagttgcaatataataataaaaatgaaattaccatgtcatttcctagaaaatctcatattacaactttgacacgcaaaggcattccatagattctataaattgctctcccaaaacactccaaacaagtcaatataacaaatttttatcttcaatcctctccccatg

SEQ ID NO: 18410 - DNA, 3003 bp, Unknown; identical to SEQ ID NO: 18409
  misc_feature (1)..( 3003): 2750-1469P.txt file - cDNA_ID_1817289; gDNA_ID_2926152; Annot_ID_198139

SEQ ID NO: 18411 - DNA, 3000 bp, Unknown; identical to SEQ ID NO: 7311
  misc_feature (1)..( 3000): 2750-1469P.txt file - cDNA_ID_1817301; gDNA_ID_1621139; Annot_ID_56596

SEQ ID NO: 18412 - DNA, 3000 bp, Unknown; identical to SEQ ID NO: 7311
  misc_feature (1)..( 3000): 2750-1469P.txt file - cDNA_ID_1817301; gDNA_ID_1621139; Annot_ID_172768

SEQ ID NO: 18413 - DNA, 3000 bp, Unknown; identical to SEQ ID NO: 7308
  misc_feature (1)..( 3000): 2750-1469P.txt file - cDNA_ID_1817305; gDNA_ID_1621139; Annot_ID_56595

SEQ ID NO: 18414 - DNA, 3000 bp, Unknown; identical to SEQ ID NO: 7334
  misc_feature (1)..( 3000): 2750-1469P.txt file - cDNA_ID_1817317; gDNA_ID_1621140; Annot_ID_56623

SEQ ID NO: 18415 - DNA, 3003 bp, Unknown
  misc_feature (1)..( 3003): 2750-1469P.txt file - cDNA_ID_1817329; gDNA_ID_1621140; Annot_ID_56619
ccggtgaaggagatcgaagaaatgttgagtttgaactagaaaaaaaaagagaagcagagagagcagcaatggagggctcacagatccaatttaaggcagttgtcagtaaaatttttttgtgtttgtgcagtgtgcagagactctgcatagagaagagagagagatagagagagagggagcatctctctgaaatcgtttaaaattaaatcatgaaaatagaaataaaaaaggtaattatttttactaataatgctctgagtcaacataattggtgttttctatggaccaatcctactagagcatagattatatgtatcgaatttccatatttgttttgaaacataaaaatatttaccaaattgttactgtcttttttattttttgttggtctcaataaccaaaatattcggtaccaatactcaattccatattcaaaatatgttgtgtgtttttttgttttatggattaaaataaaaggaaccaagtgttttacaagagatgtttagttgtaaagcccatataagcccaataaggatcaaataagaagttccccaatgtcgagcccagtagatgaaatgatagtccacataatgggatgaaggcgaatgagttgatccaaactctcaccaaatcgagaaccaagtttgcatgcactcaccataggagtttattttgtgttttatgtttgacgttctcgggggttttggctatatagaaaataagaagatcaaactaattaactatattaagaattgaatcgctttcaaattgattttttttaattccgtgtttgatcagtttaatttatcctaatcaaatactcataacccatatatgtgatattagaacatgaggtgatggtatactcaactgcttacacctactaactcctaattcttaaaatttgattatcaattacaattaacggttttaattataatgttaaagtccatttcaaattccagtcacaatttttattccatctaaagtaatttgatacaaatttgattttgcttcgaatatggttgttttgtcaacggttttttatatcaaatatagttttttttctcttttcaatgcaatcggttaggtggtatttgatttttccttcaaattgaattttaaaaaattcattttgttcttgatgatacagttcaatttatctgaattaaacaatcttaaccatattgaatattaaaacatgagtattgtatatttcattatgattacacctcatttacccccaaatctctttaatcaataaacttgacatgatcatgaaaaaaaatcattgtttaaaaaaaaaaactaaaacaataaacaaatatttgttttgatagttcgaatataatactgctaatacattgatgagtatttataagtaaaaaaacttgtagaatcttaaaaatatatttagatcgtcctttatcaataaaatttgtacaaaatgcgctttgtaatattttttctttacggttacatctttatattttatttttattttttgctaaagtgaaaaaaatagtgcattctttagagctttgaagaacgttggtagatcaacaatgagtcgtctggaaaacatgtcggcaagagatgcttacagcaatgtgactgatctaaaaacgatagccaacaaattcgtaaacggcgaatattaaattgaaaaaactagtgaattgagtatcacatatctgcgttaacgaatttagtaatttgttggacgaatgtagtaattcgttagatgaatgagatcaatcaagccatttaaaaaaatatatattcattcgcattgtagttttacacataccacctaacattgactataaaaaatatatatgaaaaagaaatctgttgcaagggagactaacctagcccaacaatttttaaagctctagggcaaaataaaaattcaggaccttatattcatgttaaaaaaaaaaatttatatatttgggcatatttatactaaaaattattttgtttgggtcttttgaaattttattaccttgaaaacaggtcatactttacacttaaatgctaaaacattgggctacattttcattttgttatttaaacggaccggtatgagtgagacatgcatgatgatttaagcttatctactcaataggattaggctgagactgatatgattccatttttcgagaccgtgtgaacatagttcatgataactactgtgtagtaaagtagtaacaagacttcaatctcaagttttaatgggttttgttcggtggttcaagcgtccttatcataagtttgtttttctgtcttcactacacacatcttaatattgagttaatccaattaacagtaggcatatatcatatatcatatatcagaacattatttgtgttatgattaccttttatattatcaaagtccctagttaatttggtttgtttacaaagacgattacagtatattatatatccaaacaaaatttgtaatgatgataatcagcccagtatggttcaattcaatgttattgaaatttgtttggtttttaaatcagacttggttattgagtcgggttggaaaaccaaattaaccacagcgcataaggacgaagccaaaatttaaaacagtagttgtacataacttcatttgttttttatcggaaaaatctcacacgataaagtaccagtcgacgacggcgactttctctatgatctgaccgtttcgctgaatctcacgtgaatctctgattttccgggaaaatcaattttctctcattgtctctctccctacattgtttctcatagcctacgagaaattacgtggtagcttgtcggaaactcaacttccgttgacggaaggcgcgagaaagaagcaagcttaggttcgatcggaaaattctagggttctctagtgtttaaacggtagagataatcgatctctaatcggatactgttttggatctccattcacaccctctggtgagctgattttgctttagagatcgccggcttagtttctctaatg

SEQ ID NO: 18416 - DNA, 3000 bp, Unknown; identical to SEQ ID NO: 7318
  misc_feature (1)..( 3000): 2750-1469P.txt file - cDNA_ID_1817333; gDNA_ID_1621140; Annot_ID_56618

SEQ ID NO: 18417 - DNA, 3003 bp, Unknown
  misc_feature (1)..( 3003): 2750-1469P.txt file - cDNA_ID_1817337; gDNA_ID_1621140; Annot_ID_56617
tttgcagaagattacacagtgaaggattgctgaacaaccttagaactgattgatgttctaggcttgttattttcatcttacagattggcttttcttcagctctcatcacactcacaagccatggagtatctgtttgtgctgcaactgcgtatattggatgaaaacatttcttcagtcttgaaaacatatcaaagaagttacctgctcacacattgtacatgtattgagatgattactaattgctccaaaacaggtatatactttttcattgagatagttaaaggtcaaaaatgtttaattgtggttttagtattcaacagtaaaattgagttcctctaaggtattatagtttacaaatcttctacatggaacatgactcaagtttcttctcttccagcgaccttggtgtgatggttactttgaggccgtacttcatgtacaagttagttgtgactctcggggctatgacatgatcttggacaaccttgattgagtacctcaacaaaactgaagcagctatcatcttcatctgcaggtaagcaaatgtttttcctatgcacagccttggtccagcattgaatacaacgtatttgaactggtcgtcactgacaaacttccctgcttggatccatctctctggtctgaaaatttcacaatcttttccccagattgattccatccttcccatggcatagattgagaagtaaacccgtgaaccttttcttacgaatgtcccatctggtaacacatcatcttcaatggcttgtttcatttccattggaattggagggaacagtctcagagtttctgatagtgctgcttgtaggtataccatgttgtttagttctttgactgtgaagaggctctcgtttttgctggttggagaatcccctcgctgtctcaagatttctcttatctcgcagatgattttgttttcaacctctgggtgtttctgtatcacccagcagaaccatgaaagtgcaacagaacttgtatctcgtccagctaatataaaacttgtgcaaaattgtctgaaaaatctaatggtggaaggatcaatctcattttcccttttatgactctctatctgaataatccttgagagaacatcagatctattgtctaacgtttcttcttccttgagctcgcagatacgatccacaatcatcttgtcgacgaacccgtgcacgaccccaacagctatcctgagacctttttcatatcctgtgtcgaggaacctcatgggcttccatataaatggagggatcatgaatctaaacagtgtagactctgttgcttcttcaaaagctttagcaaatggaacttggggaagatcaacagctagagtttccgggtcagcacctagacccgcaaggcagatgatgtcaaacgtcaagcgcaggaacacgtcttggagatcgaaagcttcttgtgactttgcgaaactctccatcaccttcaacagcttcttccttaccaaatgttgtgttgtctgaaaggaatgctctacaaacccggttgaatgcatttcggttatgatgatccgtcgttgctccttccaagaatcatcatcagcattaaagataccttcctcgagcagatcattgaaccggcttttaaagaaggtaccttttgggaagttcttgaagttagtcttgagcatgtactcgacatttgcaggaacacaagtcacagctccataagacccatcaagccaaactccccgataaagaaaggtacctcgacattttttcaaactccttgtgacccatccatagacatcatttatatgaaagaaaaactctaaagtaattccgaaaactggccatagcattggtccacgcttgttggttaacttctcacgcaaacagcagaaaacaaagagccccaacaaggaaagaagtagatcgaagagagaaagatgattataaagtcgctctgttaaagacattgtagtctcttctcagtaaactctctgcagttttgtttgtggtgatgtcattgtttcaagagtatttgaagaaagatttgcgatgcatttcatattttggttttggaattacatttgttgtcttcgtgtagaattggtctatatgaagaagatgagggtttcttgttggcgacgaaacgtaattaggctattacaaattgtgtgtttattgagaaaaacccgtgaaagaaaaattccagaaaaaatgcaaatttgcctgtcatgtcttatgtgaatctatctgacataagctgatgacaaactgaaactcttagaatcaattaacaaacaaaagaaagagcaatcgttgttactagcaagtagattacaaggaataaatctgaaaaaagattatagaattttgactttagggggaagaggtccaaaacacagaggacgagatattttagttttagatatgttcagcctagttaagtattaatcaaagaatcctaatctatgatgcttcaatggcgatcccactgattcacactttcacagtctaaagactcgagaacaatcgaaagactcaagtaacaaacatcaagattgtaaaaaaactatcttgtagtgagtagtggtgacaaattcatgatttttgaggtttgatacgttatataatataaccaaaacttgtagcactctgcaaacacaattattattgatttacataacctgaccctttgtttcaagagtctttcactactgtgagtctctacttctctcctacatgaagcctaaaaacaaagctgttaataaattcgctgttgcattgagacagtaagtatgcaccaagtaaataaactcttcagtattcaacaatcaacacccatctttaagaaaaacataaattacttggtcttaataaccggacagaaccaaagactaatcaaatcctgaaccggtctggttcaatagatctaaacctaaagtataaatcaaacgtctcaattgttttttcctagggtttcaatctctctcccaaaaaccaaaacgcaaaacctccgataatg

SEQ ID NO: 18418 - DNA, 3003 bp, Unknown; identical to SEQ ID NO: 18417
  misc_feature (1)..( 3003): 2750-1469P.txt file - cDNA_ID_1817337; gDNA_ID_1621140; Annot_ID_172799

SEQ ID NO: 18419 - DNA, 3000 bp, Unknown; identical to SEQ ID NO: 7320
  misc_feature (1)..( 3000): 2750-1469P.txt file - cDNA_ID_1817345; gDNA_ID_1621140; Annot_ID_56615

SEQ ID NO: 18420 - DNA, 3003 bp, Unknown
  misc_feature (1)..( 3003): 2750-1469P.txt file - cDNA_ID_1817357; gDNA_ID_1621140; Annot_ID_56612
ggactagaaagatctcttacaactttaaagacatcggattcgcgccttacggtgaggaatggaaggccatgcgaaagctctcggtggtcgaactcttcaccgccaaaaaacatcagtattttaggtctatcagagaggaagagaatgacttgttggtcaagaaactaacagaattggctctgacacgatccccggtgaatttgaagaagacccttttcactttagtcgggagtattgtgtgtcggatcggattcgggtttaatcttcatgagtgtgagttcatcgatgaaaatagcatctccgaccttgttgacaagtctgagatacttgagatgacttctatgttctctgatttctttccaggaggaatcggtagattcatcgattggatctccggtcaaaacaagcgattcgataatgttttctcggacctcgacactttctttcaaaacattcttgattatcatcttaagcctggaagaaaagtagcagatagctctgatataatcgacgtggtgatcaacatgataaagaagcaagagaaagatggagactctttcaagctcacaacggatcatcttaaagggatgatctcggtaatgtttttggacctttattagttgtgtagactaatcttcccttttttaattaaatattcacacaatttttgttctgtcaggacatatttctagctggagttagcacaagtgcctccacactgatatgggcgataacagagttagttaggaaccgtaaagtgatgaagaaagtgcaagaagagattaggacaacactcggagacaagaaggagagaatcacagagcaagatctcaccaatctccattacttcaagcttgtggtcaaagagatattcagattacacccagcagttccatttttgctaccaagagagacattatctcatgtcaagattcaaggctacgacattcccgccaaaacccagatcatgatcaacgtctatgcgattgctcgcgatccaaaactttggacaaacccagatgagtttaaccctgacaggttcctagacagttccatagattacaaaggactaaattttgaactgttaccgtttgggtctggtaggagaatctgtccaggaatgacgatgggaatcacacttgttgaatttgctttattgaatttgctttacttctttgattggggtttgccggagaaggaagaggcggacaagatcatcaccggcaatggagttgctgttggcctagttcaagttcttctccactgaaaatctgatagatgtttctttttttggtttgcaacatttttttagtattggttatattgaatgcttgtgttttaaccttgcttttttctttagagacattctattaattagtaaccctaattgacatgagtaaaggaccaaaaatgttgtcatagcttagaaactctataatccaaaccaaccgaaaattttgaaatataccctaattgacatgagtaaaggataatttgacaaatttaaaatagtaaacttgcagtttgcactattgaaattaaagataatgttgacaaattctttatgaagccaaatcacattattgtataaccacaagtataatgtatatatttatatatagttggtaaaaacattcaagttcacaaccacatggtcattaattacacttgataggtagagagtgaagactaattcattgtgtatgtatccactacaccaattattcattgacttttggattcttatcagaaaagcatccgtgagtttatatgaaaggtcaatcgatcattaatgcataattccataattgtcgatataactcgattttgcaaactatattcttcaatcttgttgcaaaaaatgtcaatcttgttacgtgaataatggcatatgcattattatcgggtatcatcatttacaatcagagccaaaccaaacaaagagaactaaactgaaataatgttctttctttttttgtcgacatctatattagattgattcaaataactttcgatgatacgtacttaataaagacaagtctacgtaaacagacaaagaccaaaaattcaaaatatataacgcaaccaaaccggtccgcaaaaacgaatacttaatgcggtaatatgcctagttaaaatcgacgtaataaaagcaaaaatacaaccattgacagccctatagtcaactatagaaaaagataaaagtcaactttaaaaattgtcaaacgtttgtgagaaaacttgtacgtttagcaaaaagagattttgatattagttgcgttgccaaaagaagagagtaaactgcctaataatggacgtaaacgaatcaatatataactattgacaacctaaattacgtagtcaactgtataaaaaacgatcaactctgtcaattcaaaccttgacattatttgccaaaagaagagaagaaactgcctattaatttcaatataactaaaattattggactaggtctaaatagggtaaccaataaatttgaaaggtacatcttataaattacaaaattttggaaatttcatggaggcaattaagatttatgggcccgtggcaccccatgtgtttggatactttgacgatatttcagtttcaataatacatcattactcatggatgaagatgaaaaatagttttgtgctttaaagacagaggttgatggcttttgtggcatatctctctatagatcaccagtgttgacaattcttgtgttctgtcatctacagaattattcataattgttcatgtagcacaagtttttaaaacgatgaattctttaaaataattgacaatgactgaatgaataaatttattaaaaatgattatcttaacaaaaatacaagttgcaaccaaagaaatatatgattcatccaagtagtatataaaaataaaatctcactgtctatatatgtctctcattaaacacccaaatcaaatcgaaccaactaacacaaaagaaaagaaaaaaaaaacagagtatcaaacatg

SEQ ID NO: 18421 - DNA, 3003 bp, Unknown; identical to SEQ ID NO: 18420
  misc_feature (1)..( 3003): 2750-1469P.txt file - cDNA_ID_1817357; gDNA_ID_1621140; Annot_ID_172793

SEQ ID NO: 18422 - DNA, 3003 bp, Unknown
  misc_feature (1)..( 3003): 2750-1469P.txt file - cDNA_ID_1817361; gDNA_ID_1621140; Annot_ID_56611
tcattcaacaaaattctaaattttgtttttttaagtaaaaaatgttatagcataaatgttcagatttttatgtcgtattatattgaattaaatatagaacaaagaaaaataagatacagaacaaagagaaattttgatccaaaaaaaaaaagaaagagaaataagatctagaacaaaaacgatacattcagattgattattgaaatcaaataatcgaatttataattgaatttgatggaatttataatgtattttttgtcatggaaataataaagtttgttaatatagtaggcacgatcgaatctggagcttcaatttttttttaactaattgttatggaagatgctggaatgatctctttttacaagaaagctcctctcattcttgttccggttaaacaccattaatgacatcggcacacaaaaattcaaacaccgttgaagattgtttgctatactttatttttatcaataataagttgcggtacttggttaactgtatacgtacttctatttcttatagttgtgcgataattaccacaagtccaaaaaagtaaaatatgaatttgataaagcagtgtaaacctgagattttcaagatttgggcctaaacccattagagaatgctacgtagagaaccattgggcccataaacttattttattcccgcaaagcctgagtggattcgaaccactaccacaaaaagtaagagtttgggttatttgattttaatcattcactttgaattattatagacaccggacagtgacttatgataaagagatttttaacctttaaaactaaaacactaaaatacataatccaaagaagacggaacaaaaaacaaaaacagagccaggaataatgtcagtcttcctctgtttcctctgcctcttaccccttatcttaatcttcttgaaaaatctcaaaccatcgaaatggaagcttcctccaggcccaaagaagcttccgatcatcgggaacttacaccaacgccgggaattacatcccaggaacagtcggaatctttccgaaaagtacggaccaatcgtgtttctccgatacggattcgtccccgtggtcgtgatctcgtcaaaagaagcagcagaggaagttctcaagacccacgatcttgagtgttgtagccgaccagagacggttgggaccagagcaatctcttacaactttaaagacatcggattcgcaccgtacggtgaagattggagaacgatgcggaagctctcggtggtcgagctcttcagctcgaaaaagcttcaatctttcaggtatatcagagaggaagagaacgacttgtgtgtcaagaaactctctgatttagcttcgagacgatctttggtgaatcttgagaaaaccctttttactttagtcggaagtatagtgtgtaggatagggtttgggataaatctccgtgagtgtgagttcgttgatgaagatagcatcgatgatcttgtgcacaagtctgaagatgtcataaggaattctatcttctctgatttctttcccggattaatgggtaggctcatcgagtggatcttcagtgagaggaagagattgaatagactttactcggaagtagacactttctttcagaatattcttgatgatcatctcaagcctggaagagagagctctgatatcatcgatgtgatgattgatatgatgaagaagcaagagaaagagggagactctttcaagttcaccactgatcatctcaaagggatgatctcggtaaatctataatctttcaagataagtggttaaaaatcttgcatgcaacacagtttgtgacttttgttttgttttacgtcaggacatatttctagcaggagttggaacaagctccactacattgatatgggcgatgaccgagctgatcagaaacccgagagtgatgaagaaagttcaagacgagattcggacaacacttggggacaagaaggagagaatcacagaagaagatttaaaccagcttcactacttcaagctcatggtcaaagagatattcaggttacatccagcagctccacttttgctcccaagagagacattgtctcatgtcaagatccaaggctacgatattcctgctaaaacacagatcatgatcaacgcttacgcgattgcacgtgatccaaaactatggacaaaccctgatgagtttaaccctgataggttccttgacagctccatagattacagaggactgaactttgagctattaccgtttggatctggtaggaggatatgtccagggatgacaatggggatcgccattgttgaattgggactattgaatttgctttacttcttcgactgggggctaccagagaaggaagaagccaaggagatcatcaccgggaatgaagttgctcttgaccttgttcaagtttttctccactgaatgtgttttggttatggaatgtttgtactacactaagcttgattctaaattaataacatcttacaagtactgaaaatagtagacagtagacactatggtttatcttccattagaaacaattaaattataaaatcatttttgttaaaacagattaaattctctctttacacaagccataatactaattaattaagaatagggttacgctacgttgggagttgtttaaaagtacatattttcgtcctttttgcttctcccactaccatcaattagtggttgaaacagaaagcttatcagacagaaattggcattttcggatatgttggatgcacaaagtggtatataatacgtaagacttattcgtgtcaatcatgattcatgaagctatctaacctctacaagactacaaacacgtagaagtttggactactcatttaataatcgacaacaacccatgagctgaccataatgaatattattaaacaacccaagttgtttattttctcttaatcgttaagcacttcatctgaaatacaaaacccaaagaagaaagagattaaaaaaaactagagggcaacaaaaatg

SEQ ID NO: 18423 - DNA, 3003 bp, Unknown; identical to SEQ ID NO: 18422
  misc_feature (1)..( 3003): 2750-1469P.txt file - cDNA_ID_1817361; gDNA_ID_1621140; Annot_ID_172792

SEQ ID NO: 18424 - DNA, 3003 bp, Unknown
  misc_feature (1)..( 3003): 2750-1469P.txt file - cDNA_ID_1817365; gDNA_ID_1621140; Annot_ID_56609
ttgatgctttttaccagcatgtgattgatgatcacttgaagccatcaactttggattcctccggagatattgttgccttgatgttagatatgataaagaaaaaaggacataaagatgatttcaagctcaatgtggataacatcaaagcagtcctcatggtaaagttcaaattttggttcatatatctttttatttttcaaaccattgaataaacacttagtttaaactactaagcttattatgtatatatgtctgtttatgtgatgctcagaatatatttctcgcggggatagacacaggcgccataacaatgatttgggcgatgaccgagctcgttaaaaaacccttagtgatgaagagagctcaagaaaatatccgaggcgtcctcgggctcaaaagagatagaatcactgaagaagacctatgcaaatttgattgcttgaaacatattgtcaaggaaacattaagattacacccaccagttccatttttggtcccaagggaaacaatatctcacatcaagattcaaggctacgatattccaccaaaaacgcaaatccaagttaacgtattacgtatggacgatcggacgtgaccccaagcgttggaccgaccctgaagaattccgccctgaacggtttgcaaatacttgtgtagattttagaggacaacactttgactttctaccgtttggttctggtcgaaggatctgtcccgcgatatcaatggcgattgctaccgtggagctaggactgatgaatttgcttgactttttcgattggagattgcctgatgggatgaaagttgaagacattgatatagaagaagctggtaatgtcacggtagtcaagaaactacttatttaccttgtgccccttcaacgtcattgatgagaagttaaagaaagctccatgacatggaaagaatacgagaagataacctataattctctagatattattgcgagatatataagaattaattcatgtttgatgatcaacattccaaaaacaataatttatataataataacaaatcttctatttaaaccattttgcaatgattggattgagattcggtggctggctgtcactttatcgcagttatcgatctttttgtctaccaaatgatatttcaaagagtcaattagtagtatggacaaatatagtaataaaaatcaattatgattctgtggctactatatatggagtttatcaggccacagactgagacggaagaatgaggattatgatgttccaagagtagtggaaattttttagtaccaccaaccaacatttcgtcttaggacgagaattaaacacttgtagactttataataacatttcgtccaaaatagtgggcactaaaacaaatttattattttctttaaaaaaaacacgcttttcattataatcgagttcaaattttcaaaaactctagaagtactctatttacgatataaacccatttgaagtcaaggctaagttcacattcataaaatcatgactcatgagcgacgagatcaataataaacaaattttcagcctacatttctgatttcttgcacgttatatatagcttgaattgttgtgccagttaggtgattttaattaggttaacttctctacttaatttggatatttgcatgtggtgtctaccacgttacgtggttttagggttattatttatattttactaaagtttatatataaagttcgggctttaggaatcaagcgatcaagtcaaaaaaattgttggataaattttttaacgtatgttttgttttaaccaacttagaaactttgtatttctcgtggcagtttttttcccttttcagttctcgtgccaagcttaagaatatgaaaatatactaattgtgatggtgattcaaacccttaacaaaaaaaaaaaaaggtgatggtgattcatcacaaccatatcatcgggatgtcacattcaatactaaaggacgagacctccaccgaaacaaacatctataaatccaattttagttaatgtttttttttgtttgtttctgaacagttcaatagcctataagtagttatatacaaaagtaataatgcaaggaaacttggatctatcttaactttgattgatacaacagaattgacatattcaaaaaaatatggatgtcatattcaatttttattatttttgggaaataaaatacaatatggatgtcacagtgataatatattaatatgccagcaaacatgtaaaccatcatctattcatctacgtttcctctaagaagaaataaattggattcgaacagatttagaactctcaacgtcatcagaaattagtatatcaaagagagtggatttccaacgacatcattattttccaccatataatttaaacctcattaataaggtttcatttgccgtttaaaggcataatcatttgccgttttcctctataattctcttaaagttataatttaaaaccccaataaattagtaaatttgacaatgacataaccaaaatcctaattaattataaattttgatcaaaaatctattaaattttcaaattcgaagtctactcacctatttttaatcttactctaataaataaacttatctatctctatatatccatactatgtaatcgttgacttaaaaaggtataatattatacaatcgttgacattaaaaaccatataatatacaatgattgagaaactgcttatccactcaaccaatcaaaacaaagtgtaatcggaacacgtggattttgaaccacaagacttggtttatgcttgtgtcacatttatgatttcaacgaagataatatccacaaatctagtaacttctgtatgcgactctacaaccacttgatttgaagagttaacgtctcaatcacgtcgtcaatccctgtcactctatctctatcttataaagaagaagactcttcgaagttctaaactcatagaaacagagccaacaaaacaaaaacagaggaagaaaaacaaaaatg

SEQ ID NO: 18425 - DNA, 3003 bp, Unknown; identical to SEQ ID NO: 18424
  misc_feature (1)..( 3003): 2750-1469P.txt file - cDNA_ID_1817365; gDNA_ID_1621140; Annot_ID_172790

SEQ ID NO: 18426 - DNA, 3003 bp, Unknown
  misc_feature (1)..( 3003): 2750-1469P.txt file - cDNA_ID_1817367; gDNA_ID_1621140; Annot_ID_56608
tctgatttgaagttatgagagaaaaactctttgattgacatctgattttggtttatctccttctggatcagcttatttttattgtagcttctctgattttcgatgggtacttatattttttttttcaatttgggatttttcatgattctgtagggtttgcaaagatgaagcttgatactagtgggttcgagacttccatgcctatgattggatttggctcgagcagtgatatgcttgatgagctttcttctgtaccctcgtttgatctaccccgtactaaagaggtgactttttttgtttttgtttgtgattcgaagcagtgtgagtgaattttcaatgttgtttgattacgaaactggttttatttgttggtttcagtttgatggatttcagaaaaaagctaaagacatgttgaagcatgcaaaaggaacaaccactctcgcttttatcttcaaaggtggtgttatggtcgctgctgattctcgggctagcatgggaggatatatctgtatgttctcttttatcactttacttttagttttgtttgcagactttgacgatgtttagctgtgagctctcttaagaattcctccaaaaatatgcatcctttcgatatagttgactttggtagaaacactagtacaatgaagattaagttagcttgttgttggttttggttttgtgctggagtgtcaaacaaatttctagttttcattctgttggccattaattgtgaaccagtagaggaaagaaaacgttgtgtgatttttgttaatgttttaaatctgtttaccacattcagcctcacaatctgtgaagaagattattgaaatcaatccttatatgctcggtacaatggctggaggagctgctgattgccaattctggcacagaaatcttggaattaaggtacctaactagaaatctttttggccgtgtctgaactgataacttggatctttgattaatctttctctctgtggttatcgggaatcttgctgccttgttatatagtgatttttttatatatttctaaaagcagcagattcatttaccttatcaaatgctttaagttttagttctgtctatattaaagaatgacaaagattttgcttgtttgatgttgaccctaagatcatacaagcctctttgaatgctaagcatgcaatttcagttgagcatgtggtggctttagatcccctttttttctaatcaaacattctgtagcaagaaagttcagctttttttcctctgtacttagatagcaaataaataaagaacttagtttgttgaatgcgatgtgaaattttggcatgttaataccattgtagacttcttcattttatcaccaacatcttgtttgttgattttatggctgatctcttaatttatttgtctatccaagtgccgtctacatgagctggcaaacaagaggagaatctctgtttccggagcttcgaaacttcttgccaacatgctctattcataccgtggaatgggactttctgttggtacaatgattgctggatgggacgaaactgtcagtaaaaccaacttcatatcttcaacactgttattttcttcccacgcaaaaggaaattttgaaatgctaaatccgtttacttcttgtataatagggtcccggactatactatgtcgacaacgaaggaggacggctcaagggagacaggttttcagtcggttctggttcaccatatgcttacggtgtgctggacagcgggtaagtcatttcccaaacaacatcttcatcgcttttgtcccaatctcaaaggctaaaaaccaaaatctaatgatgttagttaagcaaccgtttcatatttatgattttacttgcatcatcaggtacaaatatgatatgtcagttgaagaagcttccgagttagcaaggagatcaatctaccatgcgacattccgtgatggagccagtggtggagttgctagcggttagtaatctgaatgcatctgtggttcaaatgtaatatttaactttcaagattctgatttagctcataagtttgttctcttctcatatgaccagtgtaccacgttggtcccgaaggatggacgaaactatcaggagatgatgttggggagctacactaccattactaccccgtggcaccagctaccgcagaacaagtcatggaggaagcaacagccgaataaaaatcctgtttagttttctaatcgttcactccctttcttgttgttgcattttgtggtagtatatactgagttgtctctagctgaagctttggtattctattttactgatctgaaatgttgctcgcggattattctctataagattctctttttctgcaatcacattcttctcttactcggtgttttaaattccaatatagggaattgtgattgttttgcaccattttgttagttaaccagtctctccctatccaactctatcggcaatcctcacagatttgctcgtgatagctggtggctggcgttgtagagactagagagcaaagcttagtttggaccacatgaattgcttcggctctgtcccatcttttttatcaacctaaattcccaatgatgataacatccaccaactagaagagaagagttcatggttttgctttcgtctctcgtttcatcaatcttttttaaacacccctcaggaaacttgcacatcagtcaacatggaagtgtctcagtggtcgacaagggcatagttctgtcttaaatgatgcgatttttaccaaacggcgttcctattagcaacataaaaagccatgaggtccataactcgtcttcgttcaatgatccaatcaatcaatcaatgatttttgaaccacacgacatgattatgttttttttttgtcgcattcatgacttgaaaatttaacgtatcgatcacatcatcaaccccttataaacaagactctttgagattctaagctcatctatccaagaaacagaaaccaaggaaaccaaaaacagaggaaggcaaaaatg

SEQ ID NO: 18427 - DNA, 3003 bp, Unknown; identical to SEQ ID NO: 18426
  misc_feature (1)..( 3003): 2750-1469P.txt file - cDNA_ID_1817367; gDNA_ID_1621140; Annot_ID_172789

SEQ ID NO: 18428 - DNA, 3003 bp, Unknown
  misc_feature (1)..( 3003): 2750-1469P.txt file - cDNA_ID_1817398; gDNA_ID_2926149; Annot_ID_197938
ttttcatactccacgtaaaagagatatgttcgaggcatacatcaaatattataatcaatcatcgtgctaacttatactacaacaaaatattaatataaatttactatccaatcttacgaattcgtgcaaaaatcatctaatttttttgccacaatggcaagaaactattaaattttgatgacgtggacacgcacatgtaaaaaacgtggatgtcaagtcataatgttaacaaactgttttttttttcatttccttcaattctggtttttgttttttaaaagttgtgtataaacataaataaatatatatatttatttatatatttccaatggattctccaaaactcttatactcactttcagcatattcttccatcgtgaaaccttaccaaaaaactaatattaaatttctatggtcgtgagtatgcttaaaatgtacctactatttatgtgtagtggtttataaaatctaatattattggaaacattttaaccattgaatttttgatgacttaaatttttttttagataatttaattcgttaaaaatgtaaagatccaaataacatggtgttaagtgtccctactaaaaaattaaaagtggtgttaagtgagacttaacaacaaatcatacaaatttcagaattcacctaaaatcattaaagtcatccaaaaactcattaaaactcaaactgatttaaaatataagattaaatgttttattctatatcacttagaaaactgaaaataaaataaaattgtttgttaacactatgatgtatcattcacgtcgtttcacacatggtctacattatctattatagtttcttgccaccatgacaagaaatgtataattttgcacaaaatcataaatttagatggtaaattttaattaacgatttgttcacgtatgaattagtattcatacttatattttaattgaacttgtcgctttagttgaggtaagaaaatactataatagtaatgaaatctcaccaaataacaatcaaaaatttatttcaatcacataagatcttgtcaaaatccaccaaatcatcatgcgtgtttttcaacatctctccaaatcttctaaaaattactaatccaatacaccgcctaactaatgtatttggtaataactcttgatatgtacaactaatttacgtgttctccaccataggttatatctgttaactagttacgtacgtcgaccaaaaacatattactttatcgtggttttatcgttgaattattcactttcatgttgggatatcaagatttgaatctttcaatcatgattttaattatagttgtcaaatgtcatatcaaaaatatctattttcttatagtttttaactgattagtatgagtttcgatttggaatatttcagatatgaacatacaactaaggaacaaaatattgatattagtttcctatatctttttatttattttaaatacaatagcagatcacatgtatatattttaactcaatagttacgtcgaccaaaaacatataactttaaatatcgtggtttcattgttgatttattcactttcaggttgggacatcggaatttgaatttttcaatacgaattttaaacatagttaaatattttcttatagttcttacttcttaacgattagtatgagtttagatttggaatattttaaatatgaacatatagttaaggaacgaaaggcgatcacatgtttgtagttcacctaagtattgtagttataatctcatccagtacctggagcagttgagctaatctttagattaagcttgggcaaaaaatccggactaaaatacttgaaccgaaaccgatccaaaaaatcggtttgggacgagtacggatattacctatttactttattgagtcttgaattgtcgtacccgtgagtatagggtaaaatccaacccgaacctgatactcgaacatgtatccgcttacccgaaattacatatacttattcatagatttatatatataaaatcttattttatatttaatatttgaactaaatacatttatatccaaatatctaaaaataattaccaaaaactaaatacatttgtaaatacttaagactaaatatttttatacgcaagatacttataagttttttggatattgggacaaaatttcggttatgtgggtaaaattcagatatttgggtaaaatattcaggtatttagataaaattttagatatttggctataaaatacctgaatctcaaagatacccatttttttggtatttagcggttctaaaattatatatccgaaccgacccgaaccccattggatccaaaccgaaacaaaacagaaattttagatttatcttattgggtcctaaacttttctacccaaaaaattcttatccgatcgaattttacccgaatattccgacccacatacctgaatgcccaaccgtactttagggaattacatccgatgcacaaaagaactaacaattttgtactatcattaacaccacccatttgcaactccgaaagacgatcacatattgtagatttaaaatgcaatcttaatcacattttcactaaaagttttccttaacgtatttggtgggcatgatttaacagctcaatttggcaggtcaacgaatcaaccgtgctttaaacgttgtaatgtttttcaacttaagataagactcgaaatcaattaaaaaaacaaacaaaaatcatagtcattgtttttctttgttaattcatatacactcatacaaaacattgacaacttatctattgtttaatctaaataatacaattatgtacaagtgttactttagtaatactgccgtccatataacggcacaaaacggagaatgacgtcaccattgttgatgtcacacctccatgtaacttctgttataaacgcattaaacgttacacttgtgtatattatatagatctctgtccctttatatttcatcttttgacattacaaaattacattaccaaacacattaaatg

SEQ ID NO: 18429 - DNA, 3000 bp, Unknown; identical to SEQ ID NO: 7342
  misc_feature (1)..( 3000): 2750-1469P.txt file - cDNA_ID_1817398; gDNA_ID_1621141; Annot_ID_56640

SEQ ID NO: 18430 - DNA, 3003 bp, Unknown; identical to SEQ ID NO: 18428
  misc_feature (1)..( 3003): 2750-1469P.txt file - cDNA_ID_1817398; gDNA_ID_2926149; Annot_ID_139231

SEQ ID NO: 18431 - DNA, 3003 bp, Unknown; identical to SEQ ID NO: 18428
  misc_feature (1)..( 3003): 2750-1469P.txt file - cDNA_ID_1817398; gDNA_ID_1620685; Annot_ID_48440

SEQ ID NO: 18432 - DNA, 3000 bp, Unknown; identical to SEQ ID NO: 7342
  misc_feature (1)..( 3000): 2750-1469P.txt file - cDNA_ID_1817398; gDNA_ID_1621141; Annot_ID_172843

SEQ ID NO: 18433 - DNA, 3003 bp, Unknown; identical to SEQ ID NO: 18428
  misc_feature (1)..( 3003): 2750-1469P.txt file - cDNA_ID_1817398; gDNA_ID_1620685; Annot_ID_164585

SEQ ID NO: 18434 - DNA, 3003 bp, Unknown
  misc_feature (1)..( 3003): 2750-1469P.txt file - cDNA_ID_1817421; gDNA_ID_1621141; Annot_ID_56633
atggtgaggcatagaggtgtcttacgcgaatccatgagagagtctggagatatgctcggaagcgtttagtattgttgctcgaaggaaatgagggtcccaacgactcgtgaggagcggggtatgctcctaaggtaccggtaactcgagggacatggtgtctttagagtacgaggggtacggtggcttcgggtgacgatccgagagcacgctttagggtgacgatccgagagcgagttttgtggtattattttctccaagtgtcgtaactcgatgactttgtggctgagagtgagccgacacaactcagggtttgactttgagtggggaagataatatgtgtgatatccgagataccgtaggccgaggcctgagagtgacggtttatgctcgaagattgcggtctgagagtggagagtaagttgtgagcaacaatgactagtaaatcgtgagtatatcgactggatagagagacctagagggggtctggttggagggaatgcagactgtagtgatggttgcacggagttcctcggagtggaagggtgaagctagattcgaagacgaatctatgttagtgggggagaattgtaacgcccgtgaaccagaaaatcggttaggatttgtttttaaatcatccggtttaattggttgggttaattggaaaccctagagtgtgcctataaaagaaggaaactcgaaattagggctttagttagccacttttcgttttataaaggagaaaaagagagaaaaggagaatgagcagaatcgttagggtttgggagaaatcagtttcgtcatatcaaatcgtggtaaaaggtaacaaaatttggtagagttattcccaaatcctttatcgttattctccagtttacagaattgaatttggattaaaattggttgagttattcgcagtttcgtgagacacgttttctcagacgcgaattaggaccagcggagattgaaactgagatcgtggtctcgtctgttttccgatcggcacgagattttgtgggcagctttgtgacgtctgcagctaggattttaccggagcgattgaatagttaacggttagcttgtattttagggtttcgtctttgagactgtttgtttctggtgttttcctgtccagtttgcttcaaggttgcttttggttgtggacttgttgtaggacgtttctggactgtttccgacgcaaggagagtctctcctgggtttaattgctattagaatcaatttgttaaggtgagtgcgtgaccatgagcttatctaagcgattgggttgtgtgatttgttttgtgtgatgatatgtaagtgttgtgaatgtgttttgggtgaattgttcaatgactggtttgtttgtattgtattcgtgattatacctttgtatttgcttgtgtgtatagttcgtagatgggagtatcgcctcactaagtatttatgataatacttacgcatctcattgtgttgttgatgcatgtaaagataaagtgtgatcgtggaatcataacaaggaagagaggatgatctaggaactcgtttgttttatttttggtgtttttggttattggaacccggttaggattgtcagttattcttggttttgttggtcgatttatttatttattcataaaatagtatttttgacttgcagtttaattattatgttattagttggtttaattaaatatttatgagaatatttaattatatttaaaaaaaaaaaatgggtcaagttgtttcacaaacatttaaatatttctagatgtacctttgctctttttctcttttcattcattttagaaaatgatgaaattattataaaaaattcaaaaactgtattaattatttcaagttacaattctacgtattagtatacaaaaaagatcattataaaaaagttgtcagccaaaatttaatattaaacatcccgtaagtttaacgaatccaatgtatttcaagcagaagtccacatcagttgtctccgtgtaaaatggtatatgtctttgaaaagcatcacgtttgtaaatggaaacacaatgaacacgattacacgaataataagttaataacaacaaaggaaacatgatgtgtttgatgaactttgtggttgtggccatatttttgagaagaaacaaatctatttggtattttctatttaatatgtttgaaacattttatttatactgatatccgaaagcttaatataacaataataagtaatgtaattgtaaaataaaattttaattcatcactttaataaagaatatatttaattaatcatttttaatttatctatttttacattatattaactaataattaattataaaatagtaatatttatcaaaatgatcaaataaaataaaaatattaaataaatagtttagtaatagaaaattgtatttttattatgcttctgttcctttttgtttgatcttttaggaaaaatacaaatattaagaaaacgtattaaatgttgttttaaatgtattattttttgtgatttacaatttttaagaactctaaaccaataatatttaataatttgtattgaagtttacaagttatcaattataactaataattattgcattgaaaacctaaaaactcaatttttttgaaataatttgtttttcttaaaaaaaaaaaaggacaaagggagtattaggtaaaagtttgatgctaaaactatactcaaatggtgtatactgtattggcaatggttcatggttgcctggttggtagcaaaaaaacacagatataattacgttaaggctatcattaaacaaagagggtctcgcaattaaaactacactaattcattgtttacaagaaaagaaattgttacttctttggaaattggccattgttaattggaaatcgtgaatccaaccaacaagacatttctctgactctcttcttccttcttctcctccaatttagggttccttcaaattctctctgatttcgtttgaaattgggggctcctcttcgaagatg

SEQ ID NO: 18435 - DNA, 3000 bp, Unknown; identical to SEQ ID NO: 7347
  misc_feature (1)..( 3000): 2750-1469P.txt file - cDNA_ID_1817437; gDNA_ID_1621141; Annot_ID_56627

SEQ ID NO: 18436 - DNA, 3000 bp, Unknown; identical to SEQ ID NO: 7368
  misc_feature (1)..( 3000): 2750-1469P.txt file - cDNA_ID_1817448; gDNA_ID_1621142; Annot_ID_56659

SEQ ID NO: 18437 - DNA, 3003 bp, Unknown
  misc_feature (1)..( 3003): 2750-1469P.txt file - cDNA_ID_1817451; gDNA_ID_1621142; Annot_ID_56658
taatgcttattgctccgacaagattgaaatattatcaagaagatgtagttgcacccaaagtgacgtacggacctgcaaaatgcagaaaagaatcagcaaatgatgagaaaacaaacaaagagagttcaacatttctatcttgatttatcggtcactaacacaccctttgattctaatcacgataaggcgtgagatcgatttggaactgttgtttcccctttgtgacactctgcaaagatgttataagagccaatgttacaacaaaaggaaacagattaaatttttatgggataatgtaaagggcttaccgcgattgcaatgagctcttctagcagttcttctagatgacgcagaggctgaacgggaagaaaaacgatgatcaagaatgcattgtgttagactaatggatatggtctgaaaaaaagtaaaactcacccattgtgttggaccatcgaccggtgcatttaaaggatcatcatgcacctaattcaccggaaaatgaaccaagtttcataaccaaattggaacaaagattcagcgagatgacaaaacttgcgataaagttggatacctccatgaaaattccatcgacaccaacagctacggcggttcttgctatgcatggtattaattcgcgaaggccaccactagcaacacccccaccatctaactatataaacaaggtatgtttgagtttagaccaattctgatttagctttaaaacaccaagcattttcttaaattactcagagcatcgttctaatgaccataccttcttgcctgcaggttgttgtaatgaatgagttatatcagcaacctgaagccaataactaaattatattatacgagtgtcaaaacatcaaagtataaagccaaagccaagatataaactcccacaacaagaaaagaacaagaagcaatattaactcacaacgggacaatcagcttccctcatccattccaaatttcgtggatctactattaaatcatctgaggaacaaaattaaaatgtaaggacactcaggagttatatccagtgtcttttagtctattttagtctctatttgcaaaaaaattggtgaattctattgacacaaagaacagttaacttactgtatccaaacatggttcctctttcacaaaccatcacatttggattccctgcgagtctaaccttctcagccgagtttctcatgaccttaaaatggatatacatgaaatcagtcactacaatataccagggaacaaaagtttgtacagatcaaaaagataactcacagagtgaccacaaaattgtcctttctttatgttgataattttcccactttgggctgccgcgaccagaagatctgtctggagatataggcaatagttaaaaccctgaactctgtatataaatgataaattcaaacagtaaatgaaaatttgatagctaaaaaagagttgaagaaaagcatatgttagaatcttgcctgtcgacataagaacgccggtatctgaattatatctgcaaccttgccaactgcttcacactaataaaaacaaacgaagcattagaaaggaacaaagatttttcgaatcttgaatctctgatgtgactaaaactcaaaatacctgactcgactcatgaacgtcagtaacgattggtagatcaaatgctactttcaccttctcaagaatctgtcgagagaaacagaaaagttactacctgtagtatacttgtgcaggaactacacacaaaaaaatgaagccacatcaatactagtttccgtaaatgtaaatggttgcattatagccaggagctaaatgcaattgctggtgtcagctcatactgaaggttctaaaagacgtaagaatttatagatataagatcgctttgacatcaatatactcctgaaggttttcaaatgcgcagttctaagagcaccagataaagagtcatccatgcttgcaactcaaagaagagggaatgatttaccttgagcccctcagccatgccaggacctcggaaggactttgatgaagttctgttagctttatcgaaacttgacttgaaaaccagaggcaacccaagcctacaacattcacaatcaacatgaacatgcataactataactatataagtaaacaccttgctcaataagctaaaatgctcatgtgatgagaggatcaaggtctccactgtgttaaacatttttcccccttgtcaattattttaatagttccaacacagttgaacacaagatgtcacaacaagaaaaagagcttcaatggtgatggttacacatactttgtcgaaatatctttgatgcttttagccatacgaagaacatgctcttcggattcgatcacatttggaccagccaataagaaaaacggctcagcaacctgcaatgagtcattgtccgtacgataagataactcaattcaccggaagaaaataaaaaaaataacactgaacctagtaaaaaaaactcaaccttgagctgatcatacagtagtgacgctgaattcgccatttctatagtagagcttaagatcagataacaaaacctcaacttccaaaatcagaatctaaaattcacgaaagaacttatgataatttctctacattgatctgcatcgaagaaaatcacaaatcaaggatttaggattctgacctttaactggaagttgtagtgtgagtgaaggcagtgagatgccaaaatagaaattgccaatggccgagaggtgatgttcggatacgccaacagtactgtccctggcgtggataatcattatccggttttaattcaattcatagatcgttaaaccaatcggttaataaataaaattctatttgatttggtttaatttcttcggttccggttttatcttttcaccaacattttcgtttgtcatctttcgcacctaaaccttcacctactcctccactgaaccctagcttacactcactgttcatttctctctattggcatcgacgccattgttggactgaagatg

SEQ ID NO: 18438 - DNA, 3003 bp, Unknown; identical to SEQ ID NO: 18437
  misc_feature (1)..( 3003): 2750-1469P.txt file - cDNA_ID_1817451; gDNA_ID_1621142; Annot_ID_172870

SEQ ID NO: 18439 - DNA, 3000 bp, Unknown; identical to SEQ ID NO: 7366
  misc_feature (1)..( 3000): 2750-1469P.txt file - cDNA_ID_1817455; gDNA_ID_1621142; Annot_ID_56657

SEQ ID NO: 18440 - DNA, 3000 bp, Unknown; identical to SEQ ID NO: 7365
  misc_feature (1)..( 3000): 2750-1469P.txt file - cDNA_ID_1817459; gDNA_ID_1621142; Annot_ID_56656

SEQ ID NO: 18441 - DNA, 3003 bp, Unknown
  misc_feature (1)..( 3003): 2750-1469P.txt file - cDNA_ID_1817462; gDNA_ID_1621142; Annot_ID_56655
tgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggataatggcgacggagcatataactcgtacgggagatgaatacaatgtcgagcttttacctagtgacgacgatgcgccgccgcttgaatcgtcttggcgtctcaacctcgacgcttttcaactcccttcttccaccggtggccgtcacgacggacgtactcgcttttctcgctattttcgtactccaagtaatttttttattcttcttcatgtttttgttatctgctctcaatccgtaaagtgtgcatagagacgtgtacgtaaaatgatcagcgaccatgacttgtgaattgtggatatgaactttgatcatgtgtatgaaaaaaaaaaaagtagttatacaaatgtgtagttgttgaaatttttttgggaaaataaatttagaaattcagtctagaaggaaaaaaattagagtgaatgattctctctgtttaaaaccccttgctattgatttgattcagtataaaactttttctttttgttgattcaaagtttttgatgggatctttagcttctcttttggagtttgtatatacccatattctttgttttaaagttatgtggatgctgaatcagattaatctctacagaggttataaggcgttttagagtgatttgagaaactgttatacccatcaaaggtcgactatcaaattgttaaatcttgaaaatggactttaactttgaacccttttctctgttgtctcaatgcaggaaaggaacgtagagtctctgaatactacaagaagcaagagaggctcctcgagggtttcaatgagatggagactatccacgaaaatggttttgcatctggtgttccaactgaggtctggcctctactgttctttctttagtttttttttcttatggtatagatattagatgaatcctcaagcttgtttggtttgaacaggaagaaatgaagaagcttgcaaagagtgagagacttgcggttcacatatcgaacgcaacaaatttggtgctttttgtagcaaaagtttatgcctctatggagagtagatccatggctgtgattgcttcaactttggactctcttttggatctcttgtctggttttatcctctggtttacagctaatgccatgagaaaaccaaaccagtttcactatcctatcggaaagcgccggatgcaacctgtggtatgcttcttctgttttgatctcttaacccctttgtttggaacttacttgtctcacaagaaaatagaactgataatgtaaatttacagggtatcattgtgtttgcttccgtgatggcaactcttggactgcaagttttgctagagtcaggaaggcaactagttgccaaggtactttacatattttcaggtaactgctttcatcggttaattaatgtatttaaccaattctgttttttgttacagagtggtattcatatgaatagcacagaggagaaatggatgattggtatcatggtctctgtcaccatcgtgaagtttcttctaatgctttattgcagaggatttcagaacgaaatcgttagggcctatgctcaagatcacctctttgacgtcgtcactaattcaatcggcttagcaacagctgtcttggccgtcaaattctactggtggattgatcctaccggtgctatacttgtaagtaactaacttaggaatctaaaatgatcaagaaatgtctcgtcggattactaaaacgttttttttttcctttttatggttgcagattgctttgtacaccatagcaacatgggcaagaaccgtactagagaacgtccattcactgatcggccgctctgcgccaccagatttcttggcgaaactgacattcttgatatggaaccatcacgaacaaattaagcatattgacacagtaagggcttacacttttgggtcacactactttgtggaagtggacattgttttgccagaggacatgagactacaagaggctcacaacatcggagagactcttcaggaaaagctcgagcagctcgctgaagtagaacgagcttttgtccacatagactttgagttcactcatcgtcctgaacacaagtgtaactagattttaagtagtaatttgtagtactataattagttctttagtttatgtactcttcgtgtcgtttttgtctatatagatacttgaacgttgtgccgtctctgtttatcgaatgcgcattgtgtgtcgtttgaagctaatcgtcgacattaatagcgtttcaaacactaaactcaaaataaagataaaatcatatataataaaataatgaattttaaatgaaaaccactcaaaatggtttttatctatcttccgacaaaattccgtgcttcattgctcttctccacaagacaacatttctctggctcagaatcgacgccatggaaatgtaaagaagaaacaaagacgagctctcaaatccagcagcaatg

SEQ ID NO: 18442 - DNA, 3003 bp, Unknown; identical to SEQ ID NO: 18441
  misc_feature (1)..( 3003): 2750-1469P.txt file - cDNA_ID_1817462; gDNA_ID_1621142; Annot_ID_172867

SEQ ID NO: 18443 - DNA, 3003 bp, Unknown
  misc_feature (1)..( 3003): 2750-1469P.txt file - cDNA_ID_1817466; gDNA_ID_1621142; Annot_ID_56654
catactcttttcccatttagttttccttactcatagtaactgatccacgtgcttgaacacgtaatattaatcatacttaaaggcatgggataatatatcaaacttaaaccaaatcttctctcctcctcttatgcaggcttacatgttcaagtatgattctactcatggaaattacaaaggaactatcaatgtaattgatgattcaactttggagatcaatggaaaacaagtcaaagttgtcagcaagaggtattgcctcaaaatgttgactcatgtgtatctgtctagtatggtcaaattatgaatcaatttccactaatatcctattggtagggttttatgcttatccttttttagagtctaacatcttaattgttcttcctcagagacccagctgaaatcccgtgggctgatcttggagctgagtatgttgttgagtcttcaggggtattcaccaccgttggacaagcttcatcacatttgaaggtatgcactttcatttgaacacgcttgttgatctactagtttcattgatgctaacatttaataccaagccttatattattaataattccaaacattcaactcctaaaatggtctatgattttcttgacctttcattgtctgtgcagggtggtgctaagaaggtcatcatttctgcaccttcagcggacgcgcccatgtttgttgttggagtaaatgaaaagacatacctgcctaacatggatatagtctccaatgcaagttgtaccaccaattgtcttgcacctcttgccaaggtttgtagcattgcatttttgtcctgtatatagctcattatgaagagcttcattaaagtcaaataaagttgtctatggcccttaagcacttgtatctggcaggtggtgcatgaggaatttggtattcttgaaggcttgatgacaacagtccacgcgaccacaggtatttgatccttgtgccctcttgttatatgtcactgtatattactgaattttcgagactcaactatgtgttttttttaatcttattctttgcttttgaatattcagctactcagaaaactgtggacggcccatcaatgaaggactggagaggaggccgaggcgcaagtcaaaacatcattcctagctcaacaggcgctgcaaaggtacccaaatttgtacagttatatataaacatagcatctggaatcatatttaagccatgacttttttacttgtctcaataggctgttggtaaggtccttccggaactcaatggaaaactaacaggaatggccttccgtgtcccaacaccaaatgtctctgttgtggatttaacttgtcgacttgagaaggatgcatcgtatgaagacgtcaaggcagccataaagtattactctcaaaacctgttcaactaatttgcgtaccattctctatacatgaataaaacatggaacttgtaataacatctcatgattttgatttgaaatctctaacaggtttgcatcagaaggaccacttaggggcattcttggatatacagaagaagatgtcgtctctaatgattttcttggagattcaaggtatgtcactcttaaatattgtagcggatcatttaaaatcttggtactcaaaggttgtggccattgtcaaaaaaattcaggtcaagtatctttgatgctaatgctgggattggattaagcaagtccttcatgaaacttgtctcctggtatgacaacgaatggggttacaggtaacagttagtctctctcatttctttaccatcacatttaccatttgacaatacccaaagactaaaatatgcgtgggtcttgtaatgttacagcaaccgagtccttgacctgatagaacacatggcgttagttgcagccagccgctaaaaccatatcccgccaacgttcgttaggtagtttttgttacattgggggttcgattactgaaccttccggttttggctccaagttttatgtaaaaccatacgatatctaataatatggggaagattttttttgttgtacgaagaaatattgttagcagctagtcgaaaccttttctatatataaaaattggtttccaaagattggaattttctggttatatggttttttgttagcttcaatatctcatctctaagttatgaatattcgaaattgtgacagtgaaccatcgatgagtacacgaagatgtaacgttgagaatgagattatgactttgtacagcgtagtatatgatgaaatattgacgtgacatccacttataggcaaaatgatgtgatagcaaataatatctgcaaagtaaaaacataaacgatctataggactttgttaataatacgatgcaacataaaaacccactcagagaaaatgctggtaaaaagaggaaaagtgtgagttaacaaaaggcagaaggggacaaaaagctttatgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggataatg

SEQ ID NO: 18444 - DNA, 3003 bp, Unknown; identical to SEQ ID NO: 18443
  misc_feature (1)..( 3003): 2750-1469P.txt file - cDNA_ID_1817466; gDNA_ID_1621142; Annot_ID_172866

SEQ ID NO: 18445 - DNA, 3003 bp, Unknown
  misc_feature (1)..( 3003): 2750-1469P.txt file - cDNA_ID_1817470; gDNA_ID_1621142; Annot_ID_56653
taaggctttaatgcaaaccataaagaaacgaagtttggtcacaaacttacgagtataaccatgaagcggttgagtagtccactccgagtattcctacatgtttcttaataccgttcacaaaccgcatgcacacagtatcagcaatcgcacaaacaagaggctgcaccagtgatatggaacatattttatcagaatagcaaatgaataaaccctaaaagatgcccaatataagtttcctcagcaggtgataattagcggatatgcacacttacaactctaattcctttcgtgctgaagtactttgaaacaattatttctgcaacagcctaaaatagaaaatatagcattacttggaaggcaacatggtgagaacaattttggttattgttctacgggaaatatctgtcaaactgcaagctcaattaaaagacacacagtaccttaagttcccctcgagaaaggtaaggcctcttttcaccatcttgtgaaaaacgaacctttcccctttcttctttagattttgtccactctttacatatttcagactgattccacatatcttccatatcttcgggggaagctcgagagtcccagtatgtgaaatcggtgtctgttcaaccggagggtatatttcagttcatatcagaacttataagagaatgatagaggttctccaaatatgagcatagagctaaagcattgccacactgcacgatgctcctagagatctttatatgtttgacataggtgcatgtttatacacgtggagacattgttatatgatacagaacgatacaaaaagagggagagattacttgagcctggggaagcgggattcgtaggacgaaagcttgaagggccagcatcgccatgttttctgcaacaacaattaccaaagagactgaagttttagcttcgcttccctcaacttcttggtgcaactaccttattagtagtatgaacaaaattaacaatatgaaagcccacggcaacacaaaaccttatccgtgcaaccatgcataaaatatgacagcagaaactaggtacatagagcaagcagagataagaagcaacaaccttgaagggagactttctttcactgcaaggtatcgtttccaatatggcaatgtcgacttgtgagtcgccttttttgtcccaccattgtatgctctgacaacaaactcttcacttctctggctgcacatggaaagtaaaatatatttaaagtaattccaagaggaacttagacttgttgtcactgaaattgtaaagctagcaatgtaagcttagggacaatatatatcatacttattctgatagtctgttaaccatttcaggtaagctgccccaaagtacacatttataaagggcttgtgaagaagatcaggattgtcatctacattatatgcctgatagccttggcccctgcaataaagattgaccaaaaccggaacataagatttttttataaacttaagatcttcttgaaaaggagagaaactagaaatcgttttgtacccagccaaccatgctgctgtcttttcgaaaacttgtaaaattccaaggccagtttctttggtctttttgctgtaccgcataatgagaggctttcggtcactttcaagctcagcaattgcacatatcatttcctgcagaggaataggaaggtgcaaaacttcaagatcataaaggggcatagataatttcaataacctaaacagtagctaaaaccaagctcaaaactactagttttctaatgaagcataccgaatccaagatggaatcaaaatgcctccggacagttatatcagaaacagcctgaaaatgtaaggggttgatctcaataagtagaggcagaaagaaagaaaggtctaactagaaatccacatcaatcttgtattggaatgtttgaaatttcttatagattaccctcatctcggtctgtgtaagataaggctgaccatcaggatcccttgagaggtgaaccttctggcctttagtctctccaacatcaatccattcagcactgaccgcaggatccatccacatttcttctaaatcctctggctcaacacaatcattccagaacgtgaaactgttggccattcttgcattgctatacgacctttccattgatatctatcagaaacaaacgaaaaacaagaggaaacagaagcttatttagaacacatcgttaacaacatccataagtaacatgtttgccaaatgtaaagaagaaaatcgaaatatcagacctagccgaaggcttaagcgggaaggaagagaatatcgacgagagaagcagaggaagaaggtttctcggcgaatccagagagaagaagatgatgaagattcaaattaatctctgggaaattcaagagatacagagaattcgacggttcgccatttttgacgggagagccaaaaaagcaaattaatcacacagaggggactgtgagacgagccaactgcagaaacagcacgattctttcgaagaaaatgccacctggcatatcggagctggctcagcctcgtcgtcgtttaagttttaacagtacagaagccatttttagagggagagccagctggacttgacacgtgtcaaactaaatcaggcccattttattttcgcgtggcaaaactcaataaacaacaaaagatacgtcaacgttattcaaatatgaccaaaggcccaccaaatcatgggccttgacgccgatccggtacacgcggctttgtagttttcctccgtgaaatctcaacccttagatctcatcgcaaaagtagttacgatgggccgcgacgcatcagaacacagtcatcgtctttgcagaatcgtaagcatattttacatgagaaattgcaattgcaatttgcatttgtctcatttttttactcaaacgaacattttcgtggctccagagctacactcaaaagccattcagcggaaggggttaggatttttggcggcgagatctctctgtttctggtagcttagcaatg

SEQ ID NO: 18446 - DNA, 3000 bp, Unknown; identical to SEQ ID NO: 7360
  misc_feature (1)..( 3000): 2750-1469P.txt file - cDNA_ID_1817474; gDNA_ID_1621142; Annot_ID_56652

SEQ ID NO: 18447 - DNA, 3000 bp, Unknown; identical to SEQ ID NO: 7359
  misc_feature (1)..( 3000): 2750-1469P.txt file - cDNA_ID_1817478; gDNA_ID_1621142; Annot_ID_56651

SEQ ID NO: 18448 - DNA, 3000 bp, Unknown; identical to SEQ ID NO: 7359
  misc_feature (1)..( 3000): 2750-1469P.txt file - cDNA_ID_1817478; gDNA_ID_1621142; Annot_ID_172863

SEQ ID NO: 18449 - DNA, 3003 bp, Unknown
  misc_feature (1)..( 3003): 2750-1469P.txt file - cDNA_ID_1817482; gDNA_ID_1621142; Annot_ID_56650
caacaatccagagcttagagttccacctgcattgtaagttgatcttttcactttcaatctaaaaaggcttatgcagaaacattatataacttacttaaaatggctggccaagttttctcacatctatatgatccgagaacattcacacactttctctttccacatttatttagatgtggatctctgcattcatcaatgtctacggacacaaaaattccaaacttcacataaggttatatagtacactcaagccctctattcaaagaagttaataggtaccttggcatccgccaggtatgtagggatttccttcgtaaccattgtgacacgaacattgatagctatcttcgaaaaatgtattgcctttgcatagtacacgctttgaagtcatgtaggaaagatcaagacgccattctagctctattgttgtatattcactgtactccattaattcgggaggagtaaacaaggaccctgacaatgtgaattgagtcaagaaggcaacctgacatccttgtttatttggttccagtttctctacggttgcatcaaacacttgaagttgaagaagaggtggtatagtcatctggcagcatttgtaaccaacacaactcgtgttagctcctttgtaagaccgtatctcatttccacatgtcgtctcacatcccacgatttgtaaccctgtgacattcatgaacgccttgttgttgcatccaacagctgtgaacttattgttttctgatatgaagaatgggctgcccttcaaattcaaagacgatgatgaataaccatctctgttgggacaacctgaatgtttcaatggactctggatgtagaatttgttgtacaccgatatggagaaagggtctccaaggttgaaggaagtaactgctcgtcggatccttggcaacaaaagtatcggttgttggtctgatgagcttttgcagacaatctcgaaccatttgttcttgtaacaacctttgcctatcccaaaagggtaaggaacactaacatttccgcaatggtcactgcaattacgaagtgcaagaggaaaagtagaagcagctgcgtattcacagattcgcaacagaagcataacaacaaggaaacgtttcacatcaacacccatttgctctctctctctctctctttctttcaggagccagaagttctgttcaggctcaggcacacctctctctctctctctctttctctaacacagataagtcaagagtcaaccttttcacttttatattaattttgcatgatacatcaacgaagaccttgacccatatgaattgaggccataacatatttcagtagtgggctccgtagatacagcagaaaccacgaaaaaagaggataatgtttgtaattaaatgttttaagatattctttatcaaaacaaaacgaaaaatgccaaagatattcatgttgagcctcttcaaacgaaacacaagagtttttagtttttactgtgagacgaagtttttcattaagcagaacgttttaaaatggatatgccggtacttgagatttttttcattaaaatatagatcactatttgggtgacaattaatgaaacaaaggagcccatagtcatggtcctttaatttcaaaatgggcccaaaattagtcatggtccttttatcctttaatttaaaaatgggcctaaaattcgatatcgaaccaaaataaacattgggatggttacatttacttgtagcggtcgacaaaaaaaaaaaaaaaacatttacttgtagcggccaaaaatcccacagcatattgaaatgaaatttccgaaactgaattcaatgcaaattgaaatggaatcagattaatggaattcagaaaatgacaattcgtgtgggggaaaaaaaaaacattacgtaaggaaatataaagagagaaactttataacgaaaatgagattgaaagtatccatacgcacgttcttctaatttccattaaatttcatttaggatctgatgatattgagagtcccatttaatgcaaaccgtataacataagctacggagagagacttgttgattccatgcttctcacttactccttcacccccaaaatcttattcttctttcatctccgccgtctatttttcatcaacatcgatagatgtacggttctcgtttcttctggttataaagcaaccgagtcgcacggacacgaaccattttgtatttttctttccattacaatacaaaaaaaaagaagcaatttggtcatttttatcatttctttaagcagattttaccattttttgagtaagcaacgaggaaacctagagaaggtgagagaaaatcaacaaaaataaagataaaaataaaaagttagggttttgatgcatattcttagatttgaacaaagagaagaagatagtttttgattgttactagctctcacaatccttcttgaatctattccacctgtcaagctctacattttttctttgtggtattgttctatcagttttggattctttgccattttctgattctttatttttttggtgtctgaagctaattttagcgatttggtatggtgaaatctttcaaatcgagcgaaggttttgtttttcttaaattacttctattgaggtttttggattaattgatttaaggttgttgtagagaaagtttccatttttggaacaaaaagcatgtttttggagttttctggtcggattattcatctacaattgcaaatgggaagaactttgatgagtagtctgtgtttaattgatagtttctggaggattcaacttctgccaaaacttaattatttctcccaattgtttttttttgcagcttaaatatttgggaggggaaatttgtagcctacaatctctgaagcaatttggcatctttaaagttttagcagtgattctttatagttcagtatgtcagattcttgttacaggtcttgtcagttagaataatttgaaggactgttgttgttgttgttgttgttgttgttgtgatg

SEQ ID NO: 18450 - DNA, 3003 bp, Unknown; identical to SEQ ID NO: 18449
  misc_feature (1)..( 3003): 2750-1469P.txt file - cDNA_ID_1817482; gDNA_ID_1621142; Annot_ID_172862

SEQ ID NO: 18451 - DNA, 3003 bp, Unknown
  misc_feature (1)..( 3003): 2750-1469P.txt file - cDNA_ID_1817494; gDNA_ID_1621142; Annot_ID_56646
tacccctgaagagcaagaatcaattgaacgggtacctacacttacattcctcaccaccattatctcaacatgtaatgccatttctcatcccttctaacacttgcgttaaacctttctgatcagcttgaggcaatggggtttgatagagcaatagtcatagaagccttcctttcctgtgaccgtaacgaggaattggctgcaaactatctactagagcactcagcagattttgaagactgagttccgagccttttaacctgaacaaagcacaagattttgttttgtttctccaccccttttatctgaactgttactatgctcagagaatcaaatgattatatcttacacctccatatttaccttgaagaataatctgcgttttccacactgtaaacacaattcattgtgtttctctctactgaaatgattattaacaatatgatatggttttaaataaattgtggtcatactcgcatgttgtgtgattgtgattattccagctcacaggtatccttattaaatcgatattgtctggctatatcatagtgtttatacacaaagcacaagaaacaataagcaatgttacacagtatctctcactaaacatattttctgggaaacaaaagattttcatcatgctctctgccatgcatctccttcttcatcacaccttccattgttctgactccaggttgcatttcactcattagcagcagcagccgcagcctgttttaacaataatccatccctattaatcaacacctctgcctactacttccagagacctttaggtgtgttaactgcaaacttatttgctacaaacgcaagatggattatcacttacctggttaagaggattatctggtgatttcttccacatcttccatatcaagtccttgtactgtgtgtgagttagacctggtttctcagacttgagccttggaagttccacttcttcatatgcctaaatcacaatcatagaaacaactcagtatatagatccaccagaatttggctttgcgtatcatgatcaatctatcaaacaattatcatttcaacaacagaactctcctaatatataacttcaaaaattcatacaagaacaatccggattgtctgctaatatgatccactacaaggagcaactactaatttcctctataatgacggaatctgaacatcaaacacaagtgctatgaatcaagaagcattatagcaaaaggcacacgaggtataccttaaaagaagccttgagcctcttctccgggtgtcgatcaacgggcaggttatctgacacagtaatccgtgcaagagcctcgtcaacggtatgtgcctcgatgagagaatcatcgcgattggtattggtcaccagaaccatcttttcatactcatcttcccctgccatgcgagtctgtttcttcttagagtcttctgctttcttagccagagccacttgatcttcctcgcgtcttcggatgagctcagcctctgtgaccttaggaaccggcacagtgacgcgattcgccttcttgtctggctttttcaaagccttctccaactctttctcctcctgctcagccagacgcttcgcctccaatttcttagcggcggtctctgccttcttctccgcttcctcttctcgcttcttcaccgctttggatttgggaccttccgcctcgcgccagtattgttcctctttctcccgagtctgacgatccttctgctcagcctccgcggcgttcttacgagatttggcgacctccgccttgctgttcagacccatcttcttcggcatattcgattcgctggggttaattgatctctctcgctctctcgattgttgaattcgcttagggttacgattcaactttgtgtgatagataagaaatgaattaaccgtaccgctcagagctgagaattgactggttcgatcttaacagctttgtttggttaaggcggtggctcaaaagctgggtcaacaaccgatcgatcatttcatttgttaaggtcgttaaccgggattctttttttcaaaaatccactacaatcccttgtccaaagtttagagggccgcttaacggttcaaccaacttaatccgagaaaagcccaagttttgatggagtttgggaaatttgaactattttaaattggcaataaccataatttagtttgctttgtaaagtaattgatcacacactatagacttttacttctcttagacattaggttttgataggaggagaatctagtgtatttttttttttttcacaagaaacaacgtatgtaacaattatatacacttgatgcatattcttaggaagagtttggacttcggaaatattgattttttacatgcaatgttagacatagaacctgataaatttggagtcttagactaatcactataaaacatatatacagtgattgtcatttgattgaaacatccgaccagaggcaagagacacgtttcaggttctatgtcaattacgtgaacaattcttgctaatactaaatgtttcagtaaaatcagatttttaaaatttgaaggggcagaaaacatttaaagagtgataaagtggctcacgtgcagtaccaagctgcgacctctttccaatatctctctctctttctctaattctttttgactaaaaataagtacttttttgaatagtcagtcttaacgggagtggagttagtaaacacttttgtgctctggtctgtgttcaagttttgtctcttctcaaacagagaatcctaaacagtttacgagattcttgattgtctctactcactaatgttttgtaaagatgtgatttttgcttctctctatcttagtcttttttcttgttgatgttgaaatggaagctgtgagtctttaaacgggaatttattgccgaccaaaccccagacaaaaaaacaggtctctggtagattctatttctaactatcgattttaagaaaaaggctttaacttgttttgaaagattggggatttgcaaatg

SEQ ID NO: 18452 - DNA, 3003 bp, Unknown; identical to SEQ ID NO: 18451
  misc_feature (1)..( 3003): 2750-1469P.txt file - cDNA_ID_1817494; gDNA_ID_1621142; Annot_ID_172856

SEQ ID NO: 18453 - DNA, 3003 bp, Unknown
  misc_feature (1)..( 3003): 2750-1469P.txt file - cDNA_ID_1817506; gDNA_ID_1621142; Annot_ID_56675
aattggtcaataggttacagatggttggatgaaatctctgcggctaatttaagttcaatattcttgaagattacacgaccaagaagtcaaatagaatagtacaggaatgatatatcaatcgagtacagcgcgggcccttcgtttttgtcgattatttcattataatgaatttctttccatgataactttatgttttgttatctgtttaacgtattttttgttgataaaaacgtttttttttttacgttattaatttttatagtttatctgcccgacaagaattgtaagttcctcaacattacaaataaattttggttagtttaaatgttttaagcacttcttgtctcctaaacgttatccgcatgtttcaaacgtacaatataattccttcttagaaaaaaaaaatcaaatagatacaaggatataaaagacatcgaggcagaaacaaaacatcgaccaatttcggagtcacactagacaagttgttcacgacacacttgtccccatgcgtttttggatatttctaattcgtttttaattaatgaaaatgttacattaactaaacggcatgtttacagaaaaaaaaaaacaaaataaaacgacatacttatttaataattttattaatgttcttcagtacgactttccaactatttccatatttttctatataaataaatacacacaaaaattagcgatatttatagaaaagagaacagacaagtttatgaaaatcaaaagaaagaattttatttttggtttaaagtttaaactgacgtgtgattaaaggtattaaagagtggcaggtgggtttggttgtacggtcatttattcatatagagtgtgacccaccaactctctgcctgtccttcttttctcttacccccagtacggatccttcttattttatcattatttattttgcattcatatcttaaagacttaaaccttgacgtcacttacggaagccaaaaaaaaaaaaaagacactgaaatctgatgaaagaaaaacctgaaacctaaaaaacatatgaaggcctgtcggctcggcctcaaatcattgcgatttatcttgggccttcacaataataaaggcccatcatatttttgaataagactctagtttctgtattcgtttgtactcatgtatacgctaactactatatacactgatacacaagttaagcaaatgtgaaattaaaatagataaagaaacaaaaaataataaacgttaccaagaagaaaatgagttggtggtgattaatttgcggctaattttgggggaatataaaaagaaaaaattaccgtattttaaaaccggtctatataggatcgagcttgctaacaccattttagtaagagtcttgattggttcgctttaatttttcatttttgtatctgactgccgcaaactaagtaatatcaacactcaaaagtcacgataataaacattataaaaccttttcttcgctgtcctacgaacgtaccatattacttgattccgaaccagacaatattagacagacaaccaaactaacacaaatcattattctataagctgcggtctaacctactattcaaaatttagttttacttcacgtattaaagaaaggtacgaataacagcgatgagactggattttttttaacatggtaattaatataacgataagtacataattaaacaatactacaaaataaaactaaaaaacaatttcagcgacatctttgattacagattctaagaaaacaccagagaaagttagattaaaatctccctgagcttgttgtgtatcactaaacctcataaacgatgccgttcttggctcgccgactcgattatctggtgagatattctggaaaatagcgaagaatctgagaaagacaaaaataatcagagcaagaagataacatatccgagatgcgttgaagaacaagtgatatgctgcaacttgaagacaatacatctttttctcttcttcttcttgtctatttcgagtattaaaaggttaaaatctcagaagatgatgtttttttttcttagcatcgagatgtgtgtatatataatagtatacgtgtgtgtgtgatgtttgttgtgtatatatgtaatccgtaatcgcatgtacgcgtgtatctaacgcacacagacaatcagacatactcgacgacaccactgtggtccgaacaaagcaataaatgttcaaagccgatagttgtctctcattgatttggtactgtagtccggtttggatggtataccaggcgatacaacctattacctaagtggaggagattaagatccgattaattgtttaatcgtctgaataattaatgcaaaccggaaaaaaccggttatatgtttatacatgtaaggaaattgaatacacgtagatacgaaattgatatgcatttcaatacgtgtctggtgattctgctcaactgcttagatgtagacatctcaacttgtaaccagaagatactgaaacctttattattgcatttctaaattttagaattctattttcttatatactatatggaatactttaatgccacataataataaatgagagaattcaggtcattatatgtcattttggagtgtaggaccaaaatggcactaacattttcaattttattttattttgtgaaaaacaattttgagaaactttaaaaagtgtattttttttcctctggtttggactttggagggaaaagtaatcaaaagtgtattcttaaaattcaaacaagaaaaattcaaaatagagacaggaaaaagatatgtagccaatgataaaatgccaggtgtaaagttctgttttgtctttttgatttcccttctgcaacaacttacaggcaatcggacaattccagagctaaaaaaccctaatcttctcgggcttgtcatctccaaaattcagggttcaatttcttcaccatagaagatatagcgttatctccggcgtctaaggggactttagggacattcttgtggtggagaaatg

SEQ ID NO: 18454 - DNA, 3000 bp, Unknown; identical to SEQ ID NO: 7388
  misc_feature (1)..( 3000): 2750-1469P.txt file - cDNA_ID_1817513; gDNA_ID_1621142; Annot_ID_56671

SEQ ID NO: 18455 - DNA, 3003 bp, Unknown
  misc_feature (1)..( 3003): 2750-1469P.txt file - cDNA_ID_1817533; gDNA_ID_1621142; Annot_ID_56664
acatgttttcggatgatgggagactaggaaaagccgaaaaacatcatcttgaggtgattttcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgtaagtaaaatgtaacttttataaaagagtgtatgttatacacagaaattgtacactaaataagccaaacagaaaaaaaaaaaattatgttgaatactatatattgactaaattgcgagatctacacatatataatctaagtatattaattatttgttattctggtgttttttacaggaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtaaaacatatagggaatacatatgttttttatttacataagatttaacgtttatagctagtaagtttatgcatgagcttcgttaacaaaataaaacacatggttttggtttgtggctacatatgatacaacctaaatttttttgtaatacttttttgtttaaaataccaggacaactagtaaatttatacataggtttccttaacaaaatctcgatacaattttgcattatatattaagaaatattgatgattggacaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatgatg

SEQ ID NO: 18456 - DNA, 3003 bp, Unknown
  misc_feature (1)..( 3003): 2750-1469P.txt file - cDNA_ID_1817533; gDNA_ID_1621142; Annot_ID_172879
tcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgtaagtaaaatgtaacttttataaaagagtgtatgttatacacagaaattgtacactaaataagccaaacagaaaaaaaaaaaattatgttgaatactatatattgactaaattgcgagatctacacatatataatctaagtatattaattatttgttattctggtgttttttacaggaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtaaaacatatagggaatacatatgttttttatttacataagatttaacgtttatagctagtaagtttatgcatgagcttcgttaacaaaataaaacacatggttttggtttgtggctacatatgatacaacctaaatttttttgtaatacttttttgtttaaaataccaggacaactagtaaatttatacataggtttccttaacaaaatctcgatacaattttgcattatatattaagaaatattgatgattggacaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatgatgagctttaccacatcattaccatacccttttcacatcctactagtctttatcctctccatg

SEQ ID NO: 18457 - DNA, 3003 bp, Unknown
  misc_feature (1)..( 3003): 2750-1469P.txt file - cDNA_ID_1817537; gDNA_ID_1621142; Annot_ID_56663
cagtgcaacttgatcattattgaaacagatttattatagcgttttacagcatctattgattgtaattttgtacttatcttacaataagatatatataaatatatttttttcctcacaataagattcaatctaagaatatgaatttattgacgaagatgtaaaataaatgaaactggctttttttatgaagatgtatatcaagaaatgataataattcatagaagaaaaaatgataattataaagaagtagaccctaaaataaatagttaaccccaaagtggttgagtgggggatcacatgcagcaaattaacggcggtggggaagaaggtctgagaaattaaccaagagatggctcatcctcagccattcacttagccatcgagagatctcaaacccattaatcatttaacttactgaacatatctaataaatgtgtgtttatatatgtaatgagttagacgccaaaaataaattatagactagagacatgtcctgctagctggatcctagtcatcacggtctcacgagcagtattgcatccaattttcgatcacaatatttacaaaaaattcccaccactctaaagttgtagtttattctctatatatagagtaacataaattgattggacatgcaaatcaagtcaaacataaaagtaaacaaaaccctatctcttcctatatatggccgactcgactcggccgcttctctcagatttcaactcgtccgagtcaaatcttccgccaccaagatcccttgaggagacgatagagcgatgcattggagacttcgggtgggcacagtttctccaagccgctttagtctcattcgcttggttcttcgacgctcaacaaacattcatcaccgtcttcaccgactcacaacccatgtggcactgtgacaactcggaccgagtcgactcagtatgcaacacatcctcctccaacctctgcaccttacccaaccaaacctggtcttgggacttgaacccacacgtttcaatcatttccgagtgggggctacaatgcgccggctcgttcctcaagggatttcctgcaagctcattcttcctcggctgtctaatcggcggcttagctctctctacactcgccgactcatcgctcggtcgtaagaacatgctcttgttgtcgtgtctcataatgtctctctcttccatgttaacagctttctcaacgagcatttgggtttatgcgtttttgagattcttgaacgggtgtggccgagccacgatcgggacttgcgcgcttgttctatcaacggagttagtcggtaaaaaatggcgaggacaagttggagcgatgggtttcttttgcttcacgctagggtttttatcgcttccgatgttaggttacattaatgaagggaattcttggaggaatctgtatgtttggacatcgataccgactttaatctattgctgtttagttcggagtttcgtccgggaatctcctagatggcttatcgtaaagggtcgtaaagaagaagccgtctcaattctccaaagcattgcttctaatgcaatcactatgagcttcacaaacttatgttttgaagtagaaaatgatcaatccaagtcaaatcctgatgtttatgatgcgttaaagatcttggtgaggaaaagttggtcgtttagaagattattagcggcaatggtggttggattcggtatcggtatggtttattatggaatgccattagctttaacgaatctaaacttcaatctttacttaggggttgtgttcaacgccttgtctgagttcccagcttttctgataacgtttttcttcattgataaaatcaataggagagatgcgttgatcggatttacagctctaagtggaatctctagcgctctaatcgcggtgttaggacaacaactagggtcattacagattgtgttagagctcgtttcgtttttcagcgcatgcaccgcatttaacatgacgcttatttacacaattgaaatgtttccgacatgtgtgaggaactcggcgatttcgatggtgaggcaagcattggtgtttggcggcgtgtttagtccagtgatggttgctgctggtcgggaaaatcagttttggtcgtatgggttgtttggtttgatcataggattgtgtggattgtttgtgtttggattgccggagactagaggaagtgttttatgcgacactatggacgaggaggagtataagactttggcaaaaagacaatttattggttgatacttgatactgttgtcttttgttgtaatggttaaaaagtttgcaggcttaaaccagttcggtattgattcaaatcaattctgattttaatacttataaaccacgggttaactccttacattataagtgactgtctcatctgtaccggaccataaaccaaattcaaccaaccataatccccctttcaattttgatctattcaacaatgactcatgcatactttatttcccttatctcatttccatattcgaaatgtaagctctaaaatggtactcttaactgaaactaaaatatatataaaaaaaaaaaaatctacatttcttgaagaaacatttttaaaattaactatagttgctaaattactattttagattgacatatatatatatgtagaccaactaattaacccactgaaatgcaaagagatggtctgaaaatcaaaacagacatctaaacgtggttacctacccaagagctcaccagcctatagtatcccattccctttatattgaatcactttagattatcttttctctttcatctttccaattccactctatattaaagaaatattattttaagaataaacaggatcgtattttcatcatatgccaatatgttatttggatttaagattgttttcgaatctataaatactaattaacacaacaaacaatttccaaatatcgtagtgttcataacgaaacgagcacacaactcactaaacactcaaacaaaaatacaaacattaagatgatgatg

SEQ ID NO: 18458 - DNA, 3000 bp, Unknown; identical to SEQ ID NO: 7401
  misc_feature (1)..( 3000): 2750-1469P.txt file - cDNA_ID_1817544; gDNA_ID_1621143; Annot_ID_56697

SEQ ID NO: 18459 - DNA, 3000 bp, Unknown; identical to SEQ ID NO: 7401
  misc_feature (1)..( 3000): 2750-1469P.txt file - cDNA_ID_1817544; gDNA_ID_2214460; Annot_ID_182719

SEQ ID NO: 18460 - DNA, 3000 bp, Unknown; identical to SEQ ID NO: 7401
  misc_feature (1)..( 3000): 2750-1469P.txt file - cDNA_ID_1817544; gDNA_ID_1621143; Annot_ID_172935

SEQ ID NO: 18461 - DNA, 3000 bp, Unknown; identical to SEQ ID NO: 7396
  misc_feature (1)..( 3000): 2750-1469P.txt file - cDNA_ID_1817562; gDNA_ID_1621143; Annot_ID_56687

SEQ ID NO: 18462 - DNA, 3000 bp, Unknown; identical to SEQ ID NO: 7396
  misc_feature (1)..( 3000): 2750-1469P.txt file - cDNA_ID_1817562; gDNA_ID_1621143; Annot_ID_172922

SEQ ID NO: 18463 - DNA, 3000 bp, Unknown; identical to SEQ ID NO: 7392
  misc_feature (1)..( 3000): 2750-1469P.txt file - cDNA_ID_1817565; gDNA_ID_1621143; Annot_ID_56684

SEQ ID NO: 18464 - DNA, 3000 bp, Unknown; identical to SEQ ID NO: 7419
  misc_feature (1)..( 3000): 2750-1469P.txt file - cDNA_ID_1817596; gDNA_ID_1621144; Annot_ID_56716

SEQ ID NO: 18465 - DNA, 3000 bp, Unknown; identical to SEQ ID NO: 7419
  misc_feature (1)..( 3000): 2750-1469P.txt file - cDNA_ID_1817596; gDNA_ID_1621144; Annot_ID_172973

SEQ ID NO: 18466 - DNA, 3003 bp, Unknown
  misc_feature (1)..( 3003): 2750-1469P.txt file - cDNA_ID_1817611; gDNA_ID_1621144; Annot_ID_56711
tcgctttttgctatttccttgtaacttaaaagaagaaaaaatgagaggtagcggagcaaagatcgccggcgttttgccgttgtttatgctattcatcgccggaacaatctccgcctttgaagacatagagaggttgaggatttggccgttaccggcacaagttagccacggtggccggagaatgtatctaagtggagatttcaagcttgttacggagggaagcaaatatggagacgcctcagggattttgaaagaaggatttgatagaatgcttggtgttgtgaggctgagccacgtcatctccggtgaccggaattcttcaggcaccggtggatctgctttgcttcagggacttcacgtcatcatctcctcctctaccgatgaggttagtttcatctatcaatctacaacaacaatttttcttaatgatatatcttcaagttgatgaaaaaagctttacgtttaatgtcattataagttacaatcatctcattattaccacaatcaaagacaaatcaattgtctttatctttaacaaaaaaaaaatcaattgtctctattggttataaattgtatcctctttttttggatatgtcattttcacaaatgttgcaacatattatttttttcttttattttattttcttttctttttcctaaaacactttctatccactagtccacttatatattatttatgaaaaaaagagaaagaaataatatttctatattatcctaaaaaatatttaatgaatttcatcgatattttggatataatcatttctttaaatattaaaattttgttaatattacagcatgaaaattgtactaacgtttagttcagagtctgtctggttaaagcaaatttttctatatttttatttagaaaatttagaaactaaattagacgaattgacaaaaacaaatatatataattttatgaagtttagagtttataattattttcattatacgtagaactaatctgagcagttttcattatttagtgcattcccttttgattttggttaaattcataccaaaactaaaagagattgaatataatgggtgtatatttttcctgaaatcataagaatttgactaaaatttttagtaaattcacaagtaaaaaaagaagaagtagaaattcttctattgatacgtttattttgtgttctggagaaaaatatttctcattttttttttttccacttttccatcaaagttatgctgaaaactttttcattttttttaatcctggttggtattaagaaaaattgagacatatatttcaattgttttcctctaacatgtttaccattcaccaattggtattatttgttttattgtcttcatttataactatttttcttttgtcaactcttgataaacaatttttctctttcttaacagaagttattttagaatatattttacaaattggatcctagtttacgcaactttgtccatgagaattgagatgtgcgtagatgtatcgattatccaacttcttatcttttttttatttttttgggttgcttggctttgttgattggtgtctggcgacttggttgtgtggtggtccaccaactcacggacatcctcgttatcttcaatcagatcattgaatatatatttgttctattttaagatcattgagaatattttattccgagatccagattttaatcagatcatttcaagatttcacgtaatataaatcacaaataagtggaaaaaaactctataaaattatagtcacaagtggtagctagtaatgaaactttcatattggttgaaatacgtatcaattatattaattaagtcttttgacaaccatacgatatagctggtgcaagtgtgcaagattattctagattctggtcctaaataaaaaaatatttatctatttataaagatatgaaagtttaatagtacaaccatatatcattgagaaaatatgataatgtctaaattttcatactaaaatagtatacatcatggcctaatcttaaatcttaaatatgaaactaatttcattgtatatacattatttcatgttcttgttatgaaattaatcatctgaacattgacgtaaatttaataatatttaaaatgggaaacccccccagtaaaaaaaaaaaagatgattgaataatatagaaaatattgtttgtactaaaaatccaacaaaggtcgttaaaatttgtgtaattttcgtgttgcagttggaatatggagcagacgagtcgtacaaattagtggttccatctccagagaagccgtcttatgcacaacttgaggttagttggtaccattgaacacctaaccccagcttttgtcactttctctaactacttatatccataaagatttaaatgtaaattcagctttataaccataaaagaacctaactttgaagattttgttttctttaatagttgagttcgacatgcaatcaaattttcaccgtaaaatacatgtttcagaaaagaaaagaaaaaaaatgaaacacttctgttgtgttttgttttatgatctagtacttttgcagcttccttttaaatgtaatttttttttcacccactatagagacccatgtaacataggtagggacatgaaatggtgtactccacgtgagctgtattaaacatgatgggataattagtgtggtcatattttgttttttcctctataagaatacaaatgcttaagcacaagtcgttagctatttattatgtcaatatagagaaaggtacaaaattattgtgaaagataagtgtgattcccactagtgttggactgttgtgtttaatcaaatattatatgaaaagaaaaataatacaatctccattgatatttatgttaccacgcgtgcaggccaagagtgtttatggtgcattgcacggtctacaggtttgtgtttgctatttttccaatttggttatcattatagttaattaaagatttgagttactgaagaaaatgaaattattgtaaatg

SEQ ID NO: 18467 - DNA, 3000 bp, Unknown; identical to SEQ ID NO: 7416
  misc_feature (1)..( 3000): 2750-1469P.txt file - cDNA_ID_1817619; gDNA_ID_1621144; Annot_ID_56709

SEQ ID NO: 18468 - DNA, 3000 bp, Unknown; identical to SEQ ID NO: 7415
  misc_feature (1)..( 3000): 2750-1469P.txt file - cDNA_ID_1817627; gDNA_ID_1621144; Annot_ID_56707

SEQ ID NO: 18469 - DNA, 3000 bp, Unknown; identical to SEQ ID NO: 7413
  misc_feature (1)..( 3000): 2750-1469P.txt file - cDNA_ID_1817639; gDNA_ID_1621144; Annot_ID_56704

SEQ ID NO: 18470 - DNA, 3000 bp, Unknown; identical to SEQ ID NO: 7434
  misc_feature (1)..( 3000): 2750-1469P.txt file - cDNA_ID_1817658; gDNA_ID_1621145; Annot_ID_56729

SEQ ID NO: 18471 - DNA, 3000 bp, Unknown
  misc_feature (1)..( 3000): 2750-1469P.txt file - cDNA_ID_1817670; gDNA_ID_1621145; Annot_ID_56726
agcattccaggtttgatccagtttgtatgcatgtggataccagtagaggcacaacacttggggtgctaaaataacctcgaattaacatggttcatatttctgttgtaccatattcaggtatatacaaactttatgatctagatttaattctttgtttacatagttcctggcaattaaattcgttgttagtatttataaatcgttataaaacggtacgagttcctttcaaataatcttgcaaatgattcggccagctgaggaagaaagtatgtttggtgggtttagaaatcaattgatctgtgtttttgatgatataatgagatgtaaatttaaagagtatatataggttctacacgattaggtcaatcatatcttgatggccaagggaaatttattggtactttaactaattaggaattaatcattaatgaattttgtcaagatttaaggaagtgattatgcaatagtttttagtactacttaataatatccattttagtaagaaattaatgcaatatttgaattgttgatgaaaaatttgttcattgtcctaatgagaactaggttttaacacgcggtttaccgcgggcaatcggtttatttggttcttatactaaatatttgaataaatttgatatcctaaacttataaatataaatttctagtgattagtgaagaatcgtaatatatgatttagatattattaattattgattttgtgattgaatatagtgtttttagggatggaatgtgattatattttgatttcaaaaacgacatagattccttatttttgttgaacggtttagattgaagggaattaattttattgaatggtttagattgaatcggatcatataaagtttaggagattgttaagaccaaattacccttaatgattttgaatagcaaagaataaaatccaaatttgaaatcaaaattgaggccaaattagacaaaatttcaatttgtacttcccttttaataataaagggatatcttgtttcattaaatttgtaaggactaaacatataattaggaagttgactaaggatttttcaacccagaatacttactaaaaatgtatatatggataactaaatttaaatacatctttcttcaatatattttcttattttacatttttataaaaaaaaattaatataagaatcgtaaattttaaaaatatcattcaatgagataggtattgtgattaaatggctatcgtacttaaagatgaagtactaataaatttggagagattaataatcaattattttatttttttacaaatttaataaaatagaaatttatatgtagatactttttatattatttagtgacaaaatatttagaaaactttctatattttcaaatcttctttaattttcatatattgttttttccattttacaaaaaatctaaaaaatagaagataataataatttcataaatgaagtcattatcctaataaagttttcgatctactaattctctattgagaatctctaaaatccagtattttggtgtcccttgacactaggggtggtgtcgattgacacctacgcaaatttacgtctccaaattgcttttgcatcataagttctctgttttgatccagaatgttccataatctcaaaatgcatcccaaacatgtaaagacctgaaaaagactataaaagagtctagaaataacaaaaaaactctaaaaaccagtatttttatgcccggtccgaccggttgaaccgtgacccgaacatttttttggtttgggtttagtgctaaaacctgacaagttcaaaaccgtaaaaacccacaaaaactcaccattaacccgtgactcggttaaaccggacgggtgtgggttttaaaaattctcttgattttggaataaaatatgagatttaagactttattcaatcatttgtagaaatgttttcagttcttaaactcatttgatgttttagattttgatgaagacttcacaatgccgccttaaaaaatgaatcgaatggtgagtgagacacccgatattagttgtgtgaattcacgatgttttattaatttatttccgtcattggtgatcttctaatatatttgttacggtattagacatttagttagatttacaaaatttaatcactttattattattgtttggtataaaggattttatatttattaaacataatctgattttatattttataaacatgttatgattatttttgtttttaaattataagaactcttttttttttgtgtgcaaaacatgttttcattcattctataacgcccgtgaaccggaaaattggttagggtttgtatttaaatcatccggtttaatcggttgggttaattgaaaactctatagtgtgcctataaaagaaataaactcgaaattagggctttagttatccacttttcgttttataaaggagaaaaagtcagagaaggagaagaaccagaatcgttagggtttgggaggaaacgttttcgacatataaaatcactgtcaaaggtaacgaaatttggtagggttatttccaagtcttttattgttactctccagtttacagaagtgattttggattacaattggttgagttattcgcagttttgtgagacacgttttctcagacgcgaattaggaccagcggggattgtaactgcgatcgtagtctcatctggcttccgatcggcacgaatttttgtgggaagctttgcgacgtctaaggctagcgtttcatcggagggatttaataattaacagttagtgtgtattttagggtttcatctttgagactgtttgtttttgttttttatgtacagtttgcttcaaaggttacttttggttgtgacatgttgtaggacgtttctggactgtttcagacgcaaggagagtctctcctggctttaatcgttgttagaataattttgttaaggagagtctcttctgggtttaatgactcgagagttggtttgggttgtgttctgatg

SEQ ID NO: 18472 - DNA, 3000 bp, Unknown; identical to SEQ ID NO: 18471
  misc_feature (1)..( 3000): 2750-1469P.txt file - cDNA_ID_1817670; gDNA_ID_2926138; Annot_ID_138930

SEQ ID NO: 18473 - DNA, 3000 bp, Unknown; identical to SEQ ID NO: 7465
  misc_feature (1)..( 3000): 2750-1469P.txt file - cDNA_ID_1817699; gDNA_ID_1621146; Annot_ID_56766

SEQ ID NO: 18474 - DNA, 3003 bp, Unknown
  misc_feature (1)..( 3003): 2750-1469P.txt file - cDNA_ID_1817711; gDNA_ID_1621146; Annot_ID_56762
aacgtcgtatcccggaacagtctactccgacgaaagattcaaaatgttaaagaatccgaaaccttcaaaaagagtgagagagagagatttgaatttgcatttaccgggagaggcgaatcagtggctttaaatttcccttgccgtctcttagcatcgacgggattaagagccgccgcaacaactttaatcaaaacctgatcttctttaatctccggcacaacaatgttactctccagcttcagaacatcaactccgccgtagtcactatacacccacgccttcatctctttcggaatcgaagcatccgccgtgacattgaccgccgctgaagcgctctgagagctcgccgagattttcaagaatttcttgctgactgtttgcacgcaagatccgaatctaactctgttgatttggtaaaccggcgattttgttgtgagagaacaataatgaagaagaggcgtctcacggcggagtacgggagttgtggcggtggttgttgcaagcgctgcgttcatttttcagtctgccactagttttgtctaaaaggcttatctctttcgctttcctctgtttttaaaatactctgtttcgtggctttctttgattggttgatattttcttgtggttgtcattttaatgtttatatcacaaaaattgtggcccataatcgtttttgatctggtgctgattttgtgattcatctttgtttcatttcttttagaactacagaagtctagaacaatcacaaaacacttcggtttttgaacattacaatgtacaatttttacgtaagaagatacaatcgacattaatgggcctaaactttaaattgggctttatgaataagcccaacagttgagaaaacgcagtactaaaagtcgatcatctaggcacgatgagattaaccatagaaaccgcgcacaacgaagcacgatcagtacacgtgttaaattatgattgggtccttggtagagattaaagatccaccgtccatttccccagaactagaaaaaagagaagggagaaaactttctccgagctcgattgtttttggaaatcgtcaatcagatatttctcgttcgtctccgccttcgatttatccaaaggtaagctattgataaaaaaaactaaatccctgatatttgattttgaatctcttatactcatacattgctgttcatgtgttgttgtcttgatttcaaatctgcccagctttttgtaataatgatgcatgcactatgtttaatgcttgagttcgatttccctttgtttcgggttttgcctcattgttataactcggtcgaaagtcatctcctttacatgaaatttctgttgttaagattatatggaatgtccttcattgttctgctttctaattcttgtgtcaatcttatctaaatcttataaatcagcatttgcattagaagatttgatctattttaaattggttaagaagtgaaatgattgattgtcaatgcaggctcttgttattgaaaatggcagattccaccaaagcagggttgaagaagccagctttcactaaggttgatcagctgcgtcctgggactagcggacacaatgtcaatgtgaagattgtcagcacgaaaatggtgttacagaaaggtcgtgctgatggtcctcaagctcgccagttgcggatttctgaatgcattgttggtgacgagacaggagtgatcgtctttaccgcaagaaatgaccaaggtactttacttcagtcaataaatcatttgaaaaacaaaacgttcatataacggtttgtgtacttgattctagtaatgttacagggtagctagtaatatcttgatttggttttgtgtgtagtggacttaatgaaagagggatcaactgtaactctacgcaatgcgaaaatcgacatgtataaaggatcaatgaggctagctgtagacaagtggggtcgtgttgaagtcacagagcctgcgagcttcaaagtgaaagaagacaccaacatgtcccttatcgagtatgagctcgtaaacgtcgttgaatgagtgacaaattcctcgaaataccactaggagaaacgccctcaagaataaacaagtcaaatccgtaaccgtttatgttagcgtcaagaaaagagttaaaccctgatcagctgatgtcttgcactaagctatgtaagagtgatgatggctctaaaagttgaatgcagagcttttggcttaggttatgacttcgtgataccttttcttttgtaatgtcatcatacacgctaaggcttttgtgctacattattactctctttgtctttgcctcgtttcaaaaaatccatattcttagtgaagtaaacagtaactgcaagcctctgttgatcaacgaccataatgattatctttctattttggggttatatataaaaatagaagtttaaccaaaatgcaactcgagatgggcttgaatcactttgttaatgattgtggagaagaaatgttgtcgtgtgaagtgatgggacttcaaatgtgtgtcatcattgcgtcatgactgatggcttcttggtttcctttgtcttttaatatgtttatcttcttacatttttatatgtttgtccttgtcacgtatcggtaatgaaacttcaaacttgatataataaacgaataataggtatgaatactaaaatagttagtgaagaaacagtttctaccaacaaaaagtaatgtatcttttcatgagtgttaagtgggcaatgtttagtgcgtttagtcctttttagtctttagagctgtttccttatctcttcctcttaatcaaaattttctaatacgatttattcagagattttaatagagtaaaatgtgacatttcggtattgattgattcatagattaaaaactatataagccttggttccaacttccaacttccaacttagaaatgtgtatatacacacatttgcatcgataataactcaccaacactctctctgtctccatcgaatgtttcctctaactctcaacaaaaatg

SEQ ID NO: 18475 - DNA, 3003 bp, Unknown; identical to SEQ ID NO: 18474
  misc_feature (1)..( 3003): 2750-1469P.txt file - cDNA_ID_1817711; gDNA_ID_1621146; Annot_ID_173050

SEQ ID NO: 18476 - DNA, 3000 bp, Unknown; identical to SEQ ID NO: 7443
  misc_feature (1)..( 3000): 2750-1469P.txt file - cDNA_ID_1817729; gDNA_ID_1621146; Annot_ID_56752

SEQ ID NO: 18477 - DNA, 3000 bp, Unknown; identical to SEQ ID NO: 7459
  misc_feature (1)..( 3000): 2750-1469P.txt file - cDNA_ID_1817733; gDNA_ID_1621146; Annot_ID_56751

SEQ ID NO: 18478 - DNA, 3000 bp, Unknown; identical to SEQ ID NO: 7445
  misc_feature (1)..( 3000): 2750-1469P.txt file - cDNA_ID_1817754; gDNA_ID_1621146; Annot_ID_56745

SEQ ID NO: 18479 - DNA, 3000 bp, Unknown; identical to SEQ ID NO: 7445
  misc_feature (1)..( 3000): 2750-1469P.txt file - cDNA_ID_1817754; gDNA_ID_1621146; Annot_ID_173033

SEQ ID NO: 18480 - DNA, 3000 bp, Unknown; identical to SEQ ID NO: 7445
  misc_feature (1)..( 3000): 2750-1469P.txt file - cDNA_ID_1817754; gDNA_ID_1620832; Annot_ID_169719

SEQ ID NO: 18481 - DNA, 1588 bp, Unknown; identical to SEQ ID NO: 7435
  misc_feature (1)..( 1588): 2750-1469P.txt file - cDNA_ID_1817788; gDNA_ID_1621146; Annot_ID_56733

SEQ ID NO: 18482 - DNA, 3003 bp, Unknown
  misc_feature (1)..( 3003): 2750-1469P.txt file - cDNA_ID_1817799; gDNA_ID_2926128; Annot_ID_138672
ttttgatttacacttttagtaatagtagtttgttaagaaaacatgcataaagcataattctatgtgtgtgtatttcacttcacatatagcatatatatgaaaacttctctctatttcctagttaaaatctctacagtcgtagttaattggctaggattaaggaagttaagcgatcatttagcacatatgtattgtgaagttttgttgaatgtttacaaggtttgtttccaagtgattgagatgacaaatcttcctctgttcgcaacaaccacgttgttttacacttattcccaagcatcatttttttttttggtttatcttttaattgcaatatacatatatagtacacacatacacgagatatatacaaacgtatgcaattgcattctataaattgatgttagtgaaggatatttccaatattacaagcaagcatttatttatatgttatgtacaatgtcttttgtgttataattagattgttttattcagcatatatttttctaaatcggtggtcttgattgatcaattactcctgtcgtgtttttttggcattattgaatcaacaacatttgctcgaattcggaaactcttccaattattaaagattgctgaaaatatcattttatctagattcttatcactctttcatatttgttggcattattatccatttcaatttcgttataaaaaaaacaggtggtaagtttgcaaactgagctttcatatctacaagcacacttagcaactctagagctgccacaacctcaaccaccacaggttccggtgtcatcttcaggatctctacaggctctttccataacggacctcccaacaatatcaccgtcggtgtacgacctctcctccatcttcgagccggtcatgtcctccacttgggccatgcagcaacaaccacgaccgtctgatcatctcttcggcgtcccgtcatcgtccaatatgggcggaggcggtgagctccaagcactggcgcgtgagtttattcacggtgggcaaatgccagctcagccatcgccgggaaccagtggttctgcctcgtcagtgataaaacgagaatgaagttatttttatcgtatgtttgtttatttggaccgtaagagatctatagttagccatatgtttctccttgtaatatatatacttggtcgaattcgtatttaaattgttgtctagaatgttaatataagaactatatgatttacattgattaaatggagtatcttataggccaatatgttgaagttgctttggtctcttggaccatcgaatatgttgttttaatcagcctagagtacaccggttctccacaacttgggtggaatcttgagcgtgaaggaggcttgattctggcgcgagacacgaaccaatgagtctcatttctcattttccctatcacttatattgggccttaaatgggttcaataaagtttttttttcttatatcaagcagcccaaaatattatttaaacccgactcaattgagtttgatactctggtttgctttgtagtccacactattttaacaacatcttcgaagcatgcatttgatttaacaatcttcctaatttactagagaatttgagccaattttgtcttttttttcaccatttttataaaagctggttttcaacttgtgttctcttagcatttcccgcctctacatcaactagaaggccctacacggaccttgaacatgatcttagcgatgtctaaggactaagctacataaaccaatgagtaaaatacatatggattggacaataatcaccaatcaaaaccccaacgtcgattgcatagccgataagtagtaccacaatggtgagaggaggatagtgccagcggctatgaagggtcgacgtaaaccaaaccttgatgagacactgtaaaacacgactattggttgaacaatcagttccaatcgaggctcacaaagtcaaagcatgcttgtaagatatttggagtaattgaaggtacggtgtaatcagagcgtttcttgaattgccgaaatgaagtttagccctatggctatagaagcaataagccatttttatattcataactttagaggtattaataagaaacatatataaatttttttataaatgtattgacaaaaaatcaagtaaaaataagcaagatgcaaaacataagcaacatttctaattaatattatataattttttataatgattttatacatgaaaaaatctctaattaatagatatgacacatgtgtgatcatgtgagttatcaattttgaataattttttaatactaaattgacatattgtttgatcagaaaatgtcattttttgaaactaagtgaatgaataaagggttgagctaagcaatatataattgttgatgatgaaataataacatgaatacaaattatatttatatgtgtgtatcaattagtgtaatatttaagagagaaccattggagtagagccttacaagacaatatatgatcaccattggaaaactttaaagctattactatggtaaaaactcaattgcttgaattcgaattcaagtaatcaaaatcttattattagctcaaatctcaagttcctattactactctatacatatacatgtgtattaatctatgttatcaccaaaatagaaacaattagatatagcaagtgaccactattttccttctaagacaccatacgaactaatttttatcaaaaacaaattatcaagctctattacaattccgcatgtgtgctatacattagattaattaaaagaaattaaatctgttttcactccatttatcaaaagtaacatctttaacgaatcaaacccataaggtactcttactctctattaatagaggagaatgtgtcatcttctcattactcaataagcatacttatcatatacacaataccacaatgataaggtcaaaatgttcttgccatcatcatctacttgttcttgttatggttgttctttggatatcaccaagatatg

SEQ ID NO: 18483 - DNA, 3003 bp, Unknown; identical to SEQ ID NO: 18482
  misc_feature (1)..( 3003): 2750-1469P.txt file - cDNA_ID_1817799; gDNA_ID_1621147; Annot_ID_56793

SEQ ID NO: 18484 - DNA, 3000 bp, Unknown; identical to SEQ ID NO: 7473
  misc_feature (1)..( 3000): 2750-1469P.txt file - cDNA_ID_1817809; gDNA_ID_2926128; Annot_ID_138669

SEQ ID NO: 18485 - DNA, 3000 bp, Unknown; identical to SEQ ID NO: 7473
  misc_feature (1)..( 3000): 2750-1469P.txt file - cDNA_ID_1817809; gDNA_ID_1621147; Annot_ID_56790

SEQ ID NO: 18486 - DNA, 3000 bp, Unknown
  misc_feature (1)..( 3000): 2750-1469P.txt file - cDNA_ID_1817817; gDNA_ID_2926128; Annot_ID_138667
aatgtttgtgtgtaaggtagattgagatatatgaatggtcaaatcggaaataaaacagtatatgttcttaaataagcttctcctttgttcaacttttttgctttcatttccgttacatgatttcgcgattaattactttttataattagtcaacttcgacgccttgtgtcgtcctcgattttaatgttctgtctttctctgcattcatagtttatcttatttcatttcatatccttacttcttttttctacaaacaataatttctagacgaattgaaacaaatttccaaaactttatgagtatatataggatatttttagtggcaaaggacgacttaaattgtaacgaaaagaatttgaacttttttccattagtccctacgatgaatatttcatcctatagaacatcatatgaattgattacttaatgaagttaaatttttgaaaactctattagggacaatgtcccacatcggaagttgagtaggatcttaagtggtatatataagatatgagcctctccacctattgccaattagttttacgttggaagcccacagtctgatatggtatcagaccccgatccgcacatactcaacccgatccacatcggtccggcccaatacttggcccgccgatccatgcccaaacatatcgagatcaatggctagaagaaccatcatctcgagggggcgtattagggataatatcccacatcggaagttgaataagatcttaagtggtatatataagatatgggcctcttcacctattgccaattggttttaggttggaaacccacactctaatatggtatcagagcctgatccgcacatactcaacccgatccacatcggtccggcccaatacttggcccgccgatccatgcccaaacatatcgagatcaatggctagaagaaccatcatctcgagggggcgtattagggacaatgtcccacatcgaaagttgagtaggatcttaagtgatatatataagatatgagcctttccatctattgccaattggttttatgttggaagcccacactctaataaactcaatacaaatactaaagttgcaaacaactatactatatttgcttgaagttctattgtgataggattttgacttacaaaaatcatattctatgtctacactatatattgtgaaaccggatagccataatatttacaaaaacttaaactaatttcagatataaataaatttaaatttcactatgacctagtaattatcacgaacaattgggaagttaccacaaaatggtggtcctgtattatggaatttagcgaaaccacacacttgcgggtaaaaataatgatgacaaaatgatatacattggaatgtagagaaagtatatacaaatactaataaatagaaaagggcatggaattgacgaggatcgagggaaagtgtggtgtggcagaaatgttattaagtgtgaaaacaactgatgaatgagcctttgcttaatcacttccatgcacaagtccctttcctcttcctctctctcccacttcatcgaactttgcgtcctttaaagaaaagaaaaaacaaaacatttttcatccaattgaattcaaaccgtaaccagattagatttaacttcgtttattttacattatcttcttcttcttattttgcggagaagacttgtacaatgacctcaatacgctgaagagttggattcactgcgagtgtatatgtgcatatagaaacaaaatatctagctatatgaccacttttaactctaaatatgggtgtaatatgccaaggactttctggagatccaccacaacacacattcaagttcaagttctgctgcttttaggtctatgaaaacaacaccaaccttattttcatattgttctctctttatctcatgcataagtatattttcatattgttccctctttattttcatgcttttagttgatattttttttgttattgtattatcattagtgcgacgacacaaagtcacaaaccatgtaacaaaatgcttaaccaaaatagaaaaccttaacaattccaatatattttctgttattgcattatcaattatcatcaaatttttttccactgttgcattatcatcattgcgacgacacaaggtcacaaaccatgtaacaaaatgcataaccaaaatagaaaaccttaacaattccaactttaacatgtgaattaatattatcttaatttttggatgttcgacattcaaataaactcctaattaaaccctatagatatggttaatcttctatacatgtgtcacgtacgacacttattagccaaattgaagttttgttttttccgcaaatatataagcggtttaaatagttggtaaaaaaaaaaaaaagttagcatgtttgtcgtatgtacatgtttgatgctgcacaaatcttgtcgttataaaactttgaaatctttatatctattattcctcaccgatcggctactaattcaatggtacttgataatgataattagtcccaaagtagagtttttatctgattatatagaaacaaagactagttccggtttgatatatagaagaaagaaaaaggatggataggaataataaagaagataaaccggttcaaaaggtagtaaatgagaatgcaggtatgcagcttatctctacaatggcctcttcatcacatgtcgccaatttgtttaggtacagtgtctcttcatatttacataaatagatatctctctctctctctctctctaaaccacatcttcctctccaccgttctttctcttccttctctctctggacttcaacttctggagaagtacaagacatttataaagtactgctcatcacccaacactaaacacaattgtcaaaagggtgtggtggaaggagaatctacttctatctgaacatcgatcagtcatatcttttcaatcaaatcaaagccctcctctctctcttactccttttttgttttaaatcaagaaaaagactccatg

SEQ ID NO: 18487 - DNA, 3000 bp, Unknown; identical to SEQ ID NO: 18486
  misc_feature (1)..( 3000): 2750-1469P.txt file - cDNA_ID_1817817; gDNA_ID_1621147; Annot_ID_56788

SEQ ID NO: 18488 - DNA, 3000 bp, Unknown; identical to SEQ ID NO: 7480
  misc_feature (1)..( 3000): 2750-1469P.txt file - cDNA_ID_1817821; gDNA_ID_2926128; Annot_ID_138666

SEQ ID NO: 18489 - DNA, 3000 bp, Unknown; identical to SEQ ID NO: 7480
  misc_feature (1)..( 3000): 2750-1469P.txt file - cDNA_ID_1817821; gDNA_ID_1621147; Annot_ID_56787

SEQ ID NO: 18490 - DNA, 3003 bp, Unknown
  misc_feature (1)..( 3003): 2750-1469P.txt file - cDNA_ID_1817861; gDNA_ID_2926128; Annot_ID_138654
cgtgtttgtgtgtcttggtgatgttaggcaaaagcacaactgtcaagacacgctacacagtcatgtcacgggagacgctgcacaaataccctgaactagcaaccgagggttccccaaccatcaaacagaggcttgagattgcaaacgatgcggttgtgcagatggcatatgaagcgagcttggtttgcatcaaggaatggggaagggcagtggaagatatcactcatcttgtctacgtttcctccagtgagttccgtttgcccggaggtgatctttacctctcggcacagctgggccttagcaacgaggttcagagagtgatgctgtattttcttggatgctatggaggtttgagtgggctgcgcgtggccaaagacattgctgagaacaacccagggagccgtgtgttgctcaccacctctgagactaccgttctggggttccgcccacccaacaaagctcgtccttacaacttagtcggggctgcactctttggagatggagcagctgccctgatcatcggagcagaccctacagagtcggaatctcctttcatggagcttcactgtgctatgcagcagttcctgccccaaacacagggggtgatcgacgggcggctgtcagaagagggcataaccttcaagctaggaagagacctccctcagaagatcgaagacaacgtggaggagttctgcaagaagctagtggcaaaggctggctctggtgcgttggagttgaatgaccttttctgggcagttcatcctggtggaccagccatcctgagcgggctggagacaaagctgaagctgaagccggaaaagctggaatgcagcagaagggcgttgatggattatgggaacgtaagcagcaacaccatcttctacataatggacaaagtcagagatgagcttgagaagaaaggcacagagggagaagagtggggtctgggcttagctttcggaccgggaatcactttcgaaggctttctcatgaggaacctctaaatgtatatgaactggacatttctcaacaaataaaatatacaggaaccgatgctaacacacatacatcatgtaatggttgcattagttttgttctttaatggtaaatcacagaaatacatcaatacagtaagtttatatacataattgaagtattcttcaatggcatcttacttcatgcatccaaaaagtaatttcaaccttacataattcagatgtcgttttctctggctttcaaagattcactcgattctagcaaaggaacatacgtaacatagtgtgacacactagtctatatatacatttttgcaatatttttaacaaataaatcatagagttgagacttatttacaactcaatgctattgacattttattattatcaattaattaatattcctaattattaggatttccttatctaatatatctccatcaattctaattatttaaaaaaagagaaattttaggacattattaatattatactttattaaaccttaccaataaaaaatatatactttattaaaggtaaatattttagttatttaaagtttattaaatattttcacggaaaaaacgtttagaatatttataatatggaaaatctataaaattaaataaacatttgaaagaaaactttttaattgatttaaattataaatcttttaataaagtattattaaaacaaaaaataaaaaataatgtttaattacaccgaactggattagatggtataatgggtttagaatattataatatatgaactttagaacaattaaataaccatttgaaagaaaactttttaattgatttttgaattataaatcttttaataaaagtattattaaaacaaaaaataaaaaataatatttaatttcaccgaactggattagatggtataatgggtttagaatattgtaatatatgaactttagaacaattaaataaccatttgaaagaaaactttttaattgatttttgaattataaatcttttaataaaagtattattaaaacaaaaaataaaaaataatgtttaatttcaccgaatggtatagatggtaggacgggtttagaatattataatatatgaactttagaacaattaaataaccatttgaaagaaaacttttatattgatttgaattatatatcttttcgattaaagtattattaaacaaaaatgacaaaataatatttaattttattgatcgggtttagatggttaggacgggtttgagtcgatagaaatacaagacgatatatcatgggtgaaatccataagatatgtttgatattcactgaacgagattagattgtaggacgggtttgagtcgatagtaatacgagacggtataccacgggcgaaatcatatatataacaatcaaaatacaattatattatcttaaacactatacaaaacaaacaatattaacaaaataaatataatttaaatttaaattatttagttataatctaaattttaacttaatggacggtatgttattgttcctatatctttaaatagtaaaaatcaaacaagtaattatacagtaaataatatataaaaataagagttgtacatttagaaaatataaaacattaaatcatatatattttaatctactaaacaaattaaatttataccgcgggataaaaactagtattatatgttagcgaatcctactaaactatgacaacaaatatacatgcgagtcgtatacagaattgattctcacatttaagctgtcaacaaaacattcaacaagtcttaagcaagccattaaagaagggacctgaacaatttaatatatatggttaactatttaagtatcatgtccccacttgtccattacgtgattactacaaaagttcacataaaagttcctttttatatatataggaaagggaagaagatctcaataacacaaaaccttttaaactagtaaaatacacagattttaggatgagccaatgtgttccaaactgtcacatcgatg

SEQ ID NO: 18491 - DNA, 3003 bp, Unknown; identical to SEQ ID NO: 18490
  misc_feature (1)..( 3003): 2750-1469P.txt file - cDNA_ID_1817861; gDNA_ID_1621147; Annot_ID_56775

SEQ ID NO: 18492 - DNA, 3003 bp, Unknown
  misc_feature (1)..( 3003): 2750-1469P.txt file - cDNA_ID_1817865; gDNA_ID_2926128; Annot_ID_138652
cgatttgggccgaaattaactttgggcttggttttaacgacataacgtctcaagacaagtgagttaatgccacggccttttattgaggtaaaaaaggcacgaatgctaaccgaaaatcgttccaaacaacaattgcttacgtggacattttaaaacatctgttcaatggtcattggtgactgacttcaatgaaaattacattgcaacaatagccaagtatcacagaaagttacattgcaacaatttccacgtcaaatttctaaacatgcagaacggtaatttacacggggaaggcgctgaggaggcggagggtgctacggaggggatcgcaggaacaccgatgaatgagaagaatccagaggcggcatgatcttgctcgtcgaggagagtggatgatgctctataaacggccaacaatatggtcgacgtacacctaaaatgtcttgctacgtggatgcaccactaaacctttcaacttttttgtgttttcttttcttaattaaacacaagattaattaggaaatcttgtgtttcgttccgtttcgtttcgatttctggtttcttgtttctattactcaaattattgctcgagtgttaggtttgcttgtatctatccttgttttttccgtgattatgtaatttgattggcccttgtagtcgagatgtttgtagccttgatggctcggggaaactcagagagagagttggtcccggttgcattctccgctgtcttactgataccataaacaccgtttgatccatgattgcctctattgtatacttgatgcttcatgatatatgcattctccatgtctctgtttcatgtttacgcataaaaatattatcaagcctcaaacttgaattcggttcaaaatcctagacatccccaagaggatcataaacacagtttagacttgtttttcaattagcaaacagttgcttgataagaagtcattcctacagctcatgtgtaacacaattctctctcttttctccaacaccccaactaaaacaatctaagccgtttctgaatgttttccggatctgctgagtcataaatacgagtgctttaggcaggcaaataagactccagcatcaatttggctggggaaggtgttaaaatctctacgatcaggtacgtgtatttccattccttctctgccttgtctttaaacatctccgtgtacactttccctgctccttgaggcccacggatgtagaagtttacctgaagcatattcaattttgatcatgttaaacctgcaaaactctagacaatttatatagcaagaatgtgaatccaagcgcaatagaggttctacaatgaaatacctcaacatgctccactccgtcttcatctgtaaatactctgttgggtatacgttgacgagcagctcggtttctagtttcttgtccatagcctttgatgggggatccaatcctaaccctcacctagttaacaagacaatcacagtcacagaaattgtttcattttataaacagatgcttttgtttcatacaccacccctccgctatgatcaatctgtagagttagtttctaattacctgaccatcatcttgaattctcttcaaggctttgtcaaagaccttgtacctagaatacataatggtgtctttagattactcaaatccaagtgtctgagcagataaatcaaattagatttctgaagcctcactcttttggttgaaaaatgagctctttaaacacaccgtagccagcagctccagcgacaccaagcccagccagaataacaagactgtaggacgcaccttctgtaaaggtcaccggcttctccgggatgtggtatgtaggagaatcaaaaggatcctccacagtcgtcacctctttcttagcctgtaaaacaattggcaaagcaagcatcattattagatgacagaagctgtctgtcgcttttgacggcttgcgttgtgataaatggcaaacacataacgtagacattaagtagaaacttgtaggaagaaacaccttattctgctgattcccaggttcttttgaagttcttgatgcaaaagatctggtaaagtaagatgagttgatgttctttggacgagcttccgtacatatacttgcttgcgggtttcggaagcgaaacaatagtcctgtataacagacaattgtcagaacaacaaggtacacatcaacactaggatttgaagtttgattacacaattatcactgctgaccattagctccagtagagtcctgcataagaaaaacgatgagaggtatgagactaacatataagcccaaaagggtgtaaagagcaaagaaaatgttgtcgaagcaaatatttaacaagtaaagggaagaaaatacctttgaaagaaatgagttgctaaaaaccctcttggactgatatataacaaaagtaacactgtaagttttccccagatcaaggacactagagagattcaattcaaacaggactagagacactgaaaaaaacgacctcaattttcacaagatcctaaacaatccgtgtctatgtagtagaagaaccaatagcttttagccaatattatatagaaatgccggcagagtgagatggaatacgaaagccttaccgattttgggattccggaacaaggttgtgtagcggaggaaaacgacgccagtttcgattttgattggcggccgatggctatcgctgatctccttaaaagattcatcatcatcatctctgaaccaccaatattactgattgaaaaatcgaagtggagacgacgacgacgacgagcgaggttgaatgagcaaggcaaagccgctcgccgttgctggggttttatcgtagacacgtgacgcgcacgtgcaagctatttccttgggcttgggcttagactcatgagataaagcaaataaaacccaaatgggctttttagaaaagaaacccaaataacagagtatctcttcttcttcttcgtgcaacaacctaaccatggaaattgcaatttgcaaacatg

SEQ ID NO: 18493 - DNA, 3003 bp, Unknown; identical to SEQ ID NO: 18492
  misc_feature (1)..( 3003): 2750-1469P.txt file - cDNA_ID_1817865; gDNA_ID_1621147; Annot_ID_56773

SEQ ID NO: 18494 - DNA, 3003 bp, Unknown; identical to SEQ ID NO: 18492
  misc_feature (1)..( 3003): 2750-1469P.txt file - cDNA_ID_1817865; gDNA_ID_1621147; Annot_ID_173077

SEQ ID NO: 18495 - DNA, 3000 bp, Unknown; identical to SEQ ID NO: 7495
  misc_feature (1)..( 3000): 2750-1469P.txt file - cDNA_ID_1817880; gDNA_ID_1621148; Annot_ID_56817

SEQ ID NO: 18496 - DNA, 3000 bp, Unknown
  misc_feature (1)..( 3000): 2750-1469P.txt file - cDNA_ID_1817884; gDNA_ID_1621148; Annot_ID_56816
tcaaatcataaaaaattataatgtgtgtacttaattcacattatttaacttattcttgattttcaatctatgactaggtgcaatcccatgtggtatccaaatgatatgtttattttttattcctgaatcacctagatggctggtaattcacacacttaaagtttgttttttatttgtttaattggtaatattatatttaaaaggtacagtctacatattaatgttcatcttaggctatgtatggtagagaacgagagcttgaggttactttgaagaggctaagaggagaaaatggtgatattctcgaagaagcagctgaaatcagagtattattgtttgttccgaaaatactactactactttggctaacatatacgtattttggttaactattaattcggtttaaaatgtgaaacaggaaacagtggaaacctctagaagagaatctcgaagtggactaaaagatttgttcaatatgaaaaacgcacatccgttaatcgtaagtctcatcaaatacctatcatttatacaaataatttagaagagatcgagttcttatctagttttgtgacctattgatgatcaacttaataaacagatagacatgtatttatgcgtatgtagatctaacattctgcctatacgtatgaatgaaatactcccaagtcctaacggaaaaaaatgttttaacttgtttagtgaaataaataaagattaatttgtttttgtttgtttattaattcgttgaaaacgattagattggattgggcctaatgctcttgcaacaattttgtgggagttcggcgataagtgcttatgctgctcgtattttcgacacagccggtaaaccatgatttaaaaaaaaaaaaaaaaaaaaaaatcattggcatgtcatatcttgtttgattttgtatcgcatttcatctcacgatttttgaatatattgtcttgggtatttaggttttccaagcgacataggaacatccatccttgcagttattttggtaaatcaaaacattgtctttttagtatttaacattttataatcgaaaatatagtatttcacattttcactacaacttattcttgtttttaggtaccgcaatctattattgtcatgtttgccgtcgaccgatgtggacgccgaccacttttgatggtaatcatttcattaccttcgttatatataatttgcgtaattgatttccctagataaatattttatttgtggtttgaaactttttttgcagagctcttctatcggtctgtgcatatgttcatttttaattggcctctcttactatcttcaggtttagtcatcttaactattttattctttgtaacttcgtttgatttttggttattatagactaaatattatttatcccccacaagcagaaccatggtgattttcaagagttttgttcccctatcttaatcgtcggtttagtggtacgtgaatgccaatcttgtttcagtcaattactatttttggtttaattcatatattactttgttgaaaccacaacactaatcaaccaagtcatactatataccagggttatgtcttatcctttggcattggtctaggtggactaccatgggttattatgtctgaggtatttgtttttttttttattttaaactagaaatatttcataatgtaatcattatctttttttttttttggacaacaatttattcattatctatggcaggtgtttccggtgaatgtgaaaattaccgccggtagtcttgtaacagtgtcaaactggtttttcagttggattatcattttcagttttaatttcatgatgcaatggagtgctttcggtaaatttctatccattaatttgacatttttgtttcttcagaatattacacatctaacacaaaaatgctttatttcgacagtatttaataattattacaataaaatgaaaataaataaataaacaaacaaccagctcttaaaattgtttaaagagtatagggttatgtataatcaaatcatggtaaatatatcttttaaattattaaaaatactaaaacgggaagattagagaattttatgttaggaatgtcccctcgaattaatattttcattatataataacttagatatgaaattaaagagaatgattatatagttattttgttttattggaatttgcaggaacatatttcatatttgctggagtttctctgatgtcattcgtatttgtatggactttggtgcctgagacgaaaggccgaacacttgaagatattcaacaatcactaggccaactttcataaatccaaagttgattctttactccacaatgccagacattgttcttttatgttacatttataagtcatgtattatccgatttggaggggggggatatggatttccgaatttttttactttgataaattttgtcaatatattttgttgacagaaaaaagaataatcaatatactgtatgtggtattattctaacaatattttttaaacgtataatatgattatgtaccaatatttataaccatatcatatgattatgtacttttgtaaaaaaaattcacaccccacttaaaacttggttactactaattggatcttgcaactcaattttctaaatcgcattacaaaatactgaatgagcaaattaataaaagattagtcaaatgtgacaacgaccaatgaggcatggccaaataaaagcttgaagagactattcaaagttaaggataagaatcaaagaaagaagatggaatctgaaagactcgaatcacatcttctgaataagcaagaagaagaagcttcttccttcacttctggtcttcttctcagcacatccgtcgttgtcgctggatccttctgttatggctgcgccgtgagatctcttcctttctctctcaatttgctatccactgattttggatattacagttttagaatcctaatttcttcgtgcataattttcataactataacatactttgtagatg

SEQ ID NO: 18497 - DNA, 3000 bp, Unknown; identical to SEQ ID NO: 7504
  misc_feature (1)..( 3000): 2750-1469P.txt file - cDNA_ID_1817892; gDNA_ID_1621148; Annot_ID_56814

SEQ ID NO: 18498 - DNA, 3000 bp, Unknown; identical to SEQ ID NO: 7492
  misc_feature (1)..( 3000): 2750-1469P.txt file - cDNA_ID_1817896; gDNA_ID_1621148; Annot_ID_56813

SEQ ID NO: 18499 - DNA, 3000 bp, Unknown; identical to SEQ ID NO: 7491
  misc_feature (1)..( 3000): 2750-1469P.txt file - cDNA_ID_1817900; gDNA_ID_1621148; Annot_ID_56812

SEQ ID NO: 18500 - DNA, 3000 bp, Unknown; identical to SEQ ID NO: 7491
  misc_feature (1)..( 3000): 2750-1469P.txt file - cDNA_ID_1817900; gDNA_ID_1621148; Annot_ID_173140

SEQ ID NO: 18501 - DNA, 3003 bp, Unknown
  misc_feature (1)..( 3003): 2750-1469P.txt file - cDNA_ID_1817912; gDNA_ID_1621148; Annot_ID_56806
gaatttccaagacggaagtctggatatctcataaatcacatagttttaaatgttttactagcttctcagtatgaaatttcactcttgagtataatagcaaatttgtaaaattgcagcttggaactcatggatcaaacttgacagaggaagagcttgagacgcacacaatagcagcctggaaagaggggaaggctcatattagccggcaatatgatggaagtgggagaccatatcctaggccacttgttcaggtgagattttcacagttgatttgtatcgctgttactactaactttcttctgtttgcgtaatctctgaacatagccttatcctagaactttctattgcatgttatattgaaaagagctagtagtatttctctcttgctattaatggttttatatatggctatcaggttggaccctatgataatctgaaagacgttgccctgaaaattttgcaaaacaaggtggcagctgttccggttatatattcttctttgcaggatggttcatatccgcagttactgcatcttgcttcgctatcaggcatattaaaatgtaaggtcccttcatttgtgaataagacactgataagcgcgccaatttggcatttctcactttttaattcatgacgtgcatatgattctgctatttccaaaattttcccacttcttcatttctccaaattctgtgaagggatgggatctttaggagggagggaaattagaaactaaagttgcaattgactttaccaaactttttacacagttttccctgttaataattcctttcgaaatttatgcctttatcagacacttaagctctaaattaagcataatcttccaggtatatgcagatactttagacattcgtctagctctttacctatccttcagcaacccatttgttcaattcccctgggtacgtgggtccctagaatcggagaatcaagtagcaaacctctcgctacattgagacctcacgcctctttgggttctgcgctcgcattattagttcaaggtaatcctttttcttatcttgttgcagcaacatcttattcaaagctcatctgcaactcagactatcaacctctacattacaatcagattttcagttttaaatattttgtctagatggtaatataatcaagtagctgaacacatgggtatactcaagtcaatgcagaccaacaaaccaactttagatgttacgaccacttttattatttttatacagatgtaattgctgcaacatgagtaaactaacgaggtttaaaaacatagaaacatttttgtcaatcttaaagcagatatatttatagaatttctcgtgatcttttccctggttcctcatagatggaaatgaatgaatgagtcatgcttaatttatgtttcctggttattacagctgaagtcagttcaattcccgtagtggatgacaacgactcgcttattgacatatactctcgaaggtaaacctctatccatcaatcgacatgatgtcttatgcattccatctttgacgtccttgtgttctgatgatatttgtaattggccagtgatataactgctctggctaaagacaaggcatacgcacagattcatcttgatgacatgacagttcaccaggtaaacctctcatcagaaaccaagatccatcacatgtctcatcaaattacgagttttacttaaatgtaacctgcctatctatcatggaaattgcctcgtttctgatttatttgaacatacatctttacaagaatgaaagaagagatgaaacgttataataaagtggaggataatgtgtttgtgggttttcaggcgctacagttggggcaagatgcgagcccgccttatggaatcttcaacgggcagagatgtcacatgtgcttgcgctcagactctcttgtgaaagtgatggagcggttggcgaatccaggtacacactatctcctatatacaatcttcagctttgttgcttgacacaggaacatcagatgagatgtaactggggtttgggtttgtgtatataaaacacaacaggtgtaaggaggctggtgatagtggaagcagggagcaaacgtgttgaaggtatcatttcactgagcgatgttttccaattcctgctcggtctttgactcccacagcaaaacaacctccccaacctctttttctcatttcccctcaatcaaaactacccaacaatttgcttctttttttttttttttttttttcttcttgcaaggaatttgtaaatttgctacgaacctctttcatcattgttttcttattatttttgttgttttagttgaacgggtttccattcttgtgaagatattggctaccggaatcttttactagtagcttccctcagctttttcttccctctttttttttccatttttttttggttttgagtttttcacttcatcgactcgaaaagcaacacagcatgagaaggccgtagaagtgtaggacaatgcactggttgacaaagatgaattgtcaccagcgagaataagccttatggttgaagtttgcaagtaatgattaatacaattacaatcataacgaatcataaccttaagtacaataacaagtaaaaaagtacaatgacaagtaatattcagtaatggttaatcgagtgatttgatcatagcattatcgatttctttcggatttttcaatagctcttaaaatatatcaataaaagtaatacaaaattcaatcaaatctagtgacactaaaaaaaaataaaaaaatctaatgtcatttaaaaaatatttgagcaaaaaaaataaaatctaatgtcattaaaaataagtgttaaataattgatgacataataagtgatagagaaaaatgtatttactctatttacttatttaggcttatccagacaataaacgttttcgtttttccagtccaacaagtttcttcatcaactctctcaactgttttcgacataaacattccagaagctgagatcagatactaaaatg

SEQ ID NO: 18502 - DNA, 3003 bp, Unknown
  misc_feature (1)..( 3003): 2750-1469P.txt file - cDNA_ID_1817916; gDNA_ID_1621148; Annot_ID_56805
gactaagagaaaaatgtattcagtggaggctaaagaaattcttctcgaaatctgatgcaaaacccataactgaaagaaaagaagaagaaagaactctttgaattagttcccgagccaaagatcatatacataaccagaattacgacgaaggagttacggatgtttaggacgagagccaaagatgttctaacaatatgtaaccaaatgaagactttccaaatattaaaaagagcccttatgagataaaaaaaaaaaactttgttggcctgtttttcaatgcccaaatatagcgatcaagattttgagatgaaagttatgaccattaaaggagtatatatatccaattgtccatactagccagcgaccgtgaatgctgcccaataaccaacaagccaaaatgaccattgtttacaaatgtctttctcatttgctgttttccgacagatagagtaagtgtatatatagaatagtactgaaagagagggccgggggacttatatacgttttgaggaaaaagataaacaacattagagtaagagcgagatatatacacttatataaagtcatgtctataagaaagttcaaatccaacttaaaaatatatactcacaacaaataaaagttacatcacttcgattatttagagtttataaaactaattagaaaccgaactctttttttcttcaaggtcgtgttttggttttaggcttttagccctaatttacaggtctttctaaggctaaatctactataaaatgtaattgcatgcctagggttcaaacatgaagtctcctctccctcaaataatgtcaacttggaagacaacacgattgtctccctgtattacatgtctaccgagaatagatgtacaatgtaatttcatggattatgtttaacccgataataaattggtgtgggatgtaatgatttattttctttaatttaagaaattataagagttgacacaataaaaattagagaaaaaaaaaacatggcttttctttttactttatttatttaccctgcttcaaaacacaagagaataagagaaaagtgtattttgaaacgtttttgaatgttagtttggttttgtttgatttatagtactgtttaacatcagaaaagacaaatgagtttaaaaaaataataccaaaaaaagaatttactagatacaattttaaagtggaaatatttttaataacttggatcctcgtctaatttattcataacatttatgtgatatattatatatataggaaatgatttattagatagttgactaaaactatatattagatgctattatttgcataattcatatagttatttattatgaaaaaagagaagaataatcagttatgtaaaagtagaattttttttttttttttaaatgttatcggaaaaactgtatacagtaataaaaaagagaaaaaaaaaaaaaaccatatctttgtcgatggattaaaaacaacattttcattacgcagcgcttcttcgccctcagattcttcttcaccttgaaagaccattaacatcattccttgcccagatccaaacaatgccatctccactctctctatttagggttctctccaacttttcaaatccctaattcttgctccctcccttcaatcaattccgatcatcatcgaggtctctctactccccgaatttaaagatcagagccgcgacttcctctgccttcttttcctcggaatttttcagctacgttttccaggtggtgtgtattgtcaatcagttgacctttgcttttgtagccagatcgttcgtgctttgagtttagggctcttttacaaggtttcgtgttggtggaatttctctacctaggtttgggggaagagttcagtaatttcgttgtagatcgtgatttgggcttttagggtttcggtttactggttgctggaatttatggtagcgttattgaattcggactctctgcatgtgtaagcgttgaagtttgaagtttcaccgggttttgtttcttctgctgaagagtcgagattattttacgcattaagaatcgattcagaaggtttttaggaattagtttctgtggattgtaactatataactactgggaggggatgtttggttctacattggatagcagccgtggaaacagcgctgcctcagggcagcttcttactccgacacgcttcgtgtggccttatggaggtagaagagtcttcctaagcggatctttcaccaggtgagatgactgagcttgaactaggatagtttactttatatttcagttaagctatttatcggggtttgtgtagagtatgtgctctgtatagtatctatcggggttttgcagtccatggactgatttctgaaatgggcatttgaacaggtggacagagcatgtgccaatgtcaccgctcgagggctgccctactgtttttcaagtcatttgcaacttgacgccaggatatcatcaggttaataatcttgtactcgacctgtatcatggcaaattctttgttaattaatccctgcagaagcatttatgtccttgtagtgatttagcgatgtccataattgtgcttcatttagtctctggatacttaacctatgcaatgagaatcttatatacctctgtcatatttgtatgactgtggctgaaaattgcaaatttccttgctaattgatcaaaatttgactttatacatcaccatccacataacaaaagttggggtcttcatgctgtgtgatacctaaatcacttcttttaataaaggctacagtgtgtgtatagagattcatatattttggcagttggatgtactatatataacaagattttaattattacaatgtgagatgcttaagaagccactaatgttacatttatgttatttcattctcatgcagtataagttttttgttgatggggaatggcggcacgatgagcaccaaccatttgtaagcggaaatggtggagtagtgaatacaatatttataactgggccagatatg

SEQ ID NO: 18503 - DNA, 3003 bp, Unknown
  misc_feature (1)..( 3003): 2750-1469P.txt file - cDNA_ID_1817932; gDNA_ID_1621148; Annot_ID_56801
acgggctgatccatagtcttatgatccatagccgaagggaccggcgcgtgaggaccactcgaagatccataagtatacttttccccaaatttgaacgagaatttgagagatcctttcgccttcccgttaggcaacctcacggcgtaagtaaccgttttctcctcgtcacctttattctgatccaaaagctccttcaccggaacgctaacctcaccgacaggtttatcaccagcgatgggacgatccgccacgatctcgaaaacaagagtaagacgattgtcacgcgccgctgcgtcatcgacggtgagcttcatttgatgcttccatttaggtttggtgccgcaatctttatcaacctttgtcttctgcttcgtcctagcgtcgccgttgatggaaacgacggcgtacaagtcttgtttaccgatcaattgaacgtctttgagatcctccgcagatataatcgtcagatccaatgatctacactccatggttactcggatcgaaattgaatgaaataaacttgaaatttgctctgagaatgttttttatgatgaggaaaagaaaagtggagagggcaaaggatatatatgcatttatgataaagtcggtttaaggaacaaagagttttttttttacacacgggagggacacgcacgagattttttttgttaaggacgcggtttctttaaatgcaaatagcttttttccttctaatattagtttcttcttatctgaagtttaattatcttgctgtttttagtaaattattatttgaccatggttcaaataataaactcatgtgtatctaagagtttagtgataatggcaatgtaaacgttcaaagatatggaaattataaacgttttaaagaatgtctcaaatgataagaccatgatcaattcggtgttctccgtaagcctggttacttgacaacgtaatcaggtacgtaaaataggacaaagacacgccggagagttagacttattattgtttgatgttgatatcatgatatgtagtaatcatatcgcattttactctgctaggattggatatgatcaacatcactaacatattcgaaaaagaatatcaagtggacgagtacgaattctacaactttaccattcgaaagtttaccgtaaactctaaatgaaaatgttttaataaatttacattgaattacagtttaacaaaaccaactaatggtggtatatatgatggtaattagttgaagattagttgtcttcggaaaaaagttactaacttaaaacttggaaccatgcatgtattgcgataatgaatgagcatataaggtggaatcttttgaaatgtagaataatctcaagcatctttcttggtttcttcttcagtagtcaagagcaatacgcgtggaataacccatacgttttctatttttgcttattctcgaaggcgattggttctcattttctcgatcgaatcatccttttaattcaacgatagcctcacgtcgcgtggtcctgacgcactatccatattctttgccactttattctccttcacggaacatttaagttaaacgcaaatatacacgttagtccatatattggaggagaccatattcacaaattttgatatataacacaaaaaaagtttacctgatttttcttctagtacttgatctcatcactcaactacttgcaagtcttgaaactaatcatcaactcaccattcagaatttgtttagcaaaaaaatcactcaatgataactaaaaacccaacaaacatacacgatcatatttcaaacgacaccattgccaatgacttaaaagtttttgaccaatgaaaattttagcgttgagtattttgaatcacgttcagttgctcatcgttattttcagtaactacaaaatgaacacaatttaatcgttagtcgctgaaaattagaaaacgaatatgacatagtcattaatgttaattaccattagcaaatacgaaatgaacataatttacattagaaccaaataattctttctatgaaactatccgaaatccaaattccggatgcattacaagtcaacaggtttagaatcaaattactgtaaaacaaccttatcaaggacttttttttttgtgtttcatcaattggtaagtttactttaataaaattgcaatattaatatatttatatataattctttgacaacatatcaaaatattttaaatttgaaatttgtatacatatttcccttaacttttgtttgtttatatccatatttggtaactgtacaatggggatccacttttgaatcaaaaaacaccacactgaaacaaaaataaagaaaagaagaaaaacaagtgaacccatatccatgttctgtctgaatccgagtttacttcttcttagttacagaggaggaaaaaaggaaaacctaagcggaaagggaatatccaaaaaaaaaaaaaaaaaaaaaagacagaagtataagaaaagtatcctgaacatgataggtctctctcccatctataacctctgcaatttctctcgaccaaaaccctaatttcaggtttggggttttccttctttcactgtaagtacgagcaattattttcatatatatatgtacctatatatatatacacacttatatacttgttgatgagcctctcgaattccccaatcttaaacactcttcttcaattctacgttcgattttagcgatttcggagttctcttcttctgtcttcgaatttgtacgcacttattagttctatacatatatcgatcgatatagcatgtgtttctagagctcttaggttcagtgattgatcatgtgtgtgtgtgtgttcgttgaattgggggatttaacgggttttgcttacaaatattggattttgggattgtaatttggttgatctctctctcaaattcgagcaggagtgtataagctaccaatttagttttctttccctttagtgagtgctcaatttctgattttagtttgaaaatctagtgttttgacaatg

SEQ ID NO: 18504 - DNA, 973 bp, Unknown; identical to SEQ ID NO: 7483
  misc_feature (1)..( 973): 2750-1469P.txt file - cDNA_ID_1817952; gDNA_ID_1621148; Annot_ID_56795

SEQ ID NO: 18505 - DNA, 3003 bp, Unknown
  misc_feature (1)..( 3003): 2750-1469P.txt file - cDNA_ID_1817960; gDNA_ID_1621149; Annot_ID_56843
gttgcttattacaccaaactccatccacatattaaagaaaaacaaaacaaaaggaaaccaaataagtcaaagcaagtaaatgattggaacaaattgataggtaagttactagagacaggtacttaccgttaaaccagtttagaaaacacggttctttttttagcagatatgaaaatgagaaagagacaacatgagctatttcaatgttttttcttgggtttgcagagtgaaggagatataaatacgaagagggtgatgaagaaatgacagaggaaaacaagcattgaattaggccaacaacccccacaacaaaaaggaagttggttgtattaaatttgaaaaatatgtttgtttaagaaatagtgaaatacttttcgaaataataaatatcaaacaaaatatttaggtcgtccgttacaaaaaaaaaacaaaaaaaaaaacattgaaccacttttaagaatttcatgatgattgcttgctagttcttgtttattaaaaagtccataagaaacagctaaaccattatagacgtttctctcttaaaaaaaaaacaaaatatacgacaaaatatatcataatgattttcttataagccatgaaaaagttactattttgtgatggatattctctttgagtctatgattacaaatttatcgcatacttctaacacaaaaaaatacgtcacaatttttgttaggtggaaaacgtgagaatgtgttaaaaatacgttatttttgcgattttagttttcatttgtttaactttatttataattggattccatcctcatgaaacttgtgaggcaatatttataaataatattattacatcttgcatcttgcatgtattatgaattatatatatgctcttgatctctctcctgacctacgtaacgcctcgacggggaaatcggaacaataactacatgatatgttcatgcataagcttgcttggtctacgcattgttcttaaatctgtttgatgtcactatgtcacacatgacacgtccatatctttgatttactattttaactctaaaacgttaacatagaagttgaaaaagtagtcagttgatatttgataagaaaaacagcatttataaatctcataacgatattcaagaggaacgtaaaatttactcaattaggtagctttcatctccaagtatatacacatgggtctatgaatagtgcatgtacatgtagtatatgtacatgtgactttttatgtagagaggtttgtagaataaaatgaaataaaggaacaaggaatgccatagagctttcaaaatcggtatttatgaggacttgtatgagagacaaaggcatgttggtgggctctgctactcccaacatctatttgaattttgaaactaatttggtggtttcatttttgaaatacatctatacttccctcttaattttacctagtaaagtttctaggcctgggatttcggctaaacccgaggaaatcgaatgtttcggttctcggcgcagagagataaagagaaggcaaaccgttcggcaaaaataatattgtgattcggattacggttcggttcggttcggcaagctaaaccgatcggttttctcggtttagaggtacaccctataaaatagaagaaaccctagatctatgtcaacaattcatgtcgtctccttccttttctaatcttaaactcttctcctcaagatccttctttgatcttcttctccttcttcagtcttcttcttcttcgttctcagcttatcatattcgtttactgctgtgaaaccaacactctctggcatcaatccaatttttttttttttctcaccgccgcgacatcaaatctctcgtctagttgccggtggtggcaaacatagacatctgcactatgtaggaattacagatctagtcaagccgctaattattctttctttccctttgaaagtcggacgcgcatgagtgaacggcgtctccgtcaccgtcatcattcttcacttgtcaaaaacctagatttcagatgggcttgggcatgttgtttattttggacttggacttttattagatttagcccattattaatttattattgttggtttataattgtaaatttaataattgagcccataattttaattttggtctaattcggtttgaattaaccgatttagaaaaagggtcggtttagttcggaattgattttaatccctgtaaccgaaccgaaaaaaccgagtaccaaaccgacccgaaccgaaatttaattcggtccaattcggcagaatttttaaaaccccaaaaaccgatttaaccgacccgattaaaccgacaaaaccgaactcccaggcctaaaagtttctatgaaaatccactactaaattaaaaaaaaaaaaaagaaaaggaaagacaaatgttaaattgcatcaaccaataaaaataaagtttttgttttcacattttctgtaccaagcatattaaagtgtagactttaaatggttgcatgcgacctaattcgtaaacaaaaaaaaaatcgtataaattttttgttttgtatcttgtaaaataaaataaatcaaccaaattaatgagtcaagacaaaaaagttcaacgagaaccgaatgttattctaaaccaaaccataatccggtacaaatttccggttctgcagcaggacaaatggcaacaaaggaaagtaacgatgataagtttgatcgaaagtttcagacttcaataagttttcagtttcgtgcatagattaggaatctcgaaaccctaattctgttttctacacgaaacccatcaaaatcgaattttgatcgtttctaatttctgccatttgattctcttcatcagtcacatttaggggaaacgagaagccctaatctttggtatgttgctccctctgatttcgcagtttctgggtttttgttttcctctgcgaaatccctaattgaatatcagatttcatagattgtgttgattgattttggtgttttaatttcagattctttaatcgccatg

SEQ ID NO: 18506 - DNA, 3003 bp, Unknown
  misc_feature (1)..( 3003): 2750-1469P.txt file - cDNA_ID_1817967; gDNA_ID_1621149; Annot_ID_56841
cggtgaagaagaagactgagtttttggtcaaggagatgaattggccagtaaaggctgtggcttcaatccctcaggtacttggatacagcctagagaagaggactgtcccaaggtgtaatgttatcaaagttctcatgtcaaaaggattgcttgaaagtgaactccctccaatgtcttctgttttgacaagtactagtgagtcgtttttaaatttgtatgttagcaaacatgatgacaagcagcttgtggctgagctgatggcaatcttcaccggaaatcgtgtttcactcaccgatcagaaggcacgcctagaacaatgagcaacgttaaggattgttttttgttttctgttaggtttagattcattagtgagtcttgttgcttgacttttggaagtagataatagattttgtgtatgagtgtctaagcctttgaccctgaaggatgatgaatcagtcttgtatgaaaaaaatctttacaattatctttctttgtcttgttgatatgaattatggttaagatctttgtgatgtgctttgttctgttttggaaattaaacagagcatatgatatatttcattttactagtttcgtggcagaaatctttcctgtttcgcaggatttggtagacaactctgaggagtaagatccactcgcaaacgatggaacggtttattcaaattcctagtttgctttttctacttgagtccttaagtttgtattagagtcttcagtatacttcataccttcttgttcaacccaattccaactcttcagtctctgctacatcttcaaactccatcaagcctcaaactaataatctttcaagtgagattataaatcttcaagcttcttggattggatatatcaatagactataaaagctagtagaaaagagtagaaaagctagttgaggatttataataaggtaaataagtagaaaagacttttatagtctattgatatatccaatccatttacttgatccatctctgtatgcaatctgactgacaaattgtaattgttaaactcttttttactagctttttttaactcttcaacattaaaagtctagaaacagaagacaactatttactacatgatatttttggttatttgttaacaagaagcactgtggtaaagcagccgaggatgaataattttagtgtttgtttgatgagtgttaatcttcatggaatccataaccacaaagatttggttgatccatctatataaagcaaataggtgtagttaatcaattcaaggtcttttagtgttatcccttgccaaggagggcaacactagagtctagagtttcgttttccacttgagtccttctgttggagacagtgtcttcattacacttcctaaccgattccaaagcttcaaatttcatcaaacctgcaacataatgatgacttcacaatggtgtcgagtgagctccattaaaacatgtataggcctaggattcagcataatgatgatcaagcgctatcttgagtgcattgtaatttgatgaaagaagttgacttgaccagtggcaactagaggctggagaagaggattgtcccaagttataacctaatcaaagctggtacgtctcgaagcatgatgataagctggtattggagattactgtttttgctccaaggaatgtcatatcaagaaactgtgcattgttcttgtacctcgctagcatcttcctttgttggttacatggtttgctattccaaccaagctctggtactataaggcaaaaggaaaggagaaggagaccattaactagtctatattacaacaatacattatatgtttcgtggatatctctttttcttatcttctctgctgttttcctttcttttgtaaagattgttctttgaacatgaatcaatacactttagaatctattaagatagcaaataagttgatgcaaagagcaagtgtgagatggataattgaacgggagtgaatgaacctgtcactagatctctaatggttgttgttacctcctggctcctcctcagctgcctaaactgcgtttagctcggccgcctatcactttttttttgtgtgtaggtttgattggtctctctcattcagaatcatatgatcaatttgttttcaagttttgcaatgtttttgaaaacattacatttacgctaattggatttttaaactcgataaccgtgattacaaatagagacgtaatattttttagattatttctcatgtttttttgtgatttgttcatcttatgcataatttatttttcacttatgttcaacaatagtatacaaaaatttagaaatgctcatcatatataaaatcacttttgacgttctgaggctccaatctattaaaaataaacgatatagatgataatatatacgtcttttaatcaagtgaatgaatatttagtttttttttttttaataggcttcactttgtttcttactcagtttaatttttatttggtttttataaaattacaacttagttttaatcaaaggttctaaattaaatttgaccaaaaacataaaaaaataattacgtaagagcttttttggcagaaaataatttagagtaattatttattccttcgacgttaaaaaagaataggaaaaaatatgtttaaattgcatcattcgaccaataagattagaactcatcctttttttttttaaggatatatagaattcatcactgaatacatgtttttatcccaaattaacgcaaaagagagaactcgagatctgggcatagcgactcactcagatctatacaccttcttcttcttcttcttcttcctcttcctcttcgcttcgttcgtaaactcatctgatctgtggtaaccaccattgttcctctccttacgatttcgaatttctgttttgatctcactaccattgttgcaatttagatctatttctaattgttcgtgattcgcttttttttttctgtgatctggtttttgtagagtgccattatcgttgagagattatg

SEQ ID NO: 18507 - DNA, 3000 bp, Unknown; identical to SEQ ID NO: 7513
  misc_feature (1)..( 3000): 2750-1469P.txt file - cDNA_ID_1817989; gDNA_ID_1621149; Annot_ID_56829

SEQ ID NO: 18508 - DNA, 3000 bp, Unknown; identical to SEQ ID NO: 7513
  misc_feature (1)..( 3000): 2750-1469P.txt file - cDNA_ID_1817989; gDNA_ID_1621149; Annot_ID_173166

SEQ ID NO: 18509 - DNA, 3003 bp, Unknown
  misc_feature (1)..( 3003): 2750-1469P.txt file - cDNA_ID_1817997; gDNA_ID_1621149; Annot_ID_56826
atttagatttttgagatctttgggttttctttttctaattaatgtaaaattaacaaaccatttaccaagaaacatttgttggttcaaaagttttaggaaacaatgagatgattatgtcaaatcatcattatttataaacttaaatatatttgtttcctaaataataagaaaaaatattaattctatatttaatcccacaaaatgaattaggaatatgtattaactaaaagattttttatccttattttctatagcatctacataacatatctttaaattataaaaaaatcacataaatattttcgggattcagatttcaataattaggatgtgaacaggttttctaaaaatatcgttcgaatatattgaagataaaaaaaatacaaataggaaatataataatttaaaagatacaaaatatttataaagaaattttgttttaaaaaaaacaaatttcaatgaattcaatataaaatcttcaatacgaatccgatattgattcttaaataaaaatattaatataatatacaatttttcttattagactgaaattttaaattgactcgaagtatcttaaataataatattattaaaaatagaaaataaataatttgatttttagttatcacgggacggattatacggtggaacgggtttagatgagacatgacaaaatattatcccgtggtgtggtctatcaccagtcaaattctataagataaaataatatatattaaacttactaatatcataattacgactcactaaaaaccgtacacaaccttatcgagaattattaatcaacacaaacaacaacaaattctttatcttataaaaaaaaaaatatatatatttaacccgcggtataccgcgggtcatatcttagtacgttataaactttatactacgggtgaaatcctagattgatattaatacaaattatatactatgggagaaattaacaatcaaatacaattataaaatcttaaacactaaataaaataaacaatattatttaaacaaatataaaattaaaatttcaaatttttagtttaaaaaatatagttttgtgatgtaccatacatttaaattaaacaaaataaaaacatatatttattgatcaacttaaaaataaatatttaattttttaataaaattataggcatgcagtataccgcggattaatatctagtttaaaaacttaaaaatattataaattaaaatttaataatcatattgaaacgaatgacgacgttttgtaactcccataagattatcgagttaccaaaactcaggcgagagagagagatcagaaacggaagagaagaataattcagtgaagaatgagactactctctcctctgatcatcactcattgatcagatttgcatttttgagtctccatttctgaatcatccaatccgatcgacgttctccggtattgatttcgttgatcgggtttttgttaagtttttaatatcgatagctccgattccttaaccaaaccagtacgtaccatacacgagagagactagcacatcactagctcagctcacattacaccatacgagagagactagcacatcactagctcagctctcaagtctctcatgcgagactcgcacaattcaacaacaacaacataaagcataatccctctaaattgatctctttccttatttatactagaacggagtttgttagagatatttttatatcttcttcaagcaagcttccttctcacgtgcctcttcacttgcacatgtcttcttttgctttgtctcccattcacatgatacaccaatcgtatcagttttcagtcatacaatcctttgtcagcaaacacactttgttagccgatccaaaataaccaattcggtttgaagttcaccgattttcgttccacctctacacggttttttgtagtgaaaaatcgtcgagaaaattatgaaaattgagagcatcgtctcgtgggagagttcaactagatctttatatttacttatgctctttttattgtaaaaaataattgattatatacttcttcattatatacatattttgatttacactgtttcactaattgtagtttccatggtatgaaatcacttttagaaatttgaattatttctatgttttttttttttggggtaggagatgggatcgaacccccacttttattaataactaaaaaaacaatcacacccgaacattcagagagcccgcatacccatttacatactcaagaacaatcgacataacactatccaaagtagaattaaacaaatgaaaatctaagggtaaagtgtaaatatatagctaactcattcgcaagacgattagcctttctatacgcatatgaaatccgtactacccattcctttgaaaaaaagttatttatctatgtccaaagaaaaccaaccaccatctctaagccaatctccagctcgaagtgtatgataccgcgatccagctatatgtgagccataatatgctccccatagttccatggtatcacttttagaaatttcatttatttctgtcatacatattttcccagatgtaatgcatatttttttttttctttttggatattcgaattattcacctttcaagcgaacgacgacgtttggtagcgtcacattgattattatcaagtattcaagttactccaaaacttccaggcgagagagatcagaaaacggaagaaaaggtgatgagagagttagtctcttctgatcatcacttcttcatcttcaaccattgatcggatcacattttgtttatcgaattcaatcgaagattaccgattttgattcgaaattctcctgttttgatttcaccctccagcggtgatcggagaatttcgccatgtcgtggggattaggatggaagagatcatcggagagtttccgtttaagtctcagctacggcgccgatgatctgaacgacgatccgattcaatcaccgtcggcgtctccattcggatctccaacgtcgatg

SEQ ID NO: 18510 - DNA, 3003 bp, Unknown
  misc_feature (1)..( 3003): 2750-1469P.txt file - cDNA_ID_1818009; gDNA_ID_1621149; Annot_ID_56823
aatataatgtttttgcagaaagaacaaaagggaagcattggcattgtggtacaaacatcatggtttgaacccattagtgattccaatgcggataaagaagctgctgagagagctcaatcattttactctaattggtatgttatattactatatatgttgagatcatatttgtagatatgaagtatagtacttcacccacatatggaatatatattgttttatctatttgtattctaacatgtactaggattctagatcccgttatatatgggaaatatccaaaagaaatggtagatattcttggaccagccttgccacaattttcgagcaatgaagtgaagaacttagagaagtcgagggcagatttcgttggtattaatcactatacaagttacttcattcaagattgtttgacctctgcttgtaatactggacatggagcttttaaggccgaaggatatgctctcaagttagaccggaaaggcaatgttactataggagaacttgtaagtacattcattcagtttcttatattcaatattttacgactatattcaaatgttttagtaaattttattgtttattgaccatgtttctattgttagaccgatgtaaattggcagcatattgatcccacaggattccacaagatgctgaattatttaaaagataggtacccaaacatgccaatgttcataactgaaaacggtacaagacctcaaatttgatcaatgatcgagtcatcaaccatatttgaaattatcatgaaaaattattattaatggcttgaaggttttggagacttgcaaaaacctgaaacaacggataaagaacttctaaatgatacaaaaaggatccaatacatgagtggatacttagaagctttacaagcagcaatgaggtaaataatttatgtaaatttatgcagaaatccaattcttaaaatcatgcattcaaatagtctttaaaccaatttttatctaatgaaaatttactaattctatataagttgtgaattgttttggtagggatggagcaaatgtgaagggttattttgtgtggtcactattagacaattttgagtggttgttcggatacaaggttcggtttggtctattccatgtggatctaacaactcttaaaaggtcaccgaaacaatcagcttcatggtacaaaaattatatcgaagaacacgtgaatcgaagagatatcgtagataattattaaacacatttatttttaattcgtattcactgccaaagaaagtcaaaaattacaaaagcatttaaaattgatacttatcattgttgttgattgttgaatgattaaatttgtcttttcctcctaaaagtgaatgtttaatgtgttacatgattatttgtctaatcttgcacaataattctattagcttaagatgttgaagaacacgtgagaagagaatttaggttttttttttggtcaaaggaagaatagtaattcgtattcctaagtaaagaaagtcaaactaggaaagaatttatgtaacttcgttaaatgaatgattaatggttttctttaccttaaagtgaatgtttaatcagtgttacgcgccatacggaagtaattgtctaatcttgcacaatcattcaacacgttttcaaagaaaactttttttgttctctatgatgataatagtgttaaatcaaaagtagtacaaaagtaaactaaacttattttagattaaaaatcaccgaaaaaactaaacacgcgttagaaagcatttgacatcacctccaaatttaatttcacgcaagcaagcgtttctaagatatggattctaaacgctatatcactgttttttgtaagataaattcttcttaattttttcaataaaaaaatttaaaattaaaaataaaatcataaactaactgataatgaccaaaggaaccataaacacctagaaaattatatttctgtgttttctatctgcggtttaacgtcagtaacatctaggaaagttattttacgaaagtgaacttggtttttgtttgattgaaatatgtttcagactttcagaagaaaaaaaaagatacttatttaaaatatgttaagattttagttcacttcaaattatgtaaacatgctgatttttttttttttttttttttttttttttgcaatcatccttcaatattgtctgcgaaacagtcaagtttcaagtacgattcacaacatttttcaaaaaatttattcattcatttcactcccaaaactttttaatttacaaaactacccgtacacgtatattggttgaatagaaattttttgaatatttattatattttgagttacatatagactatgatttaatcaaatacacaatgagtcgttaaacaatctaaagaaaaagacacacgaacaaactgataacatagataacatataagcaaaataggtcggaatcaacaattacatatataaatggttgcgtggttaatgatttcatttggtattttcacgacaagatcgtttctaggtacatagaagtcaacttcgttgccatataaactgtataacacttagtcatacaatctggtttatttatcaagttcaaaaatttaatttaatcaaaatatttgtttgcgaaattttcaatcgagaattaaaaaattaaaaaaagttgcgtggttgagttaatcgtttggtctccatcgctgatatcttcaatttctctgaattaatcttcacatagctgtataaagacctagaaaagaaaacagatatactagtaaccaaacttagaatcaagaaagaaaaaaacagctatagagttgaataagaagaagaagaagatgacattttttaaaccaattagaatcatcaattttttattcctatttttcatatttcttgtggtatacgcaaccgtgttctgcaaattttgttcagacactggaaacttcaaaagaagtaagttgaggtacgaaacttccgatgatagttatgaagctaggagtagccatg

SEQ ID NO: 18511 - DNA, 3003 bp, Unknown
  misc_feature (1)..( 3003): 2750-1469P.txt file - cDNA_ID_1818013; gDNA_ID_1621149; Annot_ID_56822
cattttgtgggctagggatctacaatccaatgactgcaaaatatttacggcatgcaaaacttcttatgacaagtgtgtttgacacacgtctctaaaatttcaattatgtggatgtgcttatttgtatcaatgcatttcatgcttgcttggcttcgtatggaaaaagtatgagccatcataaaaatttgttaaaaaagattcgagtcatttacattgttttaggagccttttttgatcggttagggtgctagagaacccattacatactagtcatctgggggtattagtattttgtaagctgttttaaacgattccgaattttgtttctatattttgtggtcagatctgatggcctgaaaatcatccccaataatcaaatcttaatgcgcgtttaatattttactaaattatgatcatattattttttgcgatctagtcagtagtcactgtagtgaagttggtgagacgacacccacccaaaaggagtacgtaaagcaattccggcttccaattattttatgctaatcttgtcggcagatgagatggatacatttatacatatcatatataataggttgggaaattgttagtttcgttgataaaataattaaggttttgacttttgactgattctggatttgatttcaggaaatgtaaaattttccagattctgtatgtactttttgataagaaatttcaagttgctgcatgtcaaaaatttcaactaatctcttttgtagtgtataaatttatttactgtccaatagacaattgccaccgatcctaaggagcaacgtacaataccaaaagtttgcatgcataataaaagttcatttaaacataacgtataataattttcagagtgattattgtaactttcaaattttcacataaattttagagtattaaatcaaatagcctttgtaatttttgagtaaactaaatgacggtctttttttactcaaaatcaattacaaccctttaaaatatcctaaaagctttgttttaaaaaagaagataaattatcacaacaagaatataatctaactcactacaaaatgtaaggccaaagaagagatacgttcactgattggacgtgatggagagagctcacatctcgtctggccttatcatcatcgtaatctattgaagatatatatatggtaagacaaattaactttactcacggattctattctttttacccattctcggttttgtaacgaacgacgaaccaccaactagacaacgaaacgtcccacttgtttccattagttaaatttgggtaacaccaaaatcgcattaacttaataaaacactgttccaatatcaaccactgccatattttctcccttatttttttttgacatcaaaactgattttggagaggctttgaaaccccgactataaatttgatttaggtgttattctgatttatgagtgaatagttacacagtcggagtttgaactgaaagttataggattacatttttggtaaaaaattgttgagtcgtatttttggtagaaaacagtaaaattatgttttttgacagaaaattggaggatagtaattttggaggaaatcatatatatgaaaattgaccaactctctccatatgattgacacataatcactttagcatttgacatgtgtctattaaataattaatgtaagctcttcaacttctaatttataggttaaagatatatttattatttaattttacatcttattttattttacgtatttaattatactattactatatttattttaatattacatgatttttcaataaaaccattttaatagttttcttatactctgaagttttttttttttttttgtaatccaaactcaaagtatgagtgtataatagtcgtggattacttaataatttgagtaagttattctcttaaatgaatatttatattttcttaaattgatatttatataataaatcactaagggtgaaaaatgcgtaaggagttccatcatcaaattcttaggtttctagaatccaacactaacctctgttaaattggtttaaaacaaacgttgtttatgaattatgtatatgatgcattgttgagaacgttgctagaaaaaaatatttttaatactaaaagtaattgtttattgcatgattgaatgattagataaatataaattatatttaaattaaacactacaaaagaatccgaaaaaaccgcgacgtagcgcggataattacctagtagtgttaaaacaaaattggaggaaattttggagatcacatttttaacataaaattagtagaaatatatattttaattattaaataaaaaattaaagtaagcgctaaatgtcattaagaaaattttgtgaaaggcggaaacaaaaattttaaaagaaaaagaaaggactaatcacatcatcgccattcaatgatatagtttgacaatgatatgattcattaactaccattcaataaatcggtttatgaaatctaacggttaaatattagttggtaaagcatgattaattaagataatcactcaacaatcaattcaggaccaacgtcacctagctaccaccacgaaggaaaatgctaatacaagaaccaaatcgtcttattaaccagttatctttttctcatggaccacatttaaatcgtcacggcaattaagctagattttaagaaagaataaatgggatactcaactaattgccacaaattttattacttttaaaactcggctgctcggcccaaacttatccggtacggatggatagacctatcttttatcgtgtaaagaaactcttgggctccactcttgacgttgctcattttatctacttttgttggtttcttagtgacctttgacgtttatttacatagagttgacagatttgaattgacgttttctcaataatgcagaccaaaattttcacgtttcttacatgtacatatatatagtaaaacaaatctctgaagacacacaagagaatcaagaacaatg

SEQ ID NO: 18512 - DNA, 3003 bp, Unknown; identical to SEQ ID NO: 18511
  misc_feature (1)..( 3003): 2750-1469P.txt file - cDNA_ID_1818013; gDNA_ID_1621149; Annot_ID_173158

SEQ ID NO: 18513 - DNA, 3003 bp, Unknown
  misc_feature (1)..( 3003): 2750-1469P.txt file - cDNA_ID_1818013; gDNA_ID_1620785; Annot_ID_168123
cattttgtgggctagggatctacaatccaatgactgcaaaatatttacggcatgcaaaacttcttatgacaagtgtgtttgacacacgtctctaaaatttcaattatgtggatgtgcttatttgtatcaatgcatttcatgcttgcttggcttcgtatggaaaaagtatgagccatcataaaaatttgttaaaaaagattcgagtcatttacattgttttaggagccttttttgatcggttagggtgctagagaacccattacatactagtcatctgggggtattagtattttgtaagctgttttaaacgattccgaattttgtttctatattttgtggtcagatctgatggcctgaaaatcatccccaataatcaaatcttaatgcgcgtttaatattttactaaattatgatcatattattttttgcgatctagtcagtagtcactgtagtgaagttggtgagacgacacccacccaaaaggagtacgtaaagcaattccggcttccaattattttatgctaatcttgtcggcagatgagatggatacatttatacatatcatatataataggttgggaaattgttagtttcgttgataaaataattaaggttttgacttttgactgattctggatttgatttcaggaaatgtaaaattttccagattctgtatgtactttttgataagaaatttcaagttgctgcatgtcaaaaatttcaactaatctcttttgtagtgtataaatttatttactgtccaatagacaattgccaccgatcctaaggagcaacgtacaataccaaaagtttgcatgcataataaaagttcatttaaacataacgtataataattttcagagtgattattgtaactttcaaattttcacataaattttagagtattaaatcaaatagcctttgtaatttttgagtaaactaaatgacggtctttttttactcaaaatcaattacaaccctttaaaatatcctaaaagctttgttttaaaaaagaagataaattatcacaacaagaatataatctaactcactacaaaatgtaaggccaaagaagagatacgttcactgattggacgtgatggagagagctcacatctcgtctggccttatcatcatcgtaatctattgaagatatatatatggtaagacaaattaactttactcacggattctattctttttacccattctcggttttgtaacgaacgacgaaccaccaactagacaacgaaacgtcccacttgtttccattagttaaatttgggtaacaccaaaatcgcattaacttaataaaacactgttccaatatcaaccactgccatattttctcccttatttttttttgacatcaaaactgattttggagaggctttgaaaccccgactataaatttgatttaggtgttattctgatttatgagtgaatagttacacagtcggagtttgaactgaaagttataggattacatttttggtaaaaaattgttgagtcgtatttttggtagaaaacagtaaaattatgttttttgacagaaaattggaggatagtaattttggaggaaatcatatatatgaaaattggccaactctctccatatgattgacacataatcactttagcatttgacatgtgtctattaaataattaatgtaagctcttcaacttctaatttataggttaaagatatatttattatttaattttacatcttattttattttacgtatttaattatactattactatatttattttaatattacatgatttttcaataaaaccattttaatagttttcttatactctgaagttttttttttttttttgtaatccaaactcaaagtatgagtgtataatagtcgtggattacttaataatttgagtaagttattctcttaaatgaatatttatattttcttaaattgatatttatataataaatcactaagggtgaaaaatgcgtaaggagttccatcatcaaattcttaggtttctagaatccaacactaacctctgttaaattggtttaaaacaaacgttgtttatgaattatgtatatgatgcattgttgagaacgttgctagaaaaaaatatttttaatactaaaagtaattgtttattgcatgattgaatgattagataaatataaattatatttaaattaaacactacaaaagaatccgaaaaaaccgcgacgtagcgcggataattacctagtagtgttaaaacaaaattggaggaaattttggagatcacatttttaacataaaattagtagaaatatatattttaattattaaataaaaaattaaagtaagcgctaaatgtcattaagaaaattttgtgaaaggcggaaacaaaaattttaaaagaaaaagaaaggactaatcacatcatcgccattcaatgatatagtttgacaatgatatgattcattaactaccattcaataaatcggtttatgaaatctaacggttaaatattagttggtaaagcatgattaattaagataatcactcaacaatcaattcaggaccaacgtcacctagctaccaccacgaaggaaaatgctaatacaagaaccaaatcgtcttattaaccagttatctttttctcatggaccacatttaaatcgtcacggcaattaagctagattttaagaaagaataaatgggatactcaactaattgccacaaattttattacttttaaaactcggctgctcggcccaaacttatccggtacggatggatagacctatcttttatcgtgtaaagaaactcttgggctccactcttgacgttgctcattttatctacttttgttggtttcttagtgacctttgacgtttatttacatagagttgacagatttgaattgacgttttctcaataatgcagaccaaaattttcacgtttcttacatgtacatatatatagtaaaacaaatctctgaagacacacaagagaatcaagaacaatg

SEQ ID NO: 18514 - DNA, 1470 bp, Unknown; identical to SEQ ID NO: 7509
  misc_feature (1)..( 1470): 2750-1469P.txt file - cDNA_ID_1818017; gDNA_ID_1621149; Annot_ID_56821

SEQ ID NO: 18515 - DNA, 3003 bp, Unknown
  misc_feature (1)..( 3003): 2750-1469P.txt file - cDNA_ID_1818050; gDNA_ID_1621150; Annot_ID_56861
ttattttattttgttgatataacagggaacatctaataatagttgttctcttcgaaatgcagagagttagctaaagattttgttgtatctggaactgcttcagaatcactctatggagcttgtgaggcaatgtacaagccagatatggtttgcccgctaacaacctcatcatctcttgttatatttctaaatcccgacaatgaaaatgcttaaattaccacatctaggcgttgcagtttggtaggttcaaggtttagtgttactatgtagaaaagttgaatcttgaattggtgtgaacattaaggtgcataatgcccgtaggaatcacgatagccattagttttctctttgatatcttcaattatccctctctggcatgaggtgtttaatagtctgagcttgttagccatactccattgtactactctagacttatgtatcgagactctggcttaacacatgaggattttcaggaagctgaggaattgttcgagacaatatcgcaagcacttctctcatctgttgaccgtgattgtctgagtggttggggagggcatgtttacattgtgtaagttctcatttcttctcttcttttccacacatttgttatccaaaattagttcttaaaacaaacttccatggtgatgtgttgtacagaacaccaacagagattaaggagaggatcctaaagggaaggatggattgatctgcttcttctattcaagttgttttccgctgtaatccggttttaagtagtgtaaccttcacatcccggtttaattatatgatcattccttggctgaaattatgggttatgtatgaagtttgattttcctcttggataatggattatatgattttaattcgtagagttatcgaagaataacacttttaactcaattgtttccaactaaataagaaaaaacaggggaaactaaaatatcacagtaaccgccagatcttagagcagttacagcgactaactcctcaaaggcctctctaatttcctgtcctaattcgatcggcttgttatgtctgttaatccgcataataactaatctagaataatccaaaatcggaagttggtcgtgatgggtaacgtaatggactcattcttcaccggattctctcattctatcggaaacttctttggttctccacttgactttttatctggaaaatcttgcaggtaattatacacaaaaccatcacttatattacaataatcttcaaagtttattggtttgcttaacggaaacttaaaactaatcttacttggaacagttcggtttgtccatcaccgtgggatttcatatgctacgttgagaatttctgcgtggctaatcttgcgaaaaccgccttaatcctaatcttatcctacttctttctattcttcatctacatgctatacaaagttggtttttggcattgtatcatccacggtttcttcaaactcctatgggttttggtctcttgttggttctacatgcttggctattgttgtagtttcttctgctatgatctgctacactctaaacgtagaagaagacgcagacacaacagatatatagaggaagattatgatgataatagtgatgacgatgatgatgttgatgatgatgggtcgttcacgtaccatagatcgaagcgagaatgcagaaaagaagaacgtcttagaaagtctctgagaccgaggaaccatcgtgttagagttggtgtgaggaaagaccatcgttctgactcgggtttgagccaacatgctgatggtggtagtccgatacatggtgttagagtgagtagagagtctaagttcgcacggaaggtttcaaaacgcagaaatcgagttcaccatggtgatagaatgaaccatgtcagtcttcttaattaatacatcacaatggaggaattacctgcaactgtcaatgatctcctctaagctttataattcctcttcttgaaagttgaccagctgcatgggtcaatttttataaaccaatctctctgtgtttttggaccttttcattatgtttaattcttgcttcttcggtttaataagtattgtaatcaacataataccaaatatttagttttgttatgacttatgagggcaaaaccaaaacatgaatgagaatctttagagtgctcgcaaaatcttgaatcaagaatcatatttatggtaatgggctcctcaatattgcttcagggacaacagctagaatgtgtgatgtacctaaaggaccacaaaaaaagaacacaagtttcagcaatttgttttcattggtcaacacatcaattgttcacaaaactacaaaacaatctaactgaggttttactaacatgaatcatgtaaatatgataggttgctcgatttgtgcaaacacaaacaataagaaaactataagacttaaggaatttcatcacacacaaaaatacaatttatttttctataatctataatgttttgctttcattccgattatacccttgataatgatgattaggtgagggtaatttcgttatttacaattaaactcacataattacaaaataatgttgccttgccctgagataaacatcaccaaaaaatgttttttttttctttcttagagcaaacaatttgttttcaaaaaattattatttttggcagctcagcaaaattatttaattctttctgtcagttcatcaaataatttaaatattttgtccatgtgataataatatgtagcgcagagagtaaaaataaataaattcatttacagaattgttttgtaaccaattagatagcagtactttaatatctgaggctattttcgtcattttcaaattatggtgtgtttttttggagggagtgggaaaaaaaaaatcgatacatgaatgacgtgacctccattgatttcggcgaacgagcttcttcttcttccctctctctctctctttggctccatctcttacagtaactgtctcttggaaccatttcctcttcactagtatcttctaacaatg

SEQ ID NO: 18516 - DNA, 3003 bp, Unknown
  misc_feature (1)..( 3003): 2750-1469P.txt file - cDNA_ID_1818058; gDNA_ID_1621150; Annot_ID_56858
tgagctctcagatataatcgattcatggatcagagatatctctaactggtgagatcataaggataataagaagcgcatatgaaatctgcatcggaaaaaagttcacaaaccaatgccataaccggattcggagacttcacaaatggaagcttgatctcagtgtcagaaccttgctcggaatatcctgcagacgcaagcggacaattagtatggcatgtcaaaggaaataactatggaaagtaattcattgctacaaattgaataaaacaaaatcaccaggtaaatccccatttgaatctgttcctttgtggtcatatccatttgtagggttttccgtattagttacaccagaaacctcaacattatctaatagaccatcctccacaggtaatcgaagaaaatgaagaatgcattgagcttttgacttggaaccaacatgatcagcaatttgaacccaattttcattgtagagttccacagcttcaagaagcaagagagtttcctgatcagtccaattgtctccatcttgatcgccataaaatttcattggatccactcttacaaagtcaagacaagaatgtccaacaacaaatcttccatggtgaaaacaatcacagcataagagtatatccccctgtaaagtagagatgaagatcctttagttagaagcggtccagtatccgagacagtaagcaagataaagcttggagtctattacatcactgggtgcaaaaaagaatcagataatgatacacaaagaacagtacgtaaggggaagcagcctaagaaccttcttttgcgattggaagtacacagttggaagcggtcgagaacaatggttgcaatgactatcacataggtgttcacgaattctgatgtccaagtcagggctgtcaccatccaaacttggcaaggatgaatagacttcaccccccttgtgtctacagttgggcttgtcaaatttgatcaaactatcaatagatgttaaagcagcagacggcacattgacctcgccatttgtgtcctccctcacatccgatacatctctcaaagggccaggatgtgactgggcagtggcacagtaattgattattccccagtgatcaagaaaacggaaaactcgtgcaaaatcttcaatgtcaacaccatctaccaatccttggcaatcagaaatcgtcagtgtcttttcagggttctctacatatttggaaacaatggcgttcctgaattccatataactttcgggtgtatgatttggcgatttcccagagaaaaactgtggcaccacttgcctttcaagtcgatctactgtgtttggtgcaaaccaatctgctcaaatgtaacagcaaaagtagaagaataaattcgagcattgggaacaaaaatatcagaaaataaaaataaaataagaggagaatctcgatatatttgagccataggactccaggaacaaaacccaaacgaattagaagaacatcacttgcatagtctattcaagttgtacttctgagataagacacctaaggctacttcaagccagcaggtactctaatttatcatgtacaaaagttataatacctcttcctttccatcagacagaacatgggaacatagagaaacatctgatatgaaattgagtcgcgttcagattaatgtaaactaagaaccaggcactagacaaaaggaagataagaacttatacgttaaggagataccggcatacaaacctgttttgactaattctcattccaatcacaagatatatactacaatactaccaaccagcaaaagctgatgctgcataaagcctaacctctaacataaatgcgcgtatcaagaggaagaaaaaacacacctgaatgcataggcaagacatgaaccagatccccaaaccgtttaacaactccttctccatccataataggtggtggagagataacataagccgaagacgatccatcactcctctcaagatcaagagaatcagcaggtacagtagataacgcttgcaattgcccaaacgaaatgttctccagagctggaagtgaaccttgccctctagtctcccctatcaaaccagctctctcagccgccacaacagccattacagacgcgtgtggccggatcacaacacgcttaaccactgccgggaaatcagagatgcgcgaaccagaatcttcaactacctcgccaataccaagtcccggatcgggagttgcgccgccgttttgctgaagctcatcggcattttcaacgtcatccatttcttcgttgttgttgttgttattctcttcgtcttcttcctccatatcttcctcctcttgtttcggtttcctcgccgccgataacccccctctcttcttccttttccatttccctcttctatctgcgacagaattgtaaaaagtgtaattcaattcacacgaattctcgaaatacccatcactacgatctatgtgggtaagtcaaatcccaatttaaatttggattttgagagagataaagatgtgaaacagcaatttaccttcagaagctggcatttttgtggatgaagatagagaaatagaggttttgggttctgtggaatcgaagcaagacccttagtaaaaagaattgctttctttgtcttctctcctccgagtcgttctgatttccagctctcgagctaaacaccaaacctttttctcgcaatttctttcaccatttccttcattaatctctatatattaattcattctccacgacgacctaaccttctcgacaaacaagagggttctgatttcgaaattcaagcttcgttgaccaatccaaattttggtttaacttcggttaaagtcaactttacttcggttttatttttcaattttgaatgagaaaaaccgaatcaattatttagttcggttcttaaagttcaaattggttaaaccggtttaaattgatacattagtcgaccgtcgcgcattaatactggtgtggtggttccgttaacgagcaacggcgatg

SEQ ID NO: 18517 - DNA, 3000 bp, Unknown; identical to SEQ ID NO: 7528
  misc_feature (1)..( 3000): 2750-1469P.txt file - cDNA_ID_1818061; gDNA_ID_1621150; Annot_ID_56857

SEQ ID NO: 18518 - DNA, 3000 bp, Unknown; identical to SEQ ID NO: 7528
  misc_feature (1)..( 3000): 2750-1469P.txt file - cDNA_ID_1818061; gDNA_ID_1621150; Annot_ID_173208

SEQ ID NO: 18519 - DNA, 3003 bp, Unknown
  misc_feature (1)..( 3003): 2750-1469P.txt file - cDNA_ID_1818067; gDNA_ID_1621150; Annot_ID_56855
aacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtagccaaccaccgaccaatccgccatgaatatatctcagattattttcttcgcgtcccttcttctacggcttcacttatcaacggcggaacatcaaaattcaaacgctggtgatggagacaccatcatattcaccactctaggacgatcgcactacgaatttgacatattcgccctctccacgactcaaccgccgtcagtttccggagagctccgaatcaccgatggggaatcggtaaatttcaacggctatttcccgtctccttctccggctctattatctctccttcccgacgaaaccctaattcaaatggaagattcgtctcctctgcatctcatatacgtcaccgagagaaacggtacttctagcttgtactacgatctagtttacggcggtaattctgattttaaaacgaaacgaagatcggtgttagaagcaccgtctcgagtccaagttccgttgttatcccgctttgatcatctgagtggcatgacggtaaattcttttaaagataagcctagtttgagtggtgagtttattgtctacgtgtcaacccatgagagctcaggtgagccgagagcaagctggaccgccgtttactctaccgagttaaaaaccgggttaaccaggcggttaacaccgagtggtgtagctgatttcagcccggcggtatcgccttccggaaatttaacggctgtggcttcatacggagagagaggctggacaggggaagttgaagagctacgtacggacatctatgtattcttgactcgggatgggtctcaccgtgtcaaggtggtggagcacggtggttggccgtgttgggttgatgagtcgactctgtatttccatagaagaagtgaggaggatggttggatcagcgtttaccgagccatcttacctgaaaacggaccgttgactactgagtcggtgacaattcagcgagtcacaccaccgggagttcacgctttcacaccggccacgtcaccaaacaaccacgagttcgttgcggtagctacaaggagaccaggctcggattaccgccacgtggagttgtttgatctaaagaggaatgagtttatagagttgactcgtttggtggcgccaaagagtcatcacttgaatccattcttgtcccctgactcgtctcgagtcggatatcatagttgtagaggcgatgctaatggacggagaagtcctctgctcttccttgaaaatattcaaaccactacaagggacctctctctctttagaattgatggttcgtttccttcgttctcacctggaggtgatcgtatcgcatacgttaagatgcctggtgtgtttgtggtgaagccggatggttcagggcagcgtgaagtgtacaagggaatggcgttttcgacagcttgggatccggttcgacctggaattgtgtactctagctcaggtccaacgtttgctacagagagaacagaggttgatgttatctctattgacgttgatgcagccgataagtcatcttccgtgaggaggctaacgacaaacgggaagaacaatgctttcccttggccatctcctgatggtaagcggatagtgtttcgttcggggcggactggtcacaaaaacctctacataatggatgctgagaaaggagaaagcggtggtctatggaggttaaccgaaggtgcgtggaccgacacaatgtgtaactggtcaccggatggggaatggatcgcgtttgcatcagatcgagaaagccctggctcgggtagttttgagctcttcttgatccaccccaacggaacagggttaaggaagctcatccaaagcgggacgggtgggagaacaaaccacccgatcttcagcccggacagtaaatcattagtcttcacttctgattatgctggaatctcggcggaaccgatctcgaacccgcatcattaccagccatacggtgatatcttcacggtgaaattagatggctctaatgtgaggaggctaacgcataactcttatgaagatgggacaccggcatgggcccctcggttcatccaccccaacaatgtggagctacaaaggaggaatgattctaggtgctcgttcgaagactgtcactggctcaacaagtaccctacactaaaaggccgaaaaatatcttgttaatatgtatctacagttttgtatcccagcttgtaactctacttatagatttgtatgagactgccactgtatatgcataagactttgtattatagagatcgttaatgtgatatgtatatcatattgtcaaaacagtcgtgataagatatcaaaccctcttctaaatgatagtcttgctattgcggtttggaatcctcatgaattatccaatgtcaattcaatctcagcgtgattgaagacaggtttttaaattccaaaatctcttctttaatcacgtttataaatcagttttgatacattattactatgttttgcgtacgtgtcagaagattactatccatgtaatgtctgaagaattaggtgcgagtcaaaagtcataacagtcgataagatatcaaaccctcttcgtgacttggaaggtttgaggcgggggcgggaaaatccagaaaacgtcggataatgtttataaaggagtctctccgtcaccggagaaaaattagaagaaaaaagaggcgaagaagagagaggaatg

SEQ ID NO: 18520 - DNA, 3000 bp, Unknown; identical to SEQ ID NO: 7531
  misc_feature (1)..( 3000): 2750-1469P.txt file - cDNA_ID_1818079; gDNA_ID_1621150; Annot_ID_56851

SEQ ID NO: 18521 - DNA, 3000 bp, Unknown; identical to SEQ ID NO: 7537
  misc_feature (1)..( 3000): 2750-1469P.txt file - cDNA_ID_1818083; gDNA_ID_1621150; Annot_ID_56850

SEQ ID NO: 18522 - DNA, 3003 bp, Unknown
  misc_feature (1)..( 3003): 2750-1469P.txt file - cDNA_ID_1818091; gDNA_ID_1621150; Annot_ID_56848
aatctcaagctcttgcaatcctacagaggaaacaagagtggtcaagagaaagaacgaggctgtaatggctgagaaacaagtcgttcttgccctgaagaagcccgaacatccacagacacgtgtaatcccagctcctcagaatctgaacatcccacgaacaaccccggacctgaacttgccaagttgacatcacgattgacaaaggagctcttagaaacgccggagacaataacctctggcctcttccttccttgtattttgaggtggcacggcattagtcctggcgatgccgatgcttggtttttttagctacaaagcatggtttataaagttgtctgtattccagtttggctcttattaagttagttactctatttacgtgtcctttttcaaaactctaatgtataaagttatgattttacgggcaactctttacttttgagtaaaaaaaacagagcaggttttagtactgaattttgggtaacgtagttgaaaatttgatttcggacgataatgtaaaattgatgaaatacatcaaaatgactacattaatccttttgacacaatatgaataatcaattttaattaatattattattacttgtaaaacagtataaatatggctcattatttcacagattctcaacactctctcattctccacaatttacgatggcacaccagctccgttttgccgccgcaagagaacccatctcagaagagtatccggcggttgctcttcctcatccacgttgcatctccgtcgcgtttcctcctccgagattcacaccatctccgtcgcctttaactaattactcattcttggccgcattaactcctcaagaactggagatgcgtttgcaaattgcaatggatgtccgtaatgactaataacgaagatcatgttgcggctccgtttgaagagatgatctcgaagttagaccaaagaaagcttcaaacgatggcgtcattgctgacatcagatcccgattacttcttgatgatcgcaagaaacatgaacggctccaaacgcattcagaaacttctcggaaaaacagatgacgtggacgctttattcgccgccgctatcttgcgccgcttcctccacatcatcaccgacaagtacgcgtcgtacgtggtgagacgggggatgacagttttcgataagaagaagaaaaaagcaatgtacgagcacattctccactacgcgagccacatagcgcgtgataaacacggtaacctcgcgctcaacgacatcataaccgacgcggtacagaaacaagctctttgacgtaatcgcgcacaaagctcttgtactaagcaacgatgcttatgggaactttgtgatacaacgcgtgcttaaactgaatgacttgcgtagcaagaacaacatcgtcgttagtctacgtggccactttgttgatctctcgtttcagaaatatggaagctacgttgtggatgtacttttggagacgaaggagtcaatggttgtggtggtggaggagcttatggaatgtgaaggagatatgttgatgaggttggcgaggaatgagtatgggaatttcttggtgtgcaaggcactgagagtcacgcagaaggagatggttaggactgatctgttttggggtttggtgcataagctcaagccttttcacaatctcttgcgttggtctcgtggaaagaacattgcatccatcttaaactcgattcgttagttcgtctcaaaactagttaacattgttcagttattaaaatctctgctgaaagttctcgatttgatgttgttagctaactcttttaaggaggtttaccataacttgtcaaaaacacaaagaaagggagaagagggattgatatacagtatatagaattctctctttcgtgttattacttattagaacaagtttgaaagctgaagcactcacagtaatttctgtaattaaggacgttttgccttatgatcaaattctacaatagatcacctgaaattttaatacaaatcctaaatccatcaaggtatgtatcaaattgagatttctgtaactactagagtttgaccaaacagttttagttaacctgaatgtgtatgcctaattgcctattgcctcataatgcatcaagcaataccatctactaagcgaaaatggctcaagaaacaaacgtagagaaatcaaacattaggcattaagatttgggatagatgtgctagaattttctttgattgttacgataaagaaacacaaccctccaaaacatttttatatgattgctttttttaggtcgggtttttatatgattgttatttccaaggaaaactaaacacaaaaaataattatgaaacgtttttcggattgttattattagtaatagattaaatctgtatttctaaattttaaattttattaccaacaaataaaatgatatgatttcatatatcaaattgtaagttttgtgagcaaattttcaaaaagaaactgtgggtattcatcaatgataatctatatttggattattatcatgacaaaaaaaggttacagaaaaattaaacaattgtagatattgtttttattttagatgaaaccttctgtccgtattataatttgcatctcgaggttcttatacgatttgtactgaataaaacatattttttttgtttttaatcataactttcccaaaaaccatctcttccatcgctagctgtaccggtttcaatctcaaatcctgggaattgaaatttgtttctctgtcggagaatcatcatcgacttctctgctacttctctccgcgctctccttcgtcgtcgtcgatctcttcagcttcaccgatctcatttccaatcctgaaaaatcgatgtggtactgatctacgattgtgctccgttggtagccttatgaattagggtttttcttacgcatcttcgtatgtggagattggatcgtgttcggaaaacttctggacactgtcttcgctgctagatttttggatcatccttttgcgaaaatg

SEQ ID NO: 18523 - DNA, 3003 bp, Unknown
  misc_feature (1)..( 3003): 2750-1469P.txt file - cDNA_ID_1818099; gDNA_ID_1621150; Annot_ID_56846
cacgccggctacaagttctaactagtccactcaacaacagtcaacaccatcccaatttctcaaatacaaacactttgttccaatcttgaatatgaaaatatctcatcacaagaataatacaagccatcataatcatcaattgaaaacttgaattaaacacctcaaaacttgcaaataagctagcttctctagtcattgaatgttagtccatcaaactattgcatctacacacttttttctagaggcccatattcatctaataacacatccatctctgctgctagtgcagtacctgaggtcaccaaaattgtataccctccaccatatcatcgatttagatcatctgctctcgttttccatctcaggaagaaagttatgctgacttgtcgtttggtgtctctcgagttcttctagaaccaatttgagacactgaagtctcgtagcttcctgagatgtttctccatgtcttctctagtcttggtccactcttctctttctattaccgttgttgggtcatctctttcaccctgaaagaatggaaatatatagacatagagtgaagatgagtaaagctagatgaaggaatacaaatgactgccagatgaaatggatttggtcatttggaaatggaaaggtaccacgtgtatgatcttaaaggaggttccattatctcgtatcacaagcaagtcatccttcctatccctttttcttcctcccggaactgtcacctgaaacaatctaaaaccttaacatcggaaagaagattgtcttcatagctttgagctatgcacagtatttaaagaactcataactcaagatatctgattcagaactagaggcataaatagcactaatataaaccagcatttcattagtgttatagcatgaaaaatattctataagaatatgtcaaaaaacccaattggctatggtctacggttgaggtttgtgctcagactcggaatgagaactttgttaataatgcttaaataacttggaagataagaattagtcataccagaactctggctctggtgattgactttgtcttggaatcaataacatatatctcttcaagatctagcacaaattctggatcgtttgtccttctgttccggtaatgttttgtcaagaaaacctgcataaaaaataaacacgatgaagacaatttgtatcagaaactgtaactactaaactaagtagtttcgtgttgatctcatccttaatgcttaaaaaacatatttcctggtgtggtttccaaaaatgttgtcaaatcaaaactaagtacatccttgttaatacatgttgctcaagactccctgcatcaaagacctaatggatttaacatcaatgtacatggtccaatatgtaccttggatatctccctctcagatttgtacagtggatctctgggggcatcaataggtggttcagtgacattgtaacatccatagtcactcattgcacatcgaatatactgtacttgtaacatcattaaacaagcccttgttagcaccactcactcattgtaacaacttgcttataaataaaccttacaatgtaaaacatacgcaatcatgaagcagcaaagagtacaaaactggccacagaatgaaaggaaagtgactaaacaaacacccagctgctacattctgactctctaatcatactaaatgctgaccatttacggcactttttgagattatatgttcaaaattccagtctatcagtgtgagtagaagttccaaacaataccaaacgtgtacagctctgtgtagataagatttcttaagttatacaattactaggtagagtgaaggtatatgggttatacaattactaggtagagctctgtgcagataagatttcttaagtgatacaattactaggtagagtggaggtatatgggttcaattagcaattaagcacaatatgaaaagcaattatcttgctgaacaaaaggaagtctcagaacaacgcataggcattacaaaaacagcaaccgataaggataaatgactgaccttttgaggcatcggtgcaagaactctcggaattgagtaaatatctgtatccggaggagtaacatacatctgcagccacccacacaaaacaatttacaattgaagaatgagcacagactctagagaaatcgaagaaatgagcaattagagtcactgggaattcacacacctctctgaaatcataaacatcattatctggatcaggaggttttctgataaagaaatcacagtccattaagctgagtttatgaaactcatcttcgtttatccgataatcaaccaccatatccgaatcccatccttgtgtcgatataaaactcttactctgaacaaaagcgatatctccatcaccaccaccgcctgcagcggctatcgcggcggccaaggggtcatactcgacatcatagtccttcttgttgtcaacttcctctacctcctcatcatccatatcatactcgtccgctccacctccatcagcatcgacgtcatctactttaacgactataccacggccgcgtcgggatttcagtgttaaaggcgcgaaaagaccgtccgttctgaatgacgcaaatagccgctgagagccggagggataaggtggcttcgaggtgaatgagagtagagataaggaaggagaagcggcggaagacgccattggaagcggataaagctcacagagtgttctatctatctgtggattagatatttcgaggaaaaatacaattaaaaaaaaaagaaaaactatataatataataataatcctttttagtgaataaaacaacaaaaataaattaggaaataattaagagcgtcatttttggtatcccgcgcaactttttcttctcagtttcagtttctctacatcgattcatcgattccactctcttgattgctgtttagatcaatccgtctcgaacccaggggttagtatatagtggatcaaactgatccgacccgacccgacccgaattattaatg

SEQ ID NO: 18524 - DNA, 3000 bp, Unknown
  misc_feature (1)..( 3000): 2750-1469P.txt file - cDNA_ID_1818115; gDNA_ID_1621151; Annot_ID_56890
gctactatgtgacttgtatgacaaatacagtcgaaacttaatatgatattcggtacccaaatgacaaaaacccacgtacatcaaaagcagagaggctttataagaaatctatgactatcaattttattttttcccataaattatatgcatggtagaaatattatgaaatgagtttccttaactatggttggcaactaaaaatgtctttagtgacaaaaatatgcaacttttctacaaactgcaaatattagtttagattaaatcaaacaaatcatgccttcaaaaatctgtaaaacaaatctttttatttttaacgccggtggcaccatagacgaaatcgacaattttgaaggttggagttggatttgtctgaattttttttttattggaatttggaaagcagctgaaagatgactaaatgcgcagcaaaactcttcattcaggcttggcgtaacttgaatttgttttctttcttctatttttttagtttcattctagtttccgatcaagtcttatggttaaaatactcaattatatactcatcatttaggcatcgaaaacggtcctaacaaaacaccaaacatatattcctaggctttcacgtgtttaattcttacccgcatgatacatttccctcaaatggattgacataatgctattgttgttaactttttgtttgacacaaaatctatctagcaaattttttatagttatagatttaatatacgcaatgttagcttgattttgtttctaacttaaggaaaagttgaaggatgttttaatttgcaaggttctctttcaaaaagatttcgtgtaaattcgacaacggcctcaaacctactctaatcctgactctaaataatattataggttgaaagctttgtaattattgtttactaaaataagagaagaaaacattattacttactctcctttagaaatatatgtttgcattatgctgtatatatagatgaataaatgccataaacgtttaaatgtgtgttggtagatgtcattttacttcattcttagaggtctcttctatcaaatttagttacgtatataaatatagatgtcttgtgctttcttgcaaggaaataaacagagataatatactatttcatacacatccacacacatatagatgtctttttgtttgttgcatggatgtagacatacatccattcacatttccaagtatatacactaacctaatgacctaatgttcttgagagagacttctttcacaacctcttctagaatgtgagtttcttatatttttgttggtataaagtatttgaacatctttatcaaaagttaaaatgtttgaccatattcttggtaattcaaccggtaagtaaatgttattcttctatgacagaacccttaattttgcctgttgtatactagaggtttggttgggtgaaaagtgggcatgataaaaagaacaacatttagttttcctccttgatttttctaaattagagtttcgtatcaaaatacctaaaaaagcttgttttgtggtgcttccaatttcgaaatcggctaaactttttccacatgatttcttcttttacgatagtaagatttagaagaaaataaaaactgaataacgtcagattttccttaataaaagaagaagaaaaatctcacaacattttaagttcctttatttttttgatatgtgccctaataaatgcagtgaaataagctcacaacaaaagatgcacaacgagataaagccaaatgaaatttagtactggtatacaaattttaatgacacgttaatactctttttcgttttggttttataatcgtacttaatattcataactagcttcgaatctggtatttgtatacttaaaaagcttacatcagccaatctactatcattgaaattgtagtgagaaaatctaatataattctttagtgactgtttgtcaaaaaaaaaaaaaactcatgtctaaagtacataacaaattcaaattttgatacaaaattagttatttgtatttgttgtgaccatttctattctacattttgtttgattattagttgaattattcttagttaaatagagcaaacaaattaaattaaatgatttcttaatctataattactgtaaatacttcaaacatcttttaaatagaaacaaataaaataattactaagacatttgtccttatataagtctaataaatgtgtgttttaattcaatacctccaaaaataatttcaaaaaactagagttactgaattggtgctttcacacggtgcatgcattgtattcacacctatatgcatgtcatatattcatggtctctatgatctcgctctatataaacaccacccaatcgaccaaccttcttctctgattattttctcaaattatttaattaatttcttcttcttcatcaccaccaattacactcaaaattatggtgtttgcacatttgaaccttcttcggaagattgtggggattataggttagtccagaattttgacatctacaagttattatatctatcatgatttttttgtcccttcttcttaactttggatgatcttgtttgcaggaaacttcatcgctctatgtctgttcttgtcaccaacgtaagtattttgctatatctatgatttaaataaaattccagaaacaatgaaagatacgtgaaaaagagattcataaaaacgaaaatcgtatttcttaaagaaaaccaaacttgtttcatgaatttaacacatgcatggttcatcctgactactgaaagatctgaaattttttgtttttcattctcactgcagctttcaaaattttctttgtgtagtataatcacaatgtgaaaattgatacttttttcctcataatataatgttttttcctattatactaattgataacaattaagaaagtttatttatgtaatagagtttcttccaaaacaagagaaaaactaaaagtatgtatcatcaataaatgactaatacttttaataaatg

SEQ ID NO: 18525 - DNA, 3003 bp, Unknown
  misc_feature (1)..( 3003): 2750-1469P.txt file - cDNA_ID_1818129; gDNA_ID_1621151; Annot_ID_56881
ttatttaccgttattttgtaccattttaactattcgcattttcggcttaaaaacttgtatagcgttgtgtcaatgtaattttatatgttaatgttaattattacaatttctttttctctaagttttataacccaaaaataattatttatgtattaaatattagtttaggcctaatgagtaccatgtgaaagagtaattgttctactttctatttttgtatttcatataaagtttaatcttgttcttctgaattagtttgtattatgtttacttacggtcaaaagaatctgttagttactgtcaaaagttaaaacttgattgttctgtcttaatttgcaggtggatcttcgagacaggtctgctcttgagaagatattctcagaaacaaagtatgattgagaaaaaaacaaacattcttttagcttcttcactttatcactaacaatgagtgataatgcatattattgggtttattctttattgattgatgaacgtggaattattattattttacaggtttgatgcagtgatacattttgctggacttaaagcagttggtgagagtgtagagaagcctttgctttattataataataatcttgttggtactattactcttttggaagttatggctcaacatggctgcaaaaatgtatgtataatttgccactacacaacaagttcgaatccatttttactttgcttgatcaattctcatgattagctacttttactctgtttccagcttgtgttttcatcatcagcaactgtgtatggctctccaaaagaagttccttgtacagaggagtttccaatttctgctttgaacccatatggacgaacaaaggttgttttcttgacaaaacccacttgagtattgtggttaattatgaagtgtgaatctgacttattatggatgtttttgtagctattcattgaggaaatctgccgcgatgtatacggttctgacccggaatggaagattatattgcttaggtatttcaatcctgttggtgcacatcctagtggtgacattggtgaagaccctcgtggtattccaaacaatctcatgccctttgtacaacaagtggctgttggtaggagacctcatctcactgtctttggaaatgattacaatacaaaagatggaacaggggtatgtacttgtcttttatgttttcataaaacaagaagaggttttcaacattttgatctcatgttttgttttaggttcgagattacattcatgttattgatttagctgatggacacatagcggctctacgtaagctagaagattgcaagatcggtatattatgatttccattcgtttctcttatctactacaatcattctcaagtctcttaactttgtttgtgtgttgtttatattcaggttgtgaagtgtacaatctcggaacaggaaatggaacatcagttcttgaaatggttgatgcttttgaaaaagcatccggaaaggtaaaaagtgacactttctttcatctttagatacttggattctaagtcatgttttgttaaacctttgaactcttttgtggatcagaaaatccctctggtgatcgcgggacgtcgaccgggagatgctgaagttgtatacgcctcgacggaaagagcagaaagtgaattgaattggaagtaagttcatacatacataaagctataactttgaagatattacttgcacaaaattgtatgttagacactaaaaagttgggaatatgtaaatgagataagtctaaatttgggttggtaacaaatgcagggccaaatatgggattgaggagatgtgtagagatttgtggaactgggctagtaataatccttatggatatgattcctcttctgaagacaactctcattaacttttcttaatcgttttcttcttttgctaaaacatatttctccacactaaattattatagtatccgcaagaaaaaacaacaacaataaagagtcagattttagggaaatatagggacattatgtattattattacaatcaatacttagtctgtaattgatttggatatgttcttgtataatcaaaaaagatttgttatgaatagctacaacgcaaatgtttagctctatacggcaaaaagtaccttgaggttgacacgacgtcgttttcagctcggtgatagttgaaatgtatctttctgaagcttttaagttcaagagcccacacacttcttctcattctttataaacataacactggacagtaaccaaacttcagatctgaatcaacctcttaaggttcgtttatactcattctgtttttcactgatagtttatgcacaatccgaatctttcttctatgtgattgttttggatttgattataaatttgacattatcattaatttagaatgattttgtgtgtgttgggttgtttacaaaatcatttctttgaatgagtttgttttaattttgtgttagggttataacgcgattgggaatttagttgaatttagaactaaatttgtgctagcttgtgatttattgtctctaattttgaactactaatatttgattaccatatgtttagtggtacagaagaagagaaaggaatgatgattagtgaaagagatgattttagtctcactggaccattacacttaacatctatagattggtatgcatctactacttctactctccttttgcatttttcgagattttgtttcgtcgaaaactgaatctttatgtttatgaaatgttgttgagttagctaatgtcttggcaccattagtttagagctaacccttgtgttaaaagacctgaaaaattgttcctttatgtgaaaaatgcttcatttacttccattttcgagattttgttatgtcgaaaactgaaactttgtgttcatagaatgttgttgagttagctaatgttttggcaccaattggtatagactttagagtttagagttaacccttgtgtttaaaaacctgaaatattgttcctttgtgtttaaaatg

SEQ ID NO: 18526 - DNA, 3000 bp, Unknown; identical to SEQ ID NO: 7545
  misc_feature (1)..( 3000): 2750-1469P.txt file - cDNA_ID_1818137; gDNA_ID_1621151; Annot_ID_56878

SEQ ID NO: 18527 - DNA, 3003 bp, Unknown
  misc_feature (1)..( 3003): 2750-1469P.txt file - cDNA_ID_1818153; gDNA_ID_1621152; Annot_ID_56913
aaaagaatggtttaagattgaagaagagttaaatatttttatttattctttcaaaaatattaaataatcaataaaaatcatatttagaagatattttatggacatgtgattttggcaatttccccataggaaaaagcgaaactctctataattgattgttactggctttgatactttgaagactgaacacaaacaaaaaaatctcttatcacaccacctccaatggagagcattggcagccattgttgcagctctcctttcaccttcatcactagaaactcatcatcatcacttcctagactcgttaacatcactcacagagttaatctcagccaccaatctcaccgactcagaaactccaattctcgtctcacttgcactgctacttcttcttccaccatgtaaatgactccttcatcttcttaaatttggtctcttttgatcatgttattgaaattgtatgagtaagtttataaaaatcgaattttgatttgaccctagtgaggaacaacggaagaagaaagatgggtcaggaacgaaagtgaggttgaatgtgaggttagatcatcaagttaattttggtgaccatgtggctatgtttggatcagctaaagagattggttcatggaaaaagaaatcgcctttgaattggagtgagaatggatgggtttgtgagttggaacttgacggtggtcaggttttggagtataagtttgtcattgttaagaatgatggttcactttcatgggaatctggtgataatcgtgtccttaaggttccaaattctgggaatttttctgttgtttgtcattgggatgctactagagaaacccttgatttgcctcaggaggttggtaatgatgatgatgttggtgatggtgggcatgagagggataatcatgatgttggtgatgatagagtagtgggaagtgaaaatggtgcgcagcttcagaagagtacattgggtgggcaatggcaaggtaaagatgcgtcctttatgcgttctaatgatcatggtaacagagaagttggtagaaattgggatactagtggtcttgaaggcacagctcttaagatggttgagggtgatcgcaactctaagaactggtggagaaaggtatcacttttggactgttattttagtttcctcttacttgttttcctttgaagctggggaataatgaaacattacctcaattttgaaatgtgtttatgtgttcaagcttgaaatggtacgcgaggttatagttgggagtgttgagagggaggaacgattgaaggcgctcatatactctgcaatttatttgaaggtttctcttgtctttctatagcctaacctaagttatcttttctcatatatctgggattcaccttgcttactctttttgtttgtttgtctggcttcttatgcagtggataaacacaggtcagattccttgttttgaagatggagggcatcaccgtccaaacaggcatgccgagatttccagacttatattccgtgagttggagcacatttgcagtaagaaagatgctactccagaggtgacacattttttcgctttcaagatctcgactttcaagtctctcttctcaaatatttgtagttggtgtgttcatagtatcatcttctttaagttggatatgattttatttcgtaggaagtgcttgttgctcggaaaatccatccgtgtttaccttctttcaaagcagagtttactgcagctgtccctctaactcggattagggacatagcccatcgcaatgatattcctcatgatctcaaggtaataactcttttctcctgttttgtcattagatcagtttttttaatggtatccatataacatatctatgttccagcaagaaatcaagcatacgatacaaaataagcttcaccggaatgctggtccagaagatctaattgcaacagaagcaatgcttcaacgaattaccgagaccccaggaaaatatagtggagactttgtggagcagtttaaaatattccataatgagcttaaagatttctttaatgctggaaggtatttctgaaaccacctatcatttcgtctgattaacttgctaaatgatggtcccatggactgtagaattcaatagctcttgtatcttgttgcagtctcactgaacagcttgattctatgaaaatttctatggatgatagaggtctttctgcgctcaatttgttttttgaatgtaaaaaggtaagctctcacttttcttttacatgtgattcagtgcttttctgttggaagtatgcaatatttattgggttttcttgcatgatcttctgaagtggtatttccctagacacagcaatgctagggtagccaccgtaaagatgcagattaaattaataacaacccatccttggttgcattctctattccaataaaaggaaagaaaatcaaaaccaaagggggatgtactcttagaaacgccacaaaaggagaaatgttgatatgtgtccatataatcacatcatttgataaattgtgcatgttatacacaatcaatgagaattttgttattgtagtctcttcataagactgactgcgaaattcatatttccagcgccttgacacatcaggagaatcaagcaatgttttggagttgattaaaaccatgcattctctagcttctttaagagaaacaattataaaggaacttaatagcggcttgcgaaatgatgctcctgatactgccattgcaatgcgccagaaggtgagctattttaaacaatccagcattatcatgtaccaatttatttactaatatagtttcctcgtttcattagtggcgcctttgtgagatcggcctcgaggactacttttttgttctactaagcaggtgtgcataagattttgattgcttttaagagctaaatttcttttggaagttattaaaactcctgctacctttctccgtctcgtcttatgtctcgtcaatgatttgtgtagattcctcaatgctcttgaaactatg

SEQ ID NO: 18528 - DNA, 3003 bp, Unknown
  misc_feature (1)..( 3003): 2750-1469P.txt file - cDNA_ID_1818157; gDNA_ID_1621152; Annot_ID_56912
aacgaggacccaatgttgtacgaatgatatcagcaacagcctgtaccacaaaaacaacgatgatctgaaaccagaggagagaagcaacaagcatcacagagaaaaagagccatagaaaaggattaatttaccttggaagcttggatattaccatgatgaaccttacttccagattcacgcttcaacgaatcgcctaaaccattttcacaaaaggagttaatctcgttaccaaaaaactaatatcgatttagaggaaatgagatctggaggaagatggagatactcactcagaacgagtaccggtgcgtgcatatttgcgatctgaggttttcacagtgaagaagaagcttagagagacacggcgagtgattttcaaagagcggcaagtggaagatcctactgccttctccgatttctttcatcctctctcgtgcttttcattttaggttgagaagcccatccctaaggcccattaactaatatttcacacattgggcctttttgtaagatcaaaacaaagtaatagtatttttatatccggaagattaggtaaagatgcgtgagaacgggagaattgttaacctaatttgttaagagggaaaaaatacaaaaaatacttcatttatttttaatttgtccgtttaatacatgcgttatttaatttacctgtttaatatttaagttaatttttatgtttattgaaaaccttttttttttttttaattttagcaaaatcagacatccgagttaacgggcgttaacagtggtaacgaaatcgctaactgtagttaaaacttaaccatataatgtttactatttatatacaatttgttttctaataattatgaacatattattttagtcgagtggttatgagagagattaccatcatcatcgattcaaaatcgattatcatctccaaaattttttttgattttttttcttttttttttaacaaaaaggcaaaatcgaagtcagccatctctttcacttcaacaggctttgcacttgtgtgttgcttcacttctttctccaaaggatattgcaccaaaatcaatcaccaaccaaaagtcccaaatgttagaccaattaatacaacatagatttgtgataatcgatcttatttgttatcaacagatgcaattaatggtaacataatctttctataagctatcaacgttactaacaatgaaaaacaaagtctggatttttcaacgcaaaatatcagcaaaaactgggaatatgcaatctttgctgacttattcatatcaatcgatctagaaattgaaaaccttaatatgaattgaagagatgaaggaatctaatttagctcgttctcaaaatcgaattgaagcagatctaacaaacgtggtgctaaacaaaagaaagtctcagaatcaaattcaaaatcgtaactcggattactgagattttgccttttgttaaaaaaaaaaatcaaaaaatttgttggagatgagaatcgatctcgaactgatgaggatgataatctctctcaaaaccactgggactaagataatatgatcataactattagaaaacaaattgtatataaatagtaaacattatatggttaagttttaactgcggttagcgattccgttaccattgttaacgcccgttaactcgcatgtctgattttgccaaaatttaaaaaaatgaaggtttttaatgaacataaaaattaacttaggtattaaacggccaaattaaataacgcaggtatgaacaaattaaaaataaatggagttttttttggtttttttcctctgttaatagtataatctccctcgacctaatccatctcccgtcagaaagttgttccaaactcttcagtgttatcatcttttccttttaagattatttttgtcaagtctacttcttataacaagagtaagtgctttccctcctgttttaggtttttgtaatttggttcgctaatttatttgatttctcatttgtgtttgtttcgtttccctgaatttttcttcctttgatttttcagattacagactttgagactcttagtttttactaagacacagtgtgatcaaagaaataggcccatctttgttttatagaattctttgtaatcaggttgtgttgaaccttgttatgtaggctatagtttttgctttgaaagccatgtatgactctgaactattactcaattttttaaagtaatgtgggattttttctacttattttttttcttcatcgattgagtagtatatgtgtgtttttaaaattttgaattacctcatatgcagaaaaaactaatatatttttaactatatgtattatatatatcaaataaaaataaattagatataagaacaaataaaaatgaaagaaaaatcatatatttattattaatgtagatatatagattttaggaaattagcaattaattgaatgtaatttaataaatataaaaattaattaaagatttaaatttaaaataaaatatttttagataaattttgtagggactaaaaaagaaataaagaaaatagttaattcaagtatttaatgcaaattaacgatttgtaaatttttaagaatataacattttggttgagatagaatttataaaaactcatatgttattagtaaatattagagagatttttgatcaaaaagtgcatcaaaaatatatatataaatacttttattttaatttcaaaagaaaaacattacctaatacgtatcttattcctaggacatttatgattgatctatctttacgtattttttacgaaaagaatggtttaagattgaagaagagttaaatatttttatttattctttcaaaaatattaaataatcaataaaaatcatatttagaagatattttatggacatgtgattttggcaatttccccataggaaaaagcgaaactctctataattgattgttactggctttgatactttgaagactgaacacaaacaaaaaaatctcttatcacaccacctccaatg

SEQ ID NO: 18529 - DNA, 3000 bp, Unknown; identical to SEQ ID NO: 7572
  misc_feature (1)..( 3000): 2750-1469P.txt file - cDNA_ID_1818161; gDNA_ID_1621152; Annot_ID_56911

SEQ ID NO: 18530 - DNA, 3000 bp, Unknown; identical to SEQ ID NO: 7562
  misc_feature (1)..( 3000): 2750-1469P.txt file - cDNA_ID_1818169; gDNA_ID_1621152; Annot_ID_56909

SEQ ID NO: 18531 - DNA, 3003 bp, Unknown
  misc_feature (1)..( 3003): 2750-1469P.txt file - cDNA_ID_1818173; gDNA_ID_1621152; Annot_ID_56907
tggttcgtcactgtctggcctacccaaaagcggatggaatcttggtgaatacatgggaagagatggagcccaaatcattaaagtcccttcaagacccgaaacttttgggccgggtcgctcgtgtaccggtttatccggttggtccgttatgcagaccgatacaatcatccacgaccgatcacccggtttttgattggttaaacaaacaaccaaacgagtcggttctctacatttccttcgggagtggtggttctctaacggctcaacagttaaccgaattggcgtgggggctcgaggagagccagcaacggtttatatgggtggttcgaccgcccgttgacggctcgtcttgcagtgattatttctcggctaaaggcggtgtaaccaaagacaacacgccagagtatctaccagaagggttcgtgactcgtacttgcgatagaggtttcatgatcccatcatgggcaccgcaagctgaaatcctagcccatcaggccgttggtgggtttttaacacattgtggttggagctcgacgttggaaagcgtcctttgcggcgttccaatgatagcgtggccgcttttcgccgagcagaatatgaacgcggcgttgcttagcgatgaactgggaatctctgttagagtggatgatccaaaggaggcgatttctaggtcgaagattgaggcgatggtgaggaaggttatggctgaggacgaaggtgaagagatgagaaggaaagtgaagaagttgagagacacggcggagatgtcacttagtattcacggtggtggttcggcgcatgagtcgctttgcagagtcacgaaggagtgtcaacggtttttggaatgtgtcggggacttgggacgtggtgcttagtaatggttactgttttctagctctttagtggttgaatttacttgtcgtttcttaatgtgtatttttcattgtaatagaataatcgatgttttgtaatatattaatgtatttgatatttctcaactaatttccattgtaatattgaataatcggtgtgttgtagagagacaaattattctcctggttatattaaataataagaataaaacgacgtttagatgattcattacttttaatataatcttcacaatttaacactcaagtcgacaacgatattatcatcagactaatcatatgtttaagtcacatctacctgaacctgaccttctagatgaaatcataaaccagtaataaaattaccaaaaaaaacggtgctttgtcactaattgctttttattgaagcacaaaaccatgaagaaacagaaaaaagtacatcgtctcgatgtgacatttcctctacctcgctgatttttctgttacactgaaagcatattttaggaatcaaatcaattaaatagataatttaatacgatgacaggttccaaacatttcataaataaaaaggaacatataccaaattcacttgaattattatgcactgtccacgatatatatagacaaatttaggagttttatatcagatgccaattgcataatttgcagcatatatattttttaactaaattaaagatttaatccgtattgaaacgatatcgtatccctttaaagatcctttcttatttattatagatccaacaactttatgaataaaaaaatacgtgttttatgagtgtttaatgtttgtgatatatcgttatttatgttcttctgcatttatgatccaacaactttatgaataaaactttgcatttttattatttattatttttgaaaaatgttaggaaattagagtgttaaatttctatggactaagtcgacattgttagagacatgttaggaaattagagtgttaattttcttatggattaagtcagcatagttagaaacatagagtcagaaataaacatataatttcatttacaaaatttcggctacaaaatttcagttttgtagcagacttgacatgttgtaataaaaaagagtcatatttttcacaataatgtttttctaataatgcttcacgtctctttatcacaatttttatttttataaattttgatatgttgttaaaaaaatatttttggaaagttgtctttatttatttttattttttgtttgatatttatttttttaaagattttataaatatttttcccagcgattttgcggatgatcagaagcgtaatatatgaaaattagaatgaataacaaatttatttgatatatatttttgaaatcttcttcaatgtaggtagagtttttaatgttatgtgaatataatctacaaaagattaattaaataaataatgatatatatatatatatacaacgtatatatatatttaagttgttgaaattgaccaagcgttgatcatgtggtcatgaatgatggttaatgaagataaatgatggtttatgagagatggtcaatgagagataatcggaaggtactccctatcttggaatacaatgttaattagtttagtatgtggatatgatcattaatttgactaaacgatcatgatccaaaattatcaattggtacgttcatgttatagaggcaaggatggtgtggtgtgagtcctcccatcatccttaatcaactagctactcaacgaactgcttaatagcatcccttgagcttctttcgaagcttcgcgtcgttagttgatgcgggacaagaggcacaatatagtccttcagattgtcgactttacgtgtattgtaaccacacctgataccaccctttacataatgtaagaggtttgacttaaacattttaacaatattttgaacattatgctgctcacgtctaatctgatacttgacacattccaagtcgaccaaaagtaataataatgaatgtgtagaaatatacatatttttccaccatatggatccactttcagtattatatagtagtaacgaaactcattaaataagtaactctgtttctatatatatgtaatgcatttcccaaaaaattgaaaaaccatatgagaaaatg

SEQ ID NO: 18532 - DNA, 3003 bp, Unknown
  misc_feature (1)..( 3003): 2750-1469P.txt file - cDNA_ID_1818181; gDNA_ID_1621152; Annot_ID_56905
tcacgaatggtacgtacacttattttctttctttagattttattggttaaaacttaaaactgtgataaccattttcttgaactctttttattgataggagtgacaagagtgtggagggatgaccgaccatcggataagattctttcgataaccagcttctcaataattaggacgagacctgaaccctatgaatcctctgtttttgaggctgttggttacaaatggtaaagatcttagtatatcttacactctatcccattttttttttgttaattatatcttttgagctaattatgatgcaaataaataaatcaggagattggttttgtacgtgaatggtaatgaaaaggacggtggaaaagatcatgtttcactttacgcgaagatcgtagagacagaatctcttccagtaggatgggaagtgaatgttgatctcaaactctttgtctacaatggaaagctaaacaaatatttgattgttacaggtactttaaactgtgaatggatttttattagatccatatatatattctagcggaaaacggtctatttctccacgataagtatgacatcataacagatagagcccaggctttaacctcgtgctagatatgatgtcatattctagctctatatgttatgatgtcatattctagccattgctattttaagaaagtagacttcaaatactagtctcattagtaaatgaaccgatagttgattgtgatttgccttttttttttttgcataattgtggattgtagatggtacagtgaaacgatacaacaatgcgacaaaagagttgggttacggacaacttattcctcaatcaacattctacgacgggaacgatgggtaccgtgagcaggacactggtacatttggtgctgagatctacatcgttaaaccagcccaacaaaaagagaaagtcacattcatatcaaaccctccagacaatgttttcacttggaagatacttcatttctctaccttggaagataaagtctatcagtctaacgagtttcttgttggagaccgatactggttagtcattttcgtaaccggatattttagaccaaagtccaaattaatcttaaaagcttgttactgttatgtgactttcacagtattattgtataatcaggaaattaggattaaacccgaaaggaggcttagtcccaatcttcctatatgctcaaggctttaaggcaaacgcagttgttacaaccacttatgcagcgactaatctgcggttaaagaatcaacgaagcagcaaccacgtaacaacatatagtaagaaaactaacctaagaataaaagtttatctccaggagaaaaaaacaacaatgaatgaaactaggaatagctaaagtaaatttgtttatgctgctctgttttttctttgcagctgcatattggtacctgattccaagcggattaggtttgggagtgaacactataccgttatcagatgtaaaagatgcatcgaaaggatatgtggtgaatgattccattatcattgaagttgaaatgcttacggtctcggtgacgaacattgtatccgcttaaagatctctacttctttaccatagttcaaacaaccttatgaagaaagagatgtttgtaataagacaacgttaatgtttgtgatgtagtcgttacttcggtttttccgagttttctcttttctgttttgttatcaatgaaaataaaactctccgggttttaaattttataaaaaatgttgaggacgtgaagtgttaaaaatcgacttatctggagtcagaaataaacttataatttactttacataatttgttttgtagccaaattcaaacataacccaaaagaaaaaagtattgaatgtttttttttgtagccacattctatttatgcgaccgttgcccgttggagtaagggtcatgccctgatctacaattttcaatgtacaacgttttgaacgctttaatttgaccactataattcattactctcattaagttaaccatatttatctcgaaagttcatcaaccaatatatgtttcattccacttctaacatttcttatttctaccacttttaccacctctattttaagcatttcgcattagtaccggttgatattatatatgtatcaagtttaacaagattctaactcaaaaataagtggcaacaaacaagtgaggaaatgcatatttactatatatttgtgttgaattacctttacttttaagattggttatatacccatttgtgtttattagattttaaaatcaattaccaaataagttattatgagttcatttgaaaagttatgagctgccaactcaagactatgtgaatggattgtcatataagtatgttatgggcttgattggtataactaattaattatagtagagttgtagcaattacgagcaaagcaagtaagttgatgaagttgtaatctgttatatattaggttgatgatatatatataaataagttgttgctgaaattgaccaagttttgatcaggtggtcatgaacgatggtgaatgaagatgaatgatggtcaatgagagataattgagtgatgatagctcaaacctctggatattggaatgcaaggtttatccgtctacgtacgtggatatgaacattgattttgactactcggtcatgatccacagttatcgattggtagattcggccttccgcgatgatcggtatgtctatggtcattaattagaggtaagggtggtgtgatgtgagtccttacttcatagcttcatatgattggattgttaagcttaacaatccaatcatatttaatattttgaacattatgctacccacatcgaatctgatacttgacacattccaagtcaaatacaaaaataataataagtgaatgtgcatatatatatattctaccatgaatccactttcagtattatatagtagtaacttaacttgttcaataagtaactttgtctatatatatgtaaaagtcttaccaatg

SEQ ID NO: 18533 - DNA, 3003 bp, Unknown
  misc_feature (1)..( 3003): 2750-1469P.txt file - cDNA_ID_1818185; gDNA_ID_1621152; Annot_ID_56904
tcttaaaaattcaaaaccaaaaccaactatcatctctcccaattatcatctttttaatatatcaaaaatatctttgaaaactttcctttacccatgttttaaacctttctcatctatatatatacatttttacaaataaatcctcaagttgaaacttatttacaagaaataccatttggcattaattattattaataaattaatattcctaactactagcattttcttatctgatatatatctccatcaattcttaatacgtcaaaaaaaatcttaggacactattaatattatactttattaaaagataaataatgtagttatttaaagtttattaaaaaaaattagaatatttcacagaaaaaacgttatagtatatttataatatgtaaatctataaaaattaaataaccattgaaagaaaacttttaaattaatttaaattataaatcttttaataaaagtattattaaaacaaaaattaaaaataatatttaattttatgaaatgggattagatggtaggacggatttagaatatcataatatatgaactttataacaattaaataaccatttgaaagaaaacttttaaattgtgttgaattatatatcttttaaattaaaatattatttaaacaaaaataacaaaaataatgtttaatttcactaaacggagttagatgatataaggggtttgggtcgatagtattatgagatggtataccacaagtgaaatacattagatatgtttaatttcactaaacaggattagatggtaggacagatttggatcaatagtaatacgagacggtatacgacggatgaaatcctagatatatcattaaaaataaaattatattatctaaatactaaaacaaacaaacaatattaacaaaacaaatataattagaacttaaatatttagttataatttagattttaacttattgttcctatatttttaaacagtaaaaattaaacatagtaattatacactaaaaaatatatagatataagagttgtacgtttagaaaatacaaaacattaaatcatatttatttttaatctacaaaacaaattaatttttatttttaaaaaatataattatgcggtacaccgcgggttaaaatctagtatatattcaaaagccttcaaattgaacacgagctttgttcttgtatctagggctggaaaaatagtctgactcgaagatccaaactaaacccggctcaaaatattcgatattaattcgatttcgtatattaaaactatctgaatgggatctagaaacttgaaattctgagtgtccaatataattctgattcgaatttacccaaaaaaatcctaacatgttcaatctttagtattttaaattgttttgatagttttattaccgatatttttggttaattatgatacttttaaacaaattttaaatatttttaccggatttttcgagtaatcggataaatagtttcaattatttaggtagttttaaccaaactcaaaacatgattataaatctaaaatattaaaatctttaaaatatctaaaataactaaaatatctgaactatttagttatattttatcaatccactactgcgataatatctcgtgtacttcgagaactctcactaatccacagaaatattgttttatataacagtagtcattagtcaatagctagacatgcatggtttggtacacgtacttggaaaaagcataaaataaacaattataaccaaatcgaaatctgatatacattcaattttaaacaaaaaaaaaaatggaaatctgatactgtaaaattgaatatgtgtgtattattattggttccacgacgagtctactttcagtattttattaccaaagcaaaccaaaacggatctcaaaaaatggatactgaaaaatggagtcaaggtattaagtgatcctttgtccaaaaaaaaaaaaaaaaaaaaggtattaagtgatccacttttgttcttagtggttctgtccctgccttttgctcttgtatctagagctgaaataaaattcggacctgaacatcctaaccgaattcagattaatttttttgattagaattctaatccgaattttaaaagtattcgaacggattttagaaccggaacttcgaatatccaaaaagcccggatttaaaacagattccgaatatatactcgaaaaaatctgaatattcctaagatattaactctttttacctggttttatggatactattgattaattaaaatacttttaatagtataacttttaaccgggattttcgagtaattcgaattattttacatagtttaaataattatacgtagttttaaccgaatcttaactataattataaatctatatcaattattttttaatcaaaataattaaaataccaatcaatataactaaaacacttaaaataaacaattttaaaaaacaatttttattatatctatcaaattatattaaaaaattcaagcaaataatttttttagattatccaaacttcgaatacaaaaatctgaatagaaccagaatttgatctgatatattttgagttatggtagaaatcttaatcagaaaactaaaaaatccttacaatacctaaacgctcagacctataaattttgatttatctacatttcggtgttggtgatatactgacaccgagtcgttaacagcaataatattttgtgtactttgagatcgctcacaaatccacagaaatattgttttataatagacgtacttggaagatgcataaaatagacaatacaaccaaatcaaatttgatactttacacattcaaagtcaaacaaaaacagtgaaattgaatgtgtacatgtattattattgcttccacgaggagtccacgttcggtattttatatttgttactaaactcgatcaataagtaatcaaaagtgtctctgtttatataaatggaaagcgttaccaaaacaaaacaaaaccagatctcaaaaaatg

SEQ ID NO: 18534 - DNA, 3003 bp, Unknown
  misc_feature (1)..( 3003): 2750-1469P.txt file - cDNA_ID_1818193; gDNA_ID_1621152; Annot_ID_56902
catcgaaatattgttaaataatagactcattctaagtcgaaacaaaaataatatcgtttcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgctatggccttcgtggccgccggcgaggaccctcccttgccagaaccccctgacccgcctgatcctccctccatcttcgcccaaaccttcatacccgatccaccttctacttcttctctctttccaccttcatcgagtctagatctagatctatgttctaccgtttcttcctatggtgttactcctttcgtttttttgcgattctttactgctgtgtgcagtcccttctatcagatctgtacccgttccgtgtctttgcggttctttactgctctatgcagtccatggaaactagcctattcccagatcttgggatatcctctcgtttcaagtggatatgtttcacaggccataacctttgatgtccacgctgcccctcctacctcaactcagagagcctctcctactcgttccatggcccagacacgacaacggtttgttacttctgtaagatggtgtatgtctttgtttctggttttacccctcattcaaaatttcgtagtggtgcgatttaatgctgcagtatgcagtctctttgaactcaatctggccttttgtgctgtttgttttgtttctctttcttggtggcagtttgaaaagaaactaattaatacacctcgcctgatgaatctggttttatcgggtatttggtaccctagtagcttcttatcggagctagttatcttcccaaagttccctcctcagtggagtggtttggatgtccaagagtcgtcggtattgcaaggatcttcctcccgattgatgttcttctctgcatttgatgcagttcttgtaacctcttgtgttacgttggatacagtcttccaagaatctagccagatcgttcttattgttcgttttgccttatgttattcttatgacttctgttgcatatctatctatcctttaaccattgttatatggtctgttttggcttctgttgttgtgttttatgtagttttcttcatgttggttgtaattcctctttctgaggctcctaaaatttagtgaaaacaactattggtttgaaaaaaaaaaaaaaaaaagaatcttagtatacaaaacaaagagtaaaattgtctattttgcaaattgtaaatagtagtgttactagttacataattatgtttccaaaagtaactatatttccaacaaacccttttttaatgtatttttttgatagatatattagtagattttttttaacaatggaaaacgaacaaggttataagggcagatgagcagagtacaactgttcttaaagtctcatggcaaatcttggcacacttgtgttatctgaaatagccagtctttagattttcttgtactttttattttgttgattggagtttgaagagtgttgagagaggagcgacgaggacaataacaaatttctcagtgattaaaggtagcagagaaccctatacaattatgggttccgcattatcctttcgtaacctagattttttttttatatatagttaaactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccatagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaacaaaaacgataaaatgaatgtgtaagataatattgtttaaaaaagaaaaaaagaacaaaaaaaagataatattgttttcccgacgactaatccactttcagtattttataaaataactgaactcaagttgctcgatcaaacaagtacccttaaatg

SEQ ID NO: 18535 - DNA, 3003 bp, Unknown
  misc_feature (1)..( 3003): 2750-1469P.txt file - cDNA_ID_1818200; gDNA_ID_1621152; Annot_ID_56899
agccttttaggcagagatgggtactaaggtgcagatgagcacggcttatcatccacagagagatgggcaatctgagaggactattcagacgcttgaggatatgttgcggatgtgtgtcttggattggggaggtcgttgggcggatcactttagtctggtagagtttgcttataacaatagctatcagatgagtattgggatgactccttttgagacgttgtacgggaggccatgcaggacaccgttatgctggacccaagtgggggagaggagcatatatggtgcagattatgttcaagagaccttagagaggatccgggttcttaagctgaacatgaaggaagctcaggatcgaaagcggagttatgctgacaagaggaggagagagcttgagtttgaggttggggacagagtgtatcttaagatggccatgttgcgaggtccgaacagatctatctcagagactaagttgagtcctaggtacatgggtccgttcaggattgttgagagggtgggaccagtggcatacaggttagagttgcttgatgttatgcgtgcgtttcacaaggtctttcatttgtcgatgctgaggaagtgtcttcacaaggatgatgaggtgttggctaagattccagaggatcttcagcccaacatgactttggagacgagaccagtgagggttctcgagaggaggatcaaggaacttcggcggaagaagattcctttgatcaaagtcctgtgggactgcgatggtgtgacagaggagacttgggagccagaggcgaggatgaaggcaaggttcaagacgtggttcgagaagcaggttgctgcatgagtttgcctttccttggtttccagtttcagtgttgttgagtttttgagcttttgagttgttgttcttatttctcttttatttgtattttcgtttggagttgtaacgatcataacagttgatgattaataagatgagtattttttcttggatttgacttgagttgtcttatttaagattgtgttgtgcggtttccaaaaatgaaaagtttcctagaaaggacttgtctatttttggaaagtttgagtaaacaacctaagagatccgtgtgtttacgagatggccgggagttggtcataaggatattctcgagggatatgatggatggtgagacatagaggtgtcttacgcgaatccatgagagagtctggagatatgctcggaagcgtttaatattgttgctcgagggacatgaaggtcccaacgactcgtgaggagcggggtatgctcctgaggtaccggtaactcgagggacatggtgtatttagagaacgaggggtacggtggcttcgggtgacgatccgagagcacgctttagggtgacgacccgagagcgagttttgtggtattattttcgccaagtgtcgtaactcgatgactttgtggctgagagtgagccgacacaactcagggtttgactttgagtggggaagataatatgtgtgatacccgagataccgtaggccgaggcctgagagtgacggtttatgctcgaagattgcagtctgagagtggagagtgagttgtgagcaacaatgactagtaaatcgtgagtatattgactggatagagagacctagagggggtctggttgaagggagtgcagactgtagtgatggttgcacggagttcctcggagtggaagggtgaagctagattcgaggacgaatctatgttagtgggggagaattgtaacgcccgtgaactggaaaatcggttagggtttgtttttaaatcatccggtttaattggttatgttaattggaaaccctagagtgtgcctataaaagaaggaaactcgaaattagggctttagttagccacttttcgttttataaaggagaaaaagagagttatttccaagtcctttatagttattctccagtttacagaattggatttggattaaaattggttgagttattcgcagtttcgtgagacacgttttctcagacgcgaattaggaccagcggagattgaaactgagatcgtggtctcgtcttttttccgatcggcacgagattttgtgggcatctttgtgacgtctgcagataggattttaccggagcgattgaatagttaacggttagcttatattttagggtttcgtttttgagactgcttgtttctggtttttcctgtccagtttgcttcaaggttgcttttggttgtggacttgttgtaggacgtttctgaactgtttcagacgcaaggagagtctctcctgggtttaattggtattagaatcaatttgttaaggtgagtgcgtgaccatgaatttatctgagcgattgagttgtgtgatgatatataggtgtggtgaatatgttttgggtgaattgttcaatgactggtttgtttgtattgtattcgtgattatatttttttatttgcttttgtgtatagctcgtagatgggagaatcgcctcactaagtatttatgataatacttaagcatcttattgtgttgttgatgcagtaaaaataaagtgtgattgtggaatcatggcaaggaagagaggatgatgtaggaactcgtttgttttatgttttgtgtttttggttattggaacccggttaggattgtctgttatttttggttttgttgatcgaattatttatttatttataaaatagtatttctgatttgcggtttaattattatgttattggttgatttaattaaatatttaattatatatatatatatatatttttttttttaaatgggtctggttgtttcacaaagatatctgagtcatatttggggaatgctgacattaatactttcgataacaaaaagaaaatacactcattaaacagaacaaacctcagaaacagaatttaattaaaaacccacaaaatgaatctaagatagtttgctttacaattcaaaaacccgtctctgtgattcaaaatccctaaatccagagatcgaactctcgatcatg

SEQ ID NO: 18536 - DNA, 3000 bp, Unknown; identical to SEQ ID NO: 7553
  misc_feature (1)..( 3000): 2750-1469P.txt file - cDNA_ID_1818208; gDNA_ID_1621152; Annot_ID_56897

SEQ ID NO: 18537 - DNA, 3000 bp, Unknown; identical to SEQ ID NO: 7587
  misc_feature (1)..( 3000): 2750-1469P.txt file - cDNA_ID_1818215; gDNA_ID_1621153; Annot_ID_56940

SEQ ID NO: 18538 - DNA, 3000 bp, Unknown; identical to SEQ ID NO: 7586
  misc_feature (1)..( 3000): 2750-1469P.txt file - cDNA_ID_1818219; gDNA_ID_1621153; Annot_ID_56939

SEQ ID NO: 18539 - DNA, 3003 bp, Unknown
  misc_feature (1)..( 3003): 2750-1469P.txt file - cDNA_ID_1818231; gDNA_ID_1621153; Annot_ID_56936
attggataagcgatttgccagaagcattgctatgtatagagctgtcaaatggtccgtccaaagaccattgggcgtgtacgtacggacagttttttttatgggccaagttggacggtccataatggacaatggtccgaaaatgtccatgcccaataaagaccatgtccatatgggcaagtccatggtcagcccattttattattgttattattgataaatcaaaaatcatgattttaaagaaaaatttaaaaattttatttttccaaaaaaattgtaaaaatcggagacttgcatttttccgacaaaacagtaaaattgtgtttttcttaccaatacaataaaatcacgattttggcggaaaaattatggaattgcgttttcccgccaaaaccgtaaaattagagaattgcgtttttccgtgaaaaccgtaaaattagagaattgcgtttttccgtcaaaattataaaatcggagaattgtatttttcccgtcaaaaccgtaaaatcgaaaatttgcgtattccaaaaaattgtggaatactattttctttcaaaaccgtaaataatttaataagaaataatttattaaaatttaaaattttcataaaaatagaaacttataatgtaaaatatataatttgaaaattatttagttgtaattgtaattaaaattataaaaatatgattaaaatgaagacatatctattgactcaattcatgtccatgagcaacccattgtccatacggtcaagcccatattgtctatggacaaaactgataatatgcccaattagaccatttttttttgtctggaatatagttcgcccatatgcatttggactgggcaagcccatgggcgtcctgcccaattgacagctctagctatgtaaggtacttctgaatcttcccactaaggatgtggttaggactagtgttttttctaagagatggaaaaatctctggaaacggtacctggattagacttaagtggcgaggatatcgaaatgtactaccaatacgtgagatttgtggatagatttctgagatttaataggaactatcagatagaatattttaagttaagctaccctggtgatgggagttctgagcgtgaagttgatctgctcaagcggtggatcgatactgtcattcagctgaaggttaaagatttagatttttttgactattcatgggaatgggggtttgataactttcagctaccttcaaccatttacatttgtgagagcttggtatccttaaagctatctactgttaccctgcctagtgtcaagtctgtttctttaccttttctcagagttctcaagctaggtgcagttaagttcgccgaccatttggatttagaaacactcatctcaggctgcactgctctcgaaaccttagctataagattctttgatcgcgtccaagttttacaagtgtcttctcagtctctactgagcttcactcatgttgcgcccaagcttgtctttactcatgctgtgcgaaagcctttggctgaaaaagatctatcaattgtaattgatgctcccaggcttgagtatctgaaactcagtgatcatcagacttcaagtttcataataaaaaatcctggttcccttgttgcggtggatattgatattaacttgtcttccggcttcgattcgaggaatatgattcgtgattttcttgttgggatctctagcgtcaaaaatatgaccatctcttccattattcttaaggtaacctatgttgaattggatatttgaatgcttaactttatcttataagttttttcctcatatttctttttattcttgcagatcatctatgattacttaagatgtgaaccactacctccccattccgtaatctatatttcttgcatgttgagttctacgactacaggtttaaaatgttgccaacctttcttgagatctgcccaaatctaaaatcgcttatattggtaaggatttttcattgacccttgttataatgcaaatcgtgaaaatatcataaacgcaacttgttttggttcacttgattgtacttgcagaaatctactgaagaactggggatcaaagaaagtagtatgttttccggacctcaagatttcttaccatctctcgagtatgttgagatgaaaatgccattgaagaaagggttgctgctggagatcaggatgctagtgggttactttcttgagaaagcaacaatccttaagaaactaaccctatgcttggatgattacagaaagagaaaagaatctctcattcccagaatccttgccattccaagaatttctacctcttgcgaagttgtggttctctgatccttgtagtcgttgatgccgccgattaactaacacaaaagtttgatttttttgataactttatttatttgaactctgtttctttcttctttcattatcgttttcatgattatcgtagcttaattctttttagagaagtttatcaatgtaaacacgcgattctcttaggtggtactttgccaaatatatatgttattgctttcctcctcatttgtcgtgttgctttatttttataaatattgtacagtacagaggcttggaaaaataatagcaggttcagaggctaaagaaattgtaaatttggggatcataatgaaaaaatattatagttgacgaaacttgcacgaccaaaacccaacaggcccattgtgagcccaattatgtgaggcctataaaatattacatctataaggacgcctgctaatcaaccactacagtgacactgtcacggccacggccagacgagtagagactagagagacaattagacgaagcagatactttggccggaaaattagacggcgatttttctcacactgttctcattcttcaggtactcgctctctctttctttctatctatttgattcatcgttccaagttgattcttcatccgaaaatagttttacaggaatttttttccgatttgatgtttgtttactaggtagagtagatg

SEQ ID NO: 18540 - DNA, 3003 bp, Unknown
  misc_feature (1)..( 3003): 2750-1469P.txt file - cDNA_ID_1818275; gDNA_ID_1621153; Annot_ID_56920
ctacaaatcttgaagagcaagagcctgcaaagttttgaaatttgtttcattagaggtcaaagaaaatcttgaagtgtctatagccaaggcaaattttagatacttttagtccatattatcttatgctagctaaagaaggctttactgcccaacactctagcagagttttttcttaagttcatttgctcttcaaatttccctgctttcagctcgtgaaatcaatagaaagttatatacgactgttgcgaccatcttatagcttaccctgacgagttttggggtttattcctcgtcctcggagtgatatgcagtatttgaagtcatctccgtctcaactgattgaggctttacacctataatcaaaaacagaccaagtgttaagaaacgctcaaaagaccaaacgttaaagaaacactgtacctaacaaaaaaacatattttgacgctgcaacatttgccactgaagaatgcaaacaccacaatctattataaaacagagtgattattattcgacaagaagcaaaagcaacaagattaataaacactacaatcttttcaaccctataaaggaaagactctctatgttattactgatgatggtcacccatttccataactgacatctgaacctgtaaagaattttcaacaactatataacgataagccaagaattgcctaagtgcatctaagaatgtagcaatacctatgcagattatagatactgcaaatgtaaaaaccaaagctttttcaaaaccgaaacacatacgatcagacaattagagttaatcatataaaaaccacctttgatgaagtaatcagagcaaggccatcctcgaaccgatgagattgaaatagattcttcatcagagatcggattggccagcttctcaacgagcttagcgatcccatgagactgggatctaggaggtggaacccaaaaggaagcaccggggacaaaagggagccaatcaggtgcggatcggcgtaccataatccggtggacagcatcttccaacttattgacaagaggatccgcagcgatatcaatctcgtagattactccgagatggttagagttagaccgacgattggaggattgagatcggatgaaaatggtttgagatgaagggagaagaagagaagctgcggcgaaacggtatcgagagagagaaagtgaaggagataaagatcgagccattgtagagatttaggagaaagatggttccttttttttttggtttggtttggttgttccctttttctagtctttttaacggataaggagaaaaagagcattaatcttgtttatcggaatttccttttttaatcctttttctgccctatctgaaaatttactttctccgataagaactgtcttttttcaaaacaggtacatcatgcaaatattttctgagtataaaacaacatgagacacaatcatacaaagcatatactgatgtccaaaaatccaatctgtgtagtttttaagccatactggtgtttaaaagaaaaagaaaaaaattatacactactctagtgatgaagattgaagaatcaaagaactcaaaaacaagagcctattcgtctagtgggccaccagtccactcaaggccggccttttagtcacctgaagttggacccaacccataagtggggccggaaaacaccatataatccaataggcaataaccaatttcactagtttattaaataaaaatatattaatattattaggtgagatatcataattgataagaaaatgctccaacttagtaataattacaatatacacccttagtttaacacattgtaacaaaactctctcaaactttttaccaattaaatttggacagagacaaaaaaaagaaagtgtgttcttcactttttctttcctcagttggttgtccaaacaaaaaaaatctccaccgctctgagagaaaaaagttggaagaggagagagagagagagcgacaacgcaccaactgttgcggctcaaagagatctcgatcgggatccacaagacggagatagatagagagagagtgagagctaacggaaatgggatctcagctacttgagtgttgcttccgtttcgtcttctactgtcactcccacagctccaactgttttccttgattgtttttcttttatctcggcgttttactcggaagcttacaacacactctctcaggtgcgaatcgacgccgtcttctttttgttttctcagattgggtttttgtcttcctgtgatcatttttacttcattttgggggtttaggtattgttttagcttcgcgttttggtacttgcttcaagctctttttcttagtttctgtgatttggggattttgttagacatggcgatctgtgttcgatttctgctcaatcgcatttgaaattgaaattgcttctaaatcccagagatctcactgggtttcaagagatcagacatagaaattgtgattagggttttgtttttttcatgggttctctgatattatttggtttttctgtagcttttttgggggaagtagttgcaagaaactatgtagatctcaagtgatattagtatattacaagttccctgaattagatgtttacgaatagtcttaagtctcagtggtgctggctctgtcagagaaatggtaaaggcttttggcaaggggaagtgacttaatctcaaatgataactagtcccatcaaaacagctctgctagtgtttggtttctgagtctcattttcttagcatttagggatctatcttgcagcatactgtcctggtcgttcttggtactattttcttttgtgggcataggatgttgaaagctttttattccgtgttggtgtttgccaatgtttcgcttgtcacagttctctatatgcccatttctcatgggttattgttttgttctttcagggatttgaaatcctcacgtttcagcacattctttgtggttcccatctattctctagccagttcggagttgcctgaagaaatcaaatg

SEQ ID NO: 18541 - DNA, 3003 bp, Unknown; identical to SEQ ID NO: 18540
  misc_feature (1)..( 3003): 2750-1469P.txt file - cDNA_ID_1818275; gDNA_ID_1621153; Annot_ID_173327

SEQ ID NO: 18542 - DNA, 3000 bp, Unknown; identical to SEQ ID NO: 7613
  misc_feature (1)..( 3000): 2750-1469P.txt file - cDNA_ID_1818288; gDNA_ID_1621154; Annot_ID_56987

SEQ ID NO: 18543 - DNA, 3000 bp, Unknown; identical to SEQ ID NO: 9539
  misc_feature (1)..( 3000): 2750-1469P.txt file - cDNA_ID_1818288; gDNA_ID_1972143; Annot_ID_179294

SEQ ID NO: 18544 - DNA, 3000 bp, Unknown; identical to SEQ ID NO: 7613
  misc_feature (1)..( 3000): 2750-1469P.txt file - cDNA_ID_1818288; gDNA_ID_1621154; Annot_ID_173419

SEQ ID NO: 18545 - DNA, 3003 bp, Unknown
  misc_feature (1)..( 3003): 2750-1469P.txt file - cDNA_ID_1818292; gDNA_ID_1621154; Annot_ID_56986
caaactacatgtatatatttagtcaatcttgaaatttaaaaaaatgcctttgctaagaataaaaattatggttaggtgaagttctcacgtaaaactattcaatcctcacgcgattgaggagtgactgaccaaagtttatttctataggggcaatttaataactattgtaaactttcaacgtaaaaattaattactttgaagttatggggcaatatcatcaatagtaataaatataagcccttactcgtaaaatacaaaaggtttatttgttttctgaattgagagcgtgtaactactaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctggtatcctttttaagaaatgaaattaattgattccttgtcttccaaacgagtaaatcgactaattgattagattttgttcattagggtttgttagtgaatagataagaagataaatgggagctccgttagtgtgccacgggcattctcgtcccgtcgtcgatgtggcttatagtccggtgactccagatgggttctttctcattagcgccagcaaaggtatgatcttcgatcgatttgtatttgactatctatgatctttacttggaactgtgcctattttggattatgatttgcatagcgaatgtgctttgacgaatttgattttgctgccttttattatatatcgtctgaagtttgatttgtggctgatctaatggagaaattaggatgataagttgcatacattgttgaactctagctgaggtttctttgacttttgatatttcagattcgaatccgatgttgaggaatggagagactggtgactggattgggacttttgaaggacataagggagcagtttggagttgcagccttgataaaaatgctattcgtgctgcctcagcttctgctgatttcactgcgtatgttcttcttctttcttgttgcgttttcaagtcttttactttaccatttagtcttgcaatttcagtatcctccggtgatgggttgtttgcttaaagttataagttatggggaaactatgttcctagagaaaaatggttaagtgagaatagattaatgggatttaacactatttctttgttttcatgacacatttcaggaaaatatggaatgcattgacaggagatgaattgcactcctttgaacacaagcacattgttcgtgcatgtgccttttctgaggtaaactgtagtttcttcccaagcaaagagtgatttgatcctgttgccaagttttctggtttaaggatataatggtgggattcactaagattacttgtagcatttgagggtctataatcgttggtgtcatttgtgttactattgtggtcttaatgcataactatttatattctaggacactcaccgtttactcactggtggaatggagaaaatacttcggatattcgatttgaatcggccagacgcacctccaaaagaagtcgggaattcccctggttcaattagaactgtcgaatggcttcatagtgataatacaatcttaagctcttgcacagataccggtgacattaggtatgccaccacgtcgttccttgggtttagactcagtcctttagtattcctggtttcattgttcttttgtgtatgtcctctgtaggttatgggacataagaagtgacaagattgttcatacattagaaacaaagtccccagttactagtgctgaagtaagtcaggatgggcgatacatcactactgctgatggatctagtgttaagttttgggacgctaaaaagtaagttaaaaatatagaaatgcatcctcagttacagttttatcgtttttctttgatggttgagctttttctcctgctctcctagttttggattgctgaagagctatgacatgccttgcaatgttgaatcggcatcgttggaaccgaaacacggtaacactttcattgctggaggagaagatatgtgggtgcacaggtttgatttccagactggagaagagattggtaagtttcttttaaaaaagaatgaagttttcattttaggaacctgtgtgtatcctttaaagccaatgtggtgaatgtagggtgtaacaagggtcatcacgggccagtgcactgcgtgaggtatgcgccaggaggggagtcatacacctcaggctcagaagacggaacggtcagaatatgggtggtgggttcggtaaaccatcctgaggagagcaatctaagcggccacgtgaagcttgtggcagaggaggttgtgcgtaaagctgaaagtctccgtatcagtgagaaagccgcagaagctaaatgaaacaccatcgttagcttatgatatcacatagattcatagttgtttttgcatcattataagatgtgacaaaggggttttgccttttaaaagtctctcagaccgaataaaacgaaataatcttcaactatacttgagtgaatagtgaatctaatccaaattttgacaagaaactttacaacggtatcaaaaatatctttaaacaactgtatgtcataaatagttgcaagttttgaaagcccagttgaaactagaggggcccagaaattaagcaaacatcaaatagtcaaatacaaagaaagtgtgaaagttaaaaccctaaacccttaatttgagctctctgctctcctggttttagttttcctctatttcgtgctcaattcgcttgttctccagttccactctgtaaggatctgttacttttctgtaatcctctcaaaattcaatgcttttgcttactgggtctgatctttgcaagtgaaatgcatgacatttcgtccaaaatcagaccttgcaaaaatg

SEQ ID NO: 18546 - DNA, 3003 bp, Unknown; identical to SEQ ID NO: 18545
  misc_feature (1)..( 3003): 2750-1469P.txt file - cDNA_ID_1818292; gDNA_ID_1621154; Annot_ID_173418

SEQ ID NO: 18547 - DNA, 3000 bp, Unknown; identical to SEQ ID NO: 7635
  misc_feature (1)..( 3000): 2750-1469P.txt file - cDNA_ID_1818296; gDNA_ID_1621154; Annot_ID_56984

SEQ ID NO: 18548 - DNA, 3000 bp, Unknown; identical to SEQ ID NO: 7616
  misc_feature (1)..( 3000): 2750-1469P.txt file - cDNA_ID_1818304; gDNA_ID_1621154; Annot_ID_56981

SEQ ID NO: 18549 - DNA, 3000 bp, Unknown; identical to SEQ ID NO: 7616
  misc_feature (1)..( 3000): 2750-1469P.txt file - cDNA_ID_1818304; gDNA_ID_1621154; Annot_ID_173412

SEQ ID NO: 18550 - DNA, 3003 bp, Unknown
  misc_feature (1)..( 3003): 2750-1469P.txt file - cDNA_ID_1818309; gDNA_ID_1621154; Annot_ID_56979
cgactcctctctattcctcctggtgctcctccaccggttttaatcggtctaagcttgtctttctcatcgattggtttgacctgttcagagctttccgacataggcttaggttgttcgtcgcgttgactttcgtctttctgctcgttgtttcccgatttgttgagttcggcgatgagacgatcgtcaaacactataccggaagatccctgacggcggaaagagattgttgatctttgaagaccctccatggatctatctctctctctgttgatgagctaaaagaagggcaaaactaggaaaagtgagtttaggccttataagtgattaatcaatcattgtgtttcagacttggtttccttttatttctgtcctcattattttttcatggggtcggtccactatttattgtttatttttatgatgatgcttccagtttctatttatttctttgtaacaacaatcatcggaaattaatgtaagcggattaacgatatcattcaaccggattattcaaacattaattgtaataaaaaaaaaaaagtaaaaaccattactgttattgatgattaaggcagagaattacatgttaattttttgtttgttttcacatctttaatcggattctcaacaccacataggcacataagtcctcttatatccatatttgttattttattccaaacttttggtttctttaaactcaaaaggggtaagactttttgtaattactattgttttatcagcaaattgcaaggattagataatagattagaaatgaacaggagaattgacttataggacacactaatttaatatttccttcttccccatttcggtaaaccaaatagactatttccttcttccccatttcggtaaaccaaatctattaggtgaggatgttattaaaatgccaaatctctctttataaaaacttgaaaggaaaaacaatacaaagtggtgaaagtgagtcaaagtaattcggttaccaatttgtattcaaagtcaacatcattgtactataatatggtataacttttgttcaataattcaccttcttatatcgtctgtttcttctcaggatcaccactaactaaaacatacgcatgtggtgggtttagcaaaactgtattctttggattaaagtaatgtgcataacacaaattaataaccccgtctgagttggcacaactcaccaatgttgaagattgagataaagaatttgggcccaatcgccgaatagaagtctatattcattactctcaggcccatccataaatacaattgtcaaaaagaaaataaaaaattggtggtccagctgggaacgagccagcaggccatggtgaatctgagtggcgtcgagctgtgatccgtccactgctgagagcgggaggtgatcgctgctctgtgaaaccagcctcacgcattgccctccactgcaagaaccgcctgagccaagccttcgcttaacacacacggatcactctcagcttggactgggcagcccggaacaatgccacaacagatccgacccgtgggccgagccagtgttccaccaacttattgtccccacacgggtcacaagcccacgttactgagctcgacgtacaagtattgatttaatttcatatataaagtaaaacattttgaggtatgtaaccgatgtgggacaaaatacaagtttgggcttcccagatcccacatttggtggaacacatatataaagagtctcttcgttgattagcttcccagatcccacatttcaggtaaaaacatcgtctgggctctttgccattttagcgaatgtggaaaggtgtggtttttttttgctctgctatggattttttttttcaaatcagggtttctctgttgaagtcatatcaggagcttgacatttgtttgtttgggaattagaagctagatacgtatattatatagcatcgtacatatcaaattttggtgtgtgttctaattgaatctgtacttgtttgtgtgttagtgggaggagctcttctcagaccttaagactattgctttagtggaatgcttctcgtaaatgtataagtgaggaaagaaactccattcgtatctatctactaccctaagccgtttatgcattttctgtccatcagaagatcaacacctgtttctggaggattccattgatttaagggattagatggatgatggaccatgtgggattcagtagatgacaagaacacaaaggaatccacctaacagagacaacccacatgttgcaggaaatacatataataatatcacaagaaacggaaaaagaagcagacagagacacctcttcttgaatttaacgccttacattgtggtatcttccatcttctttactgcctcatggtgaaatccagtgcatatatgattatttatctgaggcgaagattccttacttcatcttgatgcgactactactggtccaactttcattggatcggttgatttgaggccgttgttcttacattttggtgtcccacctgttcttttagtactgttttcctttttgtttctggcaatcagaaaacataaaggcaatcagtcatccttctcaataacatacaaagatttggttttcaagagaatcttctatagaaagctagacgtttacttctgtcttattaaggagaagtactggttctttcatttatatcttggctggtttgggaattgcatccaaatttcttgcagtgggtgtcagcctggagctgcagaaaagtgagttgatgttagagattgtaggatcttactccaaaaagccagaaaaggtccttgcgactctctaacttgaaagttgtttcctttttttgaatctgagctggttttggaattttggtgtcaagatttggaatttgaatctgtagtaagattcaggtttagtgggggagggaacaagttggaagcttttgctagttttgtcaaaggtgtcactaaagtactaactatcagaaaacattttcagccagaagcttggtgatg

SEQ ID NO: 18551 - DNA, 3000 bp, Unknown; identical to SEQ ID NO: 7612
  misc_feature (1)..( 3000): 2750-1469P.txt file - cDNA_ID_1818320; gDNA_ID_1621154; Annot_ID_56966

SEQ ID NO: 18552 - DNA, 3003 bp, Unknown
  misc_feature (1)..( 3003): 2750-1469P.txt file - cDNA_ID_1818324; gDNA_ID_1621154; Annot_ID_56965
ctggttctgatattacctcgagtcaactggcatacagtatatataatatgagtagtgagtggtggtggcaatgataagtaggggaccaattttgaacactgcttatcaatgtgatgacgattgcttacctataaaagtggacaacacaatcaacaagatgacaccttcttaaagtctgacactatcagcttgcttcttcaactactacatgccactaaatcaatgttaggtttccttttgagatccctagtgacataaatatggttatcttctcaaaaaaatgagcagcaagaaagatgatgaaacctacatcaaaatcaattcagagagttggtcgtttcttaaagaagactcttgggagcatcaagtccactatctgctctagtgattacaaaaacttacctaacgacactcctctcttgagcccttactcctgcagccgccgctgtccagaagattcccaaacccaaaccaaagaaagctacaccgttatctgttgtgacacggctgtggcagatacaacacaccagaagagtctcaacaaccaacataaaaagaaaccgaagaaagtcgctgagccattcgaggatgcaaagaaaagaggtgacgcgttggcgcaaaagatgaaagatctcaatatggtggatctgagagacgtggatcacgcattggatgtaagggaagcgcttcgatgctattcaagcatcagaagtcctgtgtatcttgacattgttgacaatttcttcacagacatgtattacgagttctctgatcctcgtacctctgctaagatcaacggttcaaggagaaaggcaggctccttcaggctttaaagttcctctggatcagctttgctttcacgggctatctgtagttctttcatctatagagtatgcacttcttaagaacagtgttaaccattacacacaccgctttggtaaaatcacctgtcaccaccctcagtttctacctcatcttgtagagtcaagttacgctcctattctcaactactatcaatgcaacatattttccacttcaagttatgacaacttacagtttataatactatatctgaagatagagatgtgacaccctactactcgattcttgacaaaatgattttagggtagataccacttttctttttcatgaaaaaatggagaaagcaaacatatgtatggagaagcgaagttactcttctcgaattatgataaaaagttacatcaacacaggattatctgtttttttcacttgataaatttgcattttaaaacacacttcatggataaaacggatcatttcttgccactcttcttaagtccagaacctccaaaggatcccttctgcgatgccttggctctaagctctttaagggcctgttttatcattttcattcaaaacaaaacaggtcaggctttcggtaacaaatgatcactgtacttctcatgcgaaagaaaggctaatgagtctttcacacaattgggtggaaaaaaagtagactaaacatcctaacatgggcaaatggtcactatttcatcaaagtaagaagaaactagtccatatcatctcaaaagaatctgtaatgaatacccctaaactaacaaataattaatagaaatgacccatctagttgtagtcaccagctataaagtcataattagagtcagcttgattagtagaccaaactgacaaagtggaacatattaatgcacaacctttacaaaacctttacaaacctatgtatctaaacagaagctctcttgtgaagatacaatctttgattcgtattttatagctttccattgaaagaggagcccaaacatataagtttaactagatgcatttttccaatcacaaaacttcatatgaacaaaaagagaaaacaagtcagagcatcaaagtgggaactcaccttttcctcatctttcttcttctgaatgttagctaagtcagtctgcattgataccaaatcaacatttcagcaattagagaatgtctaagagtcattaatacacaaatagtatgcaaacaaaatcaagtgaagaagtcaagactgtgcccttaaaaacactggatcaaaattcgaacttgcgtataaatcattgaatccgagcaaaattaatgatttatgagtcactgaatgttaacaaattttaagaattcaagttagttggacaatcaaaaccagatccagagcaaaagcatcgtttgattcgaggtctaaagctaacaatataagccgatttagctgaaggcaaatcaacagaaaatccaactcttaaaagaaaaaagaaacagtagagtcacctcgtcgtattccttcttatcagctttaggctgcttcaaaggtttcgcctttcctcctgtttaaaaccaaaataagatgagcagatcgtaaacgatgtctctaatcactttattcggtgaacgaatcaccaactcaaatctctgtataacagcaacgtaccttgcttggaagacatgattggttcgttgagctagggttcgatgttgagctcaaaattggggaaaaagtagctgagagttgcagacggtatcgaatctctctgattggggctacggttcatatttataatgagttcgtagtaacaacgcaacctattaaatgggctctgaaagtgtatggcccattaaaaggcctacaaatttctttttgggcccgttaaatacctttatttgggtcaacctaggtcacagtcgttatatttaatgcgcgaaataacaaaataaaatcgattaattaacagttaacaaaaggtctggctccattcgatttcattggaaacccccaaaatcgctgaagaacgcctctcgagctcagatagggtttataggtatgcgcgagctttcttctacatagtcgattagtacggagcgcttgagcgactctttcgatttctcaattgaatttcttcttcatctaggttttggatttacgagtaccactctcctttttttcaggtttctagagagaatttcatg

SEQ ID NO: 18553 - DNA, 3003 bp, Unknown
  misc_feature (1)..( 3003): 2750-1469P.txt file - cDNA_ID_1818328; gDNA_ID_1621154; Annot_ID_56962
cataaagcactgtctccccaaattcatcctccagcttactgtagatctctttgtcagtttttccagctcctatctcattacggatcagctacaaaactcaggtgtattagaagagtagacagcaaaactatcttcaacttaatctttggaagaaaaaacggagtaaaggacacacctgtctaaggagaatagcgatatctgcctgcgagtcttcaatggactgacttccacactcagtgcagcgaacattgtggctaatgtttctggcccgagcgtccagcatctgagccttcttcctctcttcgtctgttttctccattgcgctgacaatttcatgatatgagtattgtgagttttcacacaggcatttcgtcgaacactttgtgggcaacagaggctcagagacccaaaacgtaaggaacgtaaattaagttatgaagggagaacctgggtggagaggaagcaagagaactccgagaaaccgcttagttcgttcaacgtggagctcaaaaatgaaacctttcgcttgggaaattactccgtttactagtaaaaagtaaacacccaatcgtcctccagcaataatagcgccgatccttctcgacagagccgtttagagaagatgccggtggatcttcggcgggtgaacaaatcggatccgaatgtgaaatcgaaaaggcgcgtgaaagagcgtgcgactgagagtgtgtccgaagacgtttcgcgcgtatacagtgctcgtgggcataataaacatgggcccttcaaatatataatttgtttgaaattgtaataaacatgggccttgtaactgatagaactatattctatcagtaactgcataaaactcactaagagaagaccaacactctttggagtccaaatgaccaaaacaaattgagaagagaaatatgagatgaaccaaaacaatgaaacatagaatagcgtcaggaaggaacaatgttacagaaacaattaaaagaaaaaaacacattctacaataggagaaagtgagggtgaaacaaaagcaccacactgaatactcatactattagctgaattagtgttggtgatgggtctgctcttcttcttcatcacccgtttattttacttggggtctggagtcatgggtgaataaaggctagagggggcagagccccatggtgccgatcattgatgactcactgtctttctaaatcattttgctatgaaggcagcctcaattctgatattatggaactaggcaagtgggcattatctgtgatgaccaataaagcatgacataataaagcatgacatgttagacaagaagaattgcagtgtaatatttagttatttacattcatccagacatatcataacttctaaattgcacaatctttgcctttctgctaaagagcaaactcaacaacagagagaagccaatctttctcttttcagtgttctgtatatgaattacacaaaagctactaacaccaaatgtttaatctgtatatgaattcgtttgacagaaggagagctgagcagtcactaacaagtaacaacaaactatacaattcaatttgggatttgattctgcaagacctaatagagacatggctactacttgccaacgatagcatttcgccctgctttcttcttgcatttgaaactgaatagcaaaaagagaatcaacggttcgtgaaataggcgcagaaaaagcaaatcgcaagagagaagctactttattggcccaaatcctatttcatccagttttgtgtcttacaggcgatacataagctttgccaccattgccaatggagacaaagttcagacatttaagcaccgcacaatcaacagaagcaacgcaaacggatttgtaagctgtaaaagtctaatactttttatttatatacacgagggaagaacacttctgacaatgtgaggactctcagacaaatccttcaaccaagatcggtttcatctcctcttcttcatcttcatcactctgatccttcttctcactgcttctctcaataccttcaacatctagatccttcaaaccatcaacgcagctcttcccttcttctccttcgccagccaccaccaaatctccggcctgtttcgattcagccaacttctcaatgccttttccagctaaacacggcccagtatccctttcattgtctcctccaacgataatcttgtctgcagtttccggaataggatccgctaaacaaccgtcttcctcctcgtggtcgaatatcgacgctgcgcgagacttcacggcgttagcggctttgcgaaatgcttcctgaatagattccggcggcagagcacaatcctcgagaccggcgtctgcaagtgccggcgggaggatcgtatcgagcaagccaactctttctttcgtagcctccatagatgcagagagattcagagctctcttccctgaaatgtgaatgaaccctaaattggataattaaatcctttttccgaggaaaaggcggtgataagggtattccagtcattatacttcattgttggatctaaattacaaaatagcccagtgttttagtgagcccaaggttcgacacctagcgagatcatatggacttgattgattgcccagtgttttgttaataaaaataaaccattaatgaaatgctaacaacaacgaagagagagaattaaaagatcctcctaccgtattcccgggaacattcgccggagaaacgtacggaatcaacaaccttccccgggaaagaatccattaccgccgattctatcaattcgtataccgtatttgactacccagccattgattctctctccctctcttcccttttcattgtttctaaaccagctcatctttcctgatccggacgtttttcgaagatcgggtcctaattccccgggaatgggtccttaagttctggaagaaatccgtccgctctgtctggtaatttcattgaaggacggattaagcaagcgtgtgtgagatcagaaaagacggattcaactatg

SEQ ID NO: 18554 - DNA, 3003 bp, Unknown
  misc_feature (1)..( 3003): 2750-1469P.txt file - cDNA_ID_1818332; gDNA_ID_1621154; Annot_ID_56959
aaagaactctagaatatggtctctaggtccctggtacacaatctgtccctccgacaataagattatatcatcgaatagatcaaacgtctcaggagcaggctggagaagagatataagaactgtggcttctgtgaggtgaacaatctgttgcaagcatttcacgatttggaaagtcgtggagctgtcaagtccggtggatatctcatccatgaacagagtcttagtaggtccaacgatcatctcaccagttgtcacacgcttcttctgacctcctgaaatacctctcatcatgtcatctccaactatagtgtccttgcaaatgtcaagccctagaatctgtttcatagaacaataacatctatctcaacatatgaacactatataatcgtttaatcaagacaattatgtatttaaggttgagagggactcactttgagagtataatcagtgataagactactcttgacgccttgagcagcagaggccttcatgaacaaatcaacatcagcttctggaaaaatcccagcgtccttttctcttcttgccaactcatttaaaagatctgcatcaataacaagtaagattactcaatcgaccaacaaaaacaaaatcgatagttagtttgacaaaaagtctaagattataccgtaacgggtaccaactccttgacacctagcagagaaatcaagagtctccttaacagtcatgataccaacatgaagatcgttctgactaatgtaagcagatgttttaatgggaacaaactcattgaggcgataaccattataggttacctccccagagacgtcaagagacttgtcgagtttaccggcaagagccaacaaaagcgtggtcttcccggaagacggaggacccaacaaaagtgtcatccttgaaggtttgacgataccagaaacatctttgagaatagtaagttgtgctttcttggcaagcctaattccgatcatgcctagagcagcttctcccatgtttctcaccgcgttaagaagcgaaggaagagatctatcaccggtgtaacagtcagctttcacagtcaagtggtcgtacctcacttctactgtcggaagttggatcccaactctgtcgattctgtttcttagctttgtcaagatccgttcgttgtcctgctctgcgactttgaagaccatgtcgatgaacttctgacgttcttcgccgtcaagcttcgtgacgtcaactgctttgttgaggatttggttaccgtagacgtcgtcttcgcctaattcaggcatgagacttgtgcggagacggttgtaggtagggagtttctcgatggaagcccatttgagagcttcttcgtcttcgttgacagatttggttcgtctagagcttgtattgaatatgtcttccatgtttctgcttgctttgcttacactacgacttatggtttgccgcatactcccacctctgctcatagcatgagctggatcgtaatccatctttagatcttatgaatcttgatcctgtttctattaagttaagtgcttcttcttctttcttttagactattagactgataggatccatatgtgagtagaagaaacggatgatatgtaaatttcgttgaagaaaacagagaaagagataagcaaagatggtgtgtttgtcagtgcctctgcagcattgagagagaaaagagtaagggacaatgacgagtgcaagctccccctctggtgctctctgttattttatcacaatctccaatgaaaactataaagaaaagcaccacttgattgtgccttttaaattcttgtgattattatagtaatccatgcaataatgaaacatcttttaacaggatggcccatgtggaaaatgaaggatgcctagtcaatcatacacgagttaaaaattcgatttatacgtttgtataaggttggtgcttaatgatgtagacaggttgtctttttttggcttgattggttttgtttttcctcaccttctattgtcaacaatagagcaggtggcctttttaaattaataaaagattgacggattcaagagatggcaatggaccaatggtgataagaatgagaggagtgattagtgcagaacaggtatagaaaatttgggacttatgtaagaaattgaattagtctactacgattagttatatttggttatgacttactagtagacctcgtaccaactacacacaatctacaaatgtcaaagtaactcgttatgagttcaaacatcttgaccccaatttatggatgctattagctttgttaatcaagtaaagttatagtatatctactgcgtgcgtgattagttaaataccgtaattaatacgtaacacagaatgacagctatgtaaccgagtacaaatccctgattaaattttctatgtttgcgtgtttgtgtctcggtcaaaatcaatcagggcctttgccatcattttcaaatttgtgcgtttaaaatgctttaaagcacgtgtaattaactaactaattacaataatgtatatttgatatgtttagtaacgaatcttgtattggagaaataagggcctgggttgtcgccaacaaaagaaggtagagccttagtgaggattagctgtgattaaattatatacttatacatgctatgatagtatttgattaataatgtcagtaatcatgaatattaataaacactccaccacgcaccaccagctcatatgacttggaagattccccgcggacgggttccctcatcctgtctcgattgtttcaaagtcatttataaatattaaataatagtacagttatatgagtgtggttaaaataaaataatagacggtccaaaaaacaagcatatgggtaataaattagtgagtttaagcccatttatattattattatccattttaggcccattaacccactaaagctcactgaactctgaaggcatcagtgtagtagcaaattagctcaagatccttttcacttcttcttcttcttccttgtgcgctcgataatg

SEQ ID NO: 18555 - DNA, 3003 bp, Unknown; identical to SEQ ID NO: 18554
  misc_feature (1)..( 3003): 2750-1469P.txt file - cDNA_ID_1818332; gDNA_ID_1621154; Annot_ID_173388

SEQ ID NO: 18556 - DNA, 3000 bp, Unknown; identical to SEQ ID NO: 7607
  misc_feature (1)..( 3000): 2750-1469P.txt file - cDNA_ID_1818335; gDNA_ID_1621154; Annot_ID_56958

SEQ ID NO: 18557 - DNA, 3000 bp, Unknown; identical to SEQ ID NO: 7603
  misc_feature (1)..( 3000): 2750-1469P.txt file - cDNA_ID_1818359; gDNA_ID_1621154; Annot_ID_56951

SEQ ID NO: 18558 - DNA, 3000 bp, Unknown; identical to SEQ ID NO: 7603
  misc_feature (1)..( 3000): 2750-1469P.txt file - cDNA_ID_1818359; gDNA_ID_1621154; Annot_ID_173377

SEQ ID NO: 18559 - DNA, 3000 bp, Unknown; identical to SEQ ID NO: 7602
  misc_feature (1)..( 3000): 2750-1469P.txt file - cDNA_ID_1818363; gDNA_ID_1621154; Annot_ID_56950

SEQ ID NO: 18560 - DNA, 3003 bp, Unknown
  misc_feature (1)..( 3003): 2750-1469P.txt file - cDNA_ID_1818367; gDNA_ID_1621154; Annot_ID_56949
ggctgtcactggggatatgcatagtagaacttctcatctgcatcaagtttggaagtggtaggtggttccttacacatgctctgccttagttatttatggttacagttacatagtgtggagagtgtaaacttggttgtatggttatgatacgaacaggattgtacccaacagaaatgccattgtgggtagtgacactatggggaagtgtgggacttggacttgtggccttcttgctgtcttggacatggaagatccagaagatcctcgcgcaaaagagacgttaagcgcatcattattgttgcagcagagacgagagagaaatagaggtgagacagtgaaatgccattgtggtttttttttgtaaatagggagaagaaggaacgatgtaaatgcaattttctttagggatagtgtgtgatattcaacatttacgaagattccatcaattctttcatgcatcaaaagttctttcatctttgttctgccccctcaatctgacaaaacatgttggtttgaatgtcaattttttgttaccattcacacattcaagttttcaacagttcaaaaaaagaagaagaagttattgagccattgtttcttctggtttttgagatgattgttttgtgctgccaactcttacatgacattaacaacattattgtgcttttactgccattaactccattaccaccattcaatttttctgtctttaattattggttccagttttgttattctggtctattattttgtattatcatcattctatcaaacagattatttgttttgttgaaggaaatgaaaaaaagaagaagaaagaatcaaatatgataaattgaggataatattaagattgtgtgacctgccgtgccgcccaacaacatgtcacatggtatcttaggtttgcaaattcgtaatttgacatcttcgacgacaattttgactatctatctaatcttaacatcactcttccatcatcacttcctattttattccaactttcttaaagaagccaaaaaaaggatgatgtcagaagttaaggaatattctgacaaggataggatgcccttaagggaatctagagtcttgaatgggcttttagaattccaagaagctagggaatctcgagtctttaatgggcttttaaagtttcaagaatcaaaggcccaaattgcatatttgtagcccgtcggaaacgcaatgaaaatgatgaatctgaagactgactcaaacaacatctctgtagggttcttcttccttgcttcttcgagtctcgatctcctctctcaatctcaggtaacgccaaaatcctctttttattcatgggatcttttataccaaattcgatttcttcattttgagatctgtgaatatcatcgtcccacgaaccaatcgaatctgttgttgtctgacattaattttcatttctatctcttgcagtcttcagcttccaattgactttcaacatgtaagcttattccttaaactcgataccttcttaccaatctccaatctccaatcatgttgtgtagatggatctctaacatatgtagaccctttagtattcgtgtctgaatctctagactggaatcattttttttttttattgtggctctatagttgtgtaggggtcggtctatgattagatccgattctattcatttttctggcttatgttttcgcatcatataatcagagctttatcttgtaaggaagagtgataaaactagataattatgttctttctagttttgctcgtaaagacgattcttgtatgtcatcattcacacgggagtagtttatatatctagccattgatgttgcatcctcgatgcctgtggtttttctgaatatttcagggcagatgatgaagttgttgatccaaagaagtaccttgaggaatcttgcaaaccaaaatgtgtgaagccacttctcgaatatcaggtgaaactggttgatgttgtgactaattatgaattgtgttataagttttgacacagtgccatgttttgtgaagatcattgtttgactgatacaaggcttgtttgtggttctcaggcatgtgtcaagagaatccaaggtgatgattctggccacaagcattgcactggccagtattttgactactggcaatgcattgacaaatgtgtaagttacttgaattatgttattttgctgtttcatcatatgatatcttctaaagtttgatactgagatgaaattggattttggatcttcaggttgcaccaaagctgtttgcgaaactaaaatgaaaagaggtgaagctggagactctattgtcttgagtttgctacatgtggtttaaaattgatgtataaaatgcagtggatgttgaacttttttttactgcaaaccagattgccaaatggctctgcttcttggttttgtttccatcgcaagtttgcgcttactacatttttttgctacttgagtaattgcatggcctaataacaagatatgttgtgcctttctttggtccaattgtcgtagacaatgcgtcaaacaaatcattaggcttgaagtttcaataaagagagattttcaagcctctgctattaggtggcctggtactatggccattgattaggatttcttagagcttgccaaagtttatgatcggactaactctgaagcttattggtcttaaaaagataactatctaatgatggcggctacaagaagatattttcttttaaaaaattttgaaggtgaaagaaggttgaatagtcttatggtgaaatcacatgtgactggaatgaagtgaagaactgtttagtggagtgtgtgatgcatgcagcagccacttttgaaggacagcttggactttagagtgagagtgagatgtatggcccgcggcggctgcattagactgaatcttatccttgacactctacagcaattatgtagattctcccatttgaccctctatttaagggttagcaagtgtaataccagtccatacaataccattacatagccatg

SEQ ID NO: 18561 - DNA, 3003 bp, Unknown; identical to SEQ ID NO: 18560
  misc_feature (1)..( 3003): 2750-1469P.txt file - cDNA_ID_1818367; gDNA_ID_1621154; Annot_ID_173375

SEQ ID NO: 18562 - DNA, 3003 bp, Unknown
  misc_feature (1)..( 3003): 2750-1469P.txt file - cDNA_ID_1818369; gDNA_ID_1621154; Annot_ID_56948
ttttacttagttgggctagtggagctcttgatcctgacagcactacatctgatgatcttgtcacttctgtcaaaaggttctctttttccttctgcccacatcatgtttttttttcttttttcatttgattccatcaattaacactagtctactatgtttatgttccttttctaggggagtgtgggctatgatcgctgtctttcttgcttactctttgctccaggccccttcaacgtttgtttaccatctcagctgttttattaatttgctttctcttttataatgtagattgtggttgttggtgatacttgtgatgtgtctttaatcaagtaatttgctttatgcagggttctaatcaggccccatcctgcaatctggcgcttagttcatggaatggccgtcatttacttagttgcacttacttttttgctctttcaggttcacttttttttcctccctagatccttcttacttgcctatgcctgtgatttatatatggattcttgttttaagtgagcaaactctaatagttacattattcatgctcccagagacgtgatgatgcacggcagttcatgaagtttctccaccctgaccttggaataggtaagagtttcggagaggaatgctgtttattcgaggagctaccacatcaatgattgaccatcttattgagtttgctcatgttgcagaacttcctgagaaatcatacggtgctgattgccgtatatatgtgcctgatcacccaacaaacaggtttaagaatctttatgtagggtatcttctcaacaactcccctttaccttaaccaaccttcatatcacctaaaggcttatgctttgattaaaatttatcaggacacagtatttgatgagtttttcttggctcacatctttggttggtgggggaaagcaattctgatccggaaccagccgcttctttgggtgctttcaattggttttgagttattggaggttggtctttgtcttcgttttcttatattacaggttccaatttgatatatacaaaaatatcgcttcgcctgtgtcaccgaaaagttatatttatgttctccaggttacttttcggcatatgttaccaaatttcaacgagtgctggtgggacagtattgttcttgatatcttgatatgcaactggtttggtatgattcttaagctaccttgctattctatatgtagtgcttttaaacatgttatggataacagcttttcttgttttaatcatggtaggtatctgggcaggaatgtatacagttcgatattttgatggaaaaacatatgagtgggttggcattagccgccagcctaacattattggcaaagtaggtttgttcaaccttgagagtgcatacacatggtcctagccgttgtacatccaatgagaattttgtatattttttcaggtgaaaaggacactggggcagttcacaccagctcactgggacaaagacgagtggcatccgctgcagggaccttggcgttttattcaagtactcactctttgcatcatattcttgacagtggagctgaacacattctttctcaagtttagcctgtggatcccccctcgaaacccagtgattctctataggctgatcttgtggtggctcatagcgataccaacaacacgggagtacaattcatatcttcaagacaggtaaagctatagccactgcgatattggttggagttagtttggaaagagttttgtatataacttgtgtagttttggttgttcacagaaaacctgtgaaaaaggtgggagcattctgttggctgtcactggggatatgcatagtagaacttctcatctgcatcaagtttggaagtggtaggtggttccttacacatgctctgccttagttatttatggttacagttacatagtgtggagagtgtaaacttggttgtatggttatgatacgaacaggattgtacccaacagaaatgccattgtgggtagtgacactatggggaagtgtgggacttggacttgtggccttcttgctgtcttggacatggaagatccagaagatcctcgcgcaaaagagacgttaagcgcatcattattgttgcagcagagacgagagagaaatagaggtgagacagtgaaatgccattgtggtttttttttgtaaatagggagaagaaggaacgatgtaaatgcaattttctttagggatagtgtgtgatattcaacatttacgaagattccatcaattctttcatgcatcaaaagttctttcatctttgttctgccccctcaatctgacaaaacatgttggtttgaatgtcaattttttgttaccattcacacattcaagttttcaacagttcaaaaaaagaagaagaagttattgagccattgtttcttctggtttttgagatgattgttttgtgctgccaactcttacatgacattaacaacattattgtgcttttactgccattaactccattaccaccattcaatttttctgtctttaattattggttccagttttgttattctggtctattattttgtattatcatcattctatcaaacagattatttgttttgttgaaggaaatgaaaaaaagaagaagaaagaatcaaatatgataaattgaggataatattaagattgtgtgacctgccgtgccgcccaacaacatgtcacatggtatcttaggtttgcaaattcgtaatttgacatcttcgacgacaattttgactatctatctaatcttaacatcactcttccatcatcacttcctattttattccaactttcttaaagaagccaaaaaaaggatgatgtcagaagttaaggaatattctgacaaggataggatgcccttaagggaatctagagtcttgaatgggcttttagaattccaagaagctagggaatctcgagtctttaatgggcttttaaagtttcaagaatcaaaggcccaaattgcatatttgtagcccgtcggaaacgcaatgaaaatg

SEQ ID NO: 18563 - DNA, 3003 bp, Unknown
  misc_feature (1)..( 3003): 2750-1469P.txt file - cDNA_ID_1818372; gDNA_ID_1621154; Annot_ID_56947
tagttggtggttaatgtagcattttgaaaatactgtttgcaagttatattccttggatttgcaagttaagaacatactgttttgactctttctttgagagagattgtaaaacatttgatatcaattctgatatttttgagctttgactaagaaaacataagtatctttaattatcttaataaagaacaaaaaatgtgtccaagctctaggggttggttgtattagcaacaaggagcatgtggtggatcagtcatatagaaaccataattaaagtcgtccggacggatcagaaacaagaatggaccactcttccttacttgtcttcatatgctaacacttatacttgagactgactattttgaggttgtcctcctcatattatttctagatgtagaccacacccctctctctcctcctcttaatttacctaagtttgcttgtggtgaaacagttaattgataggcttattggttacaatcgtcataagtatatgttgaaagtccttaggagttgtatgaactttactacgaaagcattatcacactattattggtgtcaactatcgatacgatattaatgtagtggtaatgctgtaatgctttttattctgccaatcattactacttgaatgatttcgaatatcatcgaatcgaaattcttaatcacgctctctatctcatcattatctttgaccctaatcattattagtagtatctctctatttatcacacacgcttattcttctgtttaatttacctgtgttttactctcacttttaatccaagaaaactatccacttttcactgttggtttcagaatcccattgcttattatttagttattattactaatgaaaaggttaaggaggaggggtaagtaatgttgtgacaagtgacaagtggtgtctccatctgcatggtcttcttgtaggaatgagctgtttatctttgtttgtattccagtttcaaactttataatactatttcgttagtgctttttaattgtattcgcagttatgtgaattttaatcaagagctagctgacctgaccgtatgcttattatagttagggtccattctctacaactacaactgtacatttataataagcatgctagtagatttattgtgacgatttcaagcacatagaagagtctatatcatcacttcacttgttaggcctctctttaatttcatattatatgacacttttttcattcaatgaaaagaataaaataaaattaattgtttgatactcctaattagggatgttattctctgcttctcctttgtacttttgggaatatctgtcaaatcaattacttaaatgagaatattaataaatttggcatttgatgtgctttatttggctgcaattaaacaacaatcatatgagttattgagtatcattccaaccccataaatgttagcctttttaaatggagtatatattactaccgtttttttgttcgtaacgcatattacaaccgctttaatcagagaaattatttaaagacgaatctggtgaaacatgaattaattttgtcaaatagaatatgtgaatagtatttctgtttatgttaaattaggcaataacattacatatatacttaatcctttatctgaaaacactagatttatgataaatacgaaaggtaacactggttagcgtatggaaccatcaaattttgactaaatgttttctaacactatgagtgaccaaaacatttccttttacaaattaaaatttgtattagtcatcctgcatacatttctttttccccaaacattttcaattttggaatttttttatatatatgtaaattacatttgaacaggtctaatttgaatggttaatacgcggttcaaataaagttggcaagtaattaacaaacgaatccacatcaaatttcaattactgtatgtaccaaaaccacatttataccaaaccgcatcataaaataaaataaaaattcttaaggcctgttttgtagattttgtaagagtttttggtttttgttttttaaaaacttattttcataccaatcaagattttaaaattttggtttccctacaatttagtaaaactattttattgtaattttccattcatgattttagttttttagtttttgtaaaatttaggaaatctagtttttgttcaatcaacgttatttttctcaaaaaccaaaaaccattttttggagattttttgaacaaaaaatataataacaaaaatctaaaactaaaatctaaaattcagaaactaaaatctaaactcaaaaactaaattaaaaatcagggcctaaattttgacataatatggatagatgatgatagtgagaccaaaccacataatattgcatattttgatgtcaccatttgatagcctataaaaaggagaagaagcaaagggtagttctggaaaaaaagggaatcgtgggggaaagaaagcagagtcgttttcagatcgtgaatagaagcagcagcagaagccgtatctatccctctctctctctctctctctctctctctctctctctctctactttgaccgttcctcttctttttattcatcaacatcatcgagctttctactacttggattcctacttcttcttcttcttcctctgattctctcccattccaatcaatctctagggttcttcttcaggtatctcaaatctcctctcttttctttttattgctaaccattttcatttactttggcttatttttaagtttaatcttcttctgatattgcgtctgcttttttacctctgcaaagacagaacctttctctgtctctctctgcttgtaccttgtaccttttctctctgtatacactccattgtctgccttttctcgtctctcttctcttacagtttttattcattaatttctctcgaggatgctcctcaggcccctctttatctcatctcccagctaaagtttctctttttgtttttaatcagcaatacttcagaagctggttttggccatg

SEQ ID NO: 18564 - DNA, 3000 bp, Unknown; identical to SEQ ID NO: 7598
  misc_feature (1)..( 3000): 2750-1469P.txt file - cDNA_ID_1818376; gDNA_ID_1621154; Annot_ID_56944

SEQ ID NO: 18565 - DNA, 3003 bp, Unknown
  misc_feature (1)..( 3003): 2750-1469P.txt file - cDNA_ID_1818380; gDNA_ID_1621155; Annot_ID_57017
gttcagaacctgagacagaacaaatggaacagccaatgcagcaactccaccggcaataaccaaaggattgtctgtgacaaaattggatatcccttcaatcagaccatccgaatcaaaagatgaagaagtggtcatagattgttgcagagcttcctcgtacgtcagggatttagcaggagctgttgcactgcttagaacagaagttagaagagccaatccaccattgaatctcttcaagaagctttcttgggagattggtctctgtgattttggtggaaagaggttagggagcgagaaaggctttcgtggttctgatcttttctcggataacaccgacatagggctaaaagttgcggttttcagagcttccatgactctctctctctcagattctccttctacaccaagaattgtccactccgtatcatcaaacttttcccaacgattaaagatgatgaagaagaagtggaagaaaagtgtcaaggacaagagcattgagccgtttctagagagctgacgtggactgtgtaatcaatcctagccaccgcttgcttgacacgtggaatattcggatgagatacctcttgatcatgttttggtgtagaggactaaagcatagtgacttacttagtccgaaattgcatgtcaaatgtgtggccagagaatattgaagatgcttcaagagaagcctctgcatatttaccaaaatgtcctttatctagaacacaaagaacagagactagactagatacaaaaggttcctcagcatttgatttaagtgaacaaagaggatcaagtataacattaagaaaacataacatgatgcaatgtatggaacttacaatagatcaaagaaataatctaaaccttgtccgatttcccagattgaaatgccgattccccagagacgagcattctcaagccgtagaaggattgacatcaatgtaggatagaaaacagcatgcttgatgttcttatcatctctatacatgaaaagatgttcgccgctctctttatcccaacggaaagttggcttgtgtttctggagtaatgcgaggtaatcccttccggtgattgctcctccacctcctgaatcttgcgcaaaagaaaacagtttatgtcagttggttttgaaagaaaggcgggaagagaacaagttgcttatataagcttggatgctttatatacctccagagattacaaaatcgttgccgtaaaagttgataccaagaagaaccttcctggctatgtttgagtctatgttgttggatgacccaagcaggagcttgagagttaaatctatccacttgacaggagcattggggccagggttctggggatttgagaaatcataggtcataagagagaacccatcaaccgaatctttcaagaattgaagatcttctggcccaaaatcgtacatttggagcttctctgaacgaggcggaccaacgacatacatgaactgcatatgttgctggttgtttcttggtgagctcgttgagtgaagagcgtctccaagttgttttacgaatttcagtgcctagaagatttataaaaaagcttgctgacatgatgcattatgtggaaaaaaaatcgcagcggcctggaagagattacagggcataccattttccgcaaatcagggtcatgcaaaacgccataagctgcccaccttgaccaagactctaacacgataccattgtattccatttccctagagttcaaggcaaacatgatgacaaggtaagtgttaaaattcacaagctctaatgtaaagaaattcatccttttcagagcatgaaatatacaggaattgtagagctttgggagacccttacttgcactctgtgacaataagactgatagctttctctcttagtttttttttgttaagcatctccccaggaattgcttctagaacaactcttggtaatatctacataaaaggggaaaaaagtccagacaatcaaagaaggaaaaacaagttaaacatcagcattttccgggtaccgatctctggccaattcagagaaggaagaaaaataggtgtgctggttaaactaccagtgcattgcctcttgaccgaagctcttgaatccatcccttatcagcattatgtctcccttccaaaaccaatccagacccttggctaccagaaacagaaaccaaaaatgtcactactattttgtggaaaccatgagataattgcaggaacttagaactcattaacaaatgtatacaatatacctcttcaggtcgtaccataccggcgataaatgtgtaaactttgagttgaatatctttgccatatcatagcctttagagttcctacacagcatttttagcatatgaatccaatccctactgccctcagtgacaacaatttgtatattttcaatatctcaaatctaaaaatgttccaaagaaaccaaccatggagtaatgtaagctaacactggataatcatagtgcctagttgaattctctgaagccttggaatgttcctgaaacaaattcaaaccaaatttaatgaaaattcatcctaaagttttcagcttttcttctttgaattgcaacattgacccaaaactatggaactcacagtgaggatttcttggaaattaatatcagttttaacgattcccttttgacgtattgatgattccgtttggatgactcgatcagcgaatttgactttgtacacagcaatcgaaacggcgggaatcacaatgaagaagattacgaaaatggtgatgagtctccgatctgaatcttgttgtacgacttgacacagtgactcgtatccgtcgttccgccgtttcaaactctccgccgccgatgaacgtcgcctcctcgccatcgagtttctcaccagtgaaacagagaacgaaacaacatcgttagaactaggagatttttggaatgatgttaattccatatttacccctgcttctggtcaaatattacgttaaagaccaataagaggatatcagagagatg

SEQ ID NO: 18566 - DNA, 3000 bp, Unknown; identical to SEQ ID NO: 7660
  misc_feature (1)..( 3000): 2750-1469P.txt file - cDNA_ID_1818384; gDNA_ID_1621155; Annot_ID_57016

SEQ ID NO: 18567 - DNA, 3003 bp, Unknown
  misc_feature (1)..( 3003): 2750-1469P.txt file - cDNA_ID_1818388; gDNA_ID_1621155; Annot_ID_57015
tgcaccactacgaggacatgaatctagtctaaattcaaccatatcgataacaagaagcaagcagtgactgtaatagtatgctgaataaactatgtcaagaataaaagcatgcgacaagagcagctacaaacatttggatcagccgatatgtacttggaaggtggacgacaaactaaaattatgttgatcattataaaaatagagataaatgcgcattttgaatgaaagaaaaacatttttttaaaacctatgaattaaaacctatggtttttgtgatcatcatcatgagagcgtttgttcttaggtcagttgtagttgagtttcgtcttgttaattgggatgtttacattgatcttttgtctttttattgatgactgtttgtttatgttcatatatattatatagtgttgtcggctttgcctcgtgttgcttagtgtttcatgtctttaatgttcatgtagtctctctgttttgattttttttgtaatactctcttttcttgtaatccaagtcaacgacatcaataatatttctaaagtggacgaagaactcatcttgcaacaagtgagcactgaacttgaaatcagaaaagatgtaagttagagatcaatttatatgcaaagtattcactagtagcccatcgaggataactaaaatctgagatccgtgaacatgaaagattaaacatacatgtgtaaaaaggcacctacaccataatttgattgtcctgatcccttcttaccagtgacattaataaaacatttgaggctaatgaataaattaaaaacaccgtgccattctactttaccagacatagtcgtcataccgttttttgtagcttgtgcggatcgtccaataatcattgacagtcgtcactggtgacatatgccatacgatgaacattcggtaacttcagcaaatttggcagatatcgaaaacaaataatttgatttcacaatattgtgtaatttgttttttagtattggttgtatatatttctttggacatttggtagctatagcaactatttactcgtggaaataatttatttatttctgtatgaaattatgataacatatctgtttaaaagttgtattgatgcgacagcttttctttgatttaatgctaccttatacttgttcaaactggctgaaaaatacatacaaaattattaaattccaaccacttatcacactatcctttatgtgataataagtttagctgggcaatgttattcattaaaaattggtgatgcaacacaagtcgaattgacaaagatataataatgagttaataggctttatgatttagcgggacatggacatatattcaattttgtaaatcataacaaaaatgatgggctatgagataaattccactttcacttttcttcactcaaacaaatgctaaaaactaatctatcgatgaatgattatatgcctttttatcgtcgccactatgacctaaaatatttcaagaagtcaattttttaatttgtatagagcaaaatgttttgcaaataaaagaaaaacattgttatgaaagaaaataatacagtagaaactctataaattaatattcgataaattaataaacacgataaattaataaattttgtcggtctcaagtcgggtcaatgtaaaaattaaccaaaatcgataagataataagataataatctttttgaaatccctatgtaaaaatatgatcctaataatatcataaattaataatcataaatcttaagcatacattctaatactaattttatctaaaacttttattcaagccacaattacaactctttttagagtacagttggtatgatctcttttgtactcacataactccttacgtatttgatccgtcatatttggttttgtaacattttttaatcattgctaagatttgtgttaaaaaaaattggattaagcctcacgttaacgtcgtaaatatacggacacaatattttgtaaaaaaataaattaaaaagtcaagagaaaaataatttttaacataattgaatatacgaacaacaaaatataagaaaaattaaattaaaaaacatatttaaaagaatttaatattgtattttacgtaaaaaaatttataaatatttattaatttataggataaactaatatcactataaattaataaaattttatggtaccaatattattaatttatagaattttttatgtaatagcaaattaccattccaaaatttaatgttaatggtaaaaaaaaaaaaaaagagcgaaagaattttattttattatagctaagaaaattggggagaaaaatcattgcggaagcattacgtttgcatttcatcacatattcacacgtgcgctcaagacatttcacacgcacaaatataattgacccacaatcacaaaaaagctggtcatcactaatttttttcaacaatttccctacccctctccaataattgaaaattttatatatattcttttggcaaccatatttaataaacatatatatatatatatattggtttcaattatggatattatataatagcattattatgtataattcccaattttatgtaagttatgaatatattttacacagcttgttaaatgctttactttaaatctacatgaaaatcaaaatgtattaatatgtccacaatttaaatggttgatttcatattaacatgagaaatcacaaaataataagtataaaaatgaattacgtaaatgatgattttttagtttaaataatcggtcaccaaaatattcatattcgaacatggtcgccacaagcgacattctacaaaaaaaacacatacaagtaaatagaaaatagaatttctcctctcaatgattcacacaaactctctatataaagccattacttaataccacacaaattacaaaaaaaaaaagaaaaaaggagataataatcacaaactacaaaagtagaaagaagaaaaaagaacaaagtatcagttcttgaatatttgcatcaatg

SEQ ID NO: 18568 - DNA, 3003 bp, Unknown
  misc_feature (1)..( 3003): 2750-1469P.txt file - cDNA_ID_1818392; gDNA_ID_1621155; Annot_ID_57013
gctttgtataactttgaaagttaccaatcacaaaaactttatcaaaagtgttattaaaagttttatactcacctttttttaataatttctttgtatagttccttctaacagctttgcactattccgataaatctaacagctaaaaatcttgtataccttttggttaccaatcagacccatcatataatgtataagaaaattgcaactatgccatcaatcttgtttcttgtcttttcatgttttggagggtccatactcaaaacaacaaatcaatatcgagtttttatgtttagttatatacactatcattactttcaaaacaaagaaaaaagcctttaacaaaaaaacaagtgggtgtgtataaaagtagatgtcggaccacagttgataagaatcaaataccgaaagccttatggctattattctatgtgataattatgtagatcacacataaaaaaagttcaccagctcattactcatactcacttacatgatcaagttcaaattattaaaatgtaaaagtcttcatgtaaacaaatcgggccgttctaagcccatataatgaagcctgttatgcacctaaacaaatagggcccttttatcaattagggaaagaattacgggcctaaacagctcagaagttctgtcaattaaactctgtgtttccttagtctaataactaaccgataaaataggtagtaaaaaagtcaacgatagttatcccaaaaatgcaatgttaatatttttgtcaaatctgattggtgttggaaagtggactatctataaatccatctttaaatgatagacagagacacagagtagaagactttacagctgtacgtagctttttgtataaaccacaaaaatagtcagaaggcgacctacactatgtgatcatataacactccccatatatctttcaagtcttcgtttacgaggttaatatttttcaacgtttaggatccaggtttcttttagattcaagttgtgaattagaaaacaaacaaaagaagaagttttgagagcacgtcttctaacatggaagcattaaacttgacgtatttttatggactatattaatcgatatgctgggaggatgatgaaaaaataaagaatttatatataaatattagttatttaggtaagtatgaaagataaataatatataaaccaaaaaattttttttaaaaaaattaattacaaaaatgctattgaataaaaataattgtaatattcggatgataagtatataattatttgtttaatgttttaaaaactatgatatcgcgataagtttataaattatttgttaaaacatatttatcgatttaaaattgtaaatcagaattttttatttatgtatattcagcacaataaaaggaaattagacttttttatataattaacatgataataattataactacatgatatatagaatgataacatgctaatatattatataacagaataatatttatatgaaaacgttaagatattcgatacatgaataatgtttactgtaacggataatttatacataatatttactaataattgttaacgaggttaacctgatgataacaatgaaaatatttagtaacaaaacaatatatgagactttaattaaaaaaaagaaaaatacagaagaataataaagtaacttcattagttcttttactgttgaaatagtccacaattcctacacctaatttttcagtcttctgagcatataaagtgatattttcctatttttatttactttttaattgtattataataatatttgggtatttttggttattataataatatctgaaaatattattgatatttttggttatttttatatttttactaaaacaaccgaaccgatccgaatccgaaccaaaatcgaaccaagtttttagaatatctgaatggttctcaacctcttcatatccgaatagatttgatatccaaaaaagaaccaaacagatagggatacccgaatgaccagacctagtattattgatataaaaaaggttgctcaatgtataatttcatttgactagctggtctgttttcgtacaaacacactcacaaaagtacgaaaataggaagtcgtcttagttttagaaaataactattgctgcttattggcatatattgaaaaatcaaatactactagtaatcgtaagttctaaatttgaatgtttttttcccgagtaattgaattgttcttagtaattaagttcacaaatttggaaaattgcgatatctgagaacgtattaatttacctgtcggtaaacagtcacactcatgtttctagatttcgtatattttagtaataatttggttagtctccttatctgcgagtcaacgagacccggtccgctcaaccgtactacagtctaaattctagtttcacgcgcttacttacattacatacgcgctcatctcttctttactcaaaagttttaaaaaacgaatatcaaatcaacgctaacaaagtttgattttttgcttccatcttcttcccctccttaagttttcaaatctattcatcaaattttcttttgtctttcccttaagattcccgggaaagccaaggaaaaacgctagaagaaaattaacataataatgttaattgttgcttaaaccttccagctcaagtttggtagtaagtaagcagacatttaatcccccaagaagcaattgaagaagacttttaattcttctgaattttctttccaaaaacccctttttagaaaattggttgcatcatagagattggttcatttattcccaccggagaagatcatcaaattcgtcttctcacctatatcgccgacgacattcttcacggttcgtttgatttctacctgttggttcttcgttttatctgaattcaatcggagatatatgtttttgagttcgaatttgataaaaaatcgaaacttttttgatttgaatcgcagttggaaaaaaacaaagcaaaaccctagaaatagtggctgatg

SEQ ID NO: 18569 - DNA, 3003 bp, Unknown
  misc_feature (1)..( 3003): 2750-1469P.txt file - cDNA_ID_1818396; gDNA_ID_1621155; Annot_ID_57011
tacatgcatcggttagagactatagatatatatacctggtcggtccaaagaatgtgactcgtcgacattaaccttgaattgtttcatctgattcagctgaatagcgagtgagaaagggctgattccggagacaaataaagacgtgtttggcaagagaaccgtggacgctaacgtcgcaaagtttgcgccatgtcgaaaatccgatccaatagattgcaaatatgggcttaggaaaggcattccaagagatttggctaaaataatttaacactacgtttagcactatagtgataatttttgggtaataacagtaagtattatagattttgtttaaaatttcaatctaaaatcctaattattagacctggaaaaataaattgaaccgaacgtacagaaccaaatccgaagaaatgaaaaccgagtcggtaccgaaccaaaatattttgagtaaccgaaaatatccgaaatataattatcttttcaaaaatattagttattttttgactaaatagtaaaaatacttgaaaatatccaaaaaaaatcaaaaagaaccgaaatatccgaaaatattcaaagcaaaataaccgaatggatactaaatatttaaaccgaaagaaccggaaccaaacccaaatttcaaaataagcgaatagatattaaacattagacccaaacagatacgaactgaaactgaatggataactgaacgctcgaactactaagtatatcttaaatatttttaaaaaatattttaatactaaaggatacaaaaaattatactttgtagaggggatttgatactgctgtcatattatacgttttttgaaaattttgagagtatttgttagtcatttgttacctagaaaatcaatgataagacgaccgtctgaagcacgaccggctggtttcttgaaataagtcattccccatggaccagattgggcaggaaaagcagcccaaaatccgccagtgtccgaattcgagtctccgaagttgaaaattgcttcgaaatcacattttgaatcacctttatgcccataaagcatcacaataatcaagactagaagagagaacgatcttcttctgtttatatcggaagccatgtctatctctgtgtgaacaaaatgtgtgtttgtatgtgagagtgaggatgagatatttggtgctatatgattcttgtaatcatcccgtccgtgactctcactctcattgtacgtgtaattagtgtgttatagccttaatggtttttttagtccaacaattccctttaagcccaataaaagataaataaagcccaatctattatattgattccaagggttcaatatatatgagatatgtctaacaatacatcaaaagaccagtttgaataacaacacatcaatttatggattggatatgaataagatgtcatgtatgcaacaaccaaatttgacatttctcttgtaatgccttgcaataaaagttattttgttaactttttgcaaagtatgtgccaatcaagaacaggataaaaaggttgggtctaataattcaactacggcccaataataacccaataaaggagggtattaacgtaaatttatgtcttggaccgggagtctaactgcacgcgtcaagtggctcccactagaattggcatcaagaacacgtcaccttgaccttgtcggatttgtctgaaattgaattcattctttttttagtgactctcttaaattggaattagatcttcagtctaaatcttaatgattataagaaacaagattatatgcatcatttcggatttaaacaacatggattaatctcaactaatttagcattaaagataagattttgttaacccttttttattgggtggatcctacgtggcgaagattgagtcatcgtctaaaattttaaaaaagatttcaagaaaaaattaaaaaatgagctggcgtcgaatcccacgttgtccgtagggaccacaacggtattccttattcagtgggacacgtcagctttataaaaccactaacggccgacacaagtcagtagatcctacagtggggaccactctaacctttttctggttaaaaaaagatatattttaccgtagatgaaatcaatattagccgtcgattaaatggtaaaaacaaatatgcttgatttggtagtccacgtttcgtcatctgtggatctcaaatgaattatacattatagtttaattctgtattttcattatttaaaaggaataaaatcagcagcacgtcaagtctacgtagagatctcaagatgaacggtggcgattatgactacgtgtaccaatcattatttaagtcagatatttaaaatgtccagcgcagatctagggttgccagctcagcatatgcgttccctttgcaaacccttcaagatcatgacacgtgtacggtgacgtgttcatcagcctcttggcgctccgttgtgtctctcttctttttcttctcttctccttcctctctcttcttttaccgaactctggttctagagagagaaaccattctctccgactaagagagagaagcgaatttgtttttttttcttttgtgggttcaattcgaattgttttccctgagactcaaggtacgtttttggattttggttttcgttattttcttcaatgaatatctgagtgattatatatgaacgctctgttttctcgagaaagtgtgtattgagtgaagaaaattactaggaaagttaaaggtagattgaattgtgtaactctactagttggtgatagttttgaacttttgacagaggaaaaaactcgactttgaatcttttactggtagattcagtggtgctatactttatagttactcggatctctgttatatttatagtttgatgtccacaattgcgagatctaggtgtaattgaatactgttcttttagatttatgctttacagaggaactgctaaaagatctgatcatttttttgtttataaagttactgtgtcattactctgcattgagcaatg

SEQ ID NO: 18570 - DNA, 3000 bp, Unknown; identical to SEQ ID NO: 7663
  misc_feature (1)..( 3000): 2750-1469P.txt file - cDNA_ID_1818400; gDNA_ID_1621155; Annot_ID_57010

SEQ ID NO: 18571 - DNA, 3003 bp, Unknown
  misc_feature (1)..( 3003): 2750-1469P.txt file - cDNA_ID_1818416; gDNA_ID_1621155; Annot_ID_57005
tgatcgtatgcgccgttagctatccttacttgccgtttctcaacaattggttgattagtgtttctagacagaagcatcaggatcaagttctcgtcatcgctgaggattacgctactctctacaaagttaacgagaaatggcctggtcacgccgttctcattcctccggcgctcgattctcagaccgctcacaaattcggttctcaggtataatacatctacacagagttttcatcttctcgatccaattttatctctagcttccagttcatgaaatctagctgaaaaatggctttgaaatctgagaatccatacttagttttgatcagtgattcacttatcttgaatgttcgttgattagcttgtttagtccctgaggtttcggttttaagctgtgttttggctgatcacatgaataacaaaagatagtgaacttgtggttaatatatatgcttaagagcttctattgcaatggaatcgattgtttaaactaacttctcgtatgcatatcttgaatgttcgttgattagcttgtttagtccctgaggtttcggttttgagctgtgtttttgtacatccatggctgatcttatgaataacaaaagatagtgaacttgtggatctagtagcagcagccatttttcccctgtttctgtatgtgatactatatatgctaagagcttgtattacaatggaatcgattgtttaaactaatttcttgtatagggattcttcaatttcacagcacggaggccgcaacatctcttggaaattttggagttaggttacaatgttatgtacaacgatgttgatatggtttggttgcaagatccgtttcagtatttagagggaaagcacgatgcttacttcatggatgatatgactgcagtatgtatatttttttctcagacatcttcttcattgatggtatttggattagtgtacttattattgtcttgattatgttgtcagattaagcctttggatcactctcatgatttaccacctccgggtaaaaaaggaaggacttatatttgtagctgtatgattttcttgcgtcccactaatggcgcaaaacttctcatgaagaaatggatcgaggagcttgaaacgcaaccttggtccagagctaagaaagcaaatgatcagcctggttttaactgggcacttaacaaaacagctaatcaggtatgttctttcttcctagttccacagtaaaacagtaacttctcttctctgtaaattggtctcaataagtagttactacacaattggtgaattcaatgaaattctagcgtaaaatctcaaaagactgaagcttttgctacgccgagagaggttccgctttatctaaccgtagctactcaagcttttaatcaactctgtaatctacttatgaatgtttagttacgataagcttttttggcacacacatggctgatcttatgaataacaaaagatagtgaacttgtggatgtagtagtagcagccatttttaccctgtttctgtatgtaataatatatatgttaagagcttgtattgcaatggaatcgattgtttaaactattttcagaggaattttatgacatcaaagtttaaaatctcaaaagactgaaccttttagtactcactcctacgaatgttgtttcaattcgagaggtaatttgatttggtttgaattcattcttcaactctttttgtattatctctgttctacaggtggatatgtacttgctttcgcaggcagctttcccaacaggaggattgtatttcaagaacaaaacatgggttaaagaaacaaagggaaaacatgcgataatccacaataactacatagtcggttttgagaagaagatcaaacgtttccgtgactttaatctatggctagtcgatgatcatgcttccgagtctcctttagggaaattagagtaaattccaatggcagaaaaagattttttgtcgctccatctttcttcttgttattggaatattcaggctgcagaaaggaagaaagatccatcgagtaaattcttttacattttttgggggtctttaaagtcatgtgaagaggtgttgttattggctaattcaatacgagttgagttgaatttggtaatgtagactactagaattggtattgggtctgaaatttcttaaataatcgaaacaaatactgacagctagcatatgaatacgagggtccacaagagtattaaacatatttattttgaattatagttgggtgttatttccacactttataacatgtgactaattttacaatctaatagaccttttggaggatgctgcttatgtaagatttaccgtaaatgataaacataaattaaatacgctctttgacgtcccattgtttggtcacacacactctagacttttcattcattcgtgtgttactcaaatctatttattcccagatctgatatatatatttattgcaattactaaatcccaatttccataaataatgatttctatgtaactcgttccataaattaaattatgcgtctaagttgtaacatataataaaaggataatatatttttcagtcacaccaaaaaaaaaattgataagaaagaaaaaaaaagagtgaaaattagaaagacagagaagcaaagattcttgctccctgcgaatccgcagctgcttcgaaacgcaaatccgatttgtagtctcctttgattcttccattgacgatacagcttctctttctctcttctctctgcttactttgctttttactaagctcacaagaatctacgcatctgtactgttattatgctgatgctctctacttaatcatcaccaccgcacgcagttcgagatttctggaattttctgtgtcggatgcgtttgagattcatcgaatctacttggttatagattggaaatttaggtggggatttgagttgcttagcttgtggtaggttacattttcttgtttgagattcagtgaatctctccagagttgcatgtatagaaatg

SEQ ID NO: 18572 - DNA, 3003 bp, Unknown
  misc_feature (1)..( 3003): 2750-1469P.txt file - cDNA_ID_1818420; gDNA_ID_1621155; Annot_ID_57004
ataccactcaagacgtgtaagatgcaaaaacttcttttcagattgcactgcagtctactcttttttattctcaggcccaaggacaggttttggttgggaaaagtacagttgttgacgaggatgcaatatcgagtggcgtggctgaaaatgagttagcagtagatgaaatctacacttgtgaggcaagcttttctatgaaaaagaaaaaacctataattgttgttataatcttgtttatgatgtttgtctctgacttgtttagatttgcaccggttgagtctctcgagctcgccaaaccctgtttcccatctccaagttactttatgttgtgtgttctacaaaatcgttgagaataattcattggattctatagtttgagactgaactctgatcttttgaatctcctggaacttaatggtttcgatgcaaaagattgaggcctctattcttcaaagcctaatccttgagtcccctatggcagcgcttatattattttgtgtatttccatgctactctgtagattccactttcttgtttgatgatcaagatttctgctttgatttcaggaattacttaacagatctggtgcaagaactttggaaccaaggacgatgacgaaagagagcactaaagttgatctatagttttcactttcctagtacagtactgtgtgagtgtgagtggattgatgatgtacagcagctgacattttccctctgtaatttctctaatatacagcagctgatatttccactataaattatgggatgtgtatcaatatggaaatatattaagataaatactttattaaaaggttttgatttataagctttctcattacttgctgctaaatttattagtttcctccttgaattcagcaacttttcttgggtttagccttgtaccatcgtggcatttcctataaacttcagaaatctccatgtgcattctactacgcttgtgctttaagtatgttgaatactattagataatttcccaaggattatattaattccactaatccctaggttagctgcaagatgaagttaaagttcacaactttatctctgcaactagattttgagtattttgcttctcatttcagatcttctctaagaaaagacaaaagaagatggtgttagcttgtgttcttgttgattttgtctgagcttgagggatggggaagacgaatgtattatcgaagatcagagctttcaatggcgtcaatagacccatctatgtgttggcaggtttggcttttcttatctcagtagctacattagctaagttcaactacatcactccactacgcttctctgatcggttctgtaactatcatggaagctttgacggcgacaactacaacatcggaagccaaatgagaaagacaatcgaaaccgccatttttaaaatccaccaagaaatggatgatctcaaggctttagaagctaattcttctactcctccatcctctgtttcatcagcttcaggatccatgtttaggcatgtagcttttcttgcggatgttctttcgctagttcagtcggttcatatggaattgccttcgttcgaagagagatccgtagcagatcatccgttgaagcagcagaaaggtgaccctggtgagcattttatgagagaagagataaagaagtacataaagatcaaacctaaccggctcgggaagcagaatttcatgggagctaacggaacattcacctcgatcgggcacgcttgttttgcgatgaagaaagatctagaagagtatatggactatgatgttggagaaatctgcaatgatgattggagattagctcagaagcttatggttcatggatgcgatccgttgcctagaagacggtgcttctcccgtggcccgcagttataccacaaaccgtttccaatcaacgagtctttatggaagcttccggataatcggaatgtgagatggggacagtataagtgcaagaactttgcttgcctagcaagcaacacaacagcacgaaaagggttctttaaatgcactgattgcttcaacctcacgcaccacgaatctccgagatggcttaaccgaggcgaaatcgatcctgagacgaaccaaactgcggatttctcgatagctgaagtactcgagattaaaccgggagagattagaatcggactggatttcagcattggcactggaactttcgcagcaagaatgagagaacagaacgtcacgattgtatcagcaacaatcaaccttggcgctccattcaacgagatgatcgctctgcgcggtttagtcccgttgtacttaaccgtgaaccaacggttaccgttcttcgacagcacgcttgatatgattcacacgacgaggtttctcgatggatggattgatctaatacttcttgatttcgtgctgtttgattgggacagggttttaaggccaggtggattgttgtggatcgatggtttcttttgtctgaaagaagatgtgagtgattacatggaagcgtttaaagcgttgaggtataggaaacataagtgggttgtggtacctaagaaagataaagatgataaagaagttttcttctctgctgtgttagagaaacctccaagaccctttagatgattgatcattgcatagtctctgtctttactattatctttgtaatcatattcttaaaacaaaacagaatgtcaaaataaactgagttatattttagttatatgttccaatttgcttgtataaattcagactaagaatttcaccaaaagtgttatatgtttgacatttatgtttgtaatccattgtgatcaatatgatacgacgtagtaatgtaactctctgagcgagaaagagggttctccattttgttgttaacaacaaaagcaatctccactaggttcgggatgaacgaaccaacaggctcggaccgtggaacgcgcggtatataaacaactttgcctctttgttcatcgattccgttacatcggctcattggaggaaatcggagaatg

SEQ ID NO: 18573 - DNA, 3003 bp, Unknown
  misc_feature (1)..( 3003): 2750-1469P.txt file - cDNA_ID_1818432; gDNA_ID_1621155; Annot_ID_57000
caagaatcaacggctataaagatgtccgcgtggagacgatctcgaggacggagaagctctcacgttttggctagtaactactaatttttgtttatcactaatccactatttaaatagtagtattaatcttcattctttaactacaagtgtttactagccccaacaaaaagttacattgtcgaaaatttagcgattagtttttccgaaatagtgttctatctgaagacaaccttgagaggacgagccacttgttttagttccaagcttgaatctcttaccacttcctgagcttgcattggttttctatgcacagatatcaacacattaggcaaggtagtggaaattaatgagaggagaaactgaagaagaatgtaaaactcacagaaatttggggtttagatctcagcactttgattctaccacctttaccatcaggtccaatagagatgagatcatcttttcttggaacagaacctcctagtgatggagttgcttcgtttctctctccatgtttgctccatctaccaaggtttctatttgttccacttgactgccaaatgtttccactacctgcattggacaatcttcaatctactactacactcaagaacttgaattcatgatgtacaacaaaagtaccattgctgtaaggtgacactgatgatgtcgggtcttttctgatgttgaactttatatccttcaccatggaattatcacctttctcttcaatattagtattccaatctctaatgccagaagtgttggtttcaggaacataatcatcatctacatctataaccgagtctgttctgctaacgaaggagtcttctcttccccttaagcatgatccttgaatggtaaagccatccttttcttctaatttaccaggtggtgtggagattttctccactttgttgtctgatgaaagcattctgaaagaagacatgctctcgattgcaggctcggaaacttctgtgtaactgcatttctttgaaacgtttatgtcccgtagagctctgttctctctctcttcagttatcaactcaagttccctcattcgtttctggtcatagaataaacataataagagccagatatagaagacacaaagaagatcgagataaacaccaaaacacacacctttagtttttctatcttttccaaagctttttcaagtttctcagaagatcgtgcttcgcctcttcccagctgattgcacttggctagcaattccttataactcctgtcagagtaagaaagattgttttttattagagacttcataaaagaaaattcaaagacctaagagaaaagaaacgcaatgttcaatcctcctttcctcaaattcttgaccatacctacttatgaaatttcgtaatttcagtttaacaagttgttgttacgaatgaactaaggtaaatcaccatttcataagtcactgaaggtcaaattaatcttttttaatcggattacactgctgtagacatgacaaatgggaaataatgaaccaagttcactaagtcaatgaccaaaatgagagcagggaaggagtgacaactaagtgctaagcacctacctatatcaaataaccaaaactaagtgaagccatgtgaactgagtggaactaatctatgtgacaaacctattccgaataaccaaggacttgactagtgtgtctattgtatctttcgtcttcgcgttattccccaacaaggccaacttcagtacatcatcttcctccaagcttaaatcagaaaccctggatgcaaaacaagatattagactcagaaaaggtttaaccatacgagtgaatgattaaattagaacctgaagacactaaaagagcaatatgaaagatgttatcttacaatttaagcgatgcgagctccttggcaagagccacagttctctcctgtagcttaacacactgtgagttaagctggatacattcctgtaacaaacaaacacactaagaaactcaacacaaaattctgcctgtgaagcaaaaaggatctaaaatctaaggatgttgtatagtttaaacaaacctcagattttaacttaagcaaatgctgagtcgttgatatttcttgaagagcctcccaccttttcactttatcctccttcaattgctcattgcattgatgcaactgagacacacacaaacaaaaacaaaaaaaaaaaaaatcacataaccttatcttatcttataaaccattctaatcaaacgaaatgaacaaaattaaccttatcagagacttcaacattctcctttttcttcgcctccagagccgaagtaagattctgtaccttcccttcaagccgcttcacttctcctctcaacaaaaccggatcttcttcgattccaacaaccttatccgaggcaatcgaatcggtttgattcccagaagactgaaagtaaagtcgacaaggatcctttagagagcacttctgcttacaaatcggacaatttcgcttgttcgtactcgggcaatactcaaaccattgctgcaaactagggtttccgaaagaaatcgattaaacacataaatctataaaatttcggagataataaacttcattagagaattgattttgccgtactaaccaaagttcgtgaaagacatggccacaagcggagattgattgcagattctcaaccaccggtttaagatcttcgtagcagattgaacaaattgcattccccgccgcgttttcttcggccatagctatctctccggcaatcaccgactagtcagtttccgacacagtcaccattttcttctcgagaaaatcaaaaggcaaatatcagagagcaaacacatggcgcggataaaaagttgaaatttcaatggtaagcgcgaaaatctggggaaggatagcacgtgtaagtcacgtgagataaaaacataaacaaccagtggcttgtattaggcccaacgtttttaccctataggtccattaaagcccaaatcagctattgatcagtggtcaaacacaatg

SEQ ID NO: 18574 - DNA, 3003 bp, Unknown
  misc_feature (1)..( 3003): 2750-1469P.txt file - cDNA_ID_1818442; gDNA_ID_1621155; Annot_ID_56997
ctagattttggttaacagagaagctccgtacattctaaaaccgaggaagagatgatgaaatcacataagctcaaatcaaatcaaacgcacgagtaagacaagaaactagtaggagtaataaaacctcagatcaaggtacgcactattagaaaagaacaaaatttagaaacgagaagcagagacgatggtatatgaaacaaacgagtcatggaatctcaacacacacaacacagaaagcaaaacccaaacaaaaacgaaatacgatgagtgaaacaggatagtaaaatgtctcagaaaaaggttttgaagcttacccacgacggtttccatgaaaggaatcgccatggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgacaatggcgtctccttcgcttctgcagtcttccgcttcttcgtttcacggacgtttctcaccattagcggctccatcctccgcacgaatgctctctccgccgctcagaaacgtggtgaaagtctcggcgtctggaactgtactggtcgagaaatctgaagccgagaaaactcaacgcctcaaaaccgcttacctcgagaggattatccctgcgctcaaagaagagttcaagtacgttaatattcaccaggtaaccccaaatccttcccctctgagctcaaacctagtttttgttctgttgcgattgattgaagtctaattctcagtgaattcgaattttttgagcgaatgttaaacctaatttgcttttaatgataagtttgaattgatttcttctagaaaatgtagtgaagaagcctagatttaagattgttgtgttgataaaatcgtgctgttgggatgtgccatttacaaatgtgaatgtgaatttgtcaatctcatcattgttgtatatctgcttggacatcttctctaccaggttccaaaggtacagaagattgtagtgaattgtggtattggagatgcggcgcagaacgacaagggtttggaggctgcgatgaaggatatcgcgcttatcacagggcagaaacctattaagacacgagctagagcttccattgctactttcaagatcagggaagatcaacctcttgggattgctgtcactctcagaggagatgtgagctatatttctcttgactaatcaaactttccttttgagttatttatgtattaacattttgtgattttgactgttgtgacaggtaatgtactccttcttggatcgtcttatcaacttagcccttccgagaactcgagatttccaaggtgtgagtcccagtagctttgatgggaacggaaactacagtattggtgtgaaagaccaaggtgtattccctgaaatcaggttagttctattgtatctaccctcaaaatcaaaactactaacttgttatccgctggttcaacaagatcaagcatggtttctctttagtcccactctttgtttacaaccgagcaactaaactctatgttggttggttggtttattacactctaggtttgatgccgttggaaaaacgagaggaatggatgtatgcatcagcacaacggctaaaagcgatcaagaaggacagaaactattggctctaatgggaatgcctttcagggaaggaggtggtggcagcacaggcgcgatagtgcggaagaagaaactaaagtctcatcactttgatgctaaaggaaaaggaaagagatgatgaacatagctgcctattgtatgtatcgtcttctgtaaccaaccatttcatgtttcagaaaaaccatctccttttgtaatgctttatgagtcaatttgaaaataatatcagggatcttgttgttatggtaaaaatttatcaaggtttttctgtaatttattgaaagttttgtggattatacaaaatgtagcgcgtgagtgaacgtgaaaagctagcgcgtggatttgtcaattttaccttcccctttgagagaaatcgctcttctttgtaagacttggtttcgatcttctctttttcatcatcaatcgatcaaaacaaacagcaacagcaaaattatctttctgcagatcgaaaccctaattggtttctccgttctccttttgttcttctagaatcggcgactcttacttttttttctttctaattatccttttctgatggattctggaatccatgtaattccccattagcgctaaaaaccctagctgtcgaagaccttagattactgcagaaatgttataatctgttttcatcttttcccgatttgaggtttttatttattttggttgggtgagagaatccgatacgagagattaaagccttgtgagtttaggatgagctagttttctttggctttgagctgtaatttctcttctctgaaatctttcactgtacatatagctagatcctgatgaagttgcgtggtggtgaatcgtggtttaagttttgctagttgagatattattggtggttactgtaatatcgaagaatcatatttcacggtatttactatagacaactactgtagagttacttgattaaggcgttaagaagagatactggtgttttttggcctcaatcagctaagatttttgtgcattgtatgatgagtatagcaaatgaacaacaatttgccatg

SEQ ID NO: 18575 - DNA, 3000 bp, Unknown; identical to SEQ ID NO: 7640
  misc_feature (1)..( 3000): 2750-1469P.txt file - cDNA_ID_1818450; gDNA_ID_1621155; Annot_ID_56994

SEQ ID NO: 18576 - DNA, 3003 bp, Unknown
  misc_feature (1)..( 3003): 2750-1469P.txt file - cDNA_ID_1818450; gDNA_ID_2926150; Annot_ID_139285
actcctgtgtgtatttctgtcatggccattttacaattcactgcttgtttgcatatgttgttaccagacaatataatctcccgcttttttatggctatagcttccagatggagacctccgggagaagattgagaaacttgcttcttctctaaagtttcctttgaagaagctgtttgttgtcgatggatctacaaggtcaagccatagcaatgtgagaagcttgagatctcttcctacctactttactctagtttaccattagaagcttacgtatcttgttacatcatacaggcttacatgtatggtttctttaagaacaaaaggattgttctttatgatacgttgattcagcaggtactgtgactcttgatgcttcaaacgagctatactcacatttctgtttctggttctgaaacataacataatcttctattgtgcagtgcaagaatgaggatgaaattgtggcggttattgcacacgagcttggacattggaaactgaatcacactacatactcgttcattgcagttcaagtgaggctcaaccgacagttcaaaaacttactcacatctacatttcacttaagaaatcatgtcttatgaccctctctcaatgttttgcttgcagatccttgccttcttacaatttggaggatacactcttgtcagaaactccactgatctcttcaggagtttcggatttgatacacagcctgttctcattggtttgatcatatttcaggtttgttatttttgccttttgacactaatctaatgaatcaaggatggattaagaaaaaaaaactctaaacctttggttatatctcctgtctgattatcacagcacactgtaataccactgcaacatctagtaagctttggcctgaacctcgttagtcgagcgtttgagtttcaggtaccatcttacaatccctcaagatccaaccatagtttctttattgcaatggcagcctcatctactaatctgagttaacgttccttttgcaggctgatgcttttgctgtgaagcttggctatgcaaaagatcttcgtcctgctctagtgaaactacaggtcagagaagataacaacagaacacaaactgttacctcaatttgtgtcacacacttaaatggattttttgttgggattttgcaggaagagaacttatcagcaatgaacactgatccattgtactcagcttatcactactcacatcctcctcttgttgaaaggcttcgagccattgatggagaagacaagaagacagattaagtccgcttaactcgtctcttgtacgggttgatgtcttttaggtgacaggtcgaaacaaaacaaaaaaaagtgtaaaaccatataggcagaggcctcttttgtttgttttttacttttacagtgggttttgcctagttactactagtttttgagtttcttaaaagtggaatcactcgcacggttcgatatgatcatttctgattcgtcttcttttattaaaatgaggagaatctaacgtatatgaatcattcttgttttgaaagtgatataggttatgattggtgttactaccacatgttagaaaatcgtgtaaaagtagtactaaattgaacatgggattcagcgatacagaattattgaacaaggcagaattgtttttatgagaatgatacatttcttgctatgatggtgcaataatgggtttctcttttcgcccaaaccttatccttttttctttatcatattctcataattacattaccctttaaagcatcccttctaaattctggattagtctgtataatatcattcattagttcaccggtttataaaaatcagaaagtttataagtttcaaaattttgctttggtgaaaagatcattcatatggttccaatttccaaaccattaatttaaattttagctcatagttgtatctcttcgtctcgatatggacaagggatcccaaagtacattataaatataaaaactatgggcatgggtcttttgacgcatacaaatttaaaacaacttaagctttagcctttgttctacctaatttagtaaattattagtataaactataaaggatctattatattatttaatacaagaatgaagaaaactatattatctactatattcgctctttcttttttttgtcaaaatggaatgctgatctggccactctacataactttcatctagcctctcatccttatctagataaacaaaatatgtggccctttgataggaaaaaatttcattcaaaaaatgcaaaggcagaataatttaattttacaaacgaatgttattaatgcagtctatagtctcttcggtataataaaagtgattccttttctccaaaaactattttgaatgatattaaagctcttaaatagcaatacactaaaaacgtagcttcattaatcaaaactcggatctaaatgtgtacttagtgaatgatattagtagagaatcatatccccaacaccgttatctctccgtcatctcatcgtttgtttttattacaaacaaaccccctcgggatcacgtaggtcccactatttttcctcttaactaaaagggtaataccgtcatttaccacacctctcgccgtcactaacacggagagagaaagaatcagacagctcatcccaagcacacacactcatatcagaaaatacacagacacaacacaacactgagagagagcttttcttttaaattccttcaatttttttttgttgttgtaaagaataataatttattcgattgaatttgtttattcgtgtctttgtttttactcaatcccctgtttccggttctgttcgattcttctctgtctctgttttgtttttcgtcattttgcctaaagccacatgcaacagtgattaactgaatttttattatccatatccattttgattcgccggaaagtttattcttttccggcgacaaatgcgaaagattcgaaaacccattttaaccaaatcaattctatgacgatg

SEQ ID NO: 18577 - DNA, 3000 bp, Unknown; identical to SEQ ID NO: 7639
  misc_feature (1)..( 3000): 2750-1469P.txt file - cDNA_ID_1818455; gDNA_ID_1621155; Annot_ID_56992

SEQ ID NO: 18578 - DNA, 2388 bp, Unknown; identical to SEQ ID NO: 7638
  misc_feature (1)..( 2388): 2750-1469P.txt file - cDNA_ID_1818467; gDNA_ID_1621155; Annot_ID_56989

SEQ ID NO: 18579 - DNA, 3000 bp, Unknown; identical to SEQ ID NO: 7674
  misc_feature (1)..( 3000): 2750-1469P.txt file - cDNA_ID_1818489; gDNA_ID_1621156; Annot_ID_57035

SEQ ID NO: 18580 - DNA, 3000 bp, Unknown; identical to SEQ ID NO: 7683
  misc_feature (1)..( 3000): 2750-1469P.txt file - cDNA_ID_1818493; gDNA_ID_1621156; Annot_ID_57034

SEQ ID NO: 18581 - DNA, 3000 bp, Unknown; identical to SEQ ID NO: 7675
  misc_feature (1)..( 3000): 2750-1469P.txt file - cDNA_ID_1818501; gDNA_ID_1621156; Annot_ID_57031

SEQ ID NO: 18582 - DNA, 3000 bp, Unknown; identical to SEQ ID NO: 7675
  misc_feature (1)..( 3000): 2750-1469P.txt file - cDNA_ID_1818501; gDNA_ID_1621156; Annot_ID_173526

SEQ ID NO: 18583 - DNA, 3003 bp, Unknown
  misc_feature (1)..( 3003): 2750-1469P.txt file - cDNA_ID_1818511; gDNA_ID_1621156; Annot_ID_57027
tgaactaaagtttgtttggtctcttctgagtgtttagcattatctataaagtttatttaattcttcttaattttcgtacaggtcttccctgacacacttcttgatgcacttctaaaagcaatgctgcatccaaatgtggaaacccgtgtaggagcgcatgaaatattctctgtaattctcttgcaaagttctggtcaatctcaggctggacttgcatcagtgagagcttctggctatcttaatgaatcaagaaactggaggagtgatacaacctctgcgttcacatctgtcactgctcgtttagacaagctcaggaaggagaaggatggcgtcaagattgagaagaatggttacaataatactcacgaggatcttaagaactacaaatcgtccccaaagtttcacaagttgaattccataattgataggactgctgggtttatcaatctagctgatatggtaacatttttccttgcttacaattggatgttgtgtgctaaaggaccatcatatgtttatgcaattgtctgatactgtttggtgatgcagttaccatcgatgatgaagtttacggaagatcaaatcgggcaactgttatctgcattttggatacaatcagcacttcctgatatcttaccttcaaacattgaagctattgctcattcttttagcttggtgcttctgtccttgcgactaaaggtcaacataaaagtttctcctcttttctggctctcttaatatttctctttcatagaggaagttttcactttcatgacgctatacttaaagcttctcatgattattttaattacagaatcctgatgacgggcttgttgttcgagccttccagcttctcttctcattgaggactctttcgttggaccttaataacggtactgattgatgaaactctcttaaactgatcaaagtttaagaaatcgcttatgtgcagtcaaactttctctttttcaggcacattaccctcagtttgcaagcggttgatccttgctttatccacaagtatgctgatgttcgctgccaaaatatatcagattcctcatatttgtgaaatgttgaaggcccaacttcctggtgatgtgagttcccaatgtgttgtttcagttattacttttattttatccatggagattgtgtatcacttgattatatactcaaaattttcaggtggatccttatcttttcattggagatgacttacaacttcacgtaagaccacaggcaaatatgaaagattttgggtcctcaagcgatagccagatggctacttcaatgctgtttgagatgcgaagcaaagtagaactgtccaacactattataaccgatattgtcgcaaaaaatctacctaaactttcgaaggtaaatcttatattttctgtttcttagtgaacaataccttttaagccccaatgttcgattctcttgtactgatttgattttatgtactctcttgttaagctcgaggaagctgatgtgaagatgcaaatcttggagcaatttacacctgatgatgcttttatgtttggatcaaggccaaacattgaacctcaaccaaaccaaagtatctctaaggaatcgctgtccttcgatgaggtaaactattctctgaagttccatattccattgggattttgataatattcagaactgttaacacttatgtttctttattacaggacatacctgccggttcaatggttgaggacgaagtgacgagtgaactctctgtgcgtttccccccaagaggatctccctcaccatctattcctcaagttatcagcattggacagctcatggaatctgtaagcatagaccacattcgacataaagaagaaactggctgatatatatatttgtgtcttcttataattggtttgtgatatgttatctaggcgcttgaggtcgctggtcaagtggttgggtcatctgtctctacttctccgcttccttatgacacaatgactaaccgctgtgaaacctttgggactggtactagagagaagctctcaaggtggttggccactgagaaccgtcagatgaatgggctctatggaaattcacttgaggaatcatctgcacttgagaaggtacgtaacagctgagttggtaaacacattagaactacaaactgttaaaatctgctatggtccttagtaatagtgagaaagatcataactttgtgataccaaatgggctggttaagagaaaggtagaaactttatcatacgaggcttacacgttgagacacgttgttacaggtagtagaagatgggaacatctatgggagagaatctggaatgttgcaggattcatggtccatgatgagactacctccagctagtccctttgacaatttcctcaaagcagcaggagctggaagatgattcaactaacttgatcatatcaatctctgtagaaagtgtgtaatcttgttgttcttattggatttgtagagaactaacttatctagggccaatcacgatgcttctcgtagtaatctagaatcagtagtaagtaatgcttgtttcgttaggacaagaatctctgttagtgttgtcgttataatcagtagagaaccaatgctatctagatttgtatcaaattctcttcattacctttaaacgcatcatcaaaacaaaatcgaagataaagttcacaactttaaaggccacatcttttactaatggcggtgaagcaaacggctttagttggccggaccggtttggttttctgataaccggaaaattcaatgaaccgactccaaaacgacgtcgtgttattgtgaaggcaaaatggtgttgttctctctgctgcctttaaaattggggttttgcttcgtcggggtttatgaagggctttgatactaatcttcgtctacaggcttcttctccagaattctccaatggtttcttgcctaaaaggcaaaactttataaaactcaatcgcagaaattgttaccccagatcttctttctctcccaccatg

SEQ ID NO: 18584 - DNA, 3003 bp, Unknown
  misc_feature (1)..( 3003): 2750-1469P.txt file - cDNA_ID_1818515; gDNA_ID_1621156; Annot_ID_57026
gaagtttaaaataataatataatttatttaacattaatttaatgagagaacattgtatttagcatgtattaatttgttttttaaagtcatttactatgggtaataatactcattaaaaaggccattgaagtttaaaataacaatataatttatttaacattaatttaattgaataaaattgcatttatcgttgtaatatagtgttttcattcattcgttacatcaaattaaaaattttgggcttataagacttaatttttgaatacttatgttatattctaagaatcttaacgcacacgttgaatacttatgttatattctaagaattttaacgcacacgtgtcacgtttattgttcagttgttgacatgtatcagatattttgtaattttttccaaaatgaaataggaaactaaaaaataaaacatatttacatattcaaatttatatgtcaacatctacaatatttaacttataattttcttaactagaaaggaaactaataataatataaagtgtataaaattaaattgtatttgtattgcaaaatcaaattgtatttgtattgcaaaatcaaattgtatttgaattttatacgatcaaattaaattttatttgtattattataaagtatatatttaaattatactacaaaatcaaatttgtaagattgaaatttggtttaagaaaatattaaattaaatattaaaagtatatcagttactatttaaactttaaatatcgtcaataagatggagtgtatagaattaaaaggcattttattatggggaaatatatagttaaaatgggtagtaaaattgaatgtgtatgattaaattttatttaatacataaattactaagttaaatattagaaaaagtgtgtggatctctatttactatatcaaattaaaatattatttataaatattttaataattttttaatattttatatccagctatttaggtcggccttatctggtatgtatatattgtaaaaactataaatttatcatgtacgatctttttgaaaaataatattggattttagagacaaacgaattatattttcaacagaaatcctgatttagttaaaaaaaagagaccaaaaacccctaatgtcgattgggaaaaaactgacctacatgatacatgataatcaacactacatattttttctttcgtcttttgaaaattggtttttaaaagaaagatgcaaattcaataataatttgtttgtggttttaatagtattagaaaaagcatattcttttaagttttgcgtacactgttggttcaagtccattagttacatttttttatattacattttttttttagttaactttgttactagatcttatgatacaaagctgaattttaaaaattcaatgacttttctaatgaatttaaatatatttcaatgattttttttaattatataaaaaattacattatttaaatatgcattaggccaccaaaattaaaaaatcggtcatgcaagaaagtctacatcaatgagtacgtcttgcgtctgatccccaactttccttctatatatggtaacaacaaaaatcgatggaatctttagacctaatatccaccaccggcaaatggcaagtggtcaaattagcctcaaatctcaacccgatgaaacctaccgtcaatgtgccacaaggtcattatgggttccaacatatattttgtcaacaagaaaggcatgggctgcaaagtgttggacttggacacaacaacacttaaaatggagagaaattatgatgcagctatgaaaaacaatgattatgccacctccctgtgttataaacaagcgtttatatatatttatatatattgttatattcttaattttggtatgaaaatgtgttattttttcaaatcacccaaaaaaacattccatcagaaaaataaagaaggctaatggaaaaaacacaaacaattggaacaaatccaaaggatgtcatcaataagccatatccaccatgtaaaatgtatacaatggaataactaaaacacaaatccaaaaaattaaactttaaataaaaaaaaactgattagaatctaggttaaaatttagtttttgatcaaggtatgaagaatgtatctcttcttcacaactttatcatcttcgtatagatcacatttaaactttcaaagtaaaaacataaagaaatttacaagatttggataacttcgaagccaacttttaatgagttcagaacctaaaaattgtgggaaggacaacaaccaaattgttagcctttggacattaatcgatggagcatcgattagcctctggacattaatcgatggagcattctgacacaagacaggactatagcctagttctgctttttctagtgagaaaagaaaagaaaaaaacattaaaatctgtgacatctcacgtgctctctctctctcttctatctctaattgtagtttgtatccaaatccacgcgcctttttccactctctgtctccacttttctttctagattaatcaaattctttgaaaccagtttctcacttcgcctctctcttcagatccgtcctctgtagctctgtatgtctcttctaatctctcctctcttacggtttctcgagattcttgtgttctgtttactcaattaccttggaaattaagctaaattttttgttagggtttgttttagaaatcgggtaaggcacatttgtgtttgatcttgttcctctgtctccaaaagcattgattcatacccagtttcgttaggttttgatgtttgaaccttaacatttgaattttgaatttcaaaaagtatagatgaggtctggtttctaagttcccccactcagaaagtaatgatttttttggtacttttcctttgtttgtcttggtttagtaactttttgtcttttagggtttacaaaagattgaagctttatgttctcttcttttgattttccaacacttatctcttgttctgtgaagggttgcagagaacaatg

SEQ ID NO: 18585 - DNA, 3003 bp, Unknown
  misc_feature (1)..( 3003): 2750-1469P.txt file - cDNA_ID_1818519; gDNA_ID_1621156; Annot_ID_57025
ctttttggtcaagcattcaacattttctacattttttgtaaagcagatcaatcttgttcttggttttaggtattgtctgaggaagagcagactgtaattgcagccactcctgctcaccctgaaggattatatggttagagctctctcactagttcattatcatattagaggccatggttatatcacttatggcatttcccatcatgatgacattttacttgtttttgatcagtcttatatgcaagttgtttggttggaaatttggttgagcaactttggaattttgcttggccgtccgccattgcaatgctatatccgagcttactacctgtggcagtcatggggtttgtcactaaattggcgataattgctggaggccctgtggttggaaagtttatggattatagtccgagagttcctacatatatctcgttgaatgtcattcaggtaaacttttcaaaaaacactgaatgaaaacatcacacatgactttgtggttactttccttcaacttttgtcacctgacattggaattaagtgtccatgtcataaacttattttatgtctacatgtttaggcagccgctcaagtgctatctgcaggaatgataattcatgcatacacggttccttccacatcggcgtcatcaattcttctgcagccttggttttttgcattgttattcgcaggggccattgacagtctatgtggaatagcatctggagtcgccattgaacgtgattgggttgtattggtatgctttctttgtgatgccatagaatacctgtttttataagaagataaaccgactgaagtaattaatttatcatttggtagttggccggcataaacagaccaatcgctcttgctcaagcaaatgctgttctccacagaatagatctgctttgcgaggtatagtaattttctctatggaatctatgtactttatgccctttgaacttttgaactccagtaattcatcaattgacataattgtaaccttaaatagatagctgggacgatgttatttggcattctcctatccaaatatgaccctgtgacctgcttaaagtttgctgccacactaatggtgggttctttgccaaccatggtaagtagcacctataaacttgtggttattcttctttcgtccaagctaaataagggaaacacaaagctgctgtgttgtacgaggctgaactatgtgtaatagaatcattcctgtttcctatgtttcaagtttcgaattcttttttcttcaattaaaaaggcagtctttctcgtttaggttttggataattggagcttagcctagatggagtattattagttcttttaactagataaataagctgtcatcaacattggagtgatactgttctgcttcagatcctagaagcaattccacttgcgctttaccaatttatatgggacttcttaccatcttgcacttctaatagaagaaatctgttttcttcagacagctcttatatggctgaccaacaagttctcctctggagttctggaccgtcctaaatgctccttgaacagctgttctgctgaaggatctcgtactaataccgacagtatttgtaaggaaaccttttactttatactacttggatacgcataatttatgatttgagcatgtagtagacatcacaaaataccatttgctttgttcatcagttgatattggcatggaaactatcaagctcggatggaaagaatatattcaacagccagttcttcctgctagcctcgcatatgtccttctctactttaacatcgtcctcaccccaggcagcttgatgactgcatttctaacacaacgatgtatgctacttcgactcggtcccttacttttctttagtgcttggatgaaaatcgtaattaatcttgcgagagtctttgtgctattacctattactctttcaaattagtcaccaatctgtcttttttcaacaggtgtgaatccatcagttattggtggtttcagtggattatgcgctgttatgggcgtcgccgcaaccttcttatcagcaaacttggtcaaacgagttggcattttaaaggtgaaatgttttcccgccatttgttatcttgagcttgtattgcgttcaagctgattaatgttattgcgtttgcgttttaaaacgatgcaggcgggtgcagtaggattgtttttccaagcttcactccttgccgttgctgttgctgtgtattgtagctcttctctatcccataaaagcccactcttcttcttcttgtccatgatcgtaagttgtttcttcactctctctctcgaccagtaatatgcggttttggtgttgactaaaaggtaacaaacaaatgcaggtattatcaaggctaggtcacatgtcttacggcgttgtgggagctcaaatacttcaaaccggcattccatcatccaaggctaatctcatcggcgcaacggagatctcagtggcaagtctagctgaatcgcttatgctcggagtagccatagcggcgaatgacgcttcccatttcgggtttctcgcggttctgtctcttttatcagttgttgcggcctcattgatattctgcagattgctgagaaatcccactgatgaacaaagacgactcttctccttcgaccctctctcaaattgatttggagcttttacattgaaatatttgtatagtagtttcactttcagtgtataaattctttatataaagtaaagaaaaaaattgactttggtgtgaaaaattcaagaagtattccacttccaccattactactctaaacaaaaagtactaaactggctaaaccttagttatttttctaaaccgagaattaacgagataatttaacaatcgatttcaaaaaccagcaaaccgaaatcacccaatttttggtcggtttggttcgattttgttttctttcacccctgacgaagaaaaaaaaaaccctagtcacactcagataacataaacctttgacaacaaattttgatg

SEQ ID NO: 18586 - DNA, 3003 bp, Unknown
  misc_feature (1)..( 3003): 2750-1469P.txt file - cDNA_ID_1818523; gDNA_ID_1621156; Annot_ID_57024
tcaaaccctaatattttcatatttatcatacatgcccacacacatctaactttaaacttatgtaattagatttccatttttcaaataatatttatatttattttagcctaaatttagattttatgtacataaggcacaagcaaatttatcttgttaacttattaaaataaaacaatagagtagccgttcgattaggcctaaattcaatatatcaaaacattcaatcaattgaataacattttggtttggtataattaagaagcaagtttagatccaaaaatacagtctctattaaataggaaaactaccataatctttttaaggaaactaataattcatccctcaccataattatactaattaacttgccattctccttcgcctcctcttctagtcttcttatgattatttttcttcctcatcttgttttttttttttcagacaaaaacctagatagctaaacatgccttgtttgttcatcttcatagctttgcttctaagttcttgtattggaacgttgaaagcccttgatcagacttgtggcaacaaagtcgtgaacacaatcgtcgtcgaccaagccggttcaggtaagttccgtactgttcaagctgccattgattcggttggtgaattgaattctctatggatcaaaatcaaagtaaaacgaggtgtttacgtgtaagtaaataccaactctctactgtttttctttttccaattttagaactcagcgttcttgaccacaattttctagcatttgatttgtttcgaatgtaaaatattactgtcgttggtgtagaaataatgacctagtagcacttgacttcatcttaggcctctccacaattctacatttatactcaaataatttttctagtttcttcgttgttttggagagaattaaagcatagttgatatcattaaatcttgaattcgtgatgttctggttcatagaattctagaaccgtaattaatctaatttacaacgatttcgatggatttgcaattgttaattttcttaatagtaagattaacattaatagtaacatattgttttgtatgataatgaatgtataaaacagagagaaggtgataataccatataataaaccgtgcataatagtagaaggagagggacaaagagtcaccaccatcacgtataatggtcatgcagccactgacgtcagctcaactttcacttcatatccatcccatattgtcgtccgaaacttatcaatcatggtacgtaacggaacggaccaacatatcttttgacttatatactatattttgttacgtaacaatataattttgataatgataacattttatatgtttttgtggcagaacacttataatcgtttgactagtctaactaaagcaaacggtatgagttgggatataaagccagcggttgcgatttcggtttatggcgataaatcagcgttttacaactgtgatttcttggggttgcaagatacagtgtgggataatcttggcagacatcacttcaaaaattgttacatcgaaggtgctatcgatttcatttttggaagtggccaatctgtttacgaggtatgtatacttaatatctctctctattacgtacacttcgattttcaatggcaaaacacgaaaactgtacttgatcactatttacacaaagactgttacattcacagtacaaacacacttttataaaatctttgtttcaaaacgccctagaaaggagctaggcacagccacaccctgtactaaaatcagctttttgttctagaaaaagtaacatttcagtcattcaaataatagaaacaaacttggttaaaaccttgtttgtagcatgttttttcctagaacaaaactaaacatgtgacttgactagctaggaggactgattttttgtaagtcaacaagttgattttgagacaccaacgattaagatctatgtgaaacatgcatgaatcgtataaaatgtttgacaggactgtcatataaacgcaacggcaggagcattggcatcaaaagtgtcgtttgggtacataacggctcaaggaagaagtagcgattcggacccaagtgggttcgtgttcctacgaggtagtgtttcagggagcaccagtgtctatcttggacgagcctatggtccattcagtcgagtgatattcatccaaaccgatctctcttccgtcgtgcaccctgagggttggtactcttggcactatggtggatacgagtaagcacatctctaactataatatatcatatataccattatcaaactatatgtgataatgatgtttttttttgtgtgttaggatgagtttcacgtatgcagaagttgagtgtaaaggagcaggatcggatatgtcacgaagagttccttggattgataaacttcattctttttacactaaacaacaattctctatctctaatttcattgaccaagatcaatggatctctaatattcctcgtttttaaataaatcactttctcttttgttagattctagttgttttatgtaatttgtatttttcctttcttgttgaatattattgtctctttgaagtttgaactatgaagactttttattttcttaccttgtattcaaaccaaactgaaccgactatatatgtatgttttctcgtttcgattctggtacatttcgatcgctctttttatatgacttcggttttcatttcaattcggttcatctattacccgagtaaaccaaattgttattattattggttcattcattcattgtatttcaaattttgattctttatatttagtactctgccaattttcatcaaaattgcactaaaacaaaaacaaaaaaattagccaaattgtaaacgaatttgaaccaatatttggtaaaactgaaccgcaattccattcccagaattataccgaaccgttataaatacggttcaaagttcaatctcttcaactaaaaccgaacttttatctattcgaaccgaaccaacagacccaatg

SEQ ID NO: 18587 - DNA, 3003 bp, Unknown
  misc_feature (1)..( 3003): 2750-1469P.txt file - cDNA_ID_1818530; gDNA_ID_1621156; Annot_ID_57022
aaaactgtccaaagttcaataaaacaaattagaggtttttgttgtcgttttttgaaaagattgaggtttgttttacagtttttcgaggttaaactcgcatttgtattgttctcattaaaaaacgactattaatattattttattttaaaaaaaatttaacttgctttaaaatacttcaacaaaaaaaaaacatatgttttttttagagctaaccaacctcaagtttgattttttcattctgttgcgaatagagacatacagttcaactgtgaatagagtacggtgcggttcaaataagaacaaaaatatatacatacacatatatgtagagattttagttactattgaaaccgcaacgcattgtttggttcaccgcaccggactgcggaatttgtgatttgttcggaaaaaattacggcttgtcgttttttcaaatgattgaggtttggtgtacaatatttttattcaaggttaatcttgcttttctttttgtaatttggtgatttctttgcattttttgtcaataattttttttattttaactcaacttggtttaaattttttaaaaatatttcaacctgccacattgaccacaatgatggaggaggaaacaactattcattctccttctcttttcaaaaaacaaatactactataaaagttgaaaaagaaccaaaaacagatcccaatatatccaatcacagctgcacatctcgaaaatgtaacatgactaaattaaaccatcaccgttaattttaaaaacatccaacacatcaaaaacacatctgtaaactcgcatggaccacatcaatcctctcatgcccatcatttccgccataaaagctttaccttttttccacaattagccaggtacacactaattcgacactagtagaatcttacacacacacactagaatccacttcaatgccgtcatctatccgctggtggtggccgatccatttcacttcatctggatctgtaccaaggtggctgagttggcgtcgaccggagctgagtttattgtctgtggtggtcgacgacgttgtgtggaaagttgttacggcgttcgagtcggtggccttggtctccatgctctgtttcttcttcctcttttgtggctgcaccgtctagttttgattttacttaatctcgttaagattttttgtatttttttgtgaacggtgttttatcaccggaaagttttgaattgtttttttttctttttaatttttagctgcgtcaccgtgtggtagtggcggagaaatttatgttagtgattcaaaaggaggcgcgtgatgctcactcgagagttatgatcatttgtgtttagttttggtttcttttgaaggatgattatgttatgttaggttcgaatcttgtgaaccagaaaaaacaaaaacctatggtttctatattaagaaagctgtaaaatcgaaatcgtaatgggattttgaaaacggatattacatagttaaattgaaaatgcttttggaaattttaatcttcatattctgatttttcaacgatttttgaatatgtttttacttagcaacctaaagttatagaaccaagctagaaaatacatgacttattcaggcgattgattttggatttttcaaaatgtagaattttttatttgggcctgctaatgggctggttcgtttacatgaacaatcaatgagcttataggttactctcacttttactaagggacttatgggagggagtcaataaactcaaaagcaccaaaaagtttcgctgaggttaattctaacaaggaagatttgtgaagaagaagctctgataatggtgtggacacgactgaagcagaacgcgaaatcagttctaaagatagcaccactatctttaactctaaaccttactagagattactctaaaccaactttttattccggtagattgttttcacttgtctttttcacggacctaggtacagaatctcttagtctttaaaaaaaaaacaaatgttttcacttgtaattactttgttagattttgcttcggagacatgtcatggattaggaccgatttagccatagtgacatgcctagatagaatacgtatatctggtcttgtaggtttggaacataactaaaagttattaaattatagatgaatagtttcattgtattattaaaaggcaaaaacaaataaagataatgttgataatctttaacaacacaaaaaagaagaaaaaaaagtaatggcattcaagtttccaagtgcatgatgcttacactatccatcagagtgaaataagccgcgatgactagtggtaggattatagatgcacgcttttccgtatagattgtataaaatcaagccgcgatgacaaactatgtcgtttcctcctccaatccttgggataaccaaaccgtggtccttactagacgataatgataatgatagcattacagaactacccaggtactcgtttacgaaacgtatgtctacacgatgaggttgttgtggtggagatgcgaccgtaagataaaggttggttaaatatcgagaatggataagagaaactcagagcttagagacacacttgaacttcatcagtgatttagcaggcaatctaattggaatctcgatcatgagatccaaaggaatctttgccgaaaccaaatcgtctatttcttcctcttctcgtcgtatttgacgactttttcttccattggaaaaaaaatagtctgagctttagacatacacatacggcatacccatagctcaactacagtgtcaaggacaaaaccctaaacccacaaatctttgttacatttttttttgcaagggaacgtgataaaaaaaggtttaggctaatgggccaaagatgtaatgggcttagccgtttaataaacaatcgatgagcttatttcagaaaacgacgtcgtagtaaggaactcccatcagagaaacccaaaaacccaaaatctctctctctatctctatctcgcccgaggaaaagctccgataatg

SEQ ID NO: 18588 - DNA, 3003 bp, Unknown
  misc_feature (1)..( 3003): 2750-1469P.txt file - cDNA_ID_1818533; gDNA_ID_1621156; Annot_ID_57021
tgtgacgacatcaacagactacttgcacaatactggtggagtaatggtccggataagcgctcaatgcactggttgtcatggaagagaatggcattgccaaaacaggaagggggcctaggttttcgagacatagaaagcttcaatatggctatgttaggtaaacaagcctggcgaatccttcaatcaccaaatagtcttctctcacgactacttagaggaaggtactttgcatcaacttctctcttaaatgcagaaacaggcacaaaaccatcctttatctagagatcaattttggaaggacgagatttgcttaaaaagggactgagggttctaataggtgaaggaaaggaaacaaacatctggatagataattggttaccaacgcatccccaaagagccccacgatgtcttgaaggaatcactccaaacgtatcgcatgtgaatcagttaattgagtcacgaccaaagagatggaacagatcacttgtcgaaaacctgtttcatgaggaggatgctaggctaatacttcaactccgtctaactagtcagccatcaccagatttgcttggttggaattatatggatgatggtgtctatacagttaaatcgggttactggctagctactcatctgcctaataacaatccggaatttgacccccctccaggagaaacaaaacagaaggaagcgatatggaagatgaagacaacaccaaaatcaaacatttcctgtggagagctctcacaaaaactttggcgacaggctctattcttacttcacgaagaataacaaatgaccctcaatgcaagcgatgttgtgcagcggaagaaactagagaacatctcttctttggatgtatttatgcccaagccgtgtggagagccacgcatgttagcagaccggaatttttcaacccaaatctttcctttgaagcgaagctcaagatacttatccaaattcataacgataagatgaatgatcctttaagaagacaactaccattgttgacactatggagaatatggaagagccgcaaccttttagtttatcaacgacgaagtagtacgtgggaacaagatgcacacaaggcaaccactgatgcttttgattggattccaagacaaaattctcggcgagatactcgaacacaattgaatcatggctgtcctgaggatggatagcgcaaaccagaatggggttacaagaaatgtaattatgatgcaagctacaaacaaaatggggtagaggtgaatgtaggctggatattgcgagatgaagaaggttactacaatgaagcttcccacaacaaagctcagacgtgcagtacaattctagaagctgaattacaagcattactcatggcgatgcaacacatgtggataaaagggcaccggaaaataatatttgaaagcgataacagtcaaatcccaaaacttctcaaaagtgaaataaacaacttcggtcttcataatcttatacaggaaataagagtatggcaacagaagtacacgagcgtgaagatacaatggactgcgagatcaagcaataaggcaacggattgtctagcgagaactcggagacccaatgatctttcatttgtcaattacttccatgtaccaaactttcttgtagacatccttcacgaggattacacttcatctatctaataaaagaagttgctgttaaaaaaaaaaagttagagataggtaaagtgaatttcatattttttggatagtatttttgaattgcttcattttcgagattaacaagcttcttctttttttaacaaccccagagtttcatcaactttcaagcaacagaaacacatgattaaaaaattaataacatcaaataaagcatattttaaaaattaaacttttcatcatatagattcttagaatgtgattgtggagccacgttggatctccagggttagatataaatgaaactgtctatgccgtgtgacagcccttgcaactattcaattcaaagttgaccatacatgaaactatttcaagcaaacgacgcccaacatcaagtattcaagttgttgatattgtctaaaagattcaccatatataaaagccaacttcatggaatcgaaattgtagcggtacaacagttactagatcaccactttatgacaagcacactcttgacatattaatcaaacttggccaagatgatcccgagctaaccacacaccacccacacatctaatatttgactgttcatgccacacttatattgaccttgagaaaaatgaagagtatatcgactcggttaacaaaacttcaacaagacaatttcttataaaaaaataatcatagactgataaatttctcaaaacacttttcaatttaaacaatttcataatatgtgtatgttgacatttctaatacatgaatagattgatgctcattgaactttattgaaatgtaaagaagagataaatgtgaaagattttatgttgtcttcaagaacaaaataagtttcaattatgttttataaaatgttgaatgtggctgttcaaaaaagtagccttgattacattaatcaaagtcttacacaatataacataagcttacacggacttctctaatgaataatgattataacttgggtttaggatcctcttttccacctagaggcttttatattgttctacaatttaattttttttaaaaaaaaaaaaaacaggagcaaaataagatagtgtgtatgtaacataatttattgttgttgtaagacattacaaataaaaaaaatatgattgcattgaagaaaacaatatcaaatgacaaatacatagaaacaaaataataattaagtaaggcaccgagagtagaaattaaaaaaagcttataaaacaaaggaatctcggtcacctctcaccaactccaatgctcacttatacagaagctgagaagcagaaccgcttttatataatcgcactcactcagagaaacagagaagacgatagatagagaaaaaaaaaaaatg

SEQ ID NO: 18589 - DNA, 3000 bp, Unknown; identical to SEQ ID NO: 7667
  misc_feature (1)..( 3000): 2750-1469P.txt file - cDNA_ID_1818541; gDNA_ID_1621156; Annot_ID_57018

SEQ ID NO: 18590 - DNA, 3000 bp, Unknown; identical to SEQ ID NO: 9186
  misc_feature (1)..( 3000): 2750-1469P.txt file - cDNA_ID_1818549; gDNA_ID_2926128; Annot_ID_138673

SEQ ID NO: 18591 - DNA, 3003 bp, Unknown
  misc_feature (1)..( 3003): 2750-1469P.txt file - cDNA_ID_1818549; gDNA_ID_1621157; Annot_ID_57063
tcattcgtcttaaccaggcggaagaagaaagaaggtgctgctgaatcaccggcggtgaagtcagggaagaagcgagctggtgaaggaagcacctcaagggacatgcatgtcaaaagagttaagaaagaggacgataacaaaaaggcgaatcctcagagagtatggagtgaagaagatgagatctctcttctacaggcagtgattgatttcaaagctgagacaggtacaagtccttgggatcataagaatgcgttttttgatatcgccaagaaatctataagctttgatgttagtcatgtccagttctttgacaagattagaagattaaagaataagtattttgttaaccggaagaacaaaagtggtgaatcgaatcatgataagaaatgtttgggtttggctgttttgatttggggatctgatggtatgaacgttgaatctcctgtgaagaaagatgaatctattcttgttaagggtaaggctaatagcaaggagaagaaggtggagaaacctttggttatagaagatgagcaagtgattcttggagcagattcggagtggtttgaggagtcttttcttgttccggttatcgcgaatctcggtttggatgagtattctgtgaagaagaagtggagcaaggtgtctctggagactaagaagaagattcaagagaagatgaaggttgtggacgctaagaaatgtgagttgttgttggcggagatggatgttttgaaggatgtgacttcggtgcttgctcaaaccaactaagaagaagaagaagaagaagctatcttagggattgtatagggttaatctaaggatgtaatgccctcttttgttatctatcttagggtttatctttctatctacgtttatggatttttagtcttttggattctcgtgtgagaattagctataacaagattaagataagttgtctaacaaaccttttggtcgatggttgtaatgaacttttaggattttgtaaatgtgcttctttttttaatgtctctctactcaaaactcatgaccagagttattacaaaacaaagaaacacacaatagaatggattcacaaacatattcaacaagagttctaaatagcttatatggtgataggttcaacctcattaaacaaaatggattctgaaatgatgtttgtaaattgtatatttattgtttatgataattacgtgcagtttgagttattctggtgacactagttcctctttctcaagtaccaaatgcaaccaaaataaaacatatacatttagttacaatctttcacagaagttattatgtctataataaaaaaattaagagattctgcatcttgaaactgcaaagtaggtgaggaaataaaaagaaacataaattgtgtttatgagcatgcttgttgttagagtcccaatatgtagtagagtagcttgcaagaaatcagagttaattatgcgtttaagagcatgcttgtgtgtgtaagtgtttcaagtaaaactataataagtatgtgtgtttgtatcttgtaagagaatcacccaagttttattatcaagacatcatgctcttaaacgtgttcttgtttctctctaaagaaaacaaaagcaaaacagagtgacaagagagtgagagtgctgacctcaaaagaatgttggaagaggtagtttgagagtgaaagtgtgattttcaacagatatcttcctcacgtagaagaagttgaatggttaatatcaatattgttatgtataaccaagaaagctatagaattgcactatgatattgtgaagctgcagaaaaataaacaacagtaaagtacatacttgaacaagaaaatgaactttgttagtccgcgtacttgtcttaactcttatgcaggggtagccaagcaatatgaaacatttagtgtggcccattttttttttttcaaattctttaacaaaaattatttacaaaatggccccaattttattgattttaacgataattggccctaaattttaaaacctttcaaaataatcttggattttttgtttttttgtatgttgcccataaaaccgtcaggtcttaggtaaaacatctataaattaatattcaataaattaataaactttataaattaataaattcattcaatcccgagttgaaaccagtgtaagaattgatacaaatcgataaattaataaaataataactttttgtgaaaatcatatgtaaatatttggtcccatcaatattataaattcactaatttatatatatatatatatagatatatactaaaatatgaatatagtattcaatttgtattaattctttgtagaatttaattctaatatttttactaaatcgaaaaatttagttttggtttttaaacttgataattgtttaataattgtaattggtttcaaaaatattattgattataagaaaagaaaaaaaataccttttttgattgaatattataagaaattacataatttgtaaaatttctttataaattaatatctcttcaaattaataaattttatcaatcttaaaattattaatttatagagattttacctaatatgcatttttaactaaaagtcataatgttatatattttatttatatttagagaataatatatatattaaaaaaaaaaaaaaaaaaggttgacaagtggaaatatgtgaccggcaatagtaagttaagttgaccaaaaccaaaaccaataaaatcaaaatcgagagactctttcttcccccaagcgaagaagcgatgatcaaaattttacaacggttcctccattttcagcgaaggtaagtctcacctaattccttggaactaagctccgctgtgatccgaatgtacttatatatctctctcttctgatcaattcgcaaaccgccattgttgcttttttgaaatttcgcttctgatgaagaaatgttgatcggagaaaacgttgaagacgtttgaatttctttatgaattagtcagttgtggtgttagttagttacgatg

SEQ ID NO: 18592 - DNA, 3003 bp, Unknown
  misc_feature (1)..( 3003): 2750-1469P.txt file - cDNA_ID_1818556; gDNA_ID_2926128; Annot_ID_138675
tgttttgcttttgttttctttagagagaaacaagaacacgtttaagagcatgatgtcttgataataaaacttgggtgattctcttacaagatacaaacacacatacttattatagttttacttgaaacacttacacacacaagcatgctcttaaacgcataattaactctgatttcttgcaagctactctactacatattgggactctaacaacaagcatgctcataaacacaatttatgtttctttttatttcctcacctactttgcagtttcaagatgcagaatctcttaatttttttattatagacataataacttctgtgaaagattgtaactaaatgtatatgttttattttggttgcatttggtacttgagaaagaggaactagtgtcaccagaataactcaaactgcacgtaattatcataaacaataaatatacaatttacaaacatcatttcagaatccattttgtttaatgaggttgaacctatcaccatataagctatttagaactcttgttgaatatgtttgtgaatccattctattgtgtgtttctttgttttgtaataactctggtcatgagttttgagtagagagacattaaaaaaagaagcacatttacaaaatcctaaaagttcattacaaccatcgaccaaaaggtttgttagacaacttatcttaatcttgttatagctaattctcacacgagaatccaaaagactaaaaatccataaacgtagatagaaagataaaccctaagatagataacaaaagagggcattacatccttagattaaccctatacaatccctaagatagcttcttcttcttcttcttcttagttggtttgagcaagcaccgaagtcacatccttcaaaacatccatctccgccaacaacaactcacatttcttagcgtccacaaccttcatcttctcttgaatcttcttcttagtctccagagacaccttgctccacttcttcttcacagaatactcatccaaaccgagattcgcgataaccggaacaagaaaagactcctcaaaccactccgaatctgctccaagaatcacttgctcatcttctataaccaaaggtttctccaccttcttctccttgctattagccttacccttaacaagaatagattcatctttcttcacaggagattcaacgttcataccatcagatccccaaatcaaaacagccaaacccaaacatttcttatcatgattcgattcaccacttttgttcttccggttaacaaaatacttattctttaatcttctaatcttgtcaaagaactggacatgactaacatcaaagcttatagatttcttggcgatatcaaaaaacgcattcttatgatcccaaggacttgtacctgtctcagctttgaaatcaatcactgcctgtagaagagagatctcatcttcttcactccatactctctgaggattcgcctttttgttatcgtcctctttcttaactcttttgacatgcatgtcccttgaggtgcttccttcaccagctcgcttcttccctgacttcaccgccggtgattcagcagcaccttctttcttcttccgcctggttaagacgaatgactgcttctctgagtcatcagaagaatctgtcttagaattcacagcggcggaaggagattttagggttttagaggaaggaactgtgacaggatctttgggtttgctttcttcagaagaagacttaaagatctcttcagaagaactctcaacttcgcttgaagaagcggttgctggactttccaaaggagccattggattttcttctttcagattctcgggtatgagtaccaagtgggaactgaagggacaattttagggtttgtgagttgcgagactttttatttttttacactgtaacatctcttatatttaagaaacaattaaagtaaataaagctcaacaacaaaaactaattaagcccaacaaaataaataaaccatcatccttatatgtaacactgtaacatgggaaaaaaaaacaattttttgcccaaatgtataagaaatttgtataacaaaattcatactagattttcttgttgtaattcttggtatacaaaatgaaaggtttctttgttgtaaaacaaaaatatatgtactaaaagtaattttacaaagtcgctttatatttttacatttagaaagatcatttgatcaagtgggaaacctttattgaaattaacaaagtggaaaagattgtaagtagtgaaatttagtgtcatctatagacaaaaaaaatgtaaattagaatttaggaatatgaattcggttaggattagtcgattaggtttattgagtaaactcaataaaaattactgtagtaatacttcagtactcggttcggtttatagttaccgaactgaaaccaaacgattattctaatttaattgaagttaccaatttttatcttaagtttaattaaaattattgaaaaatatgaactctctcttacagtaaaccgacctgaaattggtttttggttccaatttgacaccaatattttatcttgaaccaaatcgaaatttatgctattaaaattgaaccgagccgaactttactttcggtctacttcggttcaagaaatttcaatccaatacatatgaattctgaaagtcctgaaccgaaccagagtgtttaaccacaataaaagtctcttcaatggtctcttcttgagtatatcaatggtctctcatagtttcaacaacaccaataaactgtcatcttcaagttggagtttattacactcgttccttcaagaaactgtaccgtcgactttcagatttagccatttaggacttctcaagattttgaaaatggcgcatcaacatttcttcaagcctcttcttcctggcttccacgcctccttggtactctctttctcgctctttcccttcttctatctctgtctatgtctctctgagaagctaaagatgagtctggttttgtatttgcatg

SEQ ID NO: 18593 - DNA, 3000 bp, Unknown; identical to SEQ ID NO: 7701
  misc_feature (1)..( 3000): 2750-1469P.txt file - cDNA_ID_1818556; gDNA_ID_1621157; Annot_ID_57061

SEQ ID NO: 18594 - DNA, 3000 bp, Unknown; identical to SEQ ID NO: 9187
  misc_feature (1)..( 3000): 2750-1469P.txt file - cDNA_ID_1818567; gDNA_ID_2926128; Annot_ID_138678

SEQ ID NO: 18595 - DNA, 3003 bp, Unknown
  misc_feature (1)..( 3003): 2750-1469P.txt file - cDNA_ID_1818567; gDNA_ID_1621157; Annot_ID_57058
tttcaaaaagcaagtcctctttgtgaagttaacaagaagcaaactatttatcagaataagcaacaatttcgtcatttgcacaagctgccacattgatcaccattgtccccttggtcgttgttggcactaatttacaacaatctctccgtggagcctacaaaaacatttgacaatttctcgtgaacaataatagaagactaaagagttctgaatagtaaattaacagcaaaaattatgtaccttgctccacctatccggagtaggctttttgtagacaaatatctgattgatctcggaaggatccgcgattccccattcacatttaggataccattcgtcgtgcctcaagtattggctaatcgtcgttgtatcagaagaagaagagttactaaacgcatgagagaaataaaacacacgaggacgctgacaatccgtccatgttaccggacgtgtgttgaatgcaagattagtgaaatcgctacgtaagtgccaatcattaaaagtgcgagtaggcacttccatcatccttgctggcatatacgtacgcgtgatttgaactgtgtatccccacgagattgacattgtccactgatgactcttatcatagcataccgattgttggacaagactcgctgaatcgagtttcgctgggatcattagcttctttaatgcgttgactcggtttgtttttgggaatataggatccactacgtctaggtgatggattgatactattggtgcttgtggatggacagataatagccctaagagattcccgtatacatcaaactgttataaaccataccataaaattaataatcagtaagtgaagtaacaagagtcaatgacaaatgaatctaatcacggattttaagttttactatttcacatttactttgtgtttttccggctgatttttctcggtaataacaaaactaacctgatggaatccaacttctttagtgagaggaacaccaagctcagccatacaagcatgaatccgatcatcggatccgtacaaatcggagtatctctcgatacaccgatcttgcatcttctccaaaaccttggctaatggataacttatagcaaaccctcctccaccgtacgccattccataagaaaactgatgaagattctgcaaatgactctcggacggagctccgatgtaataaaactgtttatgatcgtactttctcaaaaccctaacaagattttccgtgaaaaacacggtatcgtcgtcacccatcacaacccacctcacgtttctctccgcttccgttccgtttaacatcctcaccgtctcggacacgattctcgtgatcctgatcgctgatctgtgaccgttacggtaacggtacttgaaactcgacgtgtcggaagagattctgatctgaggcaaagctgatgaagaagaaacggtgtcgttgatgggtttgtcgagccaaacggcgccgttcatgactccgttaggtttccaccatgttttcacgtattctctacgatgcttccatagatctgaagacgcggcgattccgaagactatgtgtttgagctccgtttgttcctcaggtgtttgacccgacccgagacggataacgggtacgaggagagaattgggggatttagaaggtgaatatgggtttagaaaagagatgaaactgaatgagtataagagatatgagacgaagatcaagaagacgacgatggctgtgaaggaacatggagatgaagaagaagaataaaagggtttattagatttgtcgtaagaaagtgttttttgatctcccatggctctgattgacatagaagaagactagttttttttttgctttgtgagttgtgacagtggtggtgttggtgagattgaaggctttttattaagaaatgaaaccaagtttatttttttttaattacaattataatctgtattatctaatgccaaaaaggcaaggtttgtctcgatgctgtcaattgttaatttacatatgaaaattattacactactccgagaaatttaattaagacaacttaactcaaatttaagacaagatatattttgatgatgtctaaaataatcttatttagttaaaaaaaattttggatttagaaagaaatctcctttttatatttcccaatttattagagtcaaagctgtttttggaacattaattctccacaagaataaaaccataagatggaaaacgacatttcaacattaatgattacagtaattaataactgaaaatagcgtttttcacacaaatctatcagttttttttattgtagccaagtatttgcaaaatactccatcttaggatgatactttgtctaaagtcaataccttttttattggagtacaattcatgataaatatctcttctatttttagtggttgtatatattttgtcatttataagcagatttaggcacatattattttgtccaaaacatattgaatttgtaaccatatatatttgacaaacaccgtgattaattaatgattatatatatgtacgtagttaagtaaattcacaaattcacaactttgtgtgtgtgtgtttcttaataaggttttgcaccaaattaatcaaacttgcattaagcccaacaaatttgaatcattaggcccaaaaggcccagaagttgaaggtgactaaaacgacgtcgatgttaccgaataagaagcagagttgacgaaataaacctgtctcttcttcttcttcatcttctttccctctttgccaagcaaaatttagaattctttctttatctctcagcgagaattttggctaagaatctagctaccttcaagtctctccaggtaatatacaagttctatgatctcttcacattccattgacttcaatttttgatctggtccgccattatcgaaactctagcaagctcttaattagtgaacactgtgttcttcttcaattggttaagaatgtgattaagacttctaaatcctgatttttgattttgatttgtagatcaatg

SEQ ID NO: 18596 - DNA, 3003 bp, Unknown
  misc_feature (1)..( 3003): 2750-1469P.txt file - cDNA_ID_1818571; gDNA_ID_2926128; Annot_ID_138679
atccaagtcatcgatctgcagtgggatcttggatgctattgctcgccactgagcacgtgacttattcacaatcacctatatatgttattatacttcagggtcagattcaaacaaatgagataattaaatcattgcgagtgttaactcagtgtggcattatgaaagctagagcattagcttctgcaatatgaagatgaatagtgagaaacagataaactaacctgactcgaaaacagtgaattgggtaccaaaaccggaaatttttctgcattcaacaaagatgttgtcgtaagtcccatttcaataacttgaccttctacggatccagcctgcaaagtggggacaaggaagacactatatcttgagaaaaatatgagtgagaactgccaatatatttgcttgctctatgaaactaaataaaagaagagagcagaaaagaaaaaaaggttcaactaactttgatagtatcacccatagagaaaggccgcgagaattgcattgacagaccactcagcacattaccaaggatatctctggcagcaaatgcggtggctacccctgaaaacgcaaatcaaaattggtatgttatgagcaaatactatagaatcagtaggatatctaaaaatgttagcaacccctgaaaaagataagactatatgcttgtgatggcctctagaggcctttattttctgttgaatcctagcaattagcattataggctgagcaaaacgactaatatgaaatggagaacattagacagacctccaactccaccaactgtcaagatagattgaacagctacaccacatgcttcagcagaagccatcaaaccgatagcgaaaagaccaacagatgatactttgtctaaagtcaataccttctccctatcaagcccaccaaaactcttagccgacaacattcgggtaatcacattggtcttccaccgatataggaaccacacaagtgagagaataaccgctcccttcacagtcggggaaaagtattgagctgctatagttgttggcgccaccattgcagcactgcagcatatcacattcatcaagtctatctattttctacaacatacatgtcaaaggaataaagctagagagactcacatttgtgcaaaagcaatgaaggtcaccaagtaacgagcaggatcctctaaagctccccaaaagcttttctcataaggaacatcttcgttagagaagccaacgggaagcagtttagcggaactttgcatagcataagtgtgaaaccttctaagaatcctaggcatcacaacccaagcaaataaagtaccagtcatagtgagactaacaggaactataacatctttaagataagggttagagtcaaggaactgctgaacatgagggatcatctcatcagagacatctttagtcttctttgcagtctcagtaacagcatcgacactagtctgcaacacatctttagctttctcaacccaatcattcccattcccattcccatcaccagagccagtaacaccagaggctacaatacttccgaaatcatcagatttggagctgaaagctcgtgcgtacgaagaatggcctaagtaattgaaaggcttagcatcattatgcaggcgtatgttcgatgaaaaggagatcatcgaaggagaagcttttggtccatcaagaaggtttccgcaagtaaaggccctggcatgagagtttaggagaccagaacacgattttgcagtggcatgaggttttattgatctttgaattgacttgagaagcgataacctaactccggccattgatctacaaatcaaaatcaaaaatcaggatttagaagtcttaatcacattcttaaccaattgaagaagaacacagtgttcactaattaagagcttgctagagtttcgataatggcggaccagatcaaaaattgaagtcaatggaatgtgaagagatcatagaacttgtatattacctggagagacttgaaggtagctagattcttagccaaaattctcgctgagagataaagaaagaattctaaattttgcttggcaaagagggaaagaagatgaagaagaagaagagacaggtttatttcgtcaactctgcttcttattcggtaacatcgacgtcgttttagtcaccttcaacttctgggccttttgggcctaatgattcaaatttgttgggcttaatgcaagtttgattaatttggtgcaaaaccttattaagaaacacacacacacaaagttgtgaatttgtgaatttacttaactacgtacatatatataatcattaattaatcacggtgtttgtcaaatatatatggttacaaattcaatatgttttggacaaaataatatgtgcctaaatctgcttataaatgacaaaatatatacaaccactaaaaatagaagagatatttatcatgaattgtactccaataaaaaaggtattgactttagacaaagtatcatcctaagatggagtattttgcaaatacttggctacaataaaaaaaactgatagatttgtgtgaaaaacgctattttcagttattaattactgtaatcattaatgttgaaatgtcgttttccatcttatggttttattcttgtggagaattaatgttccaaaaacagctttgactctaataaattgggaaatataaaaaggagatttctttctaaatccaaaattttttttaactaaataagattattttagacatcatcaaaatatatcttgtcttaaatttgagttaagttgtcttaattaaatttctcggagtagtgtaataattttcatatgtaaattaacaattgacagcatcgagacaaaccttgcctttttggcattagataatacagattataattgtaattaaaaaaaaataaacttggtttcatttcttaataaaaagccttcaatctcaccaacaccaccactgtcacaactcacaaagcaaaaaaaaaactagtcttcttctatgtcaatcagagccatg

SEQ ID NO: 18597 - DNA, 3000 bp, Unknown; identical to SEQ ID NO: 7698
  misc_feature (1)..( 3000): 2750-1469P.txt file - cDNA_ID_1818571; gDNA_ID_1621157; Annot_ID_57057

SEQ ID NO: 18598 - DNA, 3000 bp, Unknown; identical to SEQ ID NO: 15309
  misc_feature (1)..( 3000): 2750-1469P.txt file - cDNA_ID_1818579; gDNA_ID_2926128; Annot_ID_138682

SEQ ID NO: 18599 - DNA, 3003 bp, Unknown
  misc_feature (1)..( 3003): 2750-1469P.txt file - cDNA_ID_1818579; gDNA_ID_1621157; Annot_ID_57054
ataactgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccgatgcccagtcgtcggagacatagctacaccgtcggatctcctgcaaccacatcttccaattacagtaacactactttcaccgatcgttccttcccgacaacccctgcccgtacatccaccgacacaaccacctccatcgctcgtcgcatctccggtatcttcatcaactgcttcactcctcccgattccgtttcctccaactacatcgacaattcaaagtcctcttccggtatagtttgatcagtaattcttagattttagacttttagtggaaacagttgatgatg

SEQ ID NO: 18600 - DNA, 3003 bp, Unknown
  misc_feature (1)..( 3003): 2750-1469P.txt file - cDNA_ID_1818583; gDNA_ID_2926128; Annot_ID_138683
gctctgtgtgtcgaaaccctccgtcgccagcatttattcttctcacttttcttcaccggagaatcacgacaacatcaaattctccggcgacatctcaggttatcttcgtttactgctctcatcggttaattattccatctctttttttgtttcccggagtcggctttcgtgtactttttgtttttggtcttttcggcttcttcaattttagggttcgcgtactgtttagtgttgtttagtttctgatttagatgtgcttactgtgttcatgttgtcgtctattcttatgagaagatcttatggtagagttacatatcaatgatgttaccaattttgaaggttattgtgttgtgtttgattaaaattggctcaagtgtgaaatgcttttgctcgcgtcactgttttcattgcaacttgactgaatcctagaggttgttttagaatatagattcaagtttcagctattgatgggacattacaacagagcataaggaacattcccatacctttgtgtttcttatggataactttggcatcagatcaactttttcttttgtcattttgcttattaacactgtaataatcacttgttattgggatttctcaagtctgctttgattaatcttgtttcgtaatgttcttctcactattcactcttcccatacctttgtgtttcttatggatgactttgccatcagaccaacttttcttttgtcattttgcttactaacactgtaataatcactttttttttattggggtttcttaagagtacttttgattaatcttgttgcattcaagtaatcgttgttcagttcactcttttcctgcagtggcagtgcatctgtaaaatgcttcaaggactgttgttcgctactcttgcttaattattactatagctggtgaaaatgggaggttgctgtagttcttcgaggaagtcacatcttgttggaacacctgtttactattatgtcagtaatccttttcaccatcttgcatttgtgttgctttgcactactgactatctatagattatgattttagttaaaacaaatcgggacaagagcatgattttagaatctcaacaatttcttgtaacaatctcgcttgagtggtcgatagtagactactagaggtcgtgagtgagctgtgtttgaaaaatgtcttctgaattatctacagttatttgattgtgacactctacaaagtttctatttattaaaagtttgttacgcagtgtccagaatcttttgaagagcttgtcccttcaggaacccgtgctggtgtgggatcagcattcaccacaggcctcttggttgatataggtttggagacatctatacctgacaccttttgtgctcctgctcctcttccatatgatttgcttttggggcgaccacaatgcacagattctgagtccatcaaaggaaggatgagtggaagcagttttgaaacgctagcgacgtgtgaagatcttggggaatcagactgtaaaactctagccagctcagtcattctttcaccgaggaaatcagatttctcgaaacatcaaggattgaagatattggttgatgaagaggaggactgttgtcctatttgctttgaaggtaagaaatcaagaccgttgaataaaaagaactctttaactcttgtttttatgagagagctaaacagagtcgtggattgcactatgcagattatgatgttgagaatccaagactaacgacaaagtgtgagcacgaatttcacctctcttgtcttctggagtggattgaaagaagcgatagatgcccaatatgtgataaggtgtgtttcccgcttgagctttctttggcagatcgattgtcttgatgatcaaagaattgcactttactgttgggaattcgtagttagatcaaccattgatggttgcgtaattagggtaaataagtgcacaatttggcaactaactaacattctgtcttctttaacacaggaagttgtgtttgatgatcgcttgaactagcatcattactatcccctggcttgaaagtttgaaggtgtggcgctttgtttggttagtctactacataattagcatacatctattttgtttcttcctcacacactttaagtgttgggtctccacatttccacttagttttgtcgtattggttatgttcgttttgcccttgtgcgatcatatagatatacataacaattgtaaatattacctagcttcttgttcgttcgtttgtgatctccggggtgtgatagagaagaaaggaccaccatttcagtattttgattgtttgcatcttcaaaatcatgtccactcttgtcttgatccatgattctatcttagcaatattggttaatgccctgatctgggaatcataataagcatgattttgtttgtttgtttggttaaagaaagagagagattctattagatatggatatagtataattccatagtctaaagagaaactgaatattccaaatagtaaattgatccacatgcgactagtcttgtcgtgtgtaagatattaaaaagaaaatgattctttgattaacaccttttgtctgctgcataaagtaattaattagaaataattaagaaaaaggttaggaatcatttaagaagaagagaaaaaagatgtcatggctttgacttctagccacttatgtctgccactgccacctccctcttctcaattcctattctgcccttctctttcttttagttcctatcctgccggtgttgatgaatgagggttaatatagtaactttggcgttaggaactatagttccaaaacctttttctgaatgaatttactttttggaggtatgaagtcacagcttttacagattttatcttgcaaaaattctctccacatttcaaacgtctaatagttaaagagagcttttgttttttctttcccatgtctatcagtatcaccaccgagaaaatatcatcaacaccaccaaccaaacattaacccacccgagagtacccaatg

SEQ ID NO: 18601 - DNA, 3000 bp, Unknown; identical to SEQ ID NO: 7694
  misc_feature (1)..( 3000): 2750-1469P.txt file - cDNA_ID_1818583; gDNA_ID_1621157; Annot_ID_57053

SEQ ID NO: 18602 - DNA, 3003 bp, Unknown
  misc_feature (1)..( 3003): 2750-1469P.txt file - cDNA_ID_1818587; gDNA_ID_2926128; Annot_ID_138684
tcctcttcttcttctcctcttccttcttccaccaccatctgtacaaagcaaagttatcatcaaaggaaaccaaaccattctgagtttcaaagctattttccggcttggtttcttcagcaccaccaatggttcctccaattggtacttgggtatctcttacgcttctatgccaactcccacccacgtttgggtcgccaatcgaatccgacccgtttcggatcctgactcttccactctcgagctcacctccaccggatacctaatcgtcagtaacctccgtgacggcgtcgtttggcagacggataacaaacaacccggaaccgatttccggttctctgaaaccgggaatctgattttgatcaacgacgacggttctccggtttggcagagctttgacaatccgactgacacgtggcttccggggatgaatgtcaccggtctaacagctatgacttcgtggcggagtctcttcgatccttcgccggggttttactctctgagactgagtccaagcttcaacgagttccagcttgtttacaaaggaaccacaccgtattggtccaccggaaattggaccggagaagccttcgtcggcgttccggaaatgaccattccttacatctacaggttccatttcgttaacccttacactcccacggcgtcgttttggtacatcgtcccaccgttggactccgtttccgagccacggctgacgcggttcatggtcggcgccaacggccagctgaagcagtacacttgggatccacagacgcagagctggaacatgttctggttgcagccggaggatccttgccgcgtttacaatctctgtggtcaattagggttttgtagcagcgaattgctcaagccctgtgcttgcatccgcggtttccggcctaggaacgacgccgcgtggagatctgatgattacagcgacggatgccgccgtgaaaacggtgattccggcgaaaagagtgatacttttgaagccgttggtgatctacgctacgatggtgatgtgaagatgtcacggttgcaggtaagcaagagctcttgcgccaaaacttgcttaggaaactcttcttgtgttggtttttatcataaggagaagtctaatctctgcaaaattttactcgagtcgccgaataatctgaagaattcgagctcgtggactggagttagtgaagatgtattgtatatcagagaaccaaagaaagggaattcaaagggaaacatctctaagtctataattatattgtgcagcgttgttgggtcaatctcagttcttgggtttacattgttagtgccattgattctgttgaagaggagtcgaaagaggaagaagactaggaaacaagacgaagatgggtttgctgtgttgaatcttaaggtattttctttcaaggagcttcaatcagctaccaatgggttctcggataaggtcggacacggcggttttggggcggtgtttaagggaacattaccgggttcttctacattcgtggctgtgaaacgcttagaaagacctggaagcggggagagtgagttccgggcagaggtatgcaccattgggaacattcaacatgtcaatctcgttaggcttagaggtttctgttcagagaatcttcataggcttcttgtctatgattacatgccacaaggatccttgagttcctatctgtctagaacaagccccaaattgctaagctgggagacccgtttcaggatcgcgttaggtactgccaaagggatcgcgtacttgcatgaaggatgcagggactgtattatacactgtgatatcaaaccggagaacattcttttggacagtgattacaacgccaaagtgtctgattttggcttggctaagctccttggacgtgacttcagcagagttctagccacgatgagagggacatggggctacgtggctcccgaatggatatctggtttgcccatcacgacaaaagctgatgtgtatagctttggaatgacattgctcgagctgatcggtggtagaagaaatgtcattgttaatagcgatacactgggagagaaagagacagaaccagagaaatggtatttagagaatgtcttttacttggaatcaattgtaagagagaaaaaaacatatacattgaatcaatgaatcccttttcaggttctttccgccatgggcagcgcgtgagatcatacaaggcaatgtggactctgtggttgactctagactcaacggagaatataacactgaagaggtgacgaggatggcaacggtggcgatatggtgcatacaagacaatgaagagataaggccagcaatgggaacggtagtgaagatgcttgaaggagttgtggaggtgacggttcctccaccgcctaaattaatacaagctcttgtctccggcgattcataccgaggagtgagcggcacaagctgtagtgaaggccatggctgttcggatctcaatacaggtttgtctagccctggctcacggtcgtcttttggtagaccttctccttgatcaattttgtaaggtgatttggtcaaaaccagccttaaatgttttaagtgttgctctctaagagggtttaattagtttaaactgtatttgttggttgtatgatatttgacttaatcgacattaacagttaaaaccatggattatgtctttcttcttagtttgaaagttcttgtcactttgataatcttctaatggcatatatgtaaattcttacagaatgtattgtatgagaatcattacgtgattgaatcaataaacccatgtcgatactttaaactatatgaacggtcacaataaacccatgttctctcttcttctactccacggctaaccttaatcttaggcaaaccagaaacacaaattacaagaacaaacataaaaaagaatctcttgtcttgtctgctttcaatcctcatgtctctaatcctccccaagtagagaaatataaaaacttagacaaatattgccacaaccggtgaaaatg

SEQ ID NO: 18603 - DNA, 3000 bp, Unknown; identical to SEQ ID NO: 7693
  misc_feature (1)..( 3000): 2750-1469P.txt file - cDNA_ID_1818587; gDNA_ID_1621157; Annot_ID_57052

SEQ ID NO: 18604 - DNA, 3003 bp, Unknown
  misc_feature (1)..( 3003): 2750-1469P.txt file - cDNA_ID_1818591; gDNA_ID_2926128; Annot_ID_196768
ataaagaaaaagaatcaaattcctccatatcgttctgtatcgcctccatgtacgtaaagaaagttggtcactcttacggaaagacaccatttttaccaggtctgagcaatttataaggaaagctatttttcacttgccttgtactctattaaatactagggatgattcagcatccgcaaacagtaaatgagaaaccgcatgacttgcatttaccacctttatactaattattaacttatctatttatgctttctgaatattagcaatcagcacttttgtgcatagtacatataaatatgaggagagaggatcttcttgtcgtaggccgcattggggagtaattaagcctcttgattgaccgttaagtagcgccatatgttagactgatgtgatacaccacatcatccattgtatttatgtctcccaacaatccatttttcataataaactctcgataaaatttgattcaatctgatcataagcctttcatgttagtttttataaccataaactttcttttgtatgacgaatttgttcagagaccataaaacatctcttgcgttataagaatattatctaaaatcaatggtctttcgataaagactaattgtgtttctaaaacaaaatttatttttctattttctatttatttaattttccttctcatttttagttgtttttataatatactaagcgaggtagtataaatctagaatcctgaaccagcagtcaaatatcactatttaaagctaactatttaggtttaataataccttaggatattattaccatttacgtaaaaaagtttgaacctggaaaacatatatatctacgtagagtaccgaatattctaaaccatttaaaatattttataatgatcaaccatgattgaaatcaagtagaaaaacttgaacaatgatcttctagttcattttagttgtttcacttaaaaaggatttaaaaagagagtcaacattgcgttttaaatgcattttgaggtttggcaaaccatctacaagctatctgacatctacagactacgtacagttgtgttccatttgttacaattacaacaatcagcttgtttgtttttggcaaattaagagtcatgagtgtgtatacgaaattactttttggtggtctgaatttatgaatgcagttacactaacccttcttcaaaaataaaaatgaatgcggttatactaaactatcaaatatatctactagcaaatatgaaactacattcagtaacagtgatctctctttttggatacaagatgaaacattgttctcttctcatgctctaaatagaaaatactctacgaaatgaaaatgtatgtcatcttataagaactatacatttttactccgatggttaattctttgaaggattctcgacagtttagaagtctgcaaaaaatataatctcataagaaaaaaattctaagtctcttgatacaatgcatatagaaactgacaaataatcgaagaaattgtacttgagcccattacgactattgaaaattctgattttggatgaattcagcggaaactacaaatttaagagtactttatgtgtataatatgaagcctatatatatagaattactaatgtaataaaataagaaccggtgaaaagggggacaagatcacaaggttttcgcattcagtgcctttacagagttatatatttgatgatgttattgcttacttgcctaatagtactatactactatatatatctaaggtaacacatgtatatatatgtcacatagacattactagtatatattatgtacttctatcatatatttatgatattgcagttgcagcgtacacaagtcagctccttttgacttttacatctcatgaatgcattgccatgacatctaatcttactcgagatttgtgcatgcacattattcacttttgtcttttgcaatttttgttattgtaaaaaaaggaaaaacaaatgtaaaagagagagagaccagaaaggtctaactaaacctaaagagtcaatgaaatgtgtttctttcttgtgggattaatcaattcactctttaacacttctttataccattgaagaaattagatgaaagagtcacgagttgcttaccaaatccctcacaagaattgagaactgataaaccaaattgagaagattaaatatcacgtctccttttgatctctattataattaatcgaaaataaaaataagagttttcaacaaaacgtgatcattggtttacgatcacttgcaaagtcaaacctaaaacgtagcattagtacactaaccttaaatactaattatatcatgcaaaccctaatgtcattacctaactatacatgtgtaatgtgttcaacagatcttcttaacccacattagatcaatattaaacaataaaaagattcttatatattctactacttacttcttcttattcccatccatatttttctgtgcctttaggttctcaactaatctcatttaatttagctagcacacagagaaacacacacgtatataaataatatgataacacacaaaaagactcatatatataaataattagagtcattaaatgtggattcatcattaaatgaaacaactcttcttctctgtacaatttctcttcacaccttcaccaaattctttgacttcaaaaatcttataaaatttatatatctccaaaaccataaaaccaaaacgagttttcacaaataaattacttagttgaaatttcaaatctcattcaattagggtacactctctcaacaatccacattaatgagggttgctgcttctgatggctagcagtaacagttttatcgcctccacttcttaatgccatctttttcctcttccctctccttctctatatatattttctgactctgcaaaaccttaattcatccatctctcaaacaccatttttggaaacaccatttcatattccttaaacttttccattttagtatcatttcatattcattgatatg

SEQ ID NO: 18605 - DNA, 3003 bp, Unknown; identical to SEQ ID NO: 18604
  misc_feature (1)..( 3003): 2750-1469P.txt file - cDNA_ID_1818591; gDNA_ID_2926128; Annot_ID_138685

SEQ ID NO: 18606 - DNA, 3000 bp, Unknown; identical to SEQ ID NO: 7692
  misc_feature (1)..( 3000): 2750-1469P.txt file - cDNA_ID_1818591; gDNA_ID_1621157; Annot_ID_57051

SEQ ID NO: 18607 - DNA, 3003 bp, Unknown; identical to SEQ ID NO: 18604
  misc_feature (1)..( 3003): 2750-1469P.txt file - cDNA_ID_1818591; gDNA_ID_1972020; Annot_ID_178039

SEQ ID NO: 18608 - DNA, 3000 bp, Unknown; identical to SEQ ID NO: 7692
  misc_feature (1)..( 3000): 2750-1469P.txt file - cDNA_ID_1818591; gDNA_ID_1621157; Annot_ID_173564

SEQ ID NO: 18609 - DNA, 3000 bp, Unknown; identical to SEQ ID NO: 15313
  misc_feature (1)..( 3000): 2750-1469P.txt file - cDNA_ID_1818595; gDNA_ID_2926128; Annot_ID_138686

SEQ ID NO: 18610 - DNA, 3003 bp, Unknown
  misc_feature (1)..( 3003): 2750-1469P.txt file - cDNA_ID_1818595; gDNA_ID_1621157; Annot_ID_57050
gagaggtactcacctattggaccttgagattgaaagtcgtctgcacgtgcacaccaaccataagcctttgactctgaatctccactcctctcagtccactcttttttgcaggacccttgggtctcaaattccttttcaagctctgtggcagcagcaaacccactccagtcactgtcaaacttagcaataaccccaacaatcgaatcttgttcgacccaaaaggcattcacttcaacaggcttgaatttggaaagggtctgcagccaatatactgaatcaagtagaagctccttgtcatccgtttctttcaaagggttaacaacaatccccatccatggccagacatagacgttatgaggatttggttcagtctcgtctaacagaggaggaacaaccggagggcgtggaagaggttctgcataaccagcaagatcattctctaaaaacttagctaaagcaagatgattagacttctgtaaagcacttctggtggcagaacctttggaaacaccagtagcatgtgcatgcaactccttgtacttgtaatcttgcttcttcttgcctacacaaaaggggcatctgagccgtccattcaccttcaccttgtagtaagtctcactgcgtaaaaggtggtagggtgttttagaatactcctcaatctctgactcgctgatctcagactcttcatcagaaatgtccatcgtacctgctttacctggagaaaaagaatgttacaaaaacagagaagaagaacaaaataaggcccaaaagagactcaatttctaggcaatcccacgagcaagagaaaccctaggcaacaacttaacaaacaaaacaaaattgacactggataaagcaaaagagacgaaagtgatacagcatttacaaaattgagctaagagagtgacgcatgcatgataaggaacctagcgaaatcaaaaatatatttttaagtaacaagtgagtaaaggcgttaaatcacgaaatgcataggggaatcgaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaacatggccctcggtggcttgatttcaaatcggaacttcggttccttcatcggctcaggtatatctatccccctcctctttttgaatctgttagggctttttagttgtttatcggattatgttagtgattaggcttgagcgtagcttgcttctgtgtagcgaacgatatcactaatgtgtgcattgcttccaaatttgctaagattgctttactttgtaggcaatggttgtcagagacttggaaaaagtggtgcagaggtttccaagctttttccaaatggtatatatcggtatcttttatacctctctacctagctatattatgcaatttgtgcttaagcattttcttaatctttgtagcattgttgtgccgtaatcatcaacctctgcaagctagtttacatcatgaatcgggacacatgagaagaagttttggatgtttccttcaaccaagaatg

SEQ ID NO: 18611 - DNA, 3003 bp, Unknown
  misc_feature (1)..( 3003): 2750-1469P.txt file - cDNA_ID_1818599; gDNA_ID_2926128; Annot_ID_138687
acagaagaggccaacctcgccaatgcccatgaacgcccgcactacaagcaaaaaaggaagaccaagtctagcagcaataggtgtcataatagtggcaaaggaccaccagacaacaccaaaacctaaaacaaccttcccgccaaacttatctgcccatatacctcccagaatctatgtccaagagaagatgagctaaagttagaataaatataccctctctttcgagttctataaaagatcagattctacagagagtgatagtattagacctgacctgagtaagtaaatagccccagaagaaagaggactgaattaagccaacagttgcactactccagttatattcttgtgacatgggaagaattgcaatgctcatgttcacctgccacaagcatctctcattaagtaatatatatcttacttcttcagataagtagagaaaataagcaagatatacaacttacacggtccatattgcaaagaagaaaagacgaaaagcataacaagacgatcacccagcgtctaggaaactgctgccaccatggagatgcgttctgtagatttccttcaactaaaatagcttcagctgagccatcagccgatggcacaactccttccgtgatatctgactcctctgatttgtagtaagcacgagatctgttgatcttgatactgttcctaaacctaattacactgtccattcttggttgaaggaaacatccaaaacttcttctcatgtgtcccgattcatgatgtaaactagcttgcagaggttgatgattacggcacaacaatgctacaaagattaagaaaatgcttaagcacaaattgcataatatagctaggtagagaggtataaaagataccgatatataccatttggaaaaagcttggaaacctctgcaccactttttccaagtctctgacaaccattgcctacaaagtaaagcaatcttagcaaatttggaagcaatgcacacattagtgatatcgttcgctacacagaagcaagctacgctcaagcctaatcactaacataatccgataaacaactaaaaagccctaacagattcaaaaagaggagggggatagatatacctgagccgatgaaggaaccgaagttccgatttgaaatcaagccaccgagggccatgttgcttctcagaacaaaaatgtcaagggaagaaggagaagaagaagagagaaggattcaagcttcttccatagaagcggagtaaacgaaggaacctttggataaagccgagagagagactgagagacgctgaagcgggaaaatccctctctattggggaaggaaggaagaggaaaggggggtcgatatagtgacacgtggcacatcatcttctactcgttggaacctccgttctgttctcatttcatgaatctacccccacgttgcaaagaggaaacatgggtactattggttaatggcaggggtattattggaagttattgtggaaaatatctgagccgttaccgccgaagatgacgtcacctttagagaaatagagagagctgacaaaagaaaaaggtaggttggttaatatattgggcttacaatctcatttgtatttttgatgggcttaaaaataaaattgtcttctacatttttttgtttccatttgttcaaagttccaactgctgaaaagtgaaaacaaagagacatttattgctaaagtgcagcccataaaataactaaaatactaaaattaagcactaaaattgtacaacaatgtcattagtttttactaaaatcttgaggatttgtcattttgaacacttaaaactgtatgtatatataaaatgtttttgcaaaatatgtactttaaaccaaatactaaattttaaaaacaaatctaaccgactatatccacgtattaactggtatctattattaactaaaaatggcaaattcacaaactatatggaaaattgcaaaatcaacaaatgtcactttcaaaagtggctttctcataattgattctttttataaaaaaaaaaaatgagacatatattaatatatataacaactttggtgactataagctcttagagtaaaacaaagtcactatattaaattttgagaagaaaaataatcctggaaaccttaatgttttatgatacaattttacacatagatatataattacatactttgaccagacacatattttttaaaaaaaaatctccagtcagtggctatttgataaagccactaaaaattcttgaccaattttgtggccactatattgcttatagtataaatcattcacaatttggatcataggttttattcatcaattttgtccaaaaaaaaacttaaaattttgtcaaaaaactatagtataaaataggttttgtcaaaaaaacttaaaattatgctatttgtgaaaatttctcttttatctatttttaaattactttgttaattaatagtgctatattcttaattcttgtataaaaatgtgttattcttgcaaatcaccctctaatttttctgatatattttccaaaataaaataactcttcatcttcctcactcactctctctctactccactcttcatcaagcgttgagtcatcgccgtgttgttccttttccttccctctctagcgtaagctccagatttcttctattctctgttttcacagtgaaatctctcgtttaatgaattttttcgattcccctatgcatttcgtgatttaacgcctttactcacttgttacttaaaaatatatttttgatttcgctaggttccttatcatgcatgcgtcactctcttagctcaattttgtaaatgctgtatcactttcgtctcttttgctttatccagtgtcaattttgttttgtttgttaagttgttgcctagggtttctcttgctcgtgggattgcctagaaattgagtctcttttgggccttattttgttcttcttctctgtttttgtaacattctttttctccaggtaaagcaggtacgatg

SEQ ID NO: 18612 - DNA, 3000 bp, Unknown; identical to SEQ ID NO: 7690
  misc_feature (1)..( 3000): 2750-1469P.txt file - cDNA_ID_1818599; gDNA_ID_1621157; Annot_ID_57049

SEQ ID NO: 18613 - DNA, 3003 bp, Unknown
  misc_feature (1)..( 3003): 2750-1469P.txt file - cDNA_ID_1818610; gDNA_ID_2926128; Annot_ID_138693
ggaccttgtgctcaaatttttgttttcagaaaatttaaagtgttagttacaaacttttaaaattttggacccttattgcaaaaatatcaaaaaatttagatcttaaaaccttgttaaaattagaaaaaaatggtggatccagtgctttagcactgcctctaagccgagcctgcttatacatatatgcagagaattttgcactatttgaaacgcaccgcattgtacagttcggtcaccattaaattgtaaatgatataaattgtgataataatacggtttagatgcttagaaactccacgttaagggaaaaattgcttacagtgtcactaacttcgtcagtggtttgtacccaaaaaaaaaaacaattcctcagtgggagagagtttatgtcgtcaatatctatttgtcggtcgataagtgccaacctcaaaaaacaatgacacgtttgtatcaatttctgaatcttaatttatactataaaatagtgtatacgtttgtacgcgtgctattgatagataagtggtaactatgtgtgttttgtgtatgtaaatgtataactatggtcccgtccctgactgaattaagttgcttaaagaaaactcaactcaagtaactgagcatggtcaagatctattcgattaaattttgatatatataccaaatggtttcgacttttgctaattgctatgccacatgaatcagacaatgctagctaattatttctgttgtaccataaagtgcttggctttatcagtaaaccccacataacaacattttgcttaacggaaactttaagtacgagttctaacattcaattatgctctgtttgattagattcaaacaaataaatagtttcttgatattgtaaagttctatttgtgtatttaatatcatatataagttttttttgcgattcaaactcgagttaagatagagacgattgacgtgacgttacaatatatgcacacgagtcacaacaaaatattatatctataatcgacggttgaaacaagaactctagctaatgttttggttacactcggttttcggacatggtttagaaaagcacaactcttccttaagagaatgacaaaacgtcgtcgttaactttagattaatgacttggtcaatgaaaacaatcgcatttggtgtaataatctcaaatactacgtgttctccatattccataaccagccaagcaaaagcaccaatgaccaattacgtctctcctctttggccgcgcccactcaattcttataatttatctatttgcaccctctttctctaaaaagttacaatttgacccctatagtttcactttcacttattcttataatttatctatttgcacctttttcctctaaacgttacaatttgacccctatattttcacttttattcatacaagcccattttgtttttctctctgctttcatgctcgcagacaacaatcctcgtcactgccatgtctcaaattcagagctttgagagatcaattatttaccggtgaggctaatgatgaaggctgttgaaaaaatctctgcaaaatacttttcttccatgtaaagcttctaactttttctctctctctctctctctctcctctgttgtttctgtagagaggaatagaagatgatgggcccattttccaactgtgattgttctctttatatttctttctcctgtggaggctagcaaaggccacgacgttgtggttgtcaaattggcataaagttttccacttttttactctgattttttctcccatttctctctcactttttctttgcctttgcccaattcagagaactaatggctttgtcggtcatcgatagataaacaaaatttaatctttatctctctctttctcttgtttgtcaaaagatgcccaccaacacagaaatgaggaaaaaaagatctcttttttatttgaatgttgaacagtaagaagaaggtttattctattctattgggttgggttgttcatcaactttggaaatttaaagatgcattttttatgatccttttttctccgcctttgttgttgatttgatcgtgtatgattacggaagcttgggggggtttttatcagacagaacctggaaaagttgtcagatgaaacaatgtggcttggagattggatcatcaacttttcctctgttttcaactttataagctatcattttgcttaatcttcttcattctcttctctcggccttggctttgaagaaatctcaattttcttcttcttcttcttctaccgttttgtccggcgatcagagctggttcaggagaaaccttaagtcttggtatcaaaagaaagaaagttttggaatttacctctgctgctgcaacttgcaacactttttttatatatattggatttttctatggctttgctcaaacgtaagcaaagcagatgaaatctagctacaatcgctgttgcccttgtatgaagtttggaatttaaggaattcaggagaatctaagaggtactttcttgtactttcctcttctgtctttttccaatagggaaaggtatcttatttgctccattagtctgtatctctcaggctttgtgttctcttagttctccttaatctttgccttattagttgaacaagtaagcaaattataaaaggagtttgctttagggaactggtagaggatcctttacttcttacttgttatcttaatttatttctcaagaattccattgcagtgtttaggaaggctaattctttcttctctttttaagtactcctaagcgtggaaattttttggtcttgttctcttgttgtttgttactcaaggatctgagattgttgtccataagtagaatttaccggagttgtaatttctatatctgaaactcattattgtaccgttgtgtgtggtgtgtcttatagtttgctgcttaatagttttcttgttcttcttcagcatttctaaaggggcaacgttatagaaggttaggaaggagcatttgtatagaaagtcatg

SEQ ID NO: 18614 - DNA, 3000 bp, Unknown; identical to SEQ ID NO: 7688
  misc_feature (1)..( 3000): 2750-1469P.txt file - cDNA_ID_1818610; gDNA_ID_1621157; Annot_ID_57043

SEQ ID NO: 18615 - DNA, 3000 bp, Unknown; identical to SEQ ID NO: 7687
  misc_feature (1)..( 3000): 2750-1469P.txt file - cDNA_ID_1818614; gDNA_ID_1621157; Annot_ID_57042

SEQ ID NO: 18616 - DNA, 3003 bp, Unknown
  misc_feature (1)..( 3003): 2750-1469P.txt file - cDNA_ID_1818614; gDNA_ID_2926139; Annot_ID_138932
tagaagacgacaattttttttatttgtttaacatgaatctaaattatacttgagactatagaaacaaatagaatttatacaagaaaaatgtacttaccaaaaaaaaaaatatatatccaagaaaaatgttgaaacaattactacatactttgaagattgatctaagcaaatattgatcggatcatagtaatgaattcgaaatctaagaccatacaaaacatgccataggaagagctttaaaaatccaaaaagaataaaaatctgaaaaatcccaaaaaaggaaataaaaatggattcacaagacgaaacccttgttgcatagcatagcatccaccatcatgtcaaaactagtctaataaataaaatactattttacccatttagcccctaggagcttaggcaagagaacgcaaggacagaatcggaaatataaaccagaaaaggttaagattttcttaccagaacagtgtgtgttagatcgaaattcgatcgatcaatcgcaaaaaaaagagagtttgttgttgttgttgcttctctgcttctattcgattattcttcttctatttagtctttgtttggtgtttgttctcttccttcttcttctttcctcagagcacacgataactattttcacatcccaaactacggaatcacaaaaatctgcagataaaggaattgtttttacacagcagagagagagagcattcgttgtcctcattacaccaaaaaagtgcacaagagaagagattgaaaaagaaaagagtcaaactttaacaaagcccaagactcttctttgcttcttcttcttctgggccttgttatttattgcttcttcttcctctctgaatctctctcgcgctctagatttcccctttattggaaaaccctcaatttctataaagttccaagctttggttctgttttcgtttaccaaatctctcccttgattcgtcgaatctcgtggttcttcgagtttctctcatcagggtcgaggtcgaattcgcggaatttcctgtcaaaaccctaactttgattcgactccggattgtggggtcatctcgagctcctattggttagttttcgatttgaaaccctagcttttatttattttatcgtacggattaatatttgtttgcgtagttcgatttggtatatttgatgatcatggtgattgttttctagctcagaaaaggatttagttttagcagatttttgtttgcttctatctggatttgttcttctctggtatgtatgtagcttgacgcagtgtgttttcaactgggaataaatacttccttcttcgataaagcatctaactttaattcagattctgttttgtgtatagaaatattgttcatgatgattatttgtatgtactagaattgtacttccacgctttcatgttttctagtttggttgcttgattagggttggcttatatttactcaagatacttatcatgcaaagctcagaatttcactttaagtgatgtatgttatagataaagtttcaggctaaatatttgaagagaatgtggaacgtattaggcgatttgaactatatgactgttagagtaagcgtaatgagctcttttgagcagctgatctgtgatatgattacagacaactaaatttcataggaatatatgagaattaaagccgagtttcaaaacttctattgcacacacaatattgagactatatgtaactttagtgttttcttcttcttattcagtgtaaattcaacaccaggggtacttttatgtttcagggtttacttccatcaatggggttgcgctgtcgccagtgctaagttttatgctgtaaggagatattgaaaataaaagtggaagtccatgaaaaagtttcttatggtgctagactgtggattggtgcttagagtttattgtggtatgttgatgtcagaaccagtatgctggatatagttgggagaaatgcaaaggtatcatgctgccaactgcactagtgcagtcaacaatagtgctataggtggtgcatccgcgagggactcaggacgagctgattcctcttcgattggaaactattcactaaactccaggcatgttgatagaaagaagtacttacatagttattttatatgttgatacatttgaagacgtttgaatactttctttactgcaggagaccaccaccgttgacaccctacaagttgaagtgtgaaaaggacggtctgaattcccggtaattcctctttcaccttatccctagtttaggtattcgataaacacaatatagatgattttaaattttgctgttttagatttgtagcttgggatttcattcttttatctccgataggctaagtccttggagtacttgttaatggatgaagttggcactcttttccatttttgatttacttccctagatgatttatactttttctctattgcagattagggccgcctgattttcatcctccaacatcaaattctcccgaagagaatctgaccaaagagtatgttcaatttggatacaaggaaactgttgatggacttaaggtgcgatcaactgaatttagcagctatgcttttaatttttttgtagtatcgtagttaattatcattgacatgtttgcaattaaaataaatatcttagatcttattttggaccatgcctatagtattttcctatagatgctcagcagtaaaataagaatagtttcttactgaggctgaatgttcattgtagcttgataggttgtaatgatgatttcttcaatgtagtcatataagatgcttacaactcagaaagtctacattattataagtttcatcttttccgatgttagagtttttaattccttattccactagttttcgcgcattatcttgtaattgaggttctgaacctttggcctttacaggaatccgaagaaattatattgtcccaggtccatactttctcaaagcctgttgtccataagtgcaaagaggtacggtactagaaattatagacaatg

SEQ ID NO: 18617 - DNA, 3003 bp, Unknown
  misc_feature (1)..( 3003): 2750-1469P.txt file - cDNA_ID_1818653; gDNA_ID_1621158; Annot_ID_57071
ccactatcttcggatagagcagagaagatcgcggctttatttcggacaagcaaaaaggttgtgatatggattacgactaagattgatgccacaaatgtaacttggagcaatttcttcacaatatatatatcgaaccttgagcgaaatctttcatgtaagagtttcttcacaatatatatatcgaaccttgagcgaaatctttcatgtaagagtttcttcattgacatggagaagaaagttgctatggtttttgataaagaaaaaggaaaaaaagtcgctcacaacattattaatatcattggagaggctggatgcgtgaggaaattggttcttaaagaatctggagacaaaagctgttggccacttgtgtgctcttatgttccaagtacagtgcaaatcaagcaacataatagaggcaaaaggcaaaaaaaagtgattaggaaaggcatcgacattgatatgagacatgataaacgtatcaaggttgattagtctcaatttacaaagtctatatagtttatatgtttttcacttacccgtttaacttttttcttcccatctattgttctatatggacaaaattttcatgttttaattttttaagttttacaaaaccgctgtgtgatctattaaatgactagttttgtcgtctgaaatatcacatccgtctccggcggtgtggttgatgcaagttgcaagtatagaagaatatgtgtacttgtctcttactctgcacttgatgagattgtgttgcggcttctgactacatgtatgtggtttattccttacattgtttcatgatttgaaagtaggttatggatgtgttatggtttgtacggctacactttcagacatacacaaaatattacgaattgatctcatggcacatcactccgtcttcgagtcacctctatgtgtatctagtagctttctcgttatgattgtttttcttcttggatcagttttggttgctcaatttaaccttttttctagagaacattcaactaggaatctcactatcataaaatcattaaaggttttgttagttgtagtatgttatggatattcacttgcctgtagagaacaaacattcaagttgcaaattgtgtatatgctttacttttgaaacttgcatgaaacttttgtcatggcgtgtcagtacatagagttgagtaatcatggctttgctatatttgccctgatctacgttgaagtttccatatagtatctttttttcctagtcaaaagttggtttttcactaataaaaatttatgcagatagagagaaaccaaactgcactaaacgagcttaaccatgcattagaagatagagatatatactcgatttggtatgttaaggaagcaaccaactttgaacccatatccatttttctaataaactacgtacatgagaatcctcgtagcaacatttatagaagagatacccaaaccatgtgtaacataattaattaaagtctaaagacagcattggaagagattacacacatgagtatccaaaacgaacaagctgtcactatccaaaacaaacttcaagtgagaaaagtaataaaacatgaactaaaagatagtttaagagattgttaaagcattttcttgcagagttaggttttctcctgatcccacattgtaattaatgatgttgtacatgtcctctaaaaatctgtttgctggcattcgaatctttgcagctatcttttcctacaaacaattgcctagttttctgataatgacggcagtgtgatcttaatgacacaatggacgccgtcacatttctagagtgctattagctagggaatggttattaactttctcaaactttgatcaaggaactatgttttgccttttcttttgatgtaagttgaaatgatacatattttctcacatatgggctaccaaatcttttcttatagttgtcgaacgtaactaaacatatgctgacacagttgtataaataattttacgattcacgtttctgaaaatgttagttagtattagcctatgataattaactatacttcgctttatgtaaatcaaaggccaacttttttgaatatctatatgtaagaataaattacagctattaataaatacgagatgtaacttaattcagaaatgttcacacacatatggaacaagaagatttatccctgaaatagtattcacagtttggatcttatacctttttatgtaaaagaaaagattcaaacaaaaatctttcttatacaaataagattcaatcaaacatatattcctggaagttttgaacataaaaaaatgatttacaaaaaaattctcctaatttattaaaactgaatatttaataacataaaatctcttataatttatgtatatacaaaacaaattccatgatattcatagaatctcataaggttagattcttattataaaaagtagacaatctctaataatttatgtgtcgtgatattaattagaaatctctaataactcaaataggatattaatctaaattcgttgacaaaaatagatagagaatcattgttattcaacgcccaaaaccaaagtcattagtcaatgtcactcgtgaaactatccaaagataagagtttatgggattcgctaatctattacattaaagccacgtgtcttaatcttagatgttcaatagacttgccacgtcacacattgtctctctcgtttctcaaatcgcgtttcttctggtggaggtcaaactttttgattagcaaataaaagtcacacaagccgaatccaaaaatgtaacaagaaaaacaaatcttcacaaggcaaaaaatccaaaattgagttttttttttcttcattttttacaatggtgtctcggtttcgtcttgctctagagtacttctaagtctctctgttcttacttcgatttcgatttttattctcttttttttttttttttgaagacggatttggttggtggtttttagggctgttttgggttcgagacgacgtaagaagatg

SEQ ID NO: 18618 - DNA, 3003 bp, Unknown
  misc_feature (1)..( 3003): 2750-1469P.txt file - cDNA_ID_1818661; gDNA_ID_1621158; Annot_ID_57068
aaaaagaatataaaattacaaaaatatctttactaaaatttactaacaatttaaaaacatttctatttaaaacaaaaattagcttctttttttgttgtcgatatcaaaaaaattggttcacggtttttttttctttttcacgaattatattgatactagataaggcccgcctaaataggcgggtgtatgatataaatttatttaaatattaacagtaatatttaaactttatatagtaaatagtaatcaacacactttttctaatatttaatgtagtaatttttgtattacataaaattttaatcatacacattcaattttacttatattttaactatctatttcatcataataaactattttgttatttataatataaaaactacattcggacactctgtgaaaacgacatcccgtttgtatcctctaacaatgtcggacttacaactgttggacaaacatcaaataaatataaaccgagcagtaattaaaacgcatagtttgctaatccatttactatgcgattagctttactatacacatgagtaactcggactatgcagtccctatacactccatcttattaatgatatttgaattttaaatagtaacgtaactctcatactttttcagtatgtaattttgtatttttttaaaccaaatttcaatcttacaaattcgattttgcaatacaatttaaatacctattttatcataataaaatatataatttaatgatatacactccatcttattgttagtttttttatataatttaattatatacactccatcttattgttagttttacattttagataagaaaattgtaagttaaatatttagatataaatatattaattagtatatataaatatcttttttttttagtttcctattttcttttaggaaaaagtaaaaaaaaatcaaaaacatgtcaaaatctaagatcgttcaaataaccacgtgtcatgatctcgtgagttagtaactttcaaaactgtactttatataataagatttgaatttcaaatagtaacgtaactctcatactttttcagtatgtaatttagtatttctttaaaccaaatttcaatcttacaaattcgattttgcaatacaatttaaatacctattttaccataataaaatatataatttaatgatatacactccatcttgttgttagttttttatataatttaattatatacactccatcttattgttagttttacattttagttaagaaaattgtaagttaaatatttagatataaacatattaattagtatatataaatatctttgttttttagtttcctattttcttttaggaaaaagtaaaaaaaaaatcaaacatatgtcaaaatctaagatcgtttaaataaccacgtgtcatgatctcgtgagttagtaactttcaaaactgtactttatataataagattagattggaaacgttacaatacacatgagaaaataaaagtttaaacttcaagaagacaccatgctcgacccataacctacgacaagataaggaaggaattttccgataatacattgtaaaaaccaaacaaatcttgtctcgagactaaacgaagctctcgaagctcaccataaagacttcccgcacaacaaattatgaagaggggcttcttcataacttatggcaataacaagatagtggaacttggccttctcaataaatgcttctttttcaatgagtgcctttgtcaagggtcttccggatgaaccgtaagataatcgagaaccacttagacgttttaacgccacaacgatcaataaattaagcaaaccatcatctgctacacgatgagagaaaactcaaatataatcaaagtgctcaaccccaaactaacaaagattaacttagtcgggaagagaagattagcccaaacaagggagacggaagtccaaacgagggagacaattaaacctaatcctctgatgttaccatatctcacagagacgaactgatcagagcaacaagtcgacacaaaagaggaatacatgagagacattggagataccgagatatcgaggaggcgatccaatgttgcacagatgcagctttgggagaaaagaaacgagccgtcaagagagaagcaaaagcctccaaagtccgtcaagactcagcgaagagaaccacccgacaaagacgacgttgtgactccactctgtgaccaccgaacaagaacgatgacccaagaacacccttgaccaacagatcctatagatctgagtaccaagacccaacctcattaaatctgccccacaacacccactattccaaaatgtagagcctcgatgcttccacaaacaaagaatacaaagacaagaaatgaaaaactatgcagagaaacaaagaaggtgactgacgctggtgctatttgagcctccacgcgctggtcactttgtgttaaagcaggaagacgagagaaaaaaatattattttaggtcaaccttgtcgatttttgcgatacttagagcttcgatttttagggttaacggttcacctctgctatattttttttatcagaattcaactccaacaaactaaatcactttccgtgataaagaaaagaaaagtgcaaaaatttggattttgttgatccaaaataaaatacaaagaactgaaatcttaaaatcatatactaaactagttgttatttgtaaatttcttataaccctttcttacatttttaaattaccctacatataactttttcttacatttttaaaatatcctacaattatctaactaaacacccaaaaatatttttaccgttttatgttatcaacttatcatcgtgtccgacaaaaaaaaaaaaacttatcatcgtgctcctttacatttttcgtgacctaaaactgctacgacatcgttttagtgacttacttgctaaaaccctttttaactttctttcaagctaaagacctgcacaaactctctctcgaattcttttgtttcgaagccatg

SEQ ID NO: 18619 - DNA, 3003 bp, Unknown
  misc_feature (1)..( 3003): 2750-1469P.txt file - cDNA_ID_1818665; gDNA_ID_1621158; Annot_ID_57067
tatgtcagtgaaggagctgcatttattggaacatctagagattttaaccatagatattgtgtcaactatggttttggagcaaatgattgacgctggcactttgatgaattgtatgcaagaggtatctattcgttgtctcatttatgaccaagaacaagacacaaagttacgtctgccaactatggatagccttcgtagtctgaccatgtggaactgtgaaatttcagagatagagatagagaggttaacatggaacacaaatccaacaagtccatgtttcttcaacctctcccaagtcattattcatgtttgttctagtctcaaggatttgacttggctattgtttgctccgaacattacttatctcatgattgagcagttggagcagctacaagaattaattagtcacgcaaaagccaccggtgttactgaggaggagcagcaacaactgcataagattattcctttccagaaattacaaattctacacttgtctagtttacctgagctaaagagcatctattggatttctctgtcttttccatgcctaagtggaatctacgtggaaagatgtccaaagctgagaaaacttccattggattctaaaactggtaccgttggaaagaagtttgtcctacaatacaaagaaacagaatggatcgagagtgttgaatggaaggatgaagccactaaactccatttcttaccatcaaccaaactggtgtatatcctctcctagctccattctctctctgtttgatcaaaacaaataatataaataatgtattagcactaacgaaatcttttctttgtcagttgatttagctctttggttactcctaagacagcctgtaggccgtaggacaagccggtttttcaagaaccatatcagacgacacaaactgtcttacactatgaacatcaagcaaatgtaaccaactttctgttttctttcctaccactggattgtattttatatttcctctcccaccgtctcttttgttctgcaacttttctttatctttcctatttttttcaaacaagatcttccctatttattacagtcaaatctttaagtgatccaacatcaattttcttccaaaaatttaaaaatctatcccggcctgcaatttctttcactatgttaagtcttatgacaagtatctataaaacaccacgtttaaaactactgtttaagaaaatatacaaatcaagtcaactattaagacatgtaaacataattgaaagtttaaaactatcaaatcacatgtgatcccagattcttcacatggtagctaggcctaggctcaccttctaatagaagtagcaaatggaatttatcaattatgtgatctcagatcccatacatattattattataggatctcgaagataaagtaaacagagagaggtaacaaacataagaaaaaatctattagatttagttggtgaccaaatgatgttagtcaacaagtggttatcaatttgcttaacacatttttttcttgtaaactgcaaaatttgcacaaactaatttcttgaccactccggtttaagaagattggtttgagtctttgtctctctgagaaataaacaagaaaaggacatgaaaggtattcgatctgccaacgtgacattgtgagaatgggtaatataaattccaaataagattctctcttaatttggattatcctcctccatatgtaatataatttggaatctcgtgattgcttttttttttctatttgtaaggtttcatttagaaacagaaataatttgcatcccaacttagatactactaaccttatatgggcttatttggtagataggcaaaacttttacaaaaagttgtaaataaattatttgtcttacatgctttaaataaatattaaattgtatgttatcgaatagatgataaatttgttaaaaacttaaaatcgtcacaaagcccattgttataaaatttaaaatatatatttcttccaacttagggggtgttattggttccaaattataaggaattttgatgatttcaatcaaatcctagaaagtaaagaaatgaaagattttaaacgattgttagagagtattttataatcttgttgattagtttttcataatcttgtaaagtttctctaacaatctctttattttgataatacttttcatgactttccatgactttattttgtgaagaaaaatgtagaaagtcatgaaccaataacataataatttaaatcattaacaatcattaacaatcaaagattcttttgttttaattgaataacacaaaacttttaatgactttataagagtatgaatctaataaccaaaatttatgaagattttagattactttttacaaatcttaaatgaataacacaaaaatttaacatacttttaaaaaatcttgattgaataacaatagattttacataacagtttaaatcactaaaacttttttaaaatcataaacgaataacacccccttagtaaacatatatacatatgaggaaagaaagatatattaaattaagactctgcatgggtagctttaatatttgtttcaacaacgaatacaaaccaaccataagattagagatgatagaccaataacccttaaaaatatgaaatatcgttttgtccttttacccttttagttataatagaaaagacatgaaatagtgtatagctaaatttttgtaagactttgatgttaaaagaaattttatgtagacaagaaaattatcttagcaaaacgaaagtaataagtttgaaggaggatacaaatgtttataattgaatgaaaatctattgaaaacaaaactactttaatgtcaaaaattaaataagaagtaaatatacaatagacagttgttggatattattatttcaaatgggccaactcttcaagacgtgaagaagactagaagatagctttgtcagattcacatctccccaaaaaaaaaacagagcaagaagaagaagaagaagacaaccatg

SEQ ID NO: 18620 - DNA, 3000 bp, Unknown
  misc_feature (1)..( 3000): 2750-1469P.txt file - cDNA_ID_1818665; gDNA_ID_2926151; Annot_ID_139308
gtcagtgaaggagctgcatttattggaacatctagagattttaaccatagatattgtgtcaactatggttttggagcaaatgattgacgctggcactttgatgaattgtatgcaagaggtatctattcgttgtctcatttatgaccaagaacaagacacaaagttacgtctgccaactatggatagccttcgtagtctgaccatgtggaactgtgaaatttcagagatagagatagagaggttaacatggaacacaaatccaacaagtccatgtttcttcaacctctcccaagtcattattcatgtttgttctagtctcaaggatttgacttggctattgtttgctccgaacattacttatctcatgattgagcagttggagcagctacaagaattaattagtcacgcaaaagccaccggtgttactgaggaggagcagcaacaactgcataagattattcctttccagaaattacaaattctacacttgtctagtttacctgagctaaagagcatctattggatttctctgtcttttccatgcctaagtggaatctacgtggaaagatgtccaaagctgagaaaacttccattggattctaaaactggtaccgttggaaagaagtttgtcctacaatacaaagaaacagaatggatcgagagtgttgaatggaaggatgaagccactaaactccatttcttaccatcaaccaaactggtgtatatcctctcctagctccattctctctctgtttgatcaaaacaaataatataaataatgtattagcactaacgaaatcttttctttgtcagttgatttagctctttggttactcctaagacagcctgtaggccgtaggacaagccggtttttcaagaaccatatcagacgacacaaactgtcttacactatgaacatcaagcaaatgtaaccaactttctgttttctttcctaccactggattgtattttatatttcctctcccaccgtctcttttgttctgcaacttttctttatctttcctatttttttcaaacaagatcttccctatttattacagtcaaatctttaagtgatccaacatcaattttcttccaaaaatttaaaaatctatcccggcctgcaatttctttcactatgttaagtcttatgacaagtatctataaaacaccacgtttaaaactactgtttaagaaaatatacaaatcaagtcaactattaagacatgtaaacataattgaaagtttaaaactatcaaatcacatgtgatcccagattcttcacatggtagctaggcctaggctcaccttctaatagaagtagcaaatggaatttatcaattatgtgatctcagatcccatacatattattattataggatctcgaagataaagtaaacagagagaggtaacaaacataagaaaaaatctattagatttagttggtgaccaaatgatgttagtcaacaagtggttatcaatttgcttaacacatttttttcttgtaaactgcaaaatttgcacaaactaatttcttgaccactccggtttaagaagattggtttgagtctttgtctctctgagaaataaacaagaaaaggacatgaaaggtattcgatctgccaacgtgacattgtgagaatgggtaatataaattccaaataagattctctcttaatttggattatcctcctccatatgtaatataatttggaatctcgtgattgcttttttttttctatttgtaaggtttcatttagaaacagaaataatttgcatcccaacttagatactactaaccttatatgggcttatttggtagataggcaaaacttttacaaaaagttgtaaataaattatttgtcttacatgctttaaataaatattaaattgtatgttatcgaatagatgataaatttgttaaaaacttaaaatcgtcacaaagcccattgttataaaatttaaaatatatatttcttccaacttagggggtgttattggttccaaattataaggaattttgatgatttcaatcaaatcctagaaagtaaagaaatgaaagattttaaacgattgttagagagtattttataatcttgttgattagtttttcataatcttgtaaagtttctctaacaatctctttattttgataatacttttcatgactttccatgactttattttgtgaagaaaaatgtagaaagtcatgaaccaataacataataatttaaatcattaacaatcattaacaatcaaagattcttttgttttaattgaataacacaaaacttttaatgactttataagagtatgaatctaataaccaaaatttatgaagattttagattactttttacaaatcttaaatgaataacacaaaaatttaacatacttttaaaaaatcttgattgaataacaatagattttacataacagtttaaatcactaaaacttttttaaaatcataaacgaataacacccccttagtaaacatatatacatatgaggaaagaaagatatattaaattaagactctgcatgggtagctttaatatttgtttcaacaacgaatacaaaccaaccataagattagagatgatagaccaataacccttaaaaatatgaaatatcgttttgtccttttacccttttagttataatagaaaagacatgaaatagtgtatagctaaatttttgtaagactttgatgttaaaagaaattttatgtagacaagaaaattatcttagcaaaacgaaagtaataagtttgaaggaggatacaaatgtttataattgaatgaaaatctattgaaaacaaaactactttaatgtcaaaaattaaataagaagtaaatatacaatagacagttgttggatattattatttcaaatgggccaactcttcaagacgtgaagaagactagaagatagctttgtcagattcacatctccccaaaaaaaaaacagagcaagaagaagaagaagaagacaaccatg

SEQ ID NO: 18621 - DNA, 3003 bp, Unknown
  misc_feature (1)..( 3003): 2750-1469P.txt file - cDNA_ID_1818677; gDNA_ID_1621159; Annot_ID_57098
cttggcaatactacgaatagagaaaccagagacaagtattggtaccttccagagaccgtcgttgaggtaatgcatgttgtcaactcctattcctttgttaatgctctttctgtgaacatacacaagaaaagtttagcgatgcgaaagaaattttatgagcaaacaggggaaacacggccaaaattgatcctggtgcaggtatgtgtatctaagggaagaaggaatatcaataaagtgacaaagatagggttacttggagaggcctggagccaagagactgtattttggctaagatacgaaagtatatcaaagcacatgtttgtattttcaaataaattccagcgaaaaattgacttacatgtcctttgctgacattttggtgaagcctattgctaaggcatgttgctttccttctgcatatatggcctaaacaaatacagattcatggtttaagatcagcatatacaaacaaaaatgcaacccagggaaatactgtttttattcataccactggcctttcagcctcgacttcttgatccagaacgcctcccggggatgtaagaccaggacacattatgtttgcaccagacagaacaaactttatggcacctctatcaacttgaaacctcttcattatatttgggtctgcaaaactccaaacattcagctgccaaatttttgacattcgtggctaattgaaaaaactccaagtttctttctatgtatcattcaagtatgtaaaagttagctgaacgtggtgttttcaagaatattttatactcttctggtaacagccaatgccaaaaccttctcactatgataagggtcagctaacccggaaaacataaaacaaaatatactaaacaaaaatcctggctaaccaatcatacgtggaccttttatatagttcactcgcatgaaaaaagccaaaggaacaacaacttacaggaaccaaaccccaggaagttctaaataactcagagaaaagtgtcggacatactattcaggtatatgcagtatttgaaccaggtaagttctactgcagaccacagtaagactaacaggtgtgaagaagagtgattgtatgaataaaacacccagatatgttatgttttgataacaagaccatatagcatggatggtgtgaaggaaaagtgatattacattgatgaagaagccgcagtgttggcatgtatggcccgtcacggatacagaagaagagggggacattgttgacaacaactagggtcagatggtttgggctgcacgagaaatatagtcaggaatactgtaagacatagatagtgggtaaaagaaaattcagaaaacaaaacaatgaatatgagtttgttaatttacagaccacttcactacgataagaggaatctttttgggaagtagatcctccatcactgattcaagtcccgggtactgcaacattaacataaacatatttatatctgacaaacttcacgaaatcataaaagtttaagaaggggaaaaagacaaatgaaacaacagacatacctcatcttggatactctggcggatcctacgttgaacagatgccttcacttggttttgtgatgaaatctcctccaaacaaaacctaaataaaaagtagtgaacataaataacaccttcatagacataatggtatatcaaatagatctaaagttgatagcagtagggaaaaataaactttatacaagattcactatgaatgtataagcatgtttcaggagatggataaacacaaactccatgatagtagagagtttagactggtcaaatcaagacacaaactttcctctatgacccacgactctttgtacagatttgataaatcaaatagtgacactatcaatatagaaaccaaaactttacaatagcaagatgttagcttttgagaactcaaaaccttctactttgaagaaaatataacaaccaatatgcccataccaaggctactctaagcaatcaaattaacaatgtggtcgacaacaagtagaagggagtgagttctcgatagttattagagtaagtggatactaaataaagagaccatcacattctttatcaactagtataaacaatgccgagatgttgaaaccactaattcttagattctacaatccgggtatgaaaaacagtttctatctaaataaaaaagtagagaaagaatctagaaagagacaaagatgcttacttcttaaacatgttcgaggtttattgaaaatgatcaccagcttctaactatggtatcttcttccctgcaagcgaacagtggaagatgattgataacggaaatatcggaacatcactcaacaaaccaaaaatttggacatcatatcgcaacaaattcaataggaaaaatactgaaattccaaaacagaaaaaccaaacggaacagagcaggaactcacggactgagagagaccgtggacggtgtcacggcggaaaatggtcttggacggagttactaatcggcgaattgagatttgagaggtggtagtagaggaaccgagagaatgtttctctcaaaaaaatccccaagtgtttccgatctagtgtctcttttgtccaaaaacgacagtgtttaggaaacctaggagaatgaatgacccgatggtccgaatccgattcgaaattggttcgaattgtaataactaacatacaatattccggtttgaatgataagaaaaaacacattcgatccggttagaacaatatattaacaggcccattaaaacatatgggccgatcttgatcaactgggctattcatcgttgatacatgcggccgcacaggattaaaatccagttccgttttataaaaggatactagtttccaaacgaacggtggttgtctcctttccagaacaatctaacgctttctcgaacatcttcttcttcttctttctcgaaattatttttccagtaatcaatttcttctcttctagatttttacaggaactaattttctgctctgaggtatcagatg

SEQ ID NO: 18622 - DNA, 3003 bp, Unknown
  misc_feature (1)..( 3003): 2750-1469P.txt file - cDNA_ID_1818706; gDNA_ID_1621159; Annot_ID_57087
agccaagccaaacgaatgatgatgatatatataacatcaacggtttttgaagagtaggtgcaaattctttttgtgtatcatcatgtaactctttgactctcagtttaaagtcaataaaatatatcgctgcctaattatatcaatgagcagttgaaatcaattcttgctagatttgtgttcaaacaaactatgttcttgttctcttcacgtagaatcacctctctacgctcttacaccataatcaaacattcaagttgttattcgactttggtttctgatggtaacatcttctcgattcaacactttcaatctcttatgcaaaaatatgaatcaaaccttaaaatcatccaccagctccattcacacttcaccacttctgggtttcttctccttcatcagaagcaaaactctgggaaactttttctattcaatcctctgcttcgatgctattctcttggcgaaacccctcttcatgcttacttcctctacgaccaactccaacgactccatttcttgtctgatcacaataagagtctgcctccttttgatagtttcacttacctctttctcctgaaagcgagttcgaatccgcggttcccatctttactactgggaattggactccacgggttgactctaaaactgggttttgaatctcatgtctacgtgcagacagctttggttggtatgtatcttgttggtggaaacatgattgatgctcacaaagtgtttgatgaaatgcctgagagaaatccggtaacttggaatgtgatgatcactggccttactaatttgggagatttcgaaaaagctctttgctttttggagaagatgccgaatcggacggtagtgtcttggaccactatcattgatgggtatgcacgagtagataaacccaaggaagctatactcttgttttcaagaatggttgcttgcgacgcaataaagcccaacgagataaccattctcgccattctcccagctgtttggaacttgggagacttaaagatgtgcggatcagttcatgcttatgttgggaaaagagggtttgttccatgtgatatccgtgtgactaactctctcatcgacgcttatgcaaaatgtgggtgtattcaaagcgcgttcaagtttttcatagagattccaaacggaaggaagaatcttgtatcgtggacaacgatgatctcggcgtttgcaattcacggaatgggaaaagaagcggtcagtatgtttaaagacatggaaagattaggattgaagccgaacagagtgaccatgatcagtgttttgaacgcttgcagccatggaggtttagcagaagaagagtttctagagtttttcaacacgatggtaaacgagtacaagatcacgccggatgtgaagcactatggatgtctagtagatatgttgagaagaaaaggaagattagaagaagcagagaagattgctttggagattccaatagaagaaaaagctgtggtttggagaatgctgcttggagcttgtagcgtttatgatgatgctgaattggctgagagggttactagaaagctaatggagctagagagaagccatggaggagactatgtgcttatgtccaacatcttttgtggtactggaagatttttagatgcgcagagatttcggaaacagatggatgttagaggagtagctaaacttccaggacattcacaagtaacatagcggagcatgtatatatttatgactccaatctttattgttttgatgataaacttcagaatttttgggagctctgttctgatcctcaatgttttgatcataaactcccaaaaggtgttttctattctgaatggttttattggattataaagaaacgcaaacctaatcaagaagaccaagttcataattcattgtcataataacttcacaagaaaaaaggaaaacatgagagcattgctgggtgcaagtttgatagataataaaagaaaaagcgatgagaatctgcaacaagggtttttgatgattcctcttctgaagacccaagcttatgaaatcttgttcatagaccactgggggttgcatgtgtttctgtgctgcgcttggattctcctgaagatgggtcagcaccgaatctgtgaggatgatctgtttcttgcatccccttttcctaaaccctaaatcctaaactcccaatcttcaatgagttttgatcataaactcctaaagtttggtgagctctctaatgaagtctcagttagctgagattacagtgacaaagatgtgtaaaatacaatggagctcaaatcattcaaagagattaaaaaagactaaatggatcaatgagtaacaagaacatgcataaaaatagttcattttttgaaaaaactttgcttcaatgggtgtcattatcaaatttgaatccaagtcagattttgagtagcttttacgctaatcttcttcacacaaaaaaaccatcaacacaaaaagatttataatttaaaattttatcggcccaaaatacacacatcaatcttcctctcggcccacgcttttagaatttttgtagatttaaaaattcagttggaatctaacggctgagatcacgtttaatccaacaaaccaagctatatatttactaaaacacccgagagatctgcttcttttgtttactctactctccacgagaagcacacttgttttttgtttatatcaccgcaccaaccgctaatatctttacacgtgtcaaatcttttgcttaaggctaattatgcacagccttctttctcccgttttatccaatactataacgacatgtcattctcaatgacaaatgtatctgacgtgtcggttacctattggattacgtggctgcagatttacacgacgtagcctaaaataaaatccatgagagcaaagctcacttgctagctcctctcctcgcggtatatataagctccaggtcttgtacatcttcatcatctgatctcggggaagctccgatctgagttttttttagcaatg

SEQ ID NO: 18623 - DNA, 3003 bp, Unknown
  misc_feature (1)..( 3003): 2750-1469P.txt file - cDNA_ID_1818714; gDNA_ID_1621159; Annot_ID_57085
acaagagcagctagaaacacgacatcaaagctctttaagctctctgtcacgtccattatatcaacggtgtggaagaacatgcgttgagagatgtctggatcagaggaaaccagaagagaagcgagtgagttcgctgatgggtcgatgtcaaagttgtgaaagattgtgtctttgagatggaatgaagcaagaacgatggaagtgagaggaagaggaccagatccaatgaaagccacactctttgggacaaagccatttaggttttgttcgaggaggtcgaactcgagctttccgagtttcaaatagttgttgtaataagggaaaatgtttaaatgatgaagtgggttgtcttggtaagaggtcaagatcgaagagaaatggttttctaagtgaccttcggctagaccacaaatcttgatgagattaagtcgaatctcttggactctgtcacacatcttggtgacatcgatgttagggtttggtggtatgcatgtggaaacgagctgcttgaagagaatgttgacatcttcggatggttttagactctcaagctttgagatcttttcgtagagatcgcatattgtttgcaccaattgttcgtcttggcaacccatgtcgacactatgaggttattgatttttctctttctctttggagaataatcgtgtgttctcgggtggtgtgaactgtttggactggagggatggatatttattggcgtggggttggggatctacatcaactagaaaaagaatctaattattttaacatttcattattcaaatatactatataacgtacacttgcgtttttgtttctttttttgtttaactaattaagaatagatccttatatttaggttttgaagtaaaagatttatttaagtcaagatattagtttaatgtttacagtattggtttagtttctatgatttctgatttaggtttaaggttttagtttaggtttagagtgtatgttttcgattatagaaatttcattcctaattgctataaaatttacaatcattttcaaaattatcctggttatgaaaaatgacttgtgtgaacatggattagatccaaaaatgttataaattattggatatattgtattacactaagcaagatgtacagtaattgatggatgatatgaaacgtataatctccattaattgatggattacatgaaagctaaatgagataatttgtttgttttattccattcttctgtatataaaaaatgagataaggtttgaatgtgtccatgtagtacttcttccaactcgtatgagacaactacacaaaagtttgatgccttatcatttttctgtacgtagcatatgatgtaaacacataattacacagaaataaagagtccattactatattatggggcagttcaaaatatatagccaagagcttttagtcttttagaaagaaatgtgcatgacttgcgacaacacaaaaagtgtaactaaccacagtaattaaaaatatatatatggagtaactactaacctatataacaagttgcttgaccgaaaaacatacgtcctttgtctgtttccaaacatcaactttggaattaaattgtaagacttcctcacaaatatcaaactgagttttcaatattttttgaaaagaatatgcgaatttcagaagaagataatctcttcatggcgtgtgccttccacaaatttcttacggctctccttgttttcttttgatatgcttcatgaatctctcaaattcttcacgcaatcatatatattttcatatctagaaagaataataatttttttttttttatctcaatatagcttttaggaattctaggagagtagcatatatgggatatatacgttgacaaaaaaaacacgtatatgaaattggaatccatgtgagacgaatataaaagattggaagaagacacaaataataagaggtacttaaagatacacacacacacaacaacttgaaaggatcgatattcttttatgtaaatgacgcatcatatttatttcttatgcgaaaaaacatattcgaaacaaagaaaaaagaaaacatgtttgatctatgcatttttgcctcttctattaactccacggccaacttgattaattatatatgccaacaaaattcatacaacactattaatattcgtttgtttttctccttctcaatttcaacattaatttttaaagttttatgtttattttttgtggttgtcagtcaatggattccataatgtatatattattttcgtagagatgctaagatttttttttctcttctttttcttcctgtataaataagattgcgtgaagaacttgcggaatttcatgagtgagacaagaaaacaaggagagccataagaagtgtgtggaaggcacacgccaaaaaagatattatattctcagagaaatggacatattcttaatatttccaaaaattgaagtttcagtttgataattgtacgaaaacttacaaaaatttgtcaatgttaatgttttgaaacggatgaaagaaagtatatttagtcaagtaacctgttatagtcatgttcacttcactatcaactctatcttcttattggattgcattgtccatctcccagtttattcttcttctttttcaaaattaatttatttcctcatgttacattaacatctatctattgatttttttttttttgtaatgttaaatttatttatcaattaaagtaacaaaatatattactgaagatttaaatgattgttgccatttgccaaagctaaagagataggtctgttaaccaaaaaaaaaacattttaatgggccacatgtgtggaaaagcccatacactttaaaacaaaacgtctccccggtttgattcaatcttctctcttggtttttctggttcggtaacttaccccaaagtctagtccggtttaatctcccaaatcaattttattgaaaagaacatgtcatcgttctgagtttgggttttcgagctctaataatg

SEQ ID NO: 18624 - DNA, 3000 bp, Unknown; identical to SEQ ID NO: 7725
  misc_feature (1)..( 3000): 2750-1469P.txt file - cDNA_ID_1818721; gDNA_ID_1621159; Annot_ID_57081

SEQ ID NO: 18625 - DNA, 3000 bp, Unknown; identical to SEQ ID NO: 7725
  misc_feature (1)..( 3000): 2750-1469P.txt file - cDNA_ID_1818721; gDNA_ID_1621159; Annot_ID_173637

SEQ ID NO: 18626 - DNA, 998 bp, Unknown; identical to SEQ ID NO: 7724
  misc_feature (1)..( 998): 2750-1469P.txt file - cDNA_ID_1818725; gDNA_ID_1621159; Annot_ID_57080

SEQ ID NO: 18627 - DNA, 3000 bp, Unknown; identical to SEQ ID NO: 7738
  misc_feature (1)..( 3000): 2750-1469P.txt file - cDNA_ID_1818736; gDNA_ID_1621160; Annot_ID_57129

SEQ ID NO: 18628 - DNA, 3000 bp, Unknown; identical to SEQ ID NO: 7738
  misc_feature (1)..( 3000): 2750-1469P.txt file - cDNA_ID_1818736; gDNA_ID_1621160; Annot_ID_173696

SEQ ID NO: 18629 - DNA, 3000 bp, Unknown; identical to SEQ ID NO: 7743
  misc_feature (1)..( 3000): 2750-1469P.txt file - cDNA_ID_1818787; gDNA_ID_1621160; Annot_ID_57114

SEQ ID NO: 18630 - DNA, 3000 bp, Unknown; identical to SEQ ID NO: 7755
  misc_feature (1)..( 3000): 2750-1469P.txt file - cDNA_ID_1818791; gDNA_ID_1621160; Annot_ID_57113

SEQ ID NO: 18631 - DNA, 3000 bp, Unknown; identical to SEQ ID NO: 7745
  misc_feature (1)..( 3000): 2750-1469P.txt file - cDNA_ID_1818803; gDNA_ID_1621160; Annot_ID_57110

SEQ ID NO: 18632 - DNA, 3000 bp, Unknown; identical to SEQ ID NO: 7745
  misc_feature (1)..( 3000): 2750-1469P.txt file - cDNA_ID_1818803; gDNA_ID_1621160; Annot_ID_173678

SEQ ID NO: 18633 - DNA, 3003 bp, Unknown
  misc_feature (1)..( 3003): 2750-1469P.txt file - cDNA_ID_1818807; gDNA_ID_1621160; Annot_ID_57109
tttaattactctttatctgtgtgtgtgtgtgtgtgtgtcaaagttacaatttctttcccttctttacgacaaaaatcttaagtaacttttgtttattgttacacgtgtcaataaattattggctcattattccattgtttcaaagtcaattttcattatacaagacaaataataggcagtcgggaaaatataattcatctatacttaataaagaaaattaatggtaatttgcttaattgaccaacaaactcttaatatattcaatttatttttatgatattattgtcttggtacttagtaatcattaatcaatatacttatttaagcaatcatccttgaaaacatgatgataaaataatatttttaatggatcaagatacttaaccagtttaatttataaaagaaagaaatttacttgttgatccactcaatttagccttgaaatctttggtggttgattagcctttgctttggaagtgacaaatctgattcaatttggggtgaagatggtgacgttggtgtggagtgaagtcggcggtgctgagctcctttgttaattctttcatatgtcatcttggaaggttgctagatcggaggttttgtccttctatcaccactttgaatattattttcatcgttgtaggcgatttggtgttcttagttgggctttacttctctttctcggctattcattctgtttttagtttgggactgagttcttggctaaagaattgtggtgtcgtttactgattttttgagaatggttgtggattgaagccttagttttaaggctttggttgggtctacaaatgtcctcgtgtaagaaatgagggtcctctttggcattttccccttcggatatcaagttttctccttgtacctttgctttctcgtcttctttggttgctggaaggtagtattagtttggttctttgctctactctatttgattatccgtcttcatttctgctgaggtagtggttgtgtgagctcggtttagcccttttctcgggctttctcttttgaaggcattctaatgatttggttttcttcaaggcttttgtttgtaacctttcttgtggtgaagagtttctagtagtgaattgctttggagtctttaattgttagtcatctccatgtcttagtgattgtcaagtttagtctcagtaatcttgttttgtactagttgataggtttttgtttactatgggtttgtccattttaatggttcatatataaaaataacactcttgtgacccaaaaaaaaaaacacatattctatcttaattgtttttttttaatgatatttaaaattttaatagtaaaccacacattttttctatatttagtgtttttacttttatctcaatttatttattctctcaatatatctttaaataacgtcagttatttttgttgtttactaaataattactactgtgtaacttaaactttaaatattagtgacgataaaaaagactttaaatattagtaacttatccttaacgttttactcaaacataattatacttaattctcattcatctttgtactattgagttttcccattataatctttatctatgcatcacaccatttatgtgttttgttgagatctatattttatagttatcttaacatagcaataggaaaaagagaaattttttgacaaatactaaaaaaacttatttggaaggtccccattttttataaatctgttatattatgaattatcttattatataataaataattaataattacgaatatataattaattttttgtgattcatgtatatagattcttttcggttaggaaattttctattttttgtttttaaatattttaacaaaaacttagatttgacacatgtcgatatctcatcaatgtagttgactcgtgcgtgatcacgttagttagcaactttaaaaaccctattttatataataagatgcaaacttgaataaaatggttctatttgagacttgtttttttgtacaaaattagaaagatccaaaattcaaactgatcaaaccgtacaaattagggtttttttgtcgtgtattacgtcattagaaaatattatttttaacaatgatgatcttatacatttgataagcaaatctaaactagggttttgaaatcctaaattaaagtaaatgtttcatgtacatgacacatacattttcaaaaaattagaaaaatccaaaactcaaaccgttctaatccaataaaattaagttttttttgtcgttagaaaatactatttctaatgatgatattacatttttcaagaaaattcaaactagggtttcatgacaatacacatgcatatctttaacactattggaaaaatctaaaacctcaaaccgatccaacaagataaaattaatttttttgtcgtgtctgttaaaaagtactattttcaatgatgatcttatatttttcaagtaaatccaaactagggtttcatgacaatatacatacatttcacaaaatcgaaaactcaaaccgctccaaccttataaaattaagtttttcttttgtcgtgtattaaatcgttagaaaatattatttttaatgataattttatatttttcacaagtaaatctgaactagtgttttaaaaatcctaaattaataatatttgagcaaaagtaaattcttgacaattacacatacccatacatttacacaagtaaataagttactcaaattgcaaaattaccaacatttacgaaataacaaaaaaaagggaaaaaatctctttcttttgtggattgcgaaaaagagtcaaacattttcacaagcaaataattgctcaagttacaaaattaccaaactttacgaaaacaaaaaatagaaaaaaatccttttgtttgtttgtttgtttgtgaggaagagactcttcaaaaaggggctgacagtgaagagattgtgagaacaaagacgacaaatgggcgattgagcgaagaagaaaccttcgttctctctcggaaatg

SEQ ID NO: 18634 - DNA, 3000 bp, Unknown; identical to SEQ ID NO: 7752
  misc_feature (1)..( 3000): 2750-1469P.txt file - cDNA_ID_1818813; gDNA_ID_1621160; Annot_ID_57107

SEQ ID NO: 18635 - DNA, 3003 bp, Unknown
  misc_feature (1)..( 3003): 2750-1469P.txt file - cDNA_ID_1818825; gDNA_ID_1621160; Annot_ID_57104
ttaagcgtgttgacttacctgttatgcataagacacatccaccaagagcagaccaagcctgtttgctattcttgttgaagaacaaaacgatataaaacgggtttagtgctcttatgacagtgaagtcatacttcaacagattatagattccaatagcaccaagagagaagaaccagagcgccagaactggagcaaatagaaaaccaactttacccgtcccaaaccgttgtatgctgaacaaagccacgagaatcacaatcgaagacataaccaatgcatctgacaagaacaacacatcaagattgaaaatcaaagatcaaattgacatcaagacatagagagagaaatcatgtgataatgatacccacttgttccaaatcctttaacttcaccttgtagaccactcattgcagacatcactgcagaagaatcaaaaggaagatcaaattccaactgtaaatgcagctcaagttacactgtattaatacaaataagactcacctgacatagctggtgttagaattccatcgccaataatcatggaagttcccattaggactaaaagcaaaagaagagttttcaaatacccttttgtctccaaagcttctttaatccccagagctctttccagctcaggagttgggagtttaagcctaaaactcgagatctgctcatccgcaggttgttgatttggcagcttattcacctttgcatacctacaaataagtgaatacaacgcaaatgtccctcctgcacacataacaaacatatcctgagaaaccacttaaatatctcactttactaaacacatcggtgcggaagcattaccttcgccattgtcgttagctttaaggactacaaatacatactttgccaaaggaatcacagcaatagtgtagataacgagagacaaagctccaagaacatcaacttctgatcttataggaactttactaaacacatcactgaacacatacaaaggacttgttcccatatcaccatacacaacacctaacgtctgaaacgctattccaagtgtagtcaaaagtgacaaatcctaaaaaagttttcatttttcaatgtcaataacacaaacacaacatgtgcacttataaaaatcaaaactttaatcatgggtgattaaccttgagattgtgaccatgagaacctgcaatttccatagcttcaacatcaagagaatcagctcttttgggttttttcattaatcttctcctcaaattcccaaaactatagtctctatctctgatttctgaaaacagcggcgtttcagagtctacctcgcttccatcaacccatctccggtcactacttccggtaccaacacgtcttatgctgttgttgctgcttccttcttcaatttcctccattatttagaataatcctccaaaacgagaagaagcagagaaactaacaactctgttttcttgaaaggattataattttggttggaggaaaaattagaagagattggattggtcattgttattggttgagtgtgacttcactctctgacaatatctcacgggtaacatgttcatagttactgtcaagaaacagacaattatttgaactactttaataacgttcccaatgaaaacactatatttttttttttttttcctcgattatctatccttatcctataaaagtattttagttccttctttcttttgttatgtataatggaaatttactttattcaagaaaaaatttactctttttagtttctttgcttttttggtagcaacattttccccaatggagaacaaggatctctgtctcaaccatttttttagatacattttactctattttatttgatatacaatagattttagtttaattttttgttgtttcaagaaacacattataaagagagaatttttttttttcgatgggtgaaaattttgttttatcaaaaaaaattgttgatttgtaattgtaatataaaatttgctacatatgtataattattttaatctatatatacatttttgcagccactttgtgaaataaatcctcaagttgggacttatttacagtggctgccactgacatttaataattatttttgataattagaaagtaaatcttcgaattaaatatttgacatttaactatcttcccgaaatctctccatattaactacacaattagttactaaaataaaacttccaaaatatttaatatcatttaaacactacaaaattatcatttttgatattgcttttttcatgactataacaattcgattataagcatcaaaccgcagaaatatttgatagcagttaattactacaaaattacaaaatatttatacaatgatttataaatatatcataaataaaatcaacattaataaaataaataggtttcttttacgggacgggtttggcaggacgttacttaataacaattgtaaactttaaaataaaaatattttatatatagatacaatttgcaaatttttatatatattaaaaaattaattatccccgcggtgtaccgcggattaaaatctagtgtgacataaaatagaactgaagcaaacctaaagagtaacttccttttgtagaaatataattatttcaacaaaagattgtatagtaagatattttaaaacggaaatttgcagaagcccatttactagtgttagtttcaaagaaggcccattaaaaaaggcccaaatattgccggcttcgaaactcgacttttttatagcacacaaggtttcaactgaaaacattcctcttcgccttcctaaggaaaaaacactagtcgctcgctgctcttcaattttcttctcgaatctaatcgattgatttctccttcgattcttcaggtaacttttgattatcctcctctaatcaattgtgtatatcccaagctttctctataaattagggtttctgaatcaacgatttttcttttatccgtaggagaatcactgaagcttttgcctcccaagtagaaagagatatg

SEQ ID NO: 18636 - DNA, 3000 bp, Unknown; identical to SEQ ID NO: 7747
  misc_feature (1)..( 3000): 2750-1469P.txt file - cDNA_ID_1818829; gDNA_ID_1621160; Annot_ID_57103

SEQ ID NO: 18637 - DNA, 3000 bp, Unknown; identical to SEQ ID NO: 7747
  misc_feature (1)..( 3000): 2750-1469P.txt file - cDNA_ID_1818829; gDNA_ID_1621160; Annot_ID_173671

SEQ ID NO: 18638 - DNA, 3000 bp, Unknown; identical to SEQ ID NO: 7748
  misc_feature (1)..( 3000): 2750-1469P.txt file - cDNA_ID_1818833; gDNA_ID_1621160; Annot_ID_57102

SEQ ID NO: 18639 - DNA, 3003 bp, Unknown
  misc_feature (1)..( 3003): 2750-1469P.txt file - cDNA_ID_1818857; gDNA_ID_1620617; Annot_ID_46912
ttgtttcttcttcagcaattcagattcatcaatggtgggaacaaaaccctaattcgttactgttaatgacggaggctactggtggttattcgttggctagctattatacgtctttgggtttgtttgttatctctgttcctggtctttggtctctaatcaaacgctctgttaaatcaaaggttcgaactttactaattacaaaaccctaaatttcacttccaattcccaatttcttcgattttgaaaaagcttgaatgcaatgttgaggatttgtagatagtgagaaagacgtttgttgttaatgacgtcaagaaggagccaaagcaagtagctggagagattctatctttcttcacaaggaagaatttcaatatcactgatcgtggagaaacaatcacgtaagctacaaaaagctcgaacttttcatttgggtttctgtgttttgttactgacattgttttgataaaaagatttgaaggaaagatggttccaagtagaggacaagctgctctgcttacgttttgtacatgtataagcttagcaagtgttggtcttgtcttaaccattacagttcctgattttggaaacaattggttcttcatcattctccttagtccactcgcgtaagctctctctctttaaggtctctgagactgtttttttgtcaatgaaatggtgattattttgtatgtgtgtgtgtgttgcagaggagtgtattactggaaaaaggcgtcgaggaaagaggagataaaagtgaagatgatggtgggatcaaaagggagattggatgagattgtggttcaaggagatgatgttcaggtcgaagaaatgaggaaagagcttcagcttaatgagaaaggcatggtttatgtcaaaggtctctttgagagatcatcataatgataacattttagcctcccatttttgccttttggggaatgtgtctatacttgttttattaaggttgagattaatgactttttaactcatttcccatacttcatactaaacgaatcgatttgaatatagttcatttgattgagcaattttgttattttgaaagtccaaatccattttttcattaccaaagacaacaataaagccacaaatttactaagaattagtaagtatggtcttcctgagtgatcggctagtccatgattcccaaagccaaggttgttcagtactatatgccatcaatgatgagttcgaattatatgtacatatgaaatgggagatatggatacttcgatgccattgagaacaactcaaaaatcttggtgatcgagacttgaaataatgacagcattaagtgtacatctaaaatgtgttttggaacttttcgagatccttcagatgctcgaggtttgacacattttcttgaacacatgatgttcaaaggatcaaagctatatcttgaccggagtgaggtataatgattacaacaatagtagagacgaatacgtggagataagtataagtttgttatggaggctaataagaggttaaaacacgattgaaaaaaagaaaaaagaatcatgagaataagacttgatcaaacataatacattctatgaaaggtaaaacaccaagatgtagagttggcaaaaagaaactagaaaaagaaagtggaacttgttttttttttaatattaaattatatattttttaatattaaattatatattgacaacatataactttttgttaatattaaattatagaatttattttcatctttatttgaaatgttaattatatattgaaaacataaaaatagttacattatttgagtattttattatataaatcttggttttcaaagttagtaactcgtatgatcttgatcagatgatgcacaaactttgtagacatcatggttaacctaacataaatttatctaagttaatcaaaagaatcttacaaattaaaaaatgattaggtcgaggtgaagagaacaaattaccacatagtgttgtaattagacggacatatatgtttaagttaataatgggctttacctctatttgggttgagctcaaccttactcgattaacaaaaaatctgaaggtcgcgtgtttgatctacgctcaccgcaccatttgttaagaataagaaacgtaatctctatttcttaacttccgatacaccgtttcacaaaagattgagccaccggcacatcaccgattcataactctctctcacaagcgacacatacgttactaaacattcatcaaacaatgcataaaactaattacaagtctaatctcagtatttatatacaattgtttcttaatttttcttctttcttctcttcactcacgtgatcaatactaaactttgactctctcttgttacgaccacaaatttttgacgtatcgaaatggttgtcagtctaataaaaaaccgtaaataaaatctagtaaaatctctgttaaattaatagtgttggaatcaaaatattttgatttatagtgataagttatctctaaatgaatatttattattttatgatataaatgaattgttaatttgtagagacatttttttatttttttattaatatacgtatatcaccttgaataattaatacaaagatacttaaatgatactgtgtttatataaaaaaaaaaaaaaatcattagcaatcattcgattcggcttgcaataatctaaatggaccattttatcacttctccaacaagcaactctacagtgtttaattttaaattaagaatttaattatctatatcgtctcttctttagttaggaagtggataagataaagtctaatccaaattaaatcattaatacaaataaagttaagacaaatatttaatttaaataaataatcagaagaagagtgatgatagtgattcttcacgcgcctctctctcttcttcgtcctctacaaaaacacttgtctctcttctacacattgttcttcacgaacctctctgtatcatcttcatcttcttctcccgtaaagctctcgcgtctatg

SEQ ID NO: 18640 - DNA, 3003 bp, Unknown; identical to SEQ ID NO: 18639
  misc_feature (1)..( 3003): 2750-1469P.txt file - cDNA_ID_1818857; gDNA_ID_1620617; Annot_ID_162081

SEQ ID NO: 18641 - DNA, 3003 bp, Unknown; identical to SEQ ID NO: 15779
  misc_feature (1)..( 3003): 2750-1469P.txt file - cDNA_ID_1818861; gDNA_ID_1620617; Annot_ID_46911

SEQ ID NO: 18642 - DNA, 3003 bp, Unknown
  misc_feature (1)..( 3003): 2750-1469P.txt file - cDNA_ID_1818871; gDNA_ID_1620617; Annot_ID_46908
gaccctctcatggacaaaatctttgcccgttcgagtccgtttcctctaaaccctgtaatcttcgaagataccattggcatcactagaatcgcagatgcatttatagagtcttcaccaaatcctagtgctgctaaacaagcagtctgcaacacaatgaagtaaagagttttaattagtactgttgaataagctcacaaatgaagatggttctgcttgtgggtacctttgtcttggcaattaaatcagctgctttcatatacattccttgtacaactactcttgtgtctttgctgtgtccatcttcagatgattgtggtatcaacctgttattgaagatcaaaatagttatagtagctaaatcatagaaaacttctgaatttctaatgagaacacagttttttacctgtcctcctcagttggcacactcgaggacacgatggagtcaagagatgatgaattatcttttgtctcattgcctcttgtatcatcaggtgctagtaaagaaatgcctatgaatacacacatcattcctaatatgaacattgttgttcttagcgcatcgaaaacctgtttaaggaagaagaaaattatctaagcgactatccctaaacccacaccattctgtgacaaaatgatcaaactaatcatctagatccgtattagcccgaagataaagaaaagagaggaaaagcatcacaatgtagtcaatagatgaacctgaaactcttgaaagtaaatgcatcctgtacagatggagaagaaagtccaagcaatctgaaacattggaactatgagaattgcatcatatagagacaatccttcattcaatcttgtcatctgcaacagaagcacatgaaagacgtttttacttcagtaactatatagtctcaacggcacaacaaagcaccaaaatatttcagtagcttgaggtttttttttacccagaatccggctgtactaagaaataaaagaagcatagagtatgtgaaccagctgtgcagttgatagctactagacatggccaatctcagcaagttcgagctacaaaacgaaactcaaatttatcacctgaaactatctgattttcaagtaaagcctgtagatttgcaaactcacagtgacttggcaaataaaactgaacatgatcctatagcacccgagaccactgcatatgagaaaggaagcagcattttccaataagagctaatttcttgtccaggtgtagatatcaaaacttctcccttcctgaatatttcgattaaactaatcacaaaagaggtcccgatagttgaaaatagtcaaggaagaatttcaaatgcaagactcacctatagaggaaatggtgcacggctactattaaaatcaaaataccacagtagaccaagaatgttacattgctatatttctctgccaactgttcgggtgtgaaaactgagcacagaagatttttattaggccacgctttgtgaaaaaacgacagaacaatctgttcaagaatagttacctggtgactggtgattaccaaaagctacaaggaaaacgtttccaagaactataaaggctgtagcaacgagtactctgtgaccaaggcatactaaagatattagaagagcagagacttagtaaatcggtaatgcatgttaaagattgcagcgaggtagtttgcatacttgacagtaaccattttgttcaatacaacataagcaaatgctatgttggatacaaattgaatggatccaagagctgctagaagggactgcaaagagagttcataacggtaagaaaaccaaagagaaaccataatgaaacctgacaaatcacgcaagtaggcaatgtcgagcagatcattctacctgagcagcataaccaaacgaaatgaaattgaggcaattcccaagaagaaagacaaggatccctgtaagattccaacaacattggagactcagaaaaagcttcatataaacttcaacggggaaaaggtttaagaccaggacataccaactctccaagtctgattatgtataattggcttcaatggcatctttcctccgccatcttgtagggctaacctttctctctgataatacacaaagtaagacaatacgtttcacgtgacgagatcaaatgtaaccaaacagtagtggctgaggcaaatgcagacctcattatgtcccaatttgagaaggtttgtgccaaaattaatagcaacacttccaaaaatgttgatgaaagctccgatgacccactctcccattggtaattaaagaatgaagatagctcagttaaaggatcatctaaagctgcaaacttgaaccaatcaactagctcaggcctccctcatatgaatcttagccttcaagagaagaagcataaaacctaagaagggctattagatggtgattgcaaacacaagcttgtacctttgattgaaacagagatcaaatggacaaaattgaaacaagggttttcgatgattagcatagagaaagagaaaatgagacaaaacctgcgaagggacgatagaggagcttcagatccagatcgatttctaacagaagatgcagattgcacaagttctctcccaacaaagagaatcctttttgagatttaagctttaccaaacaaaatggcgtcgaataaaaggaagaaggataaaaattggatctttccccaaaaattgaaaattctaaaaaagctttgatttttcgtaaggaagacccaatcgccgataaagcttgaagacgacggtgacgaagacgacgacgatggcgatgttagattgatacaaaatgacgtagtggttgggcccttttgtgttgttaaatctgtcttcttgctgctcctcacgttttgttttgggctttttaccatttttactctcttctcttctctctctctcgttgagagacactcaatggccaaaaagcaacctttggcgggcgggtcaaaattgactcttttgacctttcattttcattgaacctctatagacagaaaaggatg

SEQ ID NO: 18643 - DNA, 3003 bp, Unknown; identical to SEQ ID NO: 18642
  misc_feature (1)..( 3003): 2750-1469P.txt file - cDNA_ID_1818871; gDNA_ID_1620617; Annot_ID_162077

SEQ ID NO: 18644 - DNA, 3003 bp, Unknown; identical to SEQ ID NO: 18642
  misc_feature (1)..( 3003): 2750-1469P.txt file - cDNA_ID_1818871; gDNA_ID_1620576; Annot_ID_160990

SEQ ID NO: 18645 - DNA, 3003 bp, Unknown
  misc_feature (1)..( 3003): 2750-1469P.txt file - cDNA_ID_1818875; gDNA_ID_1620617; Annot_ID_46907
caacgtttctcattggcatttgattgaatacaatctctgcagaatctaactgagaattggagacaagaccataaagcatagtagtccatgaaacaatacttctcccaggcattttatcaaacaccttacgtccactatctggtttcccacacttaaagtaaagatccatgagagtgttttggaagaagacatcattaaaaaacccagctttaatagctaaaccatgaacttgggtacctaaacgaatcgacgaagaagcgagacaagctttgataacaaaagggaaagtgaatttatcaaactgggattgatgagagatcatcataaggataaagagaagaagagcttcacgaggtttgtgattaacagagagagatcttatcataaggttccaggtaaaagtagaaggagattgaagttgattaaagacgagagaagcgtattgggtttctccgaaggaagaagaaacacttatgagctgacgaactagtaactgatcgttggtgagattgtgtttgatgattttggtgtgaatttgtttcaattgagagaaatttgaacaagttcggagaaagtaagaagcttcgggagatcggaatggtggaggagagaggaggtttggtggtgaagacggcgacggagccgccatggattaacgataaatcaccaaattctcacattcactctttcctcgattgatcgtgtgtggatgatgatgaagctgcatataaaccgaactaaaccgaagtttggctgatttggttcggattcggtttattgtgtagcaagaggaagcataaccagattgattcgactaggaaccactaaaccaaacgaaatacagaaatttcgaaccaaaccggatcgattctacgtgtattaaacgtcgtcgtttttgttagctaaaaagaagaaatagtaaatatccattagaagaagaagacgaagcagaggaatctagggtttatgctacattgaagcaaagatggttacgagcagcgatcaaatccaaaatggttctgaagagcaatcaaaaagatcagagatttacacatacgaagcaccatggcagatctacgcaatgaactggagcattcgtcgagacaagaagtatcggctcgcaatcacaagcctcatcgagcaatatccgaatcgcgtcgaaattgttcagcttgatgaatcaaatggtgagattcgttcagatccaaatctctgcttcgaacatccttacccaccaacgaaaaccagtttcatacccgataaagaatgtcaaagacccgatcttttagctacttctagtgatttccttcgtttatggcgaatctctgatgatgaatctcgtgttgagcttaagtcttgtcttagtagtgataagaatagtgagtttagtggtccaatcacttcatttgattggaatgaagctgagcctagacgaattggtacttctagtattgataccacttgtactatttgggatatagagcgtgaagttgttgatacccagcttattgctcatgataaagaggtttatgacattgcttggggtggtgttggtgtctttgcctctgtctcagaggatggttccgttagagtgtttgatctccgtgataaggagcattcgacgattatctacgagagtggtgagcctagtactcctttggtgcgacttagttggaacaagcaggatccgaggtatatggctactgttatcatgggcagtgctaaaattgttgtgttggatattcggtttccggctcttcctgtcgtggagcttcagcgacatcaggctagtgtcaatgctatagcttgggctcctcatagctcttcccatatctgctccgctggagatgattctcaggcgttgatttgggatatatcttccatgggacagcatgttgaaggtggtctggatccgattctagcttacacagccggcgctgaggttgagcagcttcagtggtcatcttctcagcctgattgggttgccattgccttctctaacaagctgcagattctccgggtctgattatgttttacagatttctgttggatacttggatgtaaaaactcgttgctattgttgattaatgatcttttgatctctgactctaagcctcattgagtttctttcatagtatggtctgtgtaggaactatgtaccttcaaaattgtgaataactagctttagcattggatttgattagacgtatggaagttagttttaacagagagcatgtggcataacggggaacttgaagtagattatgactaacaccagcatttatgtttctctgccctcgagctgatggagttgcaggattttgaaggagtgtgtgtatagaggtagttcttaacagaataatatttctctgcctcaccatcgtatggaatgtgtagctttctatggtagttgttataagctttgtctccattgtccatgtcatttttgcaatgatacttaaaacactttatgggtatgtagatttgtgaaattaggcattagtaacatcgtacagatgatgtattcttcattacttcaatacaggcatatagattctctgtccaacttaaaaggcatacaagttccgtggtttaaaaaatcagctttcctaaatcctttggccaatactctctcagccagtcctaagaacctctgctctaaaaagtctgagctttgaaaggcagacaaatggagagcagccttatcctccttttataactgtgaccacacacacaaatgaagaagcccaaatgaaaggcccaaaaatctaaaaaaataggtgaaggagggactttgtgaatatgtgatcatagaaacatgaggagacaagagagtgctaaaatcacaaccatagaaacaagtaagaaagctatccagaatctaatcttatttgcctccaagtcatcaattctttatcctatattactagtctctgcttcaccaatcctttttgctctcctgtctgctacaaaccttaacttggattctttctggtcaccatg

SEQ ID NO: 18646 - DNA, 3003 bp, Unknown; identical to SEQ ID NO: 18645
  misc_feature (1)..( 3003): 2750-1469P.txt file - cDNA_ID_1818875; gDNA_ID_1620617; Annot_ID_162073

SEQ ID NO: 18647 - DNA, 3003 bp, Unknown
  misc_feature (1)..( 3003): 2750-1469P.txt file - cDNA_ID_1818883; gDNA_ID_1620593; Annot_ID_161482
gctaacaagacgttttccgaaagtaaacgaccaggaaggaacgcagactgagacggagaaatcacctcatttaaaagcttctttagcctagaagtcagcagcttagctatcactttatacaaagtgtttaagcaagagattggcctaaagtcagtcatctttgaagagtttgtgatttttggaataaggaccaaagttgttgcgttccactgcttcaataactgacctgaacgaaaaaattcttggactgcttcagtcacctctggacccacaacaaaccaaacacctttaaagaactcagaggaatagccgtcagggccgctagctttgttcctgggcaaagagaagaaagcctcttgaatatcaagatccgagaaactcctttccaagtcattaatctgatccacagaacatctgaaagaaagaagcagattcatatcactctgtgccaaagagttctcgccctctacaccacataggagggattcaaaaaaattacagctatgctcctttatgccctcctttatgccctgctgggtctcaatcctttcaccaaaatcatcaatcaagaaatttattgtattaatcgatttacgcatgtcagccatcttatgaaagtaagcagtattattatcaccctcatataaccaagagatacttgacttctggcagaaaaaactctcctcagccttagcaagaatttgccattttctggtggcctccaactcaagtgtagcatgaacaacagaagggttggtaagagtaatcctttgacggtggagcacaatagcatgggcctcagagacccttttctcaatatcagagtagttctctctactaaaacaacaaatagggagcttaaggtgcttaagctttttggagaccctgtacatcgcagaaccagagacattgcaagagtaccaattctcacgaatcagctgcaagaaatccgggttatgtaagaaatagttgaagaaccgaaaaggtcgctttgctttcaagaccgctggatctaacaccacctcacaagagctgtggtcagagaaatctggctcaccgaagttcgcgtaagcggatgggaagagagtgttccaatgatcattgaccaaaattctatctatcttttttgccaaaggtctagagctgcacttattccaccaagtgtaagaactacctttgtagacgaggtcatacaaatcagaatcaagcaagcaacttctgaacgcacgaatcttcctgccaatatttgcattgatagcactttccggatttaagatttgattaaagtcgccaagaacaatccacgacctgccaacaacaaccggagataaggcaagctgaaccaactcattccaaagctcttttctggtaccctcctcatttgaagcgtaaacaatagacaccacaaaccaagaaggagaatcaggaagaagaagctcacatgtgatcatttgcagggacctaccaataacaactaccttcacacttggatcccacaaaacccatatttttcccaaaacagagaattcataattctcaacaaaagaccagccaggcaaaaggttagagatgaacttcttctccttaggctgctttacatgtgtctcaatgagacctccaaaaagtggtttattcaaaagaaaccatttcttaaaaccgcggcggtgactggaaatattaaatccgcgaacattccaacaaaagagcttagtacacatacttaagctttggttttgaggcccttgcctcgtagattcctcttctgacgcttagacaaaaccttgatgaaagcctcttcttcagtgtcagtagataacacgtcagaggaatcatcctcaactgcacaaactgtgcctgaacaaatgccaacctcctcattttcagttgcattatcaatgattacagcaaactgtccaacacttgaatctcctttctggaccttatccaaaccgagagagatcccattggtctgaactgaaatagacccaaaaacactatcttcaaccttaagagacttggacttagccacattcttcacagaccaaactaagccaccatcttcctttcctttgacagggagccgagtttgagtctcttgacccagagaagcttcacagaccaaactaagtccaaataataaaatcagtaatttatcaaattgaactttttttctccatcttatacttattatttattgtaaattatgagaattattaaacagacgtatgggcttaggttccttcggacagacgatatttctttctcgacacttccttcttcttctccatgtttttgatgaacacctttaatgatcttttttgcgtagaatcctggcgaacggctataattgtataatcgttggagatctcctaataaatcacagtatctgagattcgaattccaaatccctaggtgtattaatgaacatttggtcaaccaaaccaatgtaccaccaaaggggcttacacgaactttacttttctttaggaagaaaaataaaagtcagttcaaaaaaatacattgtccgtttataatgggcttttaacgttaaagccaagcccataatgatacatgacagcccattcattttagtactctaatttggggtgaataatccgtcccgcgttaaaaaacacagaatcaaaattacttcatatcttcttcacgtgagagtcacgtgttcggtaaaagtggttgaaagttgaaacccattggggaacaaaaacctaaaggagtctcatttctgctgggtcgagaaatcgctgatagagagtagagagacacacgcaggtacgtgaatcttcgcgacttcgatctctttgtgtatcaaatcaatccgttcttgttaaagttttcatttttaatcttccaatttcaatctgggtctacttaaatcaatcgaaatctcaatttcaagctgattcttataaagtttcgatttttcttgctgttttagattttgagctgcgtgctctgttttaagcttgaaggaggaaaaacatg

SEQ ID NO: 18648 - DNA, 3000 bp, Unknown; identical to SEQ ID NO: 2911
  misc_feature (1)..( 3000): 2750-1469P.txt file - cDNA_ID_1818895; gDNA_ID_1620617; Annot_ID_46900

SEQ ID NO: 18649 - DNA, 3000 bp, Unknown; identical to SEQ ID NO: 2918
  misc_feature (1)..( 3000): 2750-1469P.txt file - cDNA_ID_1818895; gDNA_ID_1620617; Annot_ID_162059

SEQ ID NO: 18650 - DNA, 3000 bp, Unknown; identical to SEQ ID NO: 2781
  misc_feature (1)..( 3000): 2750-1469P.txt file - cDNA_ID_1818895; gDNA_ID_1620593; Annot_ID_161473

SEQ ID NO: 18651 - DNA, 3003 bp, Unknown
  misc_feature (1)..( 3003): 2750-1469P.txt file - cDNA_ID_1818899; gDNA_ID_1620617; Annot_ID_46898
ccttaatcgctaagcctttgaatttctgatcatcaccttcctctttcttcttctccgacttaggcttcggaggataaataccgtggattgtagttaacaacgaccggacgaagtaatccggcatctctgcacctgccttccttaagattcttatcgaattcatcgactgtctcagagtgacgacctagatcgataatgaactcagccaaaactttttctgcagatcctagatgcgtttccaattcgttgcagacattggagacgagagagagatgattcaatttgttgagctcttctttttccattgaagaaaccaaaggaagtaacaacaaaaagagaagaagacactgtttctggataatcgacttctttctagggttttttcttatagacgctcgcagagttctgattttgctaatcctatttttttctgaaatagctgactcttaaaacgctgcgttttaatttttaaacatatgtaactttttctttaggatttatatttgggccgatgcaaaacaacttaaagttaatgggctttcgcagttaccttttttgtttttttcctcaatatagctaaccttcaatttgtataattgaaaaacatcagaacggccacgtcgtcgtctctcatcctcctcaaaaactctctcaagagagacaactttctcaataatacatgattttgatttatttttaatcatctttttccagaaaaacagctgagagaacccaatttagtcaccattgaagatgctcttacattgtttagaaaaacagggagataaacaatttatcttttctgaaagaataaacaaattgttgaatttttaatttaaaagaaaagtttaaaaggtttttcaatctaaaaataacgcaacatcatcttaaaaaaagaaatgagtacataatatggtagtgaactccgcatttttagttttctaatgctagtaacatgaaagagtactcagagtagaggtgcgtttatcatttataactctaaaactcaaaacaacttgaatatcttatagagaaataaacagattgttatccccaatacatacacattaatcacaaggtttcttgatcaactaaagatcatatctaactatatccaaatagtattgcaacataaaaataaaatcgttgaaaatcgcaaataagtataccacttattcaaataatactttgttactcttcttaccaatatttttcctaaatatacggaagaagctatcatatgtattggactacttggtaggaaatctttatcaacgttgaatttttattattttgtttatagaataaagatttataaagaagaaaagaactaaaattgtataaaaagttgataataccaataagaaattttcttcagtcatatccacacacaaaaaaaaatcattgaattttaaaaaaggagaaaaattaatcatcatgatgaatgtctttcggttgatatttgatcgtgtacataattcgtcccaacattaacactatgtcaaacgaaaaaataagttttttattgttttattgttggctacaaataggatgctaaattatcaaaactaattgaatcgaaggtgaaatctatgaaaaccaagttaataaatgacatatagttaactaaacactatgccctcaaactaacacttgaattactataatttataattgatgtgaatgagtatgtttattttctcgagcgtatatgcagttatatttgtgtattaggggtcttccaaaaaaaaatttaccacaaaattatatattaaaatatccatgatgggaaatgattgaattaaaatgatctcctctcttactcaagaaaattatgggccgaaaactcaaaatatcttggtaaaaccgaaagaaaatccacctctggttttattttgtgtagttatatcatgatgattttcaaaatacaagttctaaataagtctttttttttttttttctgaaatacaaatttaaactgaagttgttgatcaatatatgatctcccaggtaaataaaaaactatatacatatatgtctatatgatcgatcatcccaatcttccacaatcgatcttatcatgatgcatatcgaccaaattggtccaaagatcatatcttagaaatgttttgaactatttttaatgcatgtcgaccaaacattttttaatcgaaacacacaaattttatactaaccaaactgaatgaaactaaacatattcgaatatttgaaaaccaagctggataaatctattaaatgtttgatggaaaatgtattaaagtttttttgacataaaaggaaaacaaaagccataatggtaagagaagatggtgtccatcacctaactaaccagcctcacctacctcataaaccacatgatgaaatcgagttaccccacgaacacactcagctccatgtttttttaagaactaaaatgtttgatttgatttgtaatatttagtattactgttgacaatttgtatatgtaataaaaattgaagattgatttactttaacataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagacatg

SEQ ID NO: 18652 - DNA, 3003 bp, Unknown; identical to SEQ ID NO: 18651
  misc_feature (1)..( 3003): 2750-1469P.txt file - cDNA_ID_1818899; gDNA_ID_1620617; Annot_ID_162057

SEQ ID NO: 18653 - DNA, 3003 bp, Unknown
  misc_feature (1)..( 3003): 2750-1469P.txt file - cDNA_ID_1818899; gDNA_ID_1620593; Annot_ID_161471
ccttaatcgctaagcctttgaatttctgatcatcaccttcctctttcttcttctccgacttaggcttcggaggataaataccgtggattgtagttaacaacgaccggacgaagtaatccggcatctctgcacctgcttccttaagattcttatcgaattcatcgactgtctcagagtgacgacctagatcgataatgaactcagccaaaactttttctgcagatcctagatgcgtttccaattcgttgcagacattggagacgagagagagatgattcaatttgttgagctcttctttttccattgaagaaaccaaaggaagtaacaacaaaaagagaagaagacactgtttctggataatcgacttctttctagggttttttcttatagacgctcgcagagttctgattttgctaatcctatttttttctgaaatagctgactcttaaaacgctgcgttttaatttttaaacatatgtaactttttctttaggatttatatttgggccgatgcaaaacaacttaaagttaatgggctttcgcagttaccttttttgtttttttcctcaatatagctaaccttcaatttgtataattgaaaaacatcagaacggccacgtcgtcgtctctcatcctcctcaaaaactctctcaagagagacaactttctcaataatacatgattttgatttatttttaatcatctttttccagaaaaacagctgagagaacccaatttagtcaccattgaagatgctcttacattgtttagaaaaacagggagataaacaatttatcttttctgaaagaataaacaaattgttgaatttttaatttaaaagaaaagtttaaaaggtttttcaatctaaaaataacgcaacatcatcttaaaaaaagaaatgagtacataatatggtagtgaactccgcatttttagttttctaatgctagtaacatgaaagagtactcagagtagaggtgcgtttatcatttataactctaaaactcaaaacaacttgaatatcttatagagaaataaacagattgttatccccaatacatacacattaatcacaaggtttcttgatcaactaaagatcatatctaactatatccaaatagtattgcaacataaaaataaaatcgttgaaaatcgcaaataagtataccacttattcaaataatactttgttactcttcttaccaatatttttcctaaatatacggaagaagctatcatatgtattggactacttggtaggaaatctttatcaacgttgaatttttattattttgtttatagaataaagatttataaagaagaaaagaactaaaattgtataaaaagttgataataccaataagaaattttcttcagtcatatccacacacaaaaaaaaatcattgaattttaaaaaaggagaaaaattaatcatcatgatgaatgtctttcggttgatatttgatcgtgtacataattcgtcccaacattaacactatgtcaaacgaaaaaataagttttttattgttttattgttggctacaaataggatgctaaattatcaaaactaattgaatcgaaggtgaaatctatgaaaaccaagttaataaatgacatatagttaactaaacactatgccctcaaactaacacttgaattactataatttataattgatgtgaatgagtatgtttattttctcgagcgtatatgcagttatatttgtgtattaggggtcttccaaaaaaaaatttaccacaaaattatatattaaaatatccatgatgggaaatgattgaattaaaatgatctcctctcttactcaagaaaattatgggccgaaaactcaaaatatcttggtaaaaccgaaagaaaatccacctctggttttattttgtgtagttatatcatgatgattttcaaaatacaagttctaaataagtctttttttttttttttctgaaatacaaatttaaactgaagttgttgatcaatatatgatctcccaggtaaataaaaaactatatacatatatgtctatatgatcggatcatcccaatcttccacaatcgatcttatcatgatgcatatcgaccaaattggtccaaagatcatatcttagaaatgttttgaactatttttaatgcatgtcgaccaaacattttttaatcgaaacacacaaattttatactaaccaaactgaatgaaactaaacatattcgaatatttgaaaaccaagctggataaatctattaaatgtttgatggaaaatgtattaaagtttttttgacataaaaggaaaacaaaagccataatggtaagagaagatggtgtccatcacctaactaaccagcctcacctacctcataaaccacatgatgaaatcgagttaccccacgaacacactcagctccatgtttttttaagaactaaaatgtttgatttgatttgtaatatttagtattactgttgacaatttgtatatgtaataaaaattgaagattgatttactttaacataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagacatg

SEQ ID NO: 18654 - DNA, 3000 bp, Unknown; identical to SEQ ID NO: 2908
  misc_feature (1)..( 3000): 2750-1469P.txt file - cDNA_ID_1818903; gDNA_ID_1620617; Annot_ID_46897

SEQ ID NO: 18655 - DNA, 3000 bp, Unknown; identical to SEQ ID NO: 2908
  misc_feature (1)..( 3000): 2750-1469P.txt file - cDNA_ID_1818903; gDNA_ID_1620617; Annot_ID_162056

SEQ ID NO: 18656 - DNA, 3003 bp, Unknown
  misc_feature (1)..( 3003): 2750-1469P.txt file - cDNA_ID_1818930; gDNA_ID_1620618; Annot_ID_46958
tgtttttttattattattatttaaatttagcattcaaatttttgattagaatttttaaaagttgttttaaatttttgattttgtttattattgggaattttaaaacctattttgtgttttttttttttgaaaattttatttgttggattctaaatttacataatgataaaaattctaaccggattttggatctaatattagtcgttagcgattccaaacattcaacttatattttctattattatgtaaatttaccattcaagtttttaattaggaatttttaaataattaaatgtccgtctttaataggctcctaatccatctttttatttatatatatatatatatatatatatatatatttttaagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagaggaatggcgatgctagttgatcctccaaatgggataagacaagaagggaaacattactacacgatgtggcaaacattattcgaaatcgacactaagtatgttccgattaagccgattggaagaggagcttatggtgtggtttgttcttcaatcaacagcgaaaccaatgagagagttgctattaagaagatccacaatgtgtttgagaatcgcatcgatgctttgagaacattgagagagcttaagcttttaaggcatgtgagacacgaaaacgttatctcccttaaggatgttatgctgcctactcacaggtacagcttcagagatgtttatttggtctatgagcttatggattctgatttgaatcagatcatcaaatcctctcagtctctctccgatgatcactgcaagtacttcttgtttcaggtacgttggttcgatacattttctgtttctcttgttaagctttggtttgatgattgaattgtatctttttgtcgacattgtagttgctaagaggattgaagtatcttcactcagcaaacatccttcatcgcgatttaaagccagggaatctcttagtgaatgctaattgtgatctaaagatttgtgatttcgggcttgcgagaacttatgaacagtttatgacagagtatgtggtcactcgttggtaccgagcacctgagcttcttctctgttgtgataactacggaacctccattgatgtttggtcggtaggatgcatattcgcagagattcttggaagaaaaccgatattcccgggaacagaatgtctcaaccaactaaagctaatcataaatgttgttggtagccaacaagactgggatctccagttcatagataaccagaaagctaggagatttataaagtctcttcctttctcaaagggtactcacttttctcatatttacccgcacgcaaatccgctggcgatagatttgttacagaggatgcttgtgtttgatccaaccaagagaatatcggtcagcgatgcgcttttacacccctacatggagggactgttggaaccggaatgtaacccgtcggaaaatgttccggtcagtagtttggagatagatgagaacatggaaggagatatgatcagggagatgatgtgggaagagatgcttcattacctcccccgagcttaaatcaatattttgtaaaatcatctctctaacacttgtttataactttagtttgtggtaacttgtattcgtcttccatgtttctttgttacgttgttttgtgcggaatgtcattgagatgtatgcgtcaaagtagactttcggttattgaaatttggtctggttatttgatttataccggatccggtttactcccctcgtatgagagaccttcggaactatggagaaggttttgactctctcttcagtgatatgatccgtcgcaaatcggaatctgccggcgagatggttccagtcgtctttgttcccttattgatagaataatcaaaaatccgagtcggagacgacgaagacccgagttccagctattaactatgcagataccatcaagagagcatagtttcattctatttctcttcatatctggtaaaaatcctcgtcgcacgaatttgccctctctcgaatttttgagcttttgaaattttatcttttgggaaatgctgcagcttttgtaattggtgctgcgtctgtacctgtacctgattctaattgctacgctctcgacaattcaagtcgtcttgtcgattttgtatcctctttctattttattaaagcttaggatcaattcttagtaaaaaagtttgctttttgttgcattggtttgatttcgtgtcttgtaaagctgcttcctttaacttggtttgatcagagcagctggatcggtcatccatttgaatatgatggcaaggttgtgtatatgtttctcattttttagtgttgagagttagttttaaggactttggggttgagttggtatg

SEQ ID NO: 18657 - DNA, 3000 bp, Unknown
  misc_feature (1)..( 3000): 2750-1469P.txt file - cDNA_ID_1818930; gDNA_ID_2926211; Annot_ID_141985
ttttttattattattatttaaatttagcattcaaatttttgattagaatttttaaaagttgttttaaatttttgattttgtttattattgggaattttaaaacctattttgtgttttttttttttgaaaattttatttgttggattctaaatttacataatgataaaaattctaaccggattttggatctaatattagtcgttagcgattccaaacattcaacttatattttctattattatgtaaatttaccattcaagtttttaattaggaatttttaaataattaaatgtccgtctttaataggctcctaatccatctttttatttatatatatatatatatatatatatatatatttttaagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagaggaatggcgatgctagttgatcctccaaatgggataagacaagaagggaaacattactacacgatgtggcaaacattattcgaaatcgacactaagtatgttccgattaagccgattggaagaggagcttatggtgtggtttgttcttcaatcaacagcgaaaccaatgagagagttgctattaagaagatccacaatgtgtttgagaatcgcatcgatgctttgagaacattgagagagcttaagcttttaaggcatgtgagacacgaaaacgttatctcccttaaggatgttatgctgcctactcacaggtacagcttcagagatgtttatttggtctatgagcttatggattctgatttgaatcagatcatcaaatcctctcagtctctctccgatgatcactgcaagtacttcttgtttcaggtacgttggttcgatacattttctgtttctcttgttaagctttggtttgatgattgaattgtatctttttgtcgacattgtagttgctaagaggattgaagtatcttcactcagcaaacatccttcatcgcgatttaaagccagggaatctcttagtgaatgctaattgtgatctaaagatttgtgatttcgggcttgcgagaacttatgaacagtttatgacagagtatgtggtcactcgttggtaccgagcacctgagcttcttctctgttgtgataactacggaacctccattgatgtttggtcggtaggatgcatattcgcagagattcttggaagaaaaccgatattcccgggaacagaatgtctcaaccaactaaagctaatcataaatgttgttggtagccaacaagactgggatctccagttcatagataaccagaaagctaggagatttataaagtctcttcctttctcaaagggtactcacttttctcatatttacccgcacgcaaatccgctggcgatagatttgttacagaggatgcttgtgtttgatccaaccaagagaatatcggtcagcgatgcgcttttacacccctacatggagggactgttggaaccggaatgtaacccgtcggaaaatgttccggtcagtagtttggagatagatgagaacatggaaggagatatgatcagggagatgatgtgggaagagatgcttcattacctcccccgagcttaaatcaatattttgtaaaatcatctctctaacacttgtttataactttagtttgtggtaacttgtattcgtcttccatgtttctttgttacgttgttttgtgcggaatgtcattgagatgtatgcgtcaaagtagactttcggttattgaaatttggtctggttatttgatttataccggatccggtttactcccctcgtatgagagaccttcggaactatggagaaggttttgactctctcttcagtgatatgatccgtcgcaaatcggaatctgccggcgagatggttccagtcgtctttgttcccttattgatagaataatcaaaaatccgagtcggagacgacgaagacccgagttccagctattaactatgcagataccatcaagagagcatagtttcattctatttctcttcatatctggtaaaaatcctcgtcgcacgaatttgccctctctcgaatttttgagcttttgaaattttatcttttgggaaatgctgcagcttttgtaattggtgctgcgtctgtacctgtacctgattctaattgctacgctctcgacaattcaagtcgtcttgtcgattttgtatcctctttctattttattaaagcttaggatcaattcttagtaaaaaagtttgctttttgttgcattggtttgatttcgtgtcttgtaaagctgcttcctttaacttggtttgatcagagcagctggatcggtcatccatttgaatatgatggcaaggttgtgtatatgtttctcattttttagtgttgagagttagttttaaggactttggggttgagttggtatg

SEQ ID NO: 18658 - DNA, 3000 bp, Unknown; identical to SEQ ID NO: 18657
  misc_feature (1)..( 3000): 2750-1469P.txt file - cDNA_ID_1818930; gDNA_ID_2926211; Annot_ID_202629

SEQ ID NO: 18659 - DNA, 3003 bp, Unknown
  misc_feature (1)..( 3003): 2750-1469P.txt file - cDNA_ID_1818934; gDNA_ID_1620618; Annot_ID_46957
tagaaaattagaacttgacattattgtccaaagtgggttaaataaatgaatagcattttattaagaaaacattgtatttaaaaacatattaaaaaaatctaatttaaaagtttttaaaaatatatgtcggctgtttgtgtgaatagcatgattatggaatatattttttgtcgaaaaagtagtatttgtcatctagttgtaaagatatatttctgatttttcaaacttttttagatctacattttttttttaataagatttatattcgttaaaaaagagatgataaataaatttattttgaagatgacaaagaaaaaaaaaaattgaagacaaattaacttttattatgtctattttgaagatttttattataaaaaaataaactattttgaagatttttattatgtctctgaccaatggcagagtagggcaaatgccatgggttcattacaaaattcaaaaaaaaaaaaaaaggaaaaaggcccacttttatattaaaaaaatatactaagaggttttaaaattttttttgaattttaccaaaggcccacaaaaaattgagacgggcctaaaataaataataacgtcctgtttagaaaattagaactcgacattattgtccaaagtgggtcaaataaatgaatagcattttattaagaaaacattgtatttaaaaacatgttaaaaaattctaatttaaaagtttttaaaagtatatgtcggctgttttttgaatagcatgattatggaatttatattttttgtcgaaaaagtagtatttgtcatctagttgtaaagatgtatttctgatttttcaaacttttttagatatatatttgttttttgtttctaataagatttatatttgttaaaaagagatgataagtaaatctattttgaagatgacaaaaaaaaacaaaaaacaaaaaaaaatctattttgaagacaaatttttatcatgggtagttaatcttgattttggttaatggagttttggatttttgggtgggagaagagtaaagaggtaaatgctattgaaagatttattaaaggttatttgtcaatgtccatatatacattttttgtacactagcctttagatatttcgagacctacattgaagttggtttagggaaagttgggtaaatctctagataaatttgatatgatcaaattgcgttgaacactagttttaagaaaactaaaattttcaatatggacttgcgatgttgaatcaatgaatctttgtctagaaaaagctgaaatctgtttgagtttggtgaatcaaaaagattactcgatcgagatgctaagatggttcctgaagagttgaaaattattagctttgatggagaaaaagaagttattggagtagttgggaggatcatcaaatcttttttggatggaaaaggcaaagtgaatgccggtttccgtgagaatgtgttgtatcttgtgaatgtctgcctgcgcattgtgtgtctagtcacttaccaaaaatttgagccttatgaagactttggcagtgcaacgactgttgttgcgtccaccatcacgtcgattataactgtgtggttgttgtacaacaagtttgagatggggatatacgacaagatagaagtatttgctgcttggtatttatttattttgtccaaccgctatgaagaaattgtgatgtcggatgacttcgttcatgtattgctgtttttttggattgttaaggtaatattaacatggtctatcttcttctactaactagtttagagatattaacattgttttgtttgttgtaggtgcataatgaagttgcattgctatggaggtttccaaaacttaactatgctaaaatcaattatattctttgtagatcgcatgaaaaaggttagatagaaatcgaatgattggtacaatcttaaataatgatatgaaatctaacttaattttggatctatcattagtagttagcgattgtaaacattcaacttgtttttttattattattatttaaatttagcattcaaatttttgattagaatttttaaaagttgttttaaatttttgattttgtttattattgggaattttaaaacctattttgtgttttttttttttgaaaattttatttgttggattctaaatttacataatgataaaaattctaaccggattttggatctaatattagtcgttagcgattccaaacattcaacttatattttctattattatgtaaatttaccattcaagtttttaattaggaatttttaaataattaaatgtccgtctttaataggctcctaatccatctttttatttatatatatatatatatatatatatatatatttttaagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagaggaatg

SEQ ID NO: 18660 - DNA, 3003 bp, Unknown; identical to SEQ ID NO: 18659
  misc_feature (1)..( 3003): 2750-1469P.txt file - cDNA_ID_1818934; gDNA_ID_1620618; Annot_ID_162143

SEQ ID NO: 18661 - DNA, 3000 bp, Unknown
  misc_feature (1)..( 3000): 2750-1469P.txt file - cDNA_ID_1818934; gDNA_ID_2926211; Annot_ID_141986
aaaattagaacttgacattattgtccaaagtgggttaaataaatgaatagcattttattaagaaaacattgtatttaaaaacatattaaaaaaatctaatttaaaagtttttaaaaatatatgtcggctgtttgtgtgaatagcatgattatggaatatattttttgtcgaaaaagtagtatttgtcatctagttgtaaagatatatttctgatttttcaaacttttttagatctacattttttttttaataagatttatattcgttaaaaaagagatgataaataaatttattttgaagatgacaaagaaaaaaaaaaattgaagacaaattaacttttattatgtctattttgaagatttttattataaaaaaataaactattttgaagatttttattatgtctctgaccaatggcagagtagggcaaatgccatgggttcattacaaaattcaaaaaaaaaaaaaaaggaaaaaggcccacttttatattaaaaaaatatactaagaggttttaaaattttttttgaattttaccaaaggcccacaaaaaattgagacgggcctaaaataaataataacgtcctgtttagaaaattagaactcgacattattgtccaaagtgggtcaaataaatgaatagcattttattaagaaaacattgtatttaaaaacatgttaaaaaattctaatttaaaagtttttaaaagtatatgtcggctgttttttgaatagcatgattatggaatttatattttttgtcgaaaaagtagtatttgtcatctagttgtaaagatgtatttctgatttttcaaacttttttagatatatatttgttttttgtttctaataagatttatatttgttaaaaagagatgataagtaaatctattttgaagatgacaaaaaaaaacaaaaaacaaaaaaaaatctattttgaagacaaatttttatcatgggtagttaatcttgattttggttaatggagttttggatttttgggtgggagaagagtaaagaggtaaatgctattgaaagatttattaaaggttatttgtcaatgtccatatatacattttttgtacactagcctttagatatttcgagacctacattgaagttggtttagggaaagttgggtaaatctctagataaatttgatatgatcaaattgcgttgaacactagttttaagaaaactaaaattttcaatatggacttgcgatgttgaatcaatgaatctttgtctagaaaaagctgaaatctgtttgagtttggtgaatcaaaaagattactcgatcgagatgctaagatggttcctgaagagttgaaaattattagctttgatggagaaaaagaagttattggagtagttgggaggatcatcaaatcttttttggatggaaaaggcaaagtgaatgccggtttccgtgagaatgtgttgtatcttgtgaatgtctgcctgcgcattgtgtgtctagtcacttaccaaaaatttgagccttatgaagactttggcagtgcaacgactgttgttgcgtccaccatcacgtcgattataactgtgtggttgttgtacaacaagtttgagatggggatatacgacaagatagaagtatttgctgcttggtatttatttattttgtccaaccgctatgaagaaattgtgatgtcggatgacttcgttcatgtattgctgtttttttggattgttaaggtaatattaacatggtctatcttcttctactaactagtttagagatattaacattgttttgtttgttgtaggtgcataatgaagttgcattgctatggaggtttccaaaacttaactatgctaaaatcaattatattctttgtagatcgcatgaaaaaggttagatagaaatcgaatgattggtacaatcttaaataatgatatgaaatctaacttaattttggatctatcattagtagttagcgattgtaaacattcaacttgtttttttattattattatttaaatttagcattcaaatttttgattagaatttttaaaagttgttttaaatttttgattttgtttattattgggaattttaaaacctattttgtgttttttttttttgaaaattttatttgttggattctaaatttacataatgataaaaattctaaccggattttggatctaatattagtcgttagcgattccaaacattcaacttatattttctattattatgtaaatttaccattcaagtttttaattaggaatttttaaataattaaatgtccgtctttaataggctcctaatccatctttttatttatatatatatatatatatatatatatatatttttaagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagaggaatg

SEQ ID NO: 18662 - DNA, 3000 bp, Unknown; identical to SEQ ID NO: 18661
  misc_feature (1)..( 3000): 2750-1469P.txt file - cDNA_ID_1818934; gDNA_ID_2926211; Annot_ID_202630

SEQ ID NO: 18663 - DNA, 3000 bp, Unknown; identical to SEQ ID NO: 2955
  misc_feature (1)..( 3000): 2750-1469P.txt file - cDNA_ID_1818948; gDNA_ID_1620618; Annot_ID_46953

SEQ ID NO: 18664 - DNA, 3003 bp, Unknown
  misc_feature (1)..( 3003): 2750-1469P.txt file - cDNA_ID_1818948; gDNA_ID_2926211; Annot_ID_141990
acgtagaagacttctatgtagttcgttgtatagccttattctgtgttatgcttaaagattttgttgggtccatacagtgctgctggaccgcatacaacagttaatggaaaagatgtggtgaattttgcctcagctaattatcttgggctcattggccacgagaagttgctggtaacgtgaagctactttgttttcaatacaatctctcttctgtttgaatagttttatttaagatttgtcttatgccaggaatcatgtacttctgcattagaaaaatatggggtcggttcttgtgggcctcgtggattctatggtacaattggtaagaagacaataattttctaaatagatactttggttcatccattggctcgcttggaaagggttcttactgtttgattacttctcttgactagatgtccaccttgactgcgaaaccagaatatccaaatttttgggtactcctgattcaatcctttactcttatggactttccacaatgttcagcacaattccttgtttctgtaagaaaggcgatgtcattgttgcgtaagtacacaatttcttataacatcgttctacttattagattacgttagtagaaatcccaggattacattgaacatctttgtttgaaacttttttatctcgatattaaactcattcttgtcttttctattttcttagtgatgagggtgttcactggggaatacaaaatggacttcagctttcaagaagtacaattgtgtacttcaagcacaatgacatggaatcccttcgaattacccttgagaaaatcatgacaaagtacaagcgctcaaagaacttgaggcgttatattgtagctgaagctgtatatcaagtacctggcagttttctttcttctcctgcttccatattttgaaaattctccctgaactgtgatgcttacccatttgcctttgggtatgttaaaatctacagaattcaggtcaaattgcgcctctggatgagattgtaaaactaaaagagaagtatcggtttcgtgttatattggatgaaagcaactcttttggtgtgcttggccgttctgggagaggtcttgcagagcatcatagtgtccctgtaagtatgattgacacacattttagtagtgttctcatttgccaaacctgatgctaaaaatttcacggcggtttatctttaaacagattgagaagatagatgttgtgactgctgcaatgggccatgcattagccacagaaggtggattttgcactgggaatgcccgcatcatcgattaccaggtaaacatcgatcatgctgattaactaattacaaacaaaattaaaaaactaccgataatagaaacttttctctgggacgctcaaatgcacagagacttagcagttcaggatatgtgttctctgcttctttaccaccataccttgcaagtgctgctatcaccgccattgatgtcattgatcaaaaccctgatatgttagttaagctgaagcaaaatgttgctctgttatggaaaggtttgatcttcaagttttaatctaatctagcaacaattagagtttgatttagtttgttatcttcctctaattgaaaaagaaatgctgggaacaacgcaggattgtcagatatcaaggggatgtcattaacaagcaaccgggaatcacctattgttttcttaaaattagagaaatctagcggttcagctaaagatgatttgcttctacttgagaaaatggctgaccgtgtaagttcattgtttctttgcaaaaccaaatctagaccctgtccccgtttcttgacatgactagatgcatgcaggctctgaaggaagactcattgttggttgtgagttctaaaagatcatttcttgataaatgccggttacctgtgggaatcaaactctacgtctcagcgggacattcggaatccgatcttcttaaagcgtcggagtcactgaagagacttgcttcagagcttctactcaagtcctgaaacaccgaaactcttttttcttcaagaacaacaacactgaagggaactctttgaacacatccgtgtgagatagtagacaacagaatccgcagagtcagtagcttgaagatgttcatagcagattcctaaactggttctccactttcagtgatgggcttgtggttgatctgaagctcaattgacgaaggaggattatcgaagacaatggcttcttgttcttacatttatttcatttgatcatctgagttctttttttttttttcctactcatacccttcaatgatcaagtagcttagtgttgttgccgaaattcaaaaactttcaatttatgggaaacaaaaaagttcatgtgctgacatcagcctcttaaggctttctgagtttcttgcggtaaaagaaagtgtttttgcctctctcaaatctcaatagtattgacacgtgtcagtataacactcgtgcataattgacacgtgtcagtataacactcgtgggcggtataatgtgaacgaaagagcgagggacaggtaatctctcttcctctgtttctaagtttgtataattagaactgcataacgaaaaacaaaaacaaaacagtgaccaaaaaaagaagaagaatcaatggttggggaaagagagaatatgaggtggagctttacctcgacgttaatggagttgagaatccaatggaacgattttgagagattttcggagcaatctcactctccttttatctttctccttcctctcatttcctctttgcagaggtaatttatcttttaattgtctctctgttttgttctgttttcttaacttcatgttcatcgttatcgttgttcgaatttgatttgtaattagggaatgtgaatttcttacaggaatttggcaaagggcattggctaaaaataataagacactcgttagagtgctcgtccctcgtgcccttacctgcctaattccaactatctggcaaaatcatgactttgatccaaggtatagtaaacaaaaatg

SEQ ID NO: 18665 - DNA, 3000 bp, Unknown
  misc_feature (1)..( 3000): 2750-1469P.txt file - cDNA_ID_1818963; gDNA_ID_1620618; Annot_ID_46948
taacacacgaaacaaacaacagttaggtctctttattatgtatcaaaacagaaaaaactctttatgggggtttaatacctgtagtatacttctccagcatttggatctgttgcaggttttgaaatggattcgacgaggtagtcatcgacattagtagagtctatgtacacctgcaaaaacaagaaaaaactaagtacaaagtaacatacttgagatgaagtctgacagaagttaataagacattacactctttaagacagattcgattcgagaaggttgcttggcttgccagaacaagaacccaagaaccacacgttggaaaatctcttttagcggcttaactataaacttggttatcacagtttcatcagcttcctctcgttttctactctcggctgcaaattgtcccgcagagttcagaagtgcaactcccgtgacttgctcgggtaatccaaccgcaactgacaatgccgtaaatcccccaaggctgtaaagaagtggaagaacttgtttcagacttccttgtggaatgtcaaaaagagcttcaaagaagacattcatttacctgtttccaacgacaacagctggttctttcactacctctttcatgaaatcaataacttgatctgtccaaaccatggcatcatactctatgagagctttgtcactccatccgaaaccgagtaagtccaaggcgtaaaccttgtatttcttagccaattcaggaatgttatacctataaaaatctaccgatattagctcgaattcgtatgataaggtaaaaagttgacttaaagcctacactgatcaatagagcatggaggtgagattgaaggtacctccaatgaaagacagaagcaccaaaaccatgaataagaactagaggcgagccttctccttgaacaacataatgaatcttgtgacctctccattcccaaaagttatagccttctggtttaaaagccaacctctcactacctaaagaatcatccaaattctttttaacaaagatgacatttttagaccaagagagaagcaatagttccaaagctagtttttttttaccttgaacagactgagaagaagcagaagaagtatccatgactgaaactccagaagcaacaatccctcccctaattgcaaaatcccttctgctgatttcacatttgtttccttcattgcaaagattaaacagattgttcataattcaggcttaggggcacatctaaatgaaaggttggagttgaatcttacttggtcgacaaattctagcaggaaagattgatcttttagatgatgatgaactgaataactctgtcctaacagacggtgttaaagcacatgaagcagacatcgattattcacagagaacaacctcgtaaaattttcaaggacaagagaaccagatatttcagaactgagagatgcaaaaaggacaaactttttgagcaccgagtgtatgtgtgaacttgcgggagagttgtggcgacccctgagccagacaagtcgaatccgctcgacgaagcagagtgtttctgaaagttgcggtttttatggtttaacgattaggccggtaatttcgacttagctaaaccggccggttcagccgtatttgtcccaaagatcctgattttttactcatcattttgacaaaagctgtcaagttgatattatcaaacagaactattgatttgtacacaacaagatattgaagcactctttcttaaatttcatgttctctaactctcttcctcagatcttgtctcactgttgcataggtgtgacattcttttgaagtaaacagaaataattgacgtggaatgtgattcctgttatcacatagatccatcattagtgaaaagagcaaacaacacagttttgtaagtaagcaaattagagacgtgatacacacgatctagggccttatactttgatgtgacgaatacgagtgttccttccgttttcgtgattcgacaaaatgcctaattgcaacatgaatgcattgacacaaacttctttacaaaagaatacatcctgaaacccattgaatcaaaaactttctaaaacttttttgtggaaattgcaaaaaacaacagatactctcaacgttaagtattttggcatttgaagcatttactcttctcatctcataagcagcttgttattgatgtttcccaaagaaccaatgaaatggaaacctcaaagcaacctgtacggtgtgttattgaaatcggtctaattttggatatattttttcaagttcttcaaaaaaaaaaaatcgaaatagtattgattctcttgaattatgtcacgcattatagataatgtatagatatataattaatagggaaaaaaagaaagtatagggaccaaacacttagatcaaaagcaatggtgtcgcctaccttcctatcacttatcttcaaacccattttcttctttaggtcgcttattttgtgtccctatcagttatgaattataatatgtgatattataatatgtcatatattcatcgagttgccatctctctaatatatgaaatccacttaaattattggtgtaatctatggattgatgaagggtagtaatcatacgtcacaaggatcacgtatagattcacaacaagacattgaaatgatatcactcatgattcaaaccattgtttctattcatttgcaagttaagattcataattcacattccccacattctccaccttcaagcctaagaaagaccctctctctctctctctctaacaaaacaaattggtacaattagaaggttgtcttaccaaaaactcaatgatttgattttacaaaagaggatatttatatgataataccctcatgaaccttaagttttacaaagtttgattattgttgccaaacaaaaagatcctctcaaaaacttgaaaggccaaaaggaaaaaaaaaaacacagagaaaagacacaaaagagactaacttaagagactcctcatctcatgttcataaggacatg

SEQ ID NO: 18666 - DNA, 3003 bp, Unknown
  misc_feature (1)..( 3003): 2750-1469P.txt file - cDNA_ID_1818963; gDNA_ID_2926211; Annot_ID_141995
tattaacacacgaaacaaacaacagttaggtctctttattatgtatcaaaacagaaaaaactctttatgggggtttaatacctgtagtatacttctccagcatttggatctgttgcaggttttgaaatggattcgacgaggtagtcatcgacattagtagagtctatgtacacctgcaaaaacaagaaaaaactaagtacaaagtaacatacttgagatgaagtctgacagaagttaataagacattacactctttaagacagattcgattcgagaaggttgcttggcttgccagaacaagaacccaagaaccacacgttggaaaatctcttttagcggcttaactataaacttggttatcacagtttcatcagcttcctctcgttttctactctcggctgcaaattgtcccgcagagttcagaagtgcaactcccgtgacttgctcgggtaatccaaccgcaactgacaatgccgtaaatcccccaaggctgtaaagaagtggaagaacttgtttcagacttccttgtggaatgtcaaaaagagcttcaaagaagacattcatttacctgtttccaacgacaacagctggttctttcactacctctttcatgaaatcaataacttgatctgtccaaaccatggcatcatactctatgagagctttgtcactccatccgaaaccgagtaagtccaaggcgtaaaccttgtatttcttagccaattcaggaatgttatacctataaaaatctaccgatattagctcgaattcgtatgataaggtaaaaagttgacttaaagcctacactgatcaatagagcatggaggtgagattgaaggtacctccaatgaaagacagaagcaccaaaaccatgaataagaactagaggcgagccttctccttgaacaacataatgaatcttgtgacctctccattcccaaaagttatagccttctggtttaaaagccaacctctcactacctaaagaatcatccaaattctttttaacaaagatgacatttttagaccaagagagaagcaatagttccaaagctagtttttttttaccttgaacagactgagaagaagcagaagaagtatccatgactgaaactccagaagcaacaatccctcccctaattgcaaaatcccttctgctgatttcacatttgtttccttcattgcaaagattaaacagattgttcataattcaggcttaggggcacatctaaatgaaaggttggagttgaatcttacttggtcgacaaattctagcaggaaagattgatcttttagatgatgatgaactgaataactctgtcctaacagacggtgttaaagcacatgaagcagacatcgattattcacagagaacaacctcgtaaaattttcaaggacaagagaaccagatatttcagaactgagagatgcaaaaaggacaaactttttgagcaccgagtgtatgtgtgaacttgcgggagagttgtggcgacccctgagccagacaagtcgaatccgctcgacgaagcagagtgtttctgaaagttgcggtttttatggtttaacgattaggccggtaatttcgacttagctaaaccggccggttcagccgtatttgtcccaaagatcctgattttttactcatcattttgacaaaagctgtcaagttgatattatcaaacagaactattgatttgtacacaacaagatattgaagcactctttcttaaatttcatgttctctaactctcttcctcagatcttgtctcactgttgcataggtgtgacattcttttgaagtaaacagaaataattgacgtggaatgtgattcctgttatcacatagatccatcattagtgaaaagagcaaacaacacagttttgtaagtaagcaaattagagacgtgatacacacgatctagggccttatactttgatgtgacgaatacgagtgttccttccgttttcgtgattcgacaaaatgcctaattgcaacatgaatgcattgacacaaacttctttacaaaagaatacatcctgaaacccattgaatcaaaaactttctaaaacttttttgtggaaattgcaaaaaacaacagatactctcaacgttaagtattttggcatttgaagcatttactcttctcatctcataagcagcttgttattgatgtttcccaaagaaccaatgaaatggaaacctcaaagcaacctgtacggtgtgttattgaaatcggtctaattttggatatattttttcaagttcttcaaaaaaaaaaaatcgaaatagtattgattctcttgaattatgtcacgcattatagataatgtatagatatataattaatagggaaaaaaagaaagtatagggaccaaacacttagatcaaaagcaatggtgtcgcctaccttcctatcacttatcttcaaacccattttcttctttaggtcgcttattttgtgtccctatcagttatgaattataatatgtgatattataatatgtcatatattcatcgagttgccatctctctaatatatgaaatccacttaaattattggtgtaatctatggattgatgaagggtagtaatcatacgtcacaaggatcacgtatagattcacaacaagacattgaaatgatatcactcatgattcaaaccattgtttctattcatttgcaagttaagattcataattcacattccccacattctccaccttcaagcctaagaaagaccctctctctctctctctctaacaaaacaaattggtacaattagaaggttgtcttaccaaaaactcaatgatttgattttacaaaagaggatatttatatgataataccctcatgaaccttaagttttacaaagtttgattattgttgccaaacaaaaagatcctctcaaaaacttgaaaggccaaaaggaaaaaaaaaaacacagagaaaagacacaaaagagactaacttaagagactcctcatctcatgttcataaggacatg

SEQ ID NO: 18667 - DNA, 3003 bp, Unknown
  misc_feature (1)..( 3003): 2750-1469P.txt file - cDNA_ID_1818967; gDNA_ID_1620618; Annot_ID_46947
tactttcatctaacctatacatctactgaatctaaacaggtctaccacctactctaaacgcgtgccttaccaaaacttggaaaattttcaattttgattatcatgtgggtgaaaaacatcaaaaaattatgttgatgtattatctaaagtcattcacaattaatcaagaagtgtacttgttgtgagactgagagtagctttcacttgtcaatgagtaggtacctattcatttggccaataacaaaatgacaacaaaaatttacctaaaacttaaataatttagtgatttggtcagtaagcctaattaaaccctcaagcagtttacatcacaatcaagcttgaagcttttatttgatttggccaatgaaggagtttataaccctaaaacagttcacatcacaacaaaaccatttgactcgttttctgattaatttggccaatgacgagtcatcttgggcttcacatatggacattgatgttgtgtccatattacgacacacctttatcattttccatttcaaaaaaagaaaacaaaaacacccatgctattttttaaaacacacttaagaaacaaaaatcaaattaaatctttaacccatgatatctactaccaacaactaacaatattttacatcaagtgtgtcgtcaatagtagcactattatctaatttagatctagataaagccagataacactcttttgaactttccatgcttgaatatttcttctataatatcatcattaagaaatcttctcccattctttggcttcttttagaaaagatactctattagattttttagcgagtgaaagaagaataaaagatggaccagtcaacaaatggagacgaacaagtctttatacattgttgataatttgcgtttgcgaaggatgtggtcacaagaaaagaaagtattccgtccctctctctagctaatggcgtgtgatgtgactactacactctctcttctatacatgtttattttttccagaaatgtctgtttgaatataaactttttaagtgaaattgttgggcacaacagaaaactttaacaccaaaaaaaacgcgacataacatgttgcattgttgattagtttctttctactagagattagcattctcagactccgaacggtgactgcgttttacagtgcggaaaaaatgcggtacggtttaaatattaacgaaaatacataaatacatatgtataaatagagattttaatactgttatagcactgttgcggtacggttttgggtgcggttttgatcaccatttacagttttttttattcagattagatttctgtaggtaattttgattaaaatcttttggtgataacgcagtcttttcgtctggactggacccacgcgaggacccaaaatttgaccaatatgcgatccaataaacaaaaaaatggtaatttaaaatgaaataatccacatgtatgatgtcaaatgtattattttacattcacaattaaatacaggtcagcgaagtaattgttttgacaataaaaatggtaagaattacttggaacgtcatctaacatcattttaattaatactaacatcatcattttaagtaaacaatttttttagaataatagacagaaattaaggtggagttcatctttttgataattagcattaatccctactctaccatgtttataattgaaatcattatttcatattttgataattagaattaatccctactctaccatgtgtataattaaaatcacaatttcatgaaaaagatcaactaacttaaccaaaactatagtcaatgtcttttactgaaaaattcaagaataaaacaatcttagttacgtcactatcaatctccattagaaagaatggtttaaaatcattagtttttaacaaactctaatcatgattattaaaaaaaccaaagaagcaaggaagacttttattcaaaagattaaattttcttccatttaaaaaaggaataaaaagagatgtcaaaataattactacaaaaaacattagaatttgttggatatgtaattgacctaagaccataacgagcactcagacctcgtcctttcaatttagtctgcgcttgacacggcactcttaaaaataaacacggtgacgtagacgccgtcaccgtccaatctcatcgtcccttttttaattagcagctcaacgatttaaaatcgactgtcatttacaaaggctgtcatttcaacactcttcagtccttcttccttataatcctctcatcttctttttctccaggtttttaccaaccagttttttttttttcaaccctcgagatctttctttgcacgaacaaacctcgaaaaactcattctttatcttgacccatctgaaaaagtttctctttttttgtcggaataccatagagtttcattattttcgttttagggttctttttttgtaataaataattggaagcagaggagctatgctcaagttctcagatgaaattctcgcttttgatcatcagttcttgtttctctttctgatttacgctggatttgcaagggaaacactctgactttgtcaggactcttctgtgaaattctgcaagtttatgacttttctagtgctttttaactgtttgtgagtttgaagaaaacaaatttcaattgagttgctttggaatccgttgacataatagggtaagtcaattttcttactactaatatttatcccattaatgcttgagaattgttcctaatagaactctttttgctgtttgttaaatttgcagaatttagaaacttctcgtttagatgaggatcgattacacagaacggatgcctcaatcctataaggtttgttgttttatcaaatatgtcttatgatggagttttggtgtcttaaggtttgttactgtaatgactgacatgttgtgttgttctgtttcagatgcactcttccattgtgcttagaattgaagaggctagttgatagaatcatgagaatctttcctgatatagaagatg

SEQ ID NO: 18668 - DNA, 3000 bp, Unknown
  misc_feature (1)..( 3000): 2750-1469P.txt file - cDNA_ID_1818967; gDNA_ID_2926211; Annot_ID_141996
tttcatctaacctatacatctactgaatctaaacaggtctaccacctactctaaacgcgtgccttaccaaaacttggaaaattttcaattttgattatcatgtgggtgaaaaacatcaaaaaattatgttgatgtattatctaaagtcattcacaattaatcaagaagtgtacttgttgtgagactgagagtagctttcacttgtcaatgagtaggtacctattcatttggccaataacaaaatgacaacaaaaatttacctaaaacttaaataatttagtgatttggtcagtaagcctaattaaaccctcaagcagtttacatcacaatcaagcttgaagcttttatttgatttggccaatgaaggagtttataaccctaaaacagttcacatcacaacaaaaccatttgactcgttttctgattaatttggccaatgacgagtcatcttgggcttcacatatggacattgatgttgtgtccatattacgacacacctttatcattttccatttcaaaaaaagaaaacaaaaacacccatgctattttttaaaacacacttaagaaacaaaaatcaaattaaatctttaacccatgatatctactaccaacaactaacaatattttacatcaagtgtgtcgtcaatagtagcactattatctaatttagatctagataaagccagataacactcttttgaactttccatgcttgaatatttcttctataatatcatcattaagaaatcttctcccattctttggcttcttttagaaaagatactctattagattttttagcgagtgaaagaagaataaaagatggaccagtcaacaaatggagacgaacaagtctttatacattgttgataatttgcgtttgcgaaggatgtggtcacaagaaaagaaagtattccgtccctctctctagctaatggcgtgtgatgtgactactacactctctcttctatacatgtttattttttccagaaatgtctgtttgaatataaactttttaagtgaaattgttgggcacaacagaaaactttaacaccaaaaaaaacgcgacataacatgttgcattgttgattagtttctttctactagagattagcattctcagactccgaacggtgactgcgttttacagtgcggaaaaaatgcggtacggtttaaatattaacgaaaatacataaatacatatgtataaatagagattttaatactgttatagcactgttgcggtacggttttgggtgcggttttgatcaccatttacagttttttttattcagattagatttctgtaggtaattttgattaaaatcttttggtgataacgcagtcttttcgtctggactggacccacgcgaggacccaaaatttgaccaatatgcgatccaataaacaaaaaaatggtaatttaaaatgaaataatccacatgtatgatgtcaaatgtattattttacattcacaattaaatacaggtcagcgaagtaattgttttgacaataaaaatggtaagaattacttggaacgtcatctaacatcattttaattaatactaacatcatcattttaagtaaacaatttttttagaataatagacagaaattaaggtggagttcatctttttgataattagcattaatccctactctaccatgtttataattgaaatcattatttcatattttgataattagaattaatccctactctaccatgtgtataattaaaatcacaatttcatgaaaaagatcaactaacttaaccaaaactatagtcaatgtcttttactgaaaaattcaagaataaaacaatcttagttacgtcactatcaatctccattagaaagaatggtttaaaatcattagtttttaacaaactctaatcatgattattaaaaaaaccaaagaagcaaggaagacttttattcaaaagattaaattttcttccatttaaaaaaggaataaaaagagatgtcaaaataattactacaaaaaacattagaatttgttggatatgtaattgacctaagaccataacgagcactcagacctcgtcctttcaatttagtctgcgcttgacacggcactcttaaaaataaacacggtgacgtagacgccgtcaccgtccaatctcatcgtcccttttttaattagcagctcaacgatttaaaatcgactgtcatttacaaaggctgtcatttcaacactcttcagtccttcttccttataatcctctcatcttctttttctccaggtttttaccaaccagttttttttttttcaaccctcgagatctttctttgcacgaacaaacctcgaaaaactcattctttatcttgacccatctgaaaaagtttctctttttttgtcggaataccatagagtttcattattttcgttttagggttctttttttgtaataaataattggaagcagaggagctatgctcaagttctcagatgaaattctcgcttttgatcatcagttcttgtttctctttctgatttacgctggatttgcaagggaaacactctgactttgtcaggactcttctgtgaaattctgcaagtttatgacttttctagtgctttttaactgtttgtgagtttgaagaaaacaaatttcaattgagttgctttggaatccgttgacataatagggtaagtcaattttcttactactaatatttatcccattaatgcttgagaattgttcctaatagaactctttttgctgtttgttaaatttgcagaatttagaaacttctcgtttagatgaggatcgattacacagaacggatgcctcaatcctataaggtttgttgttttatcaaatatgtcttatgatggagttttggtgtcttaaggtttgttactgtaatgactgacatgttgtgttgttctgtttcagatgcactcttccattgtgcttagaattgaagaggctagttgatagaatcatgagaatctttcctgatatagaagatg

SEQ ID NO: 18669 - DNA, 3000 bp, Unknown
  misc_feature (1)..( 3000): 2750-1469P.txt file - cDNA_ID_1818973; gDNA_ID_1620618; Annot_ID_46945
attaacaaaaaaagtaacacgaaaataaaattattacatgtatccagatttttttcgtgtattcaaaaatgatttggcggcttttactttttacttacaatattgcagccaaaatagtcgtctccggacaattacgtgcagtgtcaggaggcaaaatgaattatttttgtaatactacattgtattttatccccaaaaacagaagttaaggttctgatgtttatgatgacatcaaaatacgtggattcgggaacatatatggtaattaaacaatggaaatttcatttgcatgcatttaatttgtgcccccataataacgccaccatgagatttctttatatttaacctcgaaaagaagtaattaagagcatcttcgaaacgtcaaatgaggtccacttcaaaaggatcaggtaagatcggaatctaatcaaataaagaagaaaagagaatttgtcccccctatggactgagacaacaacaatattattagtcccgtcattagatagggaggtagtactattagtccatactgtaatatatatacagtattaggaaccccacattatacgtaaaaaatatccgcaaatgcattgttaattgagtacgttgaacattgacatataggttaaatgggtatagggtaaaaccccatatatggcctgttcaaataatgaaatcgttatcaaaatcactggaaaaagcaagtttttcgttcttaagaaatcataataaacctaactgatcaaacccaacgtaatctcaacgtattttgggtacaaatttgctataagaaatcacatgactagccaaaagcggacatagaaacaacttattcatacaaaacttggaagcaggaatagtttagacgttcgtaatggaagagtaatgaatgtgagtgcttagcataagcaatgaaggcgtagacgtgaagttacggatccaaatggaagagtccaaagaaatattccaagaaggcaagttgttgagtgggaagatgaagttgaaaggagatgagtatctgccaaaagaatgttttatcacaaagcttagaatagagaccaaaagggtactacgagagctgatatttttaaactttttggagaagaaatacagtccatatcttcatctttttgttattttatatcttataataataagtacaataaaacatagcgagtggagagggatcagagtagttaaacaattaatgtccaaaacaaaggagcagaagaagcgtaggaaaggcgcagatgtcgtcgataaaattcatctacgagatcttcccaagatttggaatttgtccacttgtattgccactcaatgttaaataagagagaaatataaacaagaacacctgaatatcctcgaaaaggtgctgttttttttcttttctttttttcgtttgtgtcatgcattactaaaccaaagctaaatatgcatctcgtatatgaacaaactaaacacacacacaaaaaaaaaaaaaaaaaaaacactttgttggagtgtctttgtaaaagtacttaatttatatcttacgcttgtgtatatctttagaattactatcattaaaatatcttttaagggttatacacaaaaataattctgttaagttttaataaagttgcaaacaaataatatgacaagtattgacaatttttcgtacagaactgtttcaactcattctccggattttatgtatataaaattaatttttaattaagcattagaaaacattttgaaatagaacaatttctagaattttatctccatgctttacagttttatatccacgttaattttttttatgcatgcgccaaacggagtacatctttaaaaaggagtggtatgcaacaaaagtagctgctcaagtttactataaggtttaaatcagccaatcttcttagcccattttaagaaaagaatgacaaagcaaatattcctatacctataaaagataaatattgactaatttgatgacgaattaatcaataatactataacctaacaaggttcggttcttatcatcttatggttgccaaagaatgtttttgtgatcacggtccagaggattacatgtttaggggctaatctttcattattaattaagccaaatcacttcttagtactactctgatatttgtcttctcattggaaggaatataatttaaagctaaagagcatcaagccatgtaaagagtttgatgatattcactaataagggttgcatgcacgagtttctgttcttatcaacagatgctcaacacgagccaaatgtataaaagagatcactcagataattctattaccaaatttgctataagagccatgagacaagaatggcaagaatcgacgaagtgggattgtgttttatttttatgacattaccaaatgacttcgactatatatggcatctacgaaaagacatatcatcactaacctatccatcataaacagatatttgatatttccaatcaaaatggatggagatcaaaagaagcatcaaacataatctaacaatgtcatgtgtttataataagcatccgatactacggtctagtgatgactagatctatacaagagccttaaagaggtaagggaaggtccacaaacatgcatgggttactgacttagtcgtttactgtacggaaatatagtagcaattaatacaaaagaaaaacggggaagaaaacatcttatatttctctattgcaaggtcaaggaatctcaagtttcattggattgtttcacaattgtgtgtaccttctctaagactttatgtggttgctaaaagaaatagtcactctcttaaagtatatattcttccaactggcttaaccccacaccatgctttttcctcctacttataaggagcttctccttctcttagctaaccaaatcaactccttttttatcaagtcatagatacatcttccttcttatttttttctccctcccaagaagcagatcttgtactctcgatatacatacttattttatatg

SEQ ID NO: 18670 - DNA, 3003 bp, Unknown
  misc_feature (1)..( 3003): 2750-1469P.txt file - cDNA_ID_1818973; gDNA_ID_2926211; Annot_ID_141998
aaaattaacaaaaaaagtaacacgaaaataaaattattacatgtatccagatttttttcgtgtattcaaaaatgatttggcggcttttactttttacttacaatattgcagccaaaatagtcgtctccggacaattacgtgcagtgtcaggaggcaaaatgaattatttttgtaatactacattgtattttatccccaaaaacagaagttaaggttctgatgtttatgatgacatcaaaatacgtggattcgggaacatatatggtaattaaacaatggaaatttcatttgcatgcatttaatttgtgcccccataataacgccaccatgagatttctttatatttaacctcgaaaagaagtaattaagagcatcttcgaaacgtcaaatgaggtccacttcaaaaggatcaggtaagatcggaatctaatcaaataaagaagaaaagagaatttgtcccccctatggactgagacaacaacaatattattagtcccgtcattagatagggaggtagtactattagtccatactgtaatatatatacagtattaggaaccccacattatacgtaaaaaatatccgcaaatgcattgttaattgagtacgttgaacattgacatataggttaaatgggtatagggtaaaaccccatatatggcctgttcaaataatgaaatcgttatcaaaatcactggaaaaagcaagtttttcgttcttaagaaatcataataaacctaactgatcaaacccaacgtaatctcaacgtattttgggtacaaatttgctataagaaatcacatgactagccaaaagcggacatagaaacaacttattcatacaaaacttggaagcaggaatagtttagacgttcgtaatggaagagtaatgaatgtgagtgcttagcataagcaatgaaggcgtagacgtgaagttacggatccaaatggaagagtccaaagaaatattccaagaaggcaagttgttgagtgggaagatgaagttgaaaggagatgagtatctgccaaaagaatgttttatcacaaagcttagaatagagaccaaaagggtactacgagagctgatatttttaaactttttggagaagaaatacagtccatatcttcatctttttgttattttatatcttataataataagtacaataaaacatagcgagtggagagggatcagagtagttaaacaattaatgtccaaaacaaaggagcagaagaagcgtaggaaaggcgcagatgtcgtcgataaaattcatctacgagatcttcccaagatttggaatttgtccacttgtattgccactcaatgttaaataagagagaaatataaacaagaacacctgaatatcctcgaaaaggtgctgttttttttcttttctttttttcgtttgtgtcatgcattactaaaccaaagctaaatatgcatctcgtatatgaacaaactaaacacacacacaaaaaaaaaaaaaaaaaaaacactttgttggagtgtctttgtaaaagtacttaatttatatcttacgcttgtgtatatctttagaattactatcattaaaatatcttttaagggttatacacaaaaataattctgttaagttttaataaagttgcaaacaaataatatgacaagtattgacaatttttcgtacagaactgtttcaactcattctccggattttatgtatataaaattaatttttaattaagcattagaaaacattttgaaatagaacaatttctagaattttatctccatgctttacagttttatatccacgttaattttttttatgcatgcgccaaacggagtacatctttaaaaaggagtggtatgcaacaaaagtagctgctcaagtttactataaggtttaaatcagccaatcttcttagcccattttaagaaaagaatgacaaagcaaatattcctatacctataaaagataaatattgactaatttgatgacgaattaatcaataatactataacctaacaaggttcggttcttatcatcttatggttgccaaagaatgtttttgtgatcacggtccagaggattacatgtttaggggctaatctttcattattaattaagccaaatcacttcttagtactactctgatatttgtcttctcattggaaggaatataatttaaagctaaagagcatcaagccatgtaaagagtttgatgatattcactaataagggttgcatgcacgagtttctgttcttatcaacagatgctcaacacgagccaaatgtataaaagagatcactcagataattctattaccaaatttgctataagagccatgagacaagaatggcaagaatcgacgaagtgggattgtgttttatttttatgacattaccaaatgacttcgactatatatggcatctacgaaaagacatatcatcactaacctatccatcataaacagatatttgatatttccaatcaaaatggatggagatcaaaagaagcatcaaacataatctaacaatgtcatgtgtttataataagcatccgatactacggtctagtgatgactagatctatacaagagccttaaagaggtaagggaaggtccacaaacatgcatgggttactgacttagtcgtttactgtacggaaatatagtagcaattaatacaaaagaaaaacggggaagaaaacatcttatatttctctattgcaaggtcaaggaatctcaagtttcattggattgtttcacaattgtgtgtaccttctctaagactttatgtggttgctaaaagaaatagtcactctcttaaagtatatattcttccaactggcttaaccccacaccatgctttttcctcctacttataaggagcttctccttctcttagctaaccaaatcaactccttttttatcaagtcatagatacatcttccttcttatttttttctccctcccaagaagcagatcttgtactctcgatatacatacttattttatatg

SEQ ID NO: 18671 - DNA, 3000 bp, Unknown; identical to SEQ ID NO: 2965
  misc_feature (1)..( 3000): 2750-1469P.txt file - cDNA_ID_1818976; gDNA_ID_1620618; Annot_ID_46944

SEQ ID NO: 18672 - DNA, 3003 bp, Unknown
  misc_feature (1)..( 3003): 2750-1469P.txt file - cDNA_ID_1818976; gDNA_ID_2926211; Annot_ID_141999
taagaaagcattcataaataatagacatgcactctccagtttcttatgcgtgtcttcttgtttcaccaggccagagaaaaaaaaaatctagctttatgatatagtaaacaccaccgtttcccatatctatgaactgtcccaacttctaactgtggggccaaaagcaatctagtaacagagaattcaaaagttagttttgtcaagttcttgaaattgatcattagcccattagctctatatatatatataaaaagtcatagacgcaaaaagccatttcctggtgaaaagatgaaaagcttccatccatctttttatatgtcttttagcaaacaaaaatcaaagtcccacatagtgataggctgatagcatgttccatgtttcttgtctttaccattgcaaaaactactccacttacatagatagtattttgcccccaaaaaacaaaaacataaatagtataacgtaacccccttctctactaacttttggttagcctatagttaaagttcagaattattaaaattgctaaatttgtgtaacaagattatctagctgatttcttcattttgatatctacatctttttagtcttttgaagtagttaactcatctggattttatgtcttgcaggctctactgaagtggacatggttccaaaaccattcacaaagcacatctaagcaaagatatctaaatgtatttacttgtttttgtgttacgaatatgtaagaattatctaaatcaatcaatgtggtttcatatagtataaagtattaacaatcggacaaactatagttctccttgaattccatccatacacaaatctttacaaatcgatctaagtctaacaaacaagatcgataggccaaatatcaaaactcctgaaaaaacgattcagaacatgttttgattcacttttgcactcatctcgtcgttttggcgcgtagcctgatgagaatctccatgaacattgtaatttgaggaaatttgatacggtttcgcagaaaaatcaagagatcatcaaataaaagtaatagagtagaaaattgtgtatttacttacggataaatcaatactggatcgtttagttctcgtcagatacctcatatacacgcgtctgtgtttggggggaaactttttgcatgggatgtaatttgaatacaaacgggctaaaatcgacggtggtcataactattgtccccgaaaatgtagcgttcttattttgttttgtttttttaactttcgttgtcatataaatatcatagctttatttatggttttcgtttataatatttgcgttgatgaaaattaaaacaactactataactaaggagagtacatgcactcatgcatgcatgcaaacacggcatatcgtaaaattgtaaataagcaaattcatttatcgtgtgtttttaaaacaaacaaaaaatgttatttttataagataaaacactattttacaagatattataatatttttatttttaagtgataaagagtaacagaaacgatagattacctattacaatttttcttaatactaaatttgaaagtcaagatgagaggtccctattgagctataaactttttgtcaatttgattcatctcgagtattattcgttttgtgcaaaaaaataataaaaaaatacattacatatacctttctaaaagaaaagaagagctcaagaggggtatatatattctgtaatatgttagagcacatgccttgtataccgaaaaattgcgacccatatatgaaccatgacggataattggatttatacagtccatattaataattacaattcgaattcgtttaagaaaaagaaaagacaaactattatctgtttttttctgaaaaagagagacattattctgtaatattttaaagcacaagtctcgtatatattcctggcacaaaatagcgacccatagtcccatactaacaacaatgaagaactaaataaataaaaatttgaaaactaaaaaaccgtaaatgtctttcagttatttatagaaaatactgcgttcaaaatcgttgcaagtagaactagacaagaactaacgtttttttcaaaaaaaagcattaaacaaaagataattttacagtcaaagtgattaaagttgtggatttttttatacggtgcatgcataaccatttatttcaacttcgaacttcatctttcaactaaatggatgaaattacaattatataaaaaaaaaaatgtttagtttaaaattatgtagtataattaagtggattagatttgtacttaaaaatatgacaaaaatagtagaatatagccgatattttaaacttataaaaatttcaagtacgtacgttcgaataatccttatatccataatccactagctcaaatggtgtgtttttgtttgatattcctgcgagaatatactaatcagtatttggtcgttttaataatttgaatgtggattgtggaataatttcttctaactatattaattatctgaagaacaattatcttacgtacccgtgatctacacaaacggaatcttataaatatatatctttcgtcgctgagtggaggagaacaaaacttagcaaacttcaaacatttttttaaaaaccaaaattttacactaatggtttagtcgtggttcgagttaagaaaaaaaagaatctgtttagaacatggcccaataatagttcctatgaaaatatgctttttgattattctccaagcaataataagcccaattatatttaggcccagatctgctttttgattattctccaagcaaagtaaacttatacggtcgagattttattatcattttattttttgtccttttgaaaaataccgtttaaaccctaaaagctaactgccaccgtgggtttatggtcggcaaaacccagaaatcgaccatcattcaccgtcaatttcccaactttcatgaacctttagctctatttctcaatctctgaataagggtcaatcttttctttttatcaaaatcgatg

SEQ ID NO: 18673 - DNA, 3003 bp, Unknown
  misc_feature (1)..( 3003): 2750-1469P.txt file - cDNA_ID_1818992; gDNA_ID_1620618; Annot_ID_46938
ctagagtagctagctcctggagaagtaatacgagtatcgaaggtctctgatttttgatatgatggcgtttggactcgattcgagcctgcagtttcgattgatatatactctgttgttgtatcatttcgtacagtagttttttttagacttttgcattctgatgggatctttcaaatttaataagtcagtttcagtttatgcattgatcattgtttgatatcatacaactctgtggtgttactacttcaaattagttctatttgatgattttatatataaatttcaagtttgatttatatctaatttggttttattaaactcttgcaaccgtgggctttccgtcttcaggatgcttcaagtggggtggaatattggagcgaccatattagaaatgattctcggtagcccatggagttgatccaaataggcaaggtttgtgctaatagatctgtaagctcaaaatggtagagctctcattatgagaggttggtggttcgaatccatccagatctgtcgactttctatcctcttttacctttatcatgtcattgtataacacaatatttcaaatctatgtgtgttgaatatgatctgccgatgttattgctaaaaccagggcagccgtaaaagggcctctgtaaaatttagcatctgccacggaggaaggtggaattgatcatttttaaagcaacggcgtctaaacatggactgacatcctaagtcctaactagttgtgttatttggactacaagcaataagcaaggagcataattcacttaacagtaataaaaaaacatactaatgaaagatgactgcaaaactctgttaatcattgttgggttatgatatttatcaaggctaactcattcaccatctctatgtattcgtcatttcttagttgataaagaatatttttataatataaaaaaaaagttaaggtaattaatttcatattttttaaaggaactttaaaaattcatgtactttcttaaacaaacaatgtcatattgaatatatggtttaaatatgttatatatagaggtggacaatccggtttacttggtttggtttttaggttttagaaagagtgaaaaccagtgttacattttcgttttgctataatgctagtttttttttttttttttttttttttaaaacctagtattaataatttctaataataatttgtgtgatacagactattcaatattataaatacctttcattcatatagataacattatgcatataaagttttgttaaattccagttgattgaggtcggcaacatttgaatactaatattttttatgtggtaacaagtaacaacaacaatttaacaacaactgataagatgttctttcgattatatgaagaaaacgtcgactccaaatacagagaaactatcaatataaaataacattattctcagtgtatacctatttgatagaagaccaatatatatcttggtagaagagatgatatgaaagtatcagattaagaaaagatttggtgtcggattaacgtcacatggtgttattttaaattgtatgccatttaataatcgtccattgtcaatgctgttaatataatacaaaaccaaatatatgttaactaacatagtccaggaaccgtttaatttgattaaaccaaatcatacgcacatgattgcgatgataaaccgaatctttaatattataaaaatcaatagatcgagtaaaacgttacattttaattattattattagctgatgctgtcctttatggacttttcttcttcgtttttttgttcttctacctaaaaccatgaaagagtggtttgcacataaatacataatgaatatagtatgaaaaaactgttacatttttttaattattttgaagctaattagtgaactcaataagttttctaatcataatttacctgttctctatcgtgacacaataaacaaagacagataagagttagttaaacgtgaaagaaggttagaattttggaaaatgaccaaatttgttattacttcaccaaattcggatcttgtcctcttgtcataaaatcatttcagatctgagttatttggtccaacgccaatactgaaaattaatgttattaaagtaaatcatatttattattttcaaccaatggggcctttcacaataacaaacaaagggccagctttaaagttttattgaaattttacatgccacataaattggttaaaatacattttcttcacgtttctcgctttttaagtccctttgaagtgggaatgatactcgcgtgacgaccaaactccatcgagcctctctctctctctctgtgatcagtttaatctactgaaagaaagaaagaaagaaagaaagatccgtattattaggtaagaatgagattcccttttacgtttcgattttgattcgtttgtgtttgattctcgatcgttttgcttcgatttagcttccttctgtttttacaagtctctcttgattagaaatgtttaggtttcaatgtttcatgatcatatttagaaaaaagtttcatggtgaccaaaaaagaaagaaaattttgatggctgagagatgtcagagtcttgttttgtttttttgataaattctctgtttgtgtgcttttaaaaagtcaaatataagaaattctttgaatcatttaaagccgtatttatgtccttttgacaagtcgatttaatgctttctagaagagagtttatcagatgttaagaagattcaaagttggattataacgaaaatttgtatacctcattagagatttttcaagtggtaaatactaatagaattcatgatcccgttttagatgtaagatttggttgtgtttatcagttttctattaatagccgatattattaaaaccttttgcttaatcttggatctgatttaatttgctttaaattggacttgaaagaaatctgaatttgatttgatcgtttctaggcttcgaagctgtctcaagattgttgtttaattaaacatg

SEQ ID NO: 18674 - DNA, 3003 bp, Unknown; identical to SEQ ID NO: 18673
  misc_feature (1)..( 3003): 2750-1469P.txt file - cDNA_ID_1818992; gDNA_ID_1620618; Annot_ID_162119

SEQ ID NO: 18675 - DNA, 3000 bp, Unknown
  misc_feature (1)..( 3000): 2750-1469P.txt file - cDNA_ID_1818992; gDNA_ID_2926211; Annot_ID_142005
gagtagctagctcctggagaagtaatacgagtatcgaaggtctctgatttttgatatgatggcgtttggactcgattcgagcctgcagtttcgattgatatatactctgttgttgtatcatttcgtacagtagttttttttagacttttgcattctgatgggatctttcaaatttaataagtcagtttcagtttatgcattgatcattgtttgatatcatacaactctgtggtgttactacttcaaattagttctatttgatgattttatatataaatttcaagtttgatttatatctaatttggttttattaaactcttgcaaccgtgggctttccgtcttcaggatgcttcaagtggggtggaatattggagcgaccatattagaaatgattctcggtagcccatggagttgatccaaataggcaaggtttgtgctaatagatctgtaagctcaaaatggtagagctctcattatgagaggttggtggttcgaatccatccagatctgtcgactttctatcctcttttacctttatcatgtcattgtataacacaatatttcaaatctatgtgtgttgaatatgatctgccgatgttattgctaaaaccagggcagccgtaaaagggcctctgtaaaatttagcatctgccacggaggaaggtggaattgatcatttttaaagcaacggcgtctaaacatggactgacatcctaagtcctaactagttgtgttatttggactacaagcaataagcaaggagcataattcacttaacagtaataaaaaaacatactaatgaaagatgactgcaaaactctgttaatcattgttgggttatgatatttatcaaggctaactcattcaccatctctatgtattcgtcatttcttagttgataaagaatatttttataatataaaaaaaaagttaaggtaattaatttcatattttttaaaggaactttaaaaattcatgtactttcttaaacaaacaatgtcatattgaatatatggtttaaatatgttatatatagaggtggacaatccggtttacttggtttggtttttaggttttagaaagagtgaaaaccagtgttacattttcgttttgctataatgctagtttttttttttttttttttttttttaaaacctagtattaataatttctaataataatttgtgtgatacagactattcaatattataaatacctttcattcatatagataacattatgcatataaagttttgttaaattccagttgattgaggtcggcaacatttgaatactaatattttttatgtggtaacaagtaacaacaacaatttaacaacaactgataagatgttctttcgattatatgaagaaaacgtcgactccaaatacagagaaactatcaatataaaataacattattctcagtgtatacctatttgatagaagaccaatatatatcttggtagaagagatgatatgaaagtatcagattaagaaaagatttggtgtcggattaacgtcacatggtgttattttaaattgtatgccatttaataatcgtccattgtcaatgctgttaatataatacaaaaccaaatatatgttaactaacatagtccaggaaccgtttaatttgattaaaccaaatcatacgcacatgattgcgatgataaaccgaatctttaatattataaaaatcaatagatcgagtaaaacgttacattttaattattattattagctgatgctgtcctttatggacttttcttcttcgtttttttgttcttctacctaaaaccatgaaagagtggtttgcacataaatacataatgaatatagtatgaaaaaactgttacatttttttaattattttgaagctaattagtgaactcaataagttttctaatcataatttacctgttctctatcgtgacacaataaacaaagacagataagagttagttaaacgtgaaagaaggttagaattttggaaaatgaccaaatttgttattacttcaccaaattcggatcttgtcctcttgtcataaaatcatttcagatctgagttatttggtccaacgccaatactgaaaattaatgttattaaagtaaatcatatttattattttcaaccaatggggcctttcacaataacaaacaaagggccagctttaaagttttattgaaattttacatgccacataaattggttaaaatacattttcttcacgtttctcgctttttaagtccctttgaagtgggaatgatactcgcgtgacgaccaaactccatcgagcctctctctctctctctgtgatcagtttaatctactgaaagaaagaaagaaagaaagaaagatccgtattattaggtaagaatgagattcccttttacgtttcgattttgattcgtttgtgtttgattctcgatcgttttgcttcgatttagcttccttctgtttttacaagtctctcttgattagaaatgtttaggtttcaatgtttcatgatcatatttagaaaaaagtttcatggtgaccaaaaaagaaagaaaattttgatggctgagagatgtcagagtcttgttttgtttttttgataaattctctgtttgtgtgcttttaaaaagtcaaatataagaaattctttgaatcatttaaagccgtatttatgtccttttgacaagtcgatttaatgctttctagaagagagtttatcagatgttaagaagattcaaagttggattataacgaaaatttgtatacctcattagagatttttcaagtggtaaatactaatagaattcatgatcccgttttagatgtaagatttggttgtgtttatcagttttctattaatagccgatattattaaaaccttttgcttaatcttggatctgatttaatttgctttaaattggacttgaaagaaatctgaatttgatttgatcgtttctaggcttcgaagctgtctcaagattgttgtttaattaaacatg

SEQ ID NO: 18676 - DNA, 3000 bp, Unknown; identical to SEQ ID NO: 18675
  misc_feature (1)..( 3000): 2750-1469P.txt file - cDNA_ID_1818992; gDNA_ID_2926211; Annot_ID_202650

SEQ ID NO: 18677 - DNA, 3003 bp, Unknown
  misc_feature (1)..( 3003): 2750-1469P.txt file - cDNA_ID_1818996; gDNA_ID_1620618; Annot_ID_46937
ggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttagcatgatgaatataatgttatcattaaatgaaacgacagcgtttggggtttctcactcattacacgacgtcgtttagttgtacttttgtgtggcttttatcaaattataaatcaacggtcaagattgacgcacgctttagtatttttttcattaacaatttaagatcaacggctaatacatcgccaattactagctaataatggcccagtagtgtgaactgtgaagagagtgaactgatttttttttttttaaagttctctctcagatttaacaaaatcgagccgacactttcccaattgaactgaatctactgaaatcgattcacgagagctcagatttggtgttagcatcactcactaagcaagattattgagttgtaattagtatttgagatcaagatgaaggaggacgatgcattgccgacgacgacgacgactggtacggcgacgggaacagctatggcgaattcgaagaaggaaagctctgactcggtcttgtttggaagaggtcgatataagttctgggcgtttgctgcgattttgcttttggctttttggtcgatgtttactggcaccgtcactctccggttatctaccgggaatctgaaccggttatcggaagatctagggattccgaactacgataatctcgacgttctggttgtttactctctctgtttctatttcggttgatttggtgtgtaatttgattgtagtctggtttttgaggttttggaatttgtggtattttttaggaaatggaggagagagagaaagtggtgaagcatatgtgggatgtgtatactaatagtcgtcggatcaaattgcctagattttggcaagaggcttttgttgctgcttatgaagaactcactagtgatgtgcctggggttagagaagctgctattggtgaaatcgccaagatgtcggcgcggtcgatcactcttgatccacctccttctagatcaaggtgatgattcttgctttaaatttcgatttgttttcactatattagtcacttagaatcagtaggtagaggtatagatagatggtagtcgatcttgcctctgtgctggagtaaatagtaatgttcaatctggtatctggagtttagatcttgagtgtacctagcttaggttgttcagtttgatggtcaagttcttctgtgtctggagatatgccattaagatttagtgttactctttaagttattacctgttaaagttagtttgtgtatactctatctttgtttgtgattggtgaccagctatatggatccatgcttgatatccaaacatataaagacctgtatgaactttcgatacacatagtaccttataatggtcaaggtctaatttttctggagactgggtatgtagatctagtgtaagatactggtatgcataatagcatgtggttgagtagattatgtcttcttaaaattatgttatgagatttcagataggtatagctttcggttttgtttcttgcatttaatgctaaacctcttttgtgaaagttggttgatcaagtttggtagagcttccatcacccaccttagcttcttgatcaggattcatcttttaatttcttctcttaaattgttcatagacttaacctgagtgttaaactcttttttcttttctttatcggtttgttctcagagtgcaagggatttgggaagaaacttgaagagaattctacacaagccagcagctagtagctgataatgatattggtaacatatgtctactacttgctgaagccaaaagatgaactaccaaatggatagatttcattttgggactaaaattcaattttcgaaatcaaattgctctttttacattctatcgttggtaattatatagagctacttttataaatatatgtagaagcaaatggaaccttatgactttacacgaaaaagcaatggatcccttatgatatatttcttcttctgatatcttcaaaacttgggactcttgaatctgtgttgttattggcaaccttttgccactgtagattaccaaattaagatttgttgactaaactaaaatacgcggtttgtttactcttgtagtataaaaaagctttaccacactcgcacgtgagagtgaaaaaaaaaaaaacacaaacgtaaagaaacacaaaaatg

SEQ ID NO: 18678 - DNA, 3003 bp, Unknown; identical to SEQ ID NO: 18677
  misc_feature (1)..( 3003): 2750-1469P.txt file - cDNA_ID_1818996; gDNA_ID_1620618; Annot_ID_162117

SEQ ID NO: 18679 - DNA, 3000 bp, Unknown
  misc_feature (1)..( 3000): 2750-1469P.txt file - cDNA_ID_1818996; gDNA_ID_2926211; Annot_ID_142006
aaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttagcatgatgaatataatgttatcattaaatgaaacgacagcgtttggggtttctcactcattacacgacgtcgtttagttgtacttttgtgtggcttttatcaaattataaatcaacggtcaagattgacgcacgctttagtatttttttcattaacaatttaagatcaacggctaatacatcgccaattactagctaataatggcccagtagtgtgaactgtgaagagagtgaactgatttttttttttttaaagttctctctcagatttaacaaaatcgagccgacactttcccaattgaactgaatctactgaaatcgattcacgagagctcagatttggtgttagcatcactcactaagcaagattattgagttgtaattagtatttgagatcaagatgaaggaggacgatgcattgccgacgacgacgacgactggtacggcgacgggaacagctatggcgaattcgaagaaggaaagctctgactcggtcttgtttggaagaggtcgatataagttctgggcgtttgctgcgattttgcttttggctttttggtcgatgtttactggcaccgtcactctccggttatctaccgggaatctgaaccggttatcggaagatctagggattccgaactacgataatctcgacgttctggttgtttactctctctgtttctatttcggttgatttggtgtgtaatttgattgtagtctggtttttgaggttttggaatttgtggtattttttaggaaatggaggagagagagaaagtggtgaagcatatgtgggatgtgtatactaatagtcgtcggatcaaattgcctagattttggcaagaggcttttgttgctgcttatgaagaactcactagtgatgtgcctggggttagagaagctgctattggtgaaatcgccaagatgtcggcgcggtcgatcactcttgatccacctccttctagatcaaggtgatgattcttgctttaaatttcgatttgttttcactatattagtcacttagaatcagtaggtagaggtatagatagatggtagtcgatcttgcctctgtgctggagtaaatagtaatgttcaatctggtatctggagtttagatcttgagtgtacctagcttaggttgttcagtttgatggtcaagttcttctgtgtctggagatatgccattaagatttagtgttactctttaagttattacctgttaaagttagtttgtgtatactctatctttgtttgtgattggtgaccagctatatggatccatgcttgatatccaaacatataaagacctgtatgaactttcgatacacatagtaccttataatggtcaaggtctaatttttctggagactgggtatgtagatctagtgtaagatactggtatgcataatagcatgtggttgagtagattatgtcttcttaaaattatgttatgagatttcagataggtatagctttcggttttgtttcttgcatttaatgctaaacctcttttgtgaaagttggttgatcaagtttggtagagcttccatcacccaccttagcttcttgatcaggattcatcttttaatttcttctcttaaattgttcatagacttaacctgagtgttaaactcttttttcttttctttatcggtttgttctcagagtgcaagggatttgggaagaaacttgaagagaattctacacaagccagcagctagtagctgataatgatattggtaacatatgtctactacttgctgaagccaaaagatgaactaccaaatggatagatttcattttgggactaaaattcaattttcgaaatcaaattgctctttttacattctatcgttggtaattatatagagctacttttataaatatatgtagaagcaaatggaaccttatgactttacacgaaaaagcaatggatcccttatgatatatttcttcttctgatatcttcaaaacttgggactcttgaatctgtgttgttattggcaaccttttgccactgtagattaccaaattaagatttgttgactaaactaaaatacgcggtttgtttactcttgtagtataaaaaagctttaccacactcgcacgtgagagtgaaaaaaaaaaaaacacaaacgtaaagaaacacaaaaatg

SEQ ID NO: 18680 - DNA, 3000 bp, Unknown; identical to SEQ ID NO: 18679
  misc_feature (1)..( 3000): 2750-1469P.txt file - cDNA_ID_1818996; gDNA_ID_2926211; Annot_ID_202652

SEQ ID NO: 18681 - DNA, 3003 bp, Unknown
  misc_feature (1)..( 3003): 2750-1469P.txt file - cDNA_ID_1819004; gDNA_ID_1620618; Annot_ID_46935
cttaatagctcaagagcatttcgattgaacatcttattttgttgcttgaagacttgttgaaaactatgatctagtatgcaggtttatttataagctgctcctgcatttttctttcctcataaattagcttgtaaaagcttgacggtttgttgttggaatctctagaattccatagtcaacaattttcaggttcatatagttcactgctttgttctacacacttgtgcttcatgatgaattcaagtttctttcagttttatgttgtttttacatatccttctacttgcaactaaagggtcaagctggttctgttggtatagctaaactctgtttcttggtacgaagatggtttcgcgtatagtggaatcttgatctcgttggaactcaatttgacttggcttcccctaattttgacttgcacgaaagataagagtgacaaattttcaacaatgattttgataggtttctgatcaggtaagtatttgagttgcaacatctttcagagaatttgcaaatcctaaggttgcaaaatgttaatcatcttgcgtagttgtttgcttattttgtatcaatagctctaaatttaattaaaaagattccaaagttcaaacgaaaattacgggaatcacataagtaatactatactatatagtctacattatatgtaatgtttttaattttctgtaacactgatgtctctataatattttaatacaaattgtggaacatttttgttgaaaagtatgctttcttcatactagtaagtcaaatataaacttttgacgaaataatccaataacatcacctactcgtccggaaacagaacagtacaaagttggtgaataaaatctatggatattttatatagtgagctttttgagaaacgtgatctactttgatgtactaaagttaacttttaacaatgaaaacaaaaattgaaaaattaacaacgttaaatcagaaacgtaaataaactgaatcatcatttcaacagttgattccacaagctattaaaattttaaatattagaaagtattttaaagatgcttgaaacttagcagacagtttggtttaaaagagtaaaagtggtaatgagctgatgttggcggctaaatctctaaaatcagtaaagcatatcgcgaaccaaaagccaaagcaccaaatgaaactgagttaggttcgttgtacacacgatgttttccaataaataatcctccacaaaattcaaacaccggatgtatctcgaaaacattagatgttctatatacaaacatatagaatcatggtattgagttcgtgattttttttttgtaacatgatgtaattagtaattcatcctaatatatgtaatcatctttatattttgataatacattcgtgattcgttcgatgacattaccacacgaggttacgactgcgcacatatggtgtattatgagtccaccatacgataaattattaaaagtgtggtagagagacttttcttatggttgataaattattattttcaatatcgtcaaaattacttattcattttctctttatttggaccaatttagatttagactcgattagtttttctatagatgtaggttcttcctctcaagatgtagcgataggttttagggttaaactttgtcgtggatataggaagaaactgcatgtagtttttgatgggttacacttttagttacaacacgaaagtttatcggaaatactagttggctcatggctgccttacgttagacaattaattacaaacatctctttttttctttgtcaataattgtttcttattgtaggcatactattggagaaacatgaggtacgaacttcccaaatcagttttttttttttgggaaaaagttgaaattatgcaaaacactgaaaaaggaaagaacaagtaattaaaatgcaaaaaaaaatttttaattaaaatgcatgaacatataaacaaataacatgttataggttcaaatctcatccactgatccacaaaccgtaatcaccatcaaaatattcatgcaagtcaacttgaggatatttacatactataattaagaaaataccacaaatttccaaatcaagtttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaatcatg

SEQ ID NO: 18682 - DNA, 3003 bp, Unknown; identical to SEQ ID NO: 18681
  misc_feature (1)..( 3003): 2750-1469P.txt file - cDNA_ID_1819004; gDNA_ID_1620618; Annot_ID_162115

SEQ ID NO: 18683 - DNA, 3000 bp, Unknown
  misc_feature (1)..( 3000): 2750-1469P.txt file - cDNA_ID_1819004; gDNA_ID_2926211; Annot_ID_142008
aatagctcaagagcatttcgattgaacatcttattttgttgcttgaagacttgttgaaaactatgatctagtatgcaggtttatttataagctgctcctgcatttttctttcctcataaattagcttgtaaaagcttgacggtttgttgttggaatctctagaattccatagtcaacaattttcaggttcatatagttcactgctttgttctacacacttgtgcttcatgatgaattcaagtttctttcagttttatgttgtttttacatatccttctacttgcaactaaagggtcaagctggttctgttggtatagctaaactctgtttcttggtacgaagatggtttcgcgtatagtggaatcttgatctcgttggaactcaatttgacttggcttcccctaattttgacttgcacgaaagataagagtgacaaattttcaacaatgattttgataggtttctgatcaggtaagtatttgagttgcaacatctttcagagaatttgcaaatcctaaggttgcaaaatgttaatcatcttgcgtagttgtttgcttattttgtatcaatagctctaaatttaattaaaaagattccaaagttcaaacgaaaattacgggaatcacataagtaatactatactatatagtctacattatatgtaatgtttttaattttctgtaacactgatgtctctataatattttaatacaaattgtggaacatttttgttgaaaagtatgctttcttcatactagtaagtcaaatataaacttttgacgaaataatccaataacatcacctactcgtccggaaacagaacagtacaaagttggtgaataaaatctatggatattttatatagtgagctttttgagaaacgtgatctactttgatgtactaaagttaacttttaacaatgaaaacaaaaattgaaaaattaacaacgttaaatcagaaacgtaaataaactgaatcatcatttcaacagttgattccacaagctattaaaattttaaatattagaaagtattttaaagatgcttgaaacttagcagacagtttggtttaaaagagtaaaagtggtaatgagctgatgttggcggctaaatctctaaaatcagtaaagcatatcgcgaaccaaaagccaaagcaccaaatgaaactgagttaggttcgttgtacacacgatgttttccaataaataatcctccacaaaattcaaacaccggatgtatctcgaaaacattagatgttctatatacaaacatatagaatcatggtattgagttcgtgattttttttttgtaacatgatgtaattagtaattcatcctaatatatgtaatcatctttatattttgataatacattcgtgattcgttcgatgacattaccacacgaggttacgactgcgcacatatggtgtattatgagtccaccatacgataaattattaaaagtgtggtagagagacttttcttatggttgataaattattattttcaatatcgtcaaaattacttattcattttctctttatttggaccaatttagatttagactcgattagtttttctatagatgtaggttcttcctctcaagatgtagcgataggttttagggttaaactttgtcgtggatataggaagaaactgcatgtagtttttgatgggttacacttttagttacaacacgaaagtttatcggaaatactagttggctcatggctgccttacgttagacaattaattacaaacatctctttttttctttgtcaataattgtttcttattgtaggcatactattggagaaacatgaggtacgaacttcccaaatcagttttttttttttgggaaaaagttgaaattatgcaaaacactgaaaaaggaaagaacaagtaattaaaatgcaaaaaaaaatttttaattaaaatgcatgaacatataaacaaataacatgttataggttcaaatctcatccactgatccacaaaccgtaatcaccatcaaaatattcatgcaagtcaacttgaggatatttacatactataattaagaaaataccacaaatttccaaatcaagtttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaatcatg

SEQ ID NO: 18684 - DNA, 3000 bp, Unknown; identical to SEQ ID NO: 18683
  misc_feature (1)..( 3000): 2750-1469P.txt file - cDNA_ID_1819004; gDNA_ID_2926211; Annot_ID_202654

SEQ ID NO: 18685 - DNA, 3003 bp, Unknown
  misc_feature (1)..( 3003): 2750-1469P.txt file - cDNA_ID_1819024; gDNA_ID_1620618; Annot_ID_46928
ccaatcaaaaatataaaggaattatggctggtgacggcgacggttatgggagaacaaaaaatctaattggtctgaagaaatgagtcaggtttcatgaactgaagttgaggacacgtgtacgaatacaagaggtggtctacattattaactcgtaataagtcgccacgtggataaccccatgttcttccctggtcacttttccttctctttggcgtggctgtctttttcacctcctgtttttaataattttcacctccgggtaaaaagaaaacacaaaaaagagagagcagcatagatatatttgcaaatagtaattaactaattactatatctaaacagttgcaaatacataacattaatacaactgtcaaaattacttcaaccctaattctcatgatgtgtgttatccaaattaaaataccatcaatccttaataaattagcaatgactcatacataagttccaaaaatagggtattatcacatgccagactttttaggtggtactttcagtatcaatattttggttccaataaggacatgtggattttcttttacaaaattgtttttaaaacactttcttcaacagtacaaaaattgtatattgagaaggtaattggaggaaagagagagatagagatgtaagggtgggattggaagaacatggaaagtagtagagacatggcagtgtttttaaagcagacacaaacacttacgagaagaaagagggagacaaaaggctttggcttccattgtctacttctctatattcttatttaaaccaattttaaaatatttataaaacttatttaacattagaaacgtacgtttggttgtgttttattcgccacgtttcgttgttgtattcctttcatatgactcccatcgtgttcctttgtctcccctttttctctctttacatcatctcatagaaaacaacttttagaaataaaaaaacgtggcacattatattcaataacgaattcaaatccccaattcaacttatgagtacgaaccttgtagtcaccatccacatgattcctctagagaccgtaagattaatcgggttgaagagttaattgtaatttgttttcaatatatatagttgtatgatcaatcacccattctatcgttttattatatggatgcgtttgtgcagtttagaagcatcagtgattcacttttgtataacaatatgtatatatatatatatatagttttgaatttataggatctgattctactgtgaaactttcattgtagatttttgcttaattaatcatgattttgctagctttattctagatttgaatttattagtacacaattgatatatttttcataaaaagactgaccgatgaatgtgatattaagctcaagaaataaataaatgggtctatgggaaccaaaataagatgcacatagctaaaatatccctcacaaaatgataatagcaatattccataaattgaaaaatctagctagatgataactaatccgtaactcttaactccaaaattatacaccgtttatctaataaaagttaaaaagataagcctttaaaagcagacattatccttaagacaaataaacaagtatcttacccagtttaggggttcattggtccaatattttattaaagagtccacatctacaagcaagtatcatcatgaacatgaacttaaacccatttaaggataataactataactaatcaatgatttacttgggagttcgaaggtgtctgctacactccttccaagcctccacccacattaaagtttctatcctctttatctttttttatccccaagaatatcctctgtggcaacaagctactaatttagtcatttatttgctcattggctgcttgacaaaaaaaaaaaaaaaaaaaaaatttgctcattggctacccattttttcctctaatttgcacgttccgtaatagaatatactcattaagatatgcttttcttggatgttcataatgtccatcagtccatgtatatatatcattgaattgatcatttctcaaatccatatggattcttagaaaatataacctcttacaattactcatcaatttataacctatcacacaattctgtcgatattcaacctctacattaattagtatgcgagttaaaaaaaaaaaaaaaaaaaaaaattagtatgcgagtttaataacaagaaattaaaatttatgccttttttttatctaaagtatatatatatatttaatgtttttctatgatttttctttcggtagtaattaacgttatcaactgaaccttaagtctatgataaattctggcttatttttacggcactagctaattttctaacgaataaactaagaaaattaacaattgatctctaactacgaatttagagaagagtctaaaaagtaattaaggggcttgattgggtcgtggaggacattgagaccggtgaatgtcctctccattggacatcacattctcatttaccaaatagtctctgattattggtctcccctccccaattgtcatactactatatagttttctagactcgcaaatcttattaactacgatagattgatttatgtcattttattttggtaatgaaaaattcactttagtgtgttcacgtgccaaagctttcgacttttcatgttcctatcaatgacgtgttgaaagaatacgtctttgtttagtgttgttttgtattacgcatgaaacagtattaaagttggtgacaaagaaatattttcttctcttttaatttcactgtccttttaattaatattcctaagtactaaatcacgtccagtggtaattccgtaatttaaaataacaagaagcccacatcaggaaaatgacatttcataacccaaaaaaaaaaatcatttcttgacacctactctccttataaatcataggtcttcctcttccccaacaacacttctcacatttcataaaaagtgagacaaattaaagacagagagagatccaagaacatg

SEQ ID NO: 18686 - DNA, 3003 bp, Unknown; identical to SEQ ID NO: 18685
  misc_feature (1)..( 3003): 2750-1469P.txt file - cDNA_ID_1819024; gDNA_ID_1620618; Annot_ID_162107

SEQ ID NO: 18687 - DNA, 1126 bp, Unknown
  misc_feature (1)..( 1126): 2750-1469P.txt file - cDNA_ID_1819024; gDNA_ID_2926211; Annot_ID_142015
aaaaaaaaaaaaaaaaaaatttgctcattggctacccattttttcctctaatttgcacgttccgtaatagaatatactcattaagatatgcttttcttggatgttcataatgtccatcagtccatgtatatatatcattgaattgatcatttctcaaatccatatggattcttagaaaatataacctcttacaattactcatcaatttataacctatcacacaattctgtcgatattcaacctctacattaattagtatgcgagttaaaaaaaaaaaaaaaaaaaaaaattagtatgcgagtttaataacaagaaattaaaatttatgccttttttttatctaaagtatatatatatatttaatgtttttctatgatttttctttcggtagtaattaacgttatcaactgaaccttaagtctatgataaattctggcttatttttacggcactagctaattttctaacgaataaactaagaaaattaacaattgatctctaactacgaatttagagaagagtctaaaaagtaattaaggggcttgattgggtcgtggaggacattgagaccggtgaatgtcctctccattggacatcacattctcatttaccaaatagtctctgattattggtctcccctccccaattgtcatactactatatagttttctagactcgcaaatcttattaactacgatagattgatttatgtcattttattttggtaatgaaaaattcactttagtgtgttcacgtgccaaagctttcgacttttcatgttcctatcaatgacgtgttgaaagaatacgtctttgtttagtgttgttttgtattacgcatgaaacagtattaaagttggtgacaaagaaatattttcttctcttttaatttcactgtccttttaattaatattcctaagtactaaatcacgtccagtggtaattccgtaatttaaaataacaagaagcccacatcaggaaaatgacatttcataacccaaaaaaaaaaatcatttcttgacacctactctccttataaatcataggtcttcctcttccccaacaacacttctcacatttcataaaaagtgagacaaattaaagacagagagagatccaagaacatg

SEQ ID NO: 18688 - DNA, 1126 bp, Unknown; identical to SEQ ID NO: 18687
  misc_feature (1)..( 1126): 2750-1469P.txt file - cDNA_ID_1819024; gDNA_ID_2926211; Annot_ID_202661

SEQ ID NO: 18689 - DNA, 3000 bp, Unknown
  misc_feature (1)..( 3000): 2750-1469P.txt file - cDNA_ID_1819024; gDNA_ID_2926212; Annot_ID_202675
gtgacggcgacggttatgggagaacaaaaaatctaattggtctgaagaaatgagtcaggtttcatgaactgaagttgaggacacgtgtacgaatacaagaggtggtctacattattaactcgtaataagtcgccacgtggataaccccatgttcttccctggtcacttttccttctctttggcgtggctgtctttttcacctcctgtttttaataattttcacctccgggtaaaaagaaaacacaaaaaagagagagcagcatagatatatttgcaaatagtaattaactaattactatatctaaacagttgcaaatacataacattaatacaactgtcaaaattacttcaaccctaattctcatgatgtgtgttatccaaattaaaataccatcaatccttaataaattagcaatgactcatacataagttccaaaaatagggtattatcacatgccagactttttaggtggtactttcagtatcaatattttggttccaataaggacatgtggattttcttttacaaaattgtttttaaaacactttcttcaacagtacaaaaattgtatattgagaaggtaattggaggaaagagagagatagagatgtaagggtgggattggaagaacatggaaagtagtagagacatggcagtgtttttaaagcagacacaaacacttacgagaagaaagagggagacaaaaggctttggcttccattgtctacttctctatattcttatttaaaccaattttaaaatatttataaaacttatttaacattagaaacgtacgtttggttgtgttttattcgccacgtttcgttgttgtattcctttcatatgactcccatcgtgttcctttgtctcccctttttctctctttacatcatctcatagaaaacaacttttagaaataaaaaaacgtggcacattatattcaataacgaattcaaatccccaattcaacttatgagtacgaaccttgtagtcaccatccacatgattcctctagagaccgtaagattaatcgggttgaagagttaattgtaatttgttttcaatatatatagttgtatgatcaatcacccattctatcgttttattatatggatgcgtttgtgcagtttagaagcatcagtgattcacttttgtataacaatatgtatatatatatatatatagttttgaatttataggatctgattctactgtgaaactttcattgtagatttttgcttaattaatcatgattttgctagctttattctagatttgaatttattagtacacaattgatatatttttcataaaaagactgaccgatgaatgtgatattaagctcaagaaataaataaatgggtctatgggaaccaaaataagatgcacatagctaaaatatccctcacaaaatgataatagcaatattccataaattgaaaaatctagctagatgataactaatccgtaactcttaactccaaaattatacaccgtttatctaataaaagttaaaaagataagcctttaaaagcagacattatccttaagacaaataaacaagtatcttacccagtttaggggttcattggtccaatattttattaaagagtccacatctacaagcaagtatcatcatgaacatgaacttaaacccatttaaggataataactataactaatcaatgatttacttgggagttcgaaggtgtctgctacactccttccaagcctccacccacattaaagtttctatcctctttatctttttttatccccaagaatatcctctgtggcaacaagctactaatttagtcatttatttgctcattggctgcttgacaaaaaaaaaaaaaaaaaaaaaatttgctcattggctacccattttttcctctaatttgcacgttccgtaatagaatatactcattaagatatgcttttcttggatgttcataatgtccatcagtccatgtatatatatcattgaattgatcatttctcaaatccatatggattcttagaaaatataacctcttacaattactcatcaatttataacctatcacacaattctgtcgatattcaacctctacattaattagtatgcgagttaaaaaaaaaaaaaaaaaaaaaaattagtatgcgagtttaataacaagaaattaaaatttatgccttttttttatctaaagtatatatatatatttaatgtttttctatgatttttctttcggtagtaattaacgttatcaactgaaccttaagtctatgataaattctggcttatttttacggcactagctaattttctaacgaataaactaagaaaattaacaattgatctctaactacgaatttagagaagagtctaaaaagtaattaaggggcttgattgggtcgtggaggacattgagaccggtgaatgtcctctccattggacatcacattctcatttaccaaatagtctctgattattggtctcccctccccaattgtcatactactatatagttttctagactcgcaaatcttattaactacgatagattgatttatgtcattttattttggtaatgaaaaattcactttagtgtgttcacgtgccaaagctttcgacttttcatgttcctatcaatgacgtgttgaaagaatacgtctttgtttagtgttgttttgtattacgcatgaaacagtattaaagttggtgacaaagaaatattttcttctcttttaatttcactgtccttttaattaatattcctaagtactaaatcacgtccagtggtaattccgtaatttaaaataacaagaagcccacatcaggaaaatgacatttcataacccaaaaaaaaaaatcatttcttgacacctactctccttataaatcataggtcttcctcttccccaacaacacttctcacatttcataaaaagtgagacaaattaaagacagagagagatccaagaacatgaactacacggtggatgatcagaacatg

SEQ ID NO: 18690 - DNA, 3000 bp, Unknown; identical to SEQ ID NO: 2941
  misc_feature (1)..( 3000): 2750-1469P.txt file - cDNA_ID_1819028; gDNA_ID_1620618; Annot_ID_46926

SEQ ID NO: 18691 - DNA, 3000 bp, Unknown; identical to SEQ ID NO: 2941
  misc_feature (1)..( 3000): 2750-1469P.txt file - cDNA_ID_1819028; gDNA_ID_1620618; Annot_ID_162104

SEQ ID NO: 18692 - DNA, 3003 bp, Unknown
  misc_feature (1)..( 3003): 2750-1469P.txt file - cDNA_ID_1819028; gDNA_ID_2926212; Annot_ID_142017
taacattatgattgataattttcatgcaactccttttctctagatcgtaggtaggaggatattaggttaatttgactacgctagagatttaaattagtacgctttcgaacaagtcaaaagacaccatcgggttagccactaagaaagcaatcatcatatacatcaattaattataatactacttatatacctgtactatatacactcatgcataaaaagtaaaaacgattctctctttatcaaatttagattctggatcgttaaaaagtagtaaaaaatgagaaaacttttacaagataaatttgatgagtcaccctcatcatattatagttagaggctaataatttataaataatgtcaaaacaattttctctatgtacatattattacggagcgattacatatatcattcacaactttagtcattttgttaaccctaatataatgtgatatcaaaacggaatattaataacgttatacattacaatttttgtaataaattttgattttaatcactaatcagttacttgttgccattatattgatcggggatcccttattgataggcccaatatgaatgagctcagttatattttgggttttttctcatagcataaatggcccaatgaaagcctattaagtgatcgaaggtcagacgttggactccttgtatgaaaccaacagactaggcccaaattatcaactcaaaattgaccgtaacatatacggcgccgtttttgtagacctgagtgtgataaagtgagctgttaaatcttcacttaaccccatttttaatcacgaaattagagtggtgattaaaaatacaactaaagttgtttcaagtgattgttttcatttatttaaattttaaattaatccaactttatcgttgacggaaaatttgggagagaatattctcgatggggaaaggaggaggttgtgttccgagcaagaagaagaagccggccaccaccggcgatggtcccggaatcgatgatgataacgacgctactaatgctccgatccaaattgacgatgatcaaaccaccattgacggcgatcgaacaacggcgacgaatactggaggaacaacaacaccagcgattactactacggctgctaagatctcgtcaccgctcaagatcttcgtcgtgttctattcgatgtacggacatgtggagagcttagcgaagaggatgaaaaagggagtggatagcgtcgaaggagtggaggcgacgttgtacagagttccggagacgctttcgcaggaggttgttgagcagatgaaggcgccggttaaggatttggagattccggagattacggcggcggaattgacggcggctgatggatttctgtttggatttccgactaggtatggttgtatggctgcgcagatgaaggcgttttttgattcgacgggatcattgtggaaggagcagagtcttgctggtaagcctgctggattctttgtgagcactggcactcaaggaggtggccaagagaccactgcgtaagcttttgcttctttcttatactctttagtaccatttgcattggttctaaagtatattagttgaatttggagtacaagtattgaattgctataatcacagagtcactatgtgaaataaatgcaaccttgaatttgatgtatataggtggttgctaaaacctgaaaggttgttgtggtcaggactttgtctagtactttagaggaaacttgtcagagatggctatcattctggtgaattgcttgcttgatctttaattgctttcttaactacaccattgaccatttcaagtccaatctggtcaccattgaatagtaccctggtctctcttttggtacgataggcttgcacttatgctacgcttatgttagctctagtaaggggagatctttagaacatgtaaaactggattattttagattctcactttctcatcacccaaagtaccaattctataggcatgagtgttgcctccgataatttgcatgtgtttaagctctgagatagattcctcaatgtatgtggactctctttagtcatcatttgcacttagatatttgtctgttttacttcagctgattcactcggttgctgtgatagtttgcgaatatagagaagcataacaatgcggaatcttaaagcttttgcgtatttctccaagtgtgcaatgtggatatttttattgccatcgtttccacattaaagctcagaaacacttgctgatttccatctcgtgtgtgttctgttgcagatggacagcaatcacacagcttgtgcaccatgggatgctatttgtaccaataggctacacatttggagctggaatgttcaagatggactcgatacgtggaggctctccttatggagcaggtgtgttcgctggtgatgggtcaagagaagcaacagaaacagaattggctcttgctgaacatcaaggaaactacatggctgcaatagtcaaaagacttgctcaaccttaaaacaaaaacaaaaattgcttcctctatttgtctcttttcattcaattcctcctcctgctaaataatcataaaaaaaaaaatcttcctttcttttctcaattccatcgaaatttctttcttttctttatgagtgttttcagtttcgccattaatggttagtgtgtacatgtttctttatattatttgtctcttatttattccttgttgtaaaataaaaacaaaatttcattacgtgttctttcattggagttgttgattggatattttatcaaaaacttataatttcacaaatcgttaaagtgtaggaaaaaaaaataattagttgcgtcagccattaggattccttggaacacgtaaagtttactaacataaaactgtgatatctgtacttttttatatctatctgctgctgcatctgtgttctgttcgtccttgaagcagtcaaattcttctctgaactccaaacatcgccatgtcccgagattctctcttcgttgaggtcactaatg

SEQ ID NO: 18693 - DNA, 3003 bp, Unknown; identical to SEQ ID NO: 18692
  misc_feature (1)..( 3003): 2750-1469P.txt file - cDNA_ID_1819028; gDNA_ID_2926212; Annot_ID_202677

SEQ ID NO: 18694 - DNA, 3003 bp, Unknown
  misc_feature (1)..( 3003): 2750-1469P.txt file - cDNA_ID_1819048; gDNA_ID_1620618; Annot_ID_46917
cttatgctggctctacattagtagacatcgcatcttcttcatcatctgctgtggtgtcagcatcgtccaagaaaggtgagaggtctgattttgagaagaaacttggtgagtttttcaagcatcaaatcgagtcggattcttcatcggcatatggggatgggttcaggcaaggtaaccaagcagttcttaagcatggtctgaggcgaaccctcgaccatattcgcttgaccggtacatttcctaaatggatttaaactataaaaagagagaaaacaagctttgttatagttttttagagtatagacttgagaagaaaagaaaaagaaaaatgtataggttacaacaatacacacatttaagtgtcataaagtttccactttttaagtaaaaaatcaagagtcaagaaacaagaccaaaaattcttggcttggtttttatctttttttgccaaacgttttgcttgttatttcttagatagcaaattattctgttttcaaaatctaaattactacaatcactagtttgacttcatcatatctggaccagtggataaaagtatgaaagataaggaaaatccgaaaatggatagacttgtatatccacaattccacattatatcataatatgtactgtatattatggctcttctattcgctgagaggacgaaggtcaaatatgtagaatgtagaagtatcctcatattgacctgtctaactagattaatattatagtatgcatgcttgccatctgttaattaaaatacagacattgtgaaaaaatacactccatgctctctatctttctatcgtttgtaaaatgatattttgttgatcaaaactactatggtctacaagatcgtgtaaaacaacattcaagtaacttagtattatgggaagatgagttctctcgatcgagatgttcagtcaattctctagagtataaaaaacgaaaacgtctcaagtcaattgtcaatcattaatttccaaatataaatattagacattatcaacaaatgatgataaagagatacaaaaaacattgtgaagatgtgggatatgaggataaacatagagagataggatgatatattcacacgtgtttcccacttcctcatccaacttgtcgcggcgcctcgtcgccggttctttcttctctctttggtttttttttctaaaacattttctctatcaagcgtttatgtttcaacaaattttatttaagctaatgttttttcttataaccaaatcaaaattttattcatcgatatagaaattaatggttttttgctaatattgaaatctaattttaaagtatatattaaaaagtttttgttaaaaaaaaatgaggatactcatgttggagagggagagcaaacggattcttgatgtttttacgatcgattaaagtgaagacgttttagtggacatgatatatttctttggtatgacatattttaaaagtcacctctaagaattcaattttttctagatattatcgtcattcgtcaacattatatcgtatgatgttaacaaaattaatggttggtagagtactcgtcatttagaattagggctaatgaattgatcgttcataatgtcttgtcgagggcaaaaacgacgtaacgtgacaaaacgtattaacctttgtttctttttcttttttttttgttatttcagaattcatgaaccagagaatttcattaatccactagctaatcttgaaattattctattgccttttgaaaaagttgtaaagtataatttgaaggttgcaaaattttaattttggtttttagtgtttgagaaacaaatcaaaactgcaacattatatacagaactatcttcccttttttttttaactaacttgaaatttatgcaaaacagttcaccaaggtgtcattaaaagatgtcattaaattcgaaagtcggttcatgaaagatgtcgtcatcatcgtaacatgatgccaccacgcagtcagcactaagcaggctatttggctttggcaccttcattcaaaaataaaataaattttaaattcctggttcagtaaaaatgtggaccgttgttttgggggcagccaatcgcacgaatatggtggctacgccacaaagttacaaatgtacaactttgtcgggcttttccagattcattaacatcaataggcaagtaaactacaaaatgcaagttgcttaatcaataatgttgtaaagcttttacagcatcttttataccataaaatgtcaacatcatggagtttactccaattaagttctcgtacactttgatttgaataatcagtacaaaacataaccaaaccggattagatgtggttttaactattgcatacatttccggccaatggattaggattactgaaagaacattaaaaacatatatgtatgacgacgaaaacaatttcttagggcttaggttatatatatttcgcagaaatgtataccaaaatgttggagaatcgtgaaaaagaatatacctaataaaccgtactaaaaaggctgaacatctgagattcagcagagcatcaaaagataaaagagaatatgctcattaatcataggtcgactgttttctccaccctccaactttaatttttgaaatctcttgtttttatgtgcccttgataattattaatcaccttaacattaacaacttgttaatgcctgttaatccaaaagtaaagcaatcaaagaactatattataagattaataatgtaatgattcgaaacattacaataaagtataacgtaacaagcttagatatggtgggtaaaatatacgaagtaaaataaatggtcccaagtatatgaatgaatacatgtatttacagatatctctctcccctatctccttatgatttgtcattttcctcacccataatcctataaaataatcaagaacctccgagggagagagacatacacacagacagagtaagacatatataacatatatagagagagaagacctaaacaaagagacatatg

SEQ ID NO: 18695 - DNA, 3000 bp, Unknown
  misc_feature (1)..( 3000): 2750-1469P.txt file - cDNA_ID_1819048; gDNA_ID_2926212; Annot_ID_142026
atgctggctctacattagtagacatcgcatcttcttcatcatctgctgtggtgtcagcatcgtccaagaaaggtgagaggtctgattttgagaagaaacttggtgagtttttcaagcatcaaatcgagtcggattcttcatcggcatatggggatgggttcaggcaaggtaaccaagcagttcttaagcatggtctgaggcgaaccctcgaccatattcgcttgaccggtacatttcctaaatggatttaaactataaaaagagagaaaacaagctttgttatagttttttagagtatagacttgagaagaaaagaaaaagaaaaatgtataggttacaacaatacacacatttaagtgtcataaagtttccactttttaagtaaaaaatcaagagtcaagaaacaagaccaaaaattcttggcttggtttttatctttttttgccaaacgttttgcttgttatttcttagatagcaaattattctgttttcaaaatctaaattactacaatcactagtttgacttcatcatatctggaccagtggataaaagtatgaaagataaggaaaatccgaaaatggatagacttgtatatccacaattccacattatatcataatatgtactgtatattatggctcttctattcgctgagaggacgaaggtcaaatatgtagaatgtagaagtatcctcatattgacctgtctaactagattaatattatagtatgcatgcttgccatctgttaattaaaatacagacattgtgaaaaaatacactccatgctctctatctttctatcgtttgtaaaatgatattttgttgatcaaaactactatggtctacaagatcgtgtaaaacaacattcaagtaacttagtattatgggaagatgagttctctcgatcgagatgttcagtcaattctctagagtataaaaaacgaaaacgtctcaagtcaattgtcaatcattaatttccaaatataaatattagacattatcaacaaatgatgataaagagatacaaaaaacattgtgaagatgtgggatatgaggataaacatagagagataggatgatatattcacacgtgtttcccacttcctcatccaacttgtcgcggcgcctcgtcgccggttctttcttctctctttggtttttttttctaaaacattttctctatcaagcgtttatgtttcaacaaattttatttaagctaatgttttttcttataaccaaatcaaaattttattcatcgatatagaaattaatggttttttgctaatattgaaatctaattttaaagtatatattaaaaagtttttgttaaaaaaaaatgaggatactcatgttggagagggagagcaaacggattcttgatgtttttacgatcgattaaagtgaagacgttttagtggacatgatatatttctttggtatgacatattttaaaagtcacctctaagaattcaattttttctagatattatcgtcattcgtcaacattatatcgtatgatgttaacaaaattaatggttggtagagtactcgtcatttagaattagggctaatgaattgatcgttcataatgtcttgtcgagggcaaaaacgacgtaacgtgacaaaacgtattaacctttgtttctttttcttttttttttgttatttcagaattcatgaaccagagaatttcattaatccactagctaatcttgaaattattctattgccttttgaaaaagttgtaaagtataatttgaaggttgcaaaattttaattttggtttttagtgtttgagaaacaaatcaaaactgcaacattatatacagaactatcttcccttttttttttaactaacttgaaatttatgcaaaacagttcaccaaggtgtcattaaaagatgtcattaaattcgaaagtcggttcatgaaagatgtcgtcatcatcgtaacatgatgccaccacgcagtcagcactaagcaggctatttggctttggcaccttcattcaaaaataaaataaattttaaattcctggttcagtaaaaatgtggaccgttgttttgggggcagccaatcgcacgaatatggtggctacgccacaaagttacaaatgtacaactttgtcgggcttttccagattcattaacatcaataggcaagtaaactacaaaatgcaagttgcttaatcaataatgttgtaaagcttttacagcatcttttataccataaaatgtcaacatcatggagtttactccaattaagttctcgtacactttgatttgaataatcagtacaaaacataaccaaaccggattagatgtggttttaactattgcatacatttccggccaatggattaggattactgaaagaacattaaaaacatatatgtatgacgacgaaaacaatttcttagggcttaggttatatatatttcgcagaaatgtataccaaaatgttggagaatcgtgaaaaagaatatacctaataaaccgtactaaaaaggctgaacatctgagattcagcagagcatcaaaagataaaagagaatatgctcattaatcataggtcgactgttttctccaccctccaactttaatttttgaaatctcttgtttttatgtgcccttgataattattaatcaccttaacattaacaacttgttaatgcctgttaatccaaaagtaaagcaatcaaagaactatattataagattaataatgtaatgattcgaaacattacaataaagtataacgtaacaagcttagatatggtgggtaaaatatacgaagtaaaataaatggtcccaagtatatgaatgaatacatgtatttacagatatctctctcccctatctccttatgatttgtcattttcctcacccataatcctataaaataatcaagaacctccgagggagagagacatacacacagacagagtaagacatatataacatatatagagagagaagacctaaacaaagagacatatg

SEQ ID NO: 18696 - DNA, 3003 bp, Unknown
  misc_feature (1)..( 3003): 2750-1469P.txt file - cDNA_ID_1819051; gDNA_ID_1620618; Annot_ID_46916
ttacaacaacctctacgaattcatatcatttatttccttgtctagattcatataccaccaataattagctaggaccatttgttatagtagctttttggatatcttgaccattttgttataatgtttttgtatatatatatataaatacataagaaaatattatacaaaacacttaattcagttcttttatgtataaggaccgtagtgttatatctctaatatttatataaatcgtagatgaacacggagtaacattttttgataaacatgtttaggagatatctgtactttgcaattaaattatgatgaatgatttattggtagtgactaaattatagaggtccccaatggaaaaaagaagcagcgaaccagtcacaccgtcgttgtaatctacaactaaaaaaatgcttgatttatttttccttatcaatatgttttcaaaatgaaaacgtgtacatataaaaaaaatggtcctaagagacatattaattttgattggtccacctggaaaaccggcaagggatggccatggccacgtgggatttgtggtccatgctgggatcaacgttcctcaatgtgccacgtgttttgatcatccagcgtgacagcctgtgttttcaacttttcatcaccaagcttcaaaatcttttttactctttttatttttatgcttaaaaataatttagaaattgatatggtcgaagagtaataataacttctcttgtcaaaagggagtaattatataatatgaaaatggatttttgtcaatacataaatttttattttctaaattaactgttttgtttttttcaacatgatttctctgttttctatttgattcaacggcgcatttttttaaaatgaaaattgtttgtagctcaatattaaagatattatcgtcaaaaattgttagacaaaaaaaaaaaaaacccagcccacaatcattatatgatatatggccactgataatacaactatctgtaactgatttaaacttaaaaattattctacaataagggttttgattcgtcggcccaaatttaccatatgggccttaagaagcctggttaaaatatatggccactggataatacaactatctttctttctttttttctttagtaatatatggcatcagtattagtgtcaatgatttatagatgtgaataaagtgaaatttttggaaagctaattgataactttgatgaccaatatataacaaataagtttgtctattgcagtactttaattcattgcttgcgtaagaagtgagtgggatcacaatttaaagaacgtcacttgattcaactactactaaaataaaacaatcagaaaaaaaaaatattaacagaggaaaataaaatatcctggagtagttgaatcatcttgctaagcacctaattttgataaaacttgcggtggcacagtaagtttgggcacctaaacaactaattgattggctaatcacaatatacacgttttttttttcacatgtggttttatattgaacccaccgaattctcttgatccttctaacaaaatttaatctcaaccacaaaaataaaataataatatatataagaaactgtaatgtacaattgtgattagcaatgggtcatctcatctaattatccagataatattgtctatatttttccaattaatttggtcgtatgtaactaaataatgcattaggttgagctaaataaagtattagataaccttacctactaacaattttcaatgatttttttcagtttctatatttctgctttgtatttttgtgtaaaattgggtttacagaccaggggatttcgaacagggtgatgtgttggacacaaaatttattccattcatgtgcgagttattattcattgaagtatattaaacttttgttttattttacttttttctattaattttaattaaaaatttgatgtgaaagaaaaaaacggtattttattgtgaatagtaaaagtcatgagcaaaatcatcaacttaggagtgttgaaaaaaggctaaagaagagtaaattagaggagagtcaaagattgtgtgtcactagtgttaatgctagtaaacatcagctcttttttttcttctctcttaatttttcaaacatttgatttctataaaccttcttaataatttcttccgtaaaataatatgattagtttttttttttgtaaacaagtgcccacttgcttgaccttcccaaccaaaaaaaacgtaacaatttccatcatcttctccataaagttcttacctttaagtgtgtttaatggagatttatcctctactcatctctctctctctattctgttccatttattaagctttcttcacgctttttaagataattaacagtcacgggttctaaaagctaaagggttttgcttcgaattcaagtgtctcccttcactttctctctctctattgctgctctgtttctgctgtcaattccctaagaaagtcctgatttttagggtgatcgagagaagttgaagaatcatgtttattgagtttccttttttgatccatagggtcatctaattttgctaattttattgtcatctccttcaggtaatttgcgatttctctttactctgtttttgacttgtacttagattccttttctttaacagtaataaacttcataaagatttcatttttcttcttatgggtatttggaatgatgaatgtagattaggttgattgttttgaggatgatgtggataatctttttctggatattattacaatttagggtcttgagattgtttgtaataagctccgtactttggtcccttattttcaattcagtctttaagatttcggtaacccttttatatttgatgcaatctccctataataataccttcttcaattgctgttttgccatttgcatattatttaactttctttgttggatcagtctgattctttcttaccaattattgtcttaatccttgattaagaaaaaacaaaaaaacaaaagacatg

SEQ ID NO: 18697 - DNA, 3000 bp, Unknown
  misc_feature (1)..( 3000): 2750-1469P.txt file - cDNA_ID_1819051; gDNA_ID_2926212; Annot_ID_142027
caacaacctctacgaattcatatcatttatttccttgtctagattcatataccaccaataattagctaggaccatttgttatagtagctttttggatatcttgaccattttgttataatgtttttgtatatatatatataaatacataagaaaatattatacaaaacacttaattcagttcttttatgtataaggaccgtagtgttatatctctaatatttatataaatcgtagatgaacacggagtaacattttttgataaacatgtttaggagatatctgtactttgcaattaaattatgatgaatgatttattggtagtgactaaattatagaggtccccaatggaaaaaagaagcagcgaaccagtcacaccgtcgttgtaatctacaactaaaaaaatgcttgatttatttttccttatcaatatgttttcaaaatgaaaacgtgtacatataaaaaaaatggtcctaagagacatattaattttgattggtccacctggaaaaccggcaagggatggccatggccacgtgggatttgtggtccatgctgggatcaacgttcctcaatgtgccacgtgttttgatcatccagcgtgacagcctgtgttttcaacttttcatcaccaagcttcaaaatcttttttactctttttatttttatgcttaaaaataatttagaaattgatatggtcgaagagtaataataacttctcttgtcaaaagggagtaattatataatatgaaaatggatttttgtcaatacataaatttttattttctaaattaactgttttgtttttttcaacatgatttctctgttttctatttgattcaacggcgcatttttttaaaatgaaaattgtttgtagctcaatattaaagatattatcgtcaaaaattgttagacaaaaaaaaaaaaaacccagcccacaatcattatatgatatatggccactgataatacaactatctgtaactgatttaaacttaaaaattattctacaataagggttttgattcgtcggcccaaatttaccatatgggccttaagaagcctggttaaaatatatggccactggataatacaactatctttctttctttttttctttagtaatatatggcatcagtattagtgtcaatgatttatagatgtgaataaagtgaaatttttggaaagctaattgataactttgatgaccaatatataacaaataagtttgtctattgcagtactttaattcattgcttgcgtaagaagtgagtgggatcacaatttaaagaacgtcacttgattcaactactactaaaataaaacaatcagaaaaaaaaaatattaacagaggaaaataaaatatcctggagtagttgaatcatcttgctaagcacctaattttgataaaacttgcggtggcacagtaagtttgggcacctaaacaactaattgattggctaatcacaatatacacgttttttttttcacatgtggttttatattgaacccaccgaattctcttgatccttctaacaaaatttaatctcaaccacaaaaataaaataataatatatataagaaactgtaatgtacaattgtgattagcaatgggtcatctcatctaattatccagataatattgtctatatttttccaattaatttggtcgtatgtaactaaataatgcattaggttgagctaaataaagtattagataaccttacctactaacaattttcaatgatttttttcagtttctatatttctgctttgtatttttgtgtaaaattgggtttacagaccaggggatttcgaacagggtgatgtgttggacacaaaatttattccattcatgtgcgagttattattcattgaagtatattaaacttttgttttattttacttttttctattaattttaattaaaaatttgatgtgaaagaaaaaaacggtattttattgtgaatagtaaaagtcatgagcaaaatcatcaacttaggagtgttgaaaaaaggctaaagaagagtaaattagaggagagtcaaagattgtgtgtcactagtgttaatgctagtaaacatcagctcttttttttcttctctcttaatttttcaaacatttgatttctataaaccttcttaataatttcttccgtaaaataatatgattagtttttttttttgtaaacaagtgcccacttgcttgaccttcccaaccaaaaaaaacgtaacaatttccatcatcttctccataaagttcttacctttaagtgtgtttaatggagatttatcctctactcatctctctctctctattctgttccatttattaagctttcttcacgctttttaagataattaacagtcacgggttctaaaagctaaagggttttgcttcgaattcaagtgtctcccttcactttctctctctctattgctgctctgtttctgctgtcaattccctaagaaagtcctgatttttagggtgatcgagagaagttgaagaatcatgtttattgagtttccttttttgatccatagggtcatctaattttgctaattttattgtcatctccttcaggtaatttgcgatttctctttactctgtttttgacttgtacttagattccttttctttaacagtaataaacttcataaagatttcatttttcttcttatgggtatttggaatgatgaatgtagattaggttgattgttttgaggatgatgtggataatctttttctggatattattacaatttagggtcttgagattgtttgtaataagctccgtactttggtcccttattttcaattcagtctttaagatttcggtaacccttttatatttgatgcaatctccctataataataccttcttcaattgctgttttgccatttgcatattatttaactttctttgttggatcagtctgattctttcttaccaattattgtcttaatccttgattaagaaaaaacaaaaaaacaaaagacatg

SEQ ID NO: 18698 - DNA, 3003 bp, Unknown
  misc_feature (1)..( 3003): 2750-1469P.txt file - cDNA_ID_1819055; gDNA_ID_1620619; Annot_ID_46988
actttgcgattctatcgatgcagagatctggtagtggctggtttgagactttgttaaacaatcatactaacataagctccaacggggagatattttctgtgaaagataggagggctaatgtttccaccattttcgagactcttgacaaagtctataatctagactggttgagtagtgcctctaagaacgagtgcacttccgctgttggcttcaagtggatgcttaatcaggtaaagtgattgttattcacggacactgtgacatatctttagtctttcttactcatatgttttcgactcgtctctgtttccatttgagtgcttgaacaaagagattgctatattccatccttatctgttggtcactgttgcttataactaactacttgtgaatttaaagtgataagatcttgttctgttttctagataagagcagcaacgttttcgttttacaaaagatgtgtgttgagaataggacaatttctcaataatgtgtttgcttttgctatatactttgtaaagttgataaacacgttgcagggattggtcttagagaataggacttcttttcttccctcagtgctcttcacttataagggagtttccgagtcaatgtcatttgaaactaacctgttctatttaggtagcttctttctggttgttgatgttcaaaaaagttgcctgaataaaagtttaggttgaaatagtctgtgatttgatgttggaggaacggaagatagctgatgttcccttcttatttgatccataaacctcggttctatgtagcagtaattgaactgataaatgatcacagttattttatctgatgatgaattattaacattgcagggtctaatgaaacatcatgaagaaatagtagaatacttcaaaacccgaggcgtctctgcgattttcctattcagaaaaaacctattgcgccgcatgatatcagtactcgcaaactcttatgacagagatgctaagctactaaacgggactcacaagtctcacacccattcggccaaagaagctgagatattagcaggttacaaaccaatgatcaacacaacacttttaataaatgagctgagacagattcaagaaatgactttgaaagctttgacttacttcaataccactcgacatatccttgtctactacgaagatgttgtcaagaacctcacggtaattattacatatttttttattgaactagttccagttactgattgtttattatcttatatgtgtttttgaatgaagcagagactagacgatgtacaggagtttctaaaggtaccaaaacgtaagttaaagagtaggcaagtgaagattcatggaggttcattgtcaaaacatgtacagaattgggaagaggtcatgaccacacttaaaggaaccaatttcgaaaatttcttacaccaagaattttaatttttttttgtatatatcagaccaaacaaacccttgtaggaaagttttgtttcacttgccttttttcttttttgctgtttgctgtagggtttggcattaattctcttaaatatgaagaagatttaaacaaaatttcgttgaaaattgtttcttcccctgaagagattttttatctaaatttcttaaaagcagaagaatcacaaaattatagtgaaaccgaaagaaaccagagcgatttagtttgatttattttgttcaattcaacatcaataacaccaaaccggtaaaaaccggaaggctaattcgagattgattgatttaaaccggacaaaaccactcaagccgcgtgaccgagtttccaacacattgcagattccagtcccaaaaagaaaagagagttaaaaatgcaaaaacggtgaaggggaagagaagcgaaattgggggattgggaatagcaacgttttgcaaatggtctcttctttgtagctgcaattgcaaagaacactgagagagagagagagtgtgtgtgtgacctttgagagatggaggaaaaacgacgcgattctgctggaaccctagcttttgctggtagctctggagattctccggcatctgagccgatgccggcgccacggcgacgcggcggaggtttgaaaaggaaagcgaatgctcttgggggttctaatttcttctcttctgcgccgtcgaagaggatgttgacgcgtgagaaggcgatgcttgcttctttttctccggtacataatgggcctttaactagagctcgtcaggcgccgagtattatgccctcggcggcggatggggttaagtcggaggttttgaatgtagcggtgggtgcggatggagagaagcccaaggaggaggaagagaggaataaggcgatccgtgagtgggaggctttggaggctaagatcgaagctgattttgaagcaattagatctcgtgacagtaatgttcatgtggtgcctaatcattgcggttcgttcgttcttcttcttcttcctgtttttggttgagactaaatgcaaaatattgatttcgttttacatttgttactgttttgctttgcaaattttgaaactttatgtggagagactttccaaagtaggcaaagtaaagaactttaggtagtctaggatttatgtatcacttcgtctggaaacaaggagagatttggaattgggtttggttctagaaatcatcatatggcggatcaaagtagaatgtgcatgctcattttatctagtagaatctcattggaaaaaacttaggctatgaactgatgctcctagtccttttcttgtggtaatatgatatctaagttagattttgagttgttggtattgttgatttttcacaacttctcaccctcgcatttatgataaaaaggagttgtttttaatttgggttcctgtacttcaaattctttgaaggttggttttcatgggaaaaaattcacccgcttgaggaacgttcattgccctctttcttcaatggcaagttggagggtcgcacttctgaggtatatagggaaatacggaattggatcatg

SEQ ID NO: 18699 - DNA, 3003 bp, Unknown; identical to SEQ ID NO: 18698
  misc_feature (1)..( 3003): 2750-1469P.txt file - cDNA_ID_1819055; gDNA_ID_2926207; Annot_ID_141792

SEQ ID NO: 18700 - DNA, 3003 bp, Unknown
  misc_feature (1)..( 3003): 2750-1469P.txt file - cDNA_ID_1819067; gDNA_ID_1620619; Annot_ID_46984
taaaagtcaatatttgctctagaccctccaattttccgtaaaaatctccataaaagtctctgtccctccttgccaaccaaaaactacaaacacacatcatccttcgactatcttattcatagctatcaccacccaaaaaagaaatcaccctaatcaaaaaaaaaaaggcaaggagagattttatcattattctattttcatattttttgaaaaaactcaagcaattgacttttgtgataaagatttgaagaaagagatgaggaacgaaacgggtggtaccatggtcgttgatctccaaaccgatccatataacaacattcacagtcgccataatctgagctacgaccttagcgagggtcccaaacctaggcctaaatttggtaatatctcgaaaactgaccacgacgagatattccctcccgacgatcccatcattatcaacagcaacgtgactcaccagcggtttagcagcgtctcggcctcgaccatgagcagcggtccggccagcggagaaggttctccttgcgtaatgtcgccttgggcccgcgtgtcgcctccttggggtgcagatttcaacgaagacaatgtcctcgagaccaacggtctcattggatctattgttagaaaagaagggcatatatactcgctagccgcttctggtgaccttctctacacgggctcggattcgaagaacattagggtttggaagaatttgaaggaacacgctgggtttaaatccagtagtgggctaatcaaggccattgtgatattcggagaccgaatctttaccggccatcaagacgggaagatccggatttggaaggtttcgaagagaaaaccaggaaaacataagcgggttggaacattgccaacatttaaatcaatggtcaagagctccgtcaaccctaagcatttcatggaggtacgccgcaacagaaactctgtgaagacgaagcataacgacgcagtgtctagtcttagcttggacgtggagcttggattgttgtactcgagttcttgggacacgacaatcaaagtgtggagaatcgcggattcaaaatgtttggaatcgatacatgcacacgatgacgcgataaactctgtaatgtccggttttgatgacttggtgttcacgggatccgcagatggtactgttaaagtgtggaaacgtgagttgcaaggcaaaggaacaaaacatacgttagctcaagttttgctcaagcaagaaaatgcggtcacggcgttggccgtaaaatcacaatcttccatcgtatattgcggttcttcggacgggctagtgaactattgggagcgttcaaagcggtcattcacaggcggaatactcaaaggccacaaatccgcagtgctttgtctaggtatagcggggaacttgctgttgagtggttccgccgacaagaacatatgcgtatggaggcgggacccgtctgacaagtcccatcagtgtctctctgttttgacgggacacatggggccggtcaagtgcctagccgtggaggaggaacgggcttgtcatcagggagcaaaagcctcagtggccgagggagaccggaagtggattatatacagcggaagtttggacaagtcggtgaaagtgtggcgcgtgtcggagagaatggccacgtggaaggagatggacgagccagcagcatcttcagagcggaagagctcttcgtctccgcatgaaggaagtggcgcgtggagttcacgcaatgtggaaaaataagagtggaggagcatagtgtgattatttacgagagtgtcacgtcgtcacgagagccatattcacgccgggaaagagacagaggattgatttcatttttatgactaagtcaacggagaggtttgtgccacgctagctggtgtgagaatcaaagtcgggttaatggttttcacgtaatgagttttttggttatttttttctttaaaaaaaatgtttgaaacgaaattgaattatttatttattttccataaatttgtaagataacaagaacaaagaccgaatcaaacatatatatttgttttctttagtggtctatgtcgtggttgcaactttataacttggaattttggatgagtcgttttcctcttcattagaattagtctttctatattattataatataggatgttgatattttttaattgattttccaacctggaaatatccacccaaagttgttagaaattactaatctttgtgaatttactgttaccatttaaacctaatctatctttatgagcaaaaaaaaaaaagtcttattcaatcacttaaccgaaaacatttccacaaccgggatcatcatatatgtctctgcgcctctctttgataaatacttaaatagggtcaacacctccggttttctattaaccgtgtaattcgggttatgcgaacattattgcaggaccgaagatatatttacgaaattgccctctctctttgactccatcaacgcctttcgcaacgcatcgttttcaactcccctaacccgcgttgacggcaagaattttcccggaaaataactcatttttccttttgattgcagagaaaataaaaaacaaagagaaagtcttcccctttttttgtcaagtcctcgtcttttactagtgtatacgatccaacccatctttctgtctttcttctttttgtttacttcttctgcaaattcccttttcccggaaaatttatttgctgatttttcttccttccatcgccactttcctggaaaaaaaaactaaatttcgtctctttctttaagctaaaggagctttctgtgatcaattttttctatatttctgtagttgcgttcttatttcacgcgctttgtgatttgattatttaagccactaatggcttaggatctgtatattatcacttcatgaattctcgttttctcggataagttgttaagtttctaaattagggaattttaggaattagggcttttttgggtttgtatgtgtgcttgattgggtaagaagatg

SEQ ID NO: 18701 - DNA, 3003 bp, Unknown; identical to SEQ ID NO: 18700
  misc_feature (1)..( 3003): 2750-1469P.txt file - cDNA_ID_1819067; gDNA_ID_2926207; Annot_ID_141788

SEQ ID NO: 18702 - DNA, 3000 bp, Unknown; identical to SEQ ID NO: 2973
  misc_feature (1)..( 3000): 2750-1469P.txt file - cDNA_ID_1819079; gDNA_ID_1620619; Annot_ID_46980

SEQ ID NO: 18703 - DNA, 3000 bp, Unknown; identical to SEQ ID NO: 2973
  misc_feature (1)..( 3000): 2750-1469P.txt file - cDNA_ID_1819079; gDNA_ID_2926207; Annot_ID_141784

SEQ ID NO: 18704 - DNA, 3003 bp, Unknown
  misc_feature (1)..( 3003): 2750-1469P.txt file - cDNA_ID_1819102; gDNA_ID_1620619; Annot_ID_46971
ctagaacgttccggtctaggccaagagacgtacgtacccgaaggtcttcaaactttgccactacaacagaatttggctgtatcacgtatagagacggaggaagttattattggtgcggtcgataatctgtttcgcaacacgggaataagccctagtgatataggtatattggtggtgaattcaagcacttttaatccaacaccttcgctatcaagtatcttagtgaataagtttaaacttagggataatataaagagcttgaatcttggtgggatggggtgtagcgctggagtcatcgctatcgatgcggctaagagcttgttacaagttcatagaaacacttatgctcttgtggtgagcacggagaacatcactcaaaacttgtacatgggtaacaacaaatcaatgttggttacaaactgtttgttccgtataggtggggccgcgattttgctttctaaccggtctatagatcgtaaacgcgcaaaatacgagcttgttcacaccgtgcgggtccataccggagcagatgaccgatcctatgaatgtgcaactcaagaagaggatgaagatggcatagttggggtttccttgtcaaagaatctaccaatggtagctgcaagaaccctaaagatcaatatcgcaactttgggtccgcttgttcttcccataagcgagaagtttcacttctttgtgaggttcgttaaaaagaagtttctcaaccccaagctaaagcattacattccggatttcaagctcgcattcgagcatttctgtatccatgcgggtggtagagcgctaattgatgagatggagaagaatcttcatctaactccactagacgttgaggcttcaagaatgacattacacaggtttggtaatacctcttcgagctccatttggtacgagttggcttacacagaagccaaaggaaggatgacgaaaggagataggatttggcagattgcgttggggtcaggttttaagtgtaatagttcagtttgggtggctcttcgtaacgtcaagccttctactaataatccttgggaacagtgtctacacaaatatccagttgagatcgatatagatttaaaagagtgagtgattctatttatcgttattaagttatgatacgaattaagaagatagagacgtatagactggttttatatatcgactatcgtactttaatttggtcggtccaaatatgtacaactaatctatccgttctctatgtattgttctcttttaagatttcttgttttttttttctttggttgttatgatgcttaattcctctcgtcaactgtttaagaataagatttgatgcgtggtagtggacttgttttcacacttcgtatatatatgaccttgtttacttttctacaaagaagttttatcacacatatttagacagggaaaacaagaggaatatatataaatgtaaaacttgccttcgtgtagaagagaaaatgattttcttaatttgatccgtaaaaatgaaggcaagtaaactggagtgcttgtacttgtagcatttaaacaaactcgagtgtgcaataattccacaagcatgttactttaaagatgggaagatgatatttagcagatcgatcttgcgcgtgagatgacgtaactgttctcggtaagatttgtctttacatgaaacagcttgagaagcccatatctaaatatctctttaatcgtgtgccaatcaattttcttatgtttggtttgtctatatagatatatgaccattgtattaatcatcacaaacagaacagttggaagtagatatattaattcatacccaaatctttcaacaaatttttaagtccaacaaaatgtcaatatcacaagttgcaattgatacctaggatttttcattaatcaatataaaaaccaaaaacaatctgtaaaccctacagcctaaatattgtatttattatcaaaacctatataaaaccctcaagtcataaaaccttaattaatattattaaataaatataaatagatttgaatcaagatcacgtcatgtttgtttgattttatttcgcttcatatcattgaagaaaatcataaaaccacatgagatgaatatcttcgacaacgaatacaatcagcgtaatatacggcttggatgatatgactatagatctttcagtatctatttaaagaaaaaatgacgaaccaaaataaacttcattcgtttgttaattaagagattattattttttcttagataaacgaaagtcggtggatagaaaaatattaaatgctcaaattattatggttggtttagtcttctgaattcgtagaaaattgagatgagctaagcaaaaatgttctttatcctcgtgagctgctccaagaagtggttgatgatgtaatggacaaactcgtttcgtggatcttatcattctaggctatggaccaatatggtgcagtcgacacgttcggggctttgtctgcattttgtggtctcgttattctgagttgtgatcatcattaataagtgagttgtaatgcattacaaaatcggtttgtagttattcatcctttccaaatcaaaagtgacatattgacaattttgaggcaagctttttgtttttataataatactaattagattacataatcttcaatttatattatttttaaaattagaaaagagcatttttaaagcaaaaattacattgaatcataaagaaatattggtttaatttatagagatgaacatgttgataattgaaacaaatttatttaattattttttgtatgcactcaactctgtttggcttcaatcatataagtataaaatataattaaaatgtttttattaaaatattagatttcatgattcttgttttagtatataaaaaaaattgatatctccatatcgctagtgaatagtgcagtatctctttacgcgctatttcaagaccaaaccttttctctcttctagagtgaaactgtggaagcaactctcacagagcagcaatg

SEQ ID NO: 18705 - DNA, 3003 bp, Unknown; identical to SEQ ID NO: 18704
  misc_feature (1)..( 3003): 2750-1469P.txt file - cDNA_ID_1819102; gDNA_ID_2926207; Annot_ID_141775

SEQ ID NO: 18706 - DNA, 3003 bp, Unknown
  misc_feature (1)..( 3003): 2750-1469P.txt file - cDNA_ID_1819110; gDNA_ID_1620619; Annot_ID_46969
aaaatagtgacacacgaatgaaaaagctcacaaacaaacataagagtgtttaaatcgagtattcgagtatgtataaaaagcctcgagtttcatgatatcaagcgtcgagattgcttccttcgacatcaacgacgaacctataacgcacatcgttcttctcgagtctctcaaacgcagtgttaacataatccatcttcacaacttcgataatcgaactcaaacccttttctttacagaactcaagcatctcctctgtctccttcatgctccctatgaagctccccgttatcactttcctccctaatcaaaccatcatcatcatcattcccaattagtaatcctctaaatcacaatcattaagaaagggttaacttttttaataagggactcaccaagcataagcagaggagtgagaaactgtaatggattgttgataactcccatgagaatgagtttaccatcaagcttaagcagagacaaatatggctcaagtgcatgatgaacaggcaccgtgtcaattacgtaatccaacgaatcagccaattcgctcatcttcgcttggtcggatccgatcacgtaatcatcagctccaagatcttgcaatgcctcttctctcttcttgtttgatgagcttatgacagtcacatggtgacccattgctttggctattttcacacccatgtgaccgactccacctaaccctagtatacctcctcttaggcctggttgtttcagaccaaagtggctcagtggactgtacacagtcacaccagcgcacagtagcggcgcagcctgctcaaccgccattccttctggaatcttgaccacaaacctgaacacaagaaattgaccctttagccaaacataccctaccctgttccccaagatacctaaaccaaaacctaaagatccggtttgaagcttgattttctattagataaattcaaattcatatgcatctctttgattttagtataaggatatttatgagtagttagtatatgccaaaatcgttagttgaacaacaccaagattatgtgttgaaattcaatcataaacttggtgggatttttgtatattatgattgaatttcatcacatactttatactaatttttttaaaatcattgatcaaatagcacaaagattattatcactggatttcaagatcaccgcaatcaaataaaacctgtattaattaatttacgaagatcaagataatcataaaagttaagaaagaaaaagagttgtacttttggtgaacgacggtggctttagcgaagccgccttgtgtaggttgaccattgatgtaaacatcattgtagctccaaatcttctttggacaatactgttccagatctctctcgcaggggctacaacctccgcaacatccaacgaggcaaccaactccaactatgtcccctacggtgaacttgctcacatctgatcccacctccactacttcccctaccacttcatgcctgacaacatatcactcgatctcagattctattgtactctatatgtcattttcatcagaattgatcaagaacaagaaagaagagattattatacccaggaaccatggggtaattagacatgccaagatcatttttagtttgatgaagatcggtgtggcagattccacagcaaatgattcttatgttcacatcctctggtccagtctctctgtaatcaaaacacacaaaagatgatgaaactgaaataaatcaaaacaaaacacaaagatgtaaaagaagaggaaactaattaaaaacctaagagtgtaagtgtaaggagagaggatcccagatgggtctctggcagcccagcctgttgttttcctctctgcctccattattcccattttttgatgattctttcttctttcttatcttgatctgctgctttcacgcttttgctgtttatgtgtgtgtattactatatatatatatagagaaagttggaaacgtaacgtatgcgtatgtgtgatgaaataattggtgtttctgcatagcacacatttgatggctataattgagtgtaaatttgtgtatattattgacaaaattagtcaaaagcttaaaatcttttttagtcgttgaaagatccttctagaaaaagacattttttttcttcttcttttcatacgatggctcatggctgtgtagtttattagaattttaggtgaaaaaaatattagaagccaacaaaacttaaatgaaatttatttgcattcataattcattttaccagtttataacaacaacgtaatccaaaaagtaaaatgagaaagaatggaatttgtgtactttgaaaggaagaaaaaccactattgacgtggacacgtcggctaaaggagggtccacgggggttggtgaacaaacaatgtggggtctaatcgtgtgtttgctttggtttaaaatcatggttggccacgtgttgattcttgacctctctctgacatgaaactgtagcattgacggcccagatcagctgcgagaatacttcccacaaccatggaaattttacggcccagatcaacaaagaatcgatttgctctttactatttcgaagaacaaagagtgacagttatgaataatagaaaagaaggacaaagagtgtgtgaatggcttcacattaaaacaaaagcccattatgaatgacccattcacatttcacacccagtttgaaaaatcgaccgtccaattaagtaacattcaaaaacccaaaagataaacctctaattcacgaatcacaacagcagcatgagccgtttcatcacgacgttatctcagagtttcttggaaataatttgttgtagcggacttgtggctgtaaatggggccaatgcttaaatttacttgtctcgtctcttctacacgtcttctcttccgaccacacccttcattcaattcaacgtctcctctctggctctctctctcaaatatataaacaccaataatgtctccaatttgagatttttaactgaacccaagtcatg

SEQ ID NO: 18707 - DNA, 3003 bp, Unknown
  misc_feature (1)..( 3003): 2750-1469P.txt file - cDNA_ID_1819110; gDNA_ID_2926207; Annot_ID_141773
aaatagtgacacacgaatgaaaaagctcacaaacaaacataagagtgtttaaatcgagtattcgagtatgtataaaaagcctcgagtttcatgatatcaagcgtcgagattgcttccttcgacatcaacgacgaacctataacgcacatcgttcttctcgagtctctcaaacgcagtgttaacataatccatcttcacaacttcgataatcgaactcaaacccttttctttacagaactcaagcatctcctctgtctccttcatgctccctatgaagctccccgttatcactttcctccctaatcaaaccatcatcatcatcattcccaattagtaatcctctaaatcacaatcattaagaaagggttaacttttttaataagggactcaccaagcataagcagaggagtgagaaactgtaatggattgttgataactcccatgagaatgagtttaccatcaagcttaagcagagacaaatatggctcaagtgcatgatgaacaggcaccgtgtcaattacgtaatccaacgaatcagccaattcgctcatcttcgcttggtcggatccgatcacgtaatcatcagctccaagatcttgcaatgcctcttctctcttcttgtttgatgagcttatgacagtcacatggtgacccattgctttggctattttcacacccatgtgaccgactccacctaaccctagtatacctcctcttaggcctggttgtttcagaccaaagtggctcagtggactgtacacagtcacaccagcgcacagtagcggcgcagcctgctcaaccgccattccttctggaatcttgaccacaaacctgaacacaagaaattgaccctttagccaaacataccctaccctgttccccaagatacctaaaccaaaacctaaagatccggtttgaagcttgattttctattagataaattcaaattcatatgcatctctttgattttagtataaggatatttatgagtagttagtatatgccaaaatcgttagttgaacaacaccaagattatgtgttgaaattcaatcataaacttggtgggatttttgtatattatgattgaatttcatcacatactttatactaatttttttaaaatcattgatcaaatagcacaaagattattatcactggatttcaagatcaccgcaatcaaataaaacctgtattaattaatttacgaagatcaagataatcataaaagttaagaaagaaaaagagttgtacttttggtgaacgacggtggctttagcgaagccgccttgtgtaggttgaccattgatgtaaacatcattgtagctccaaatcttctttggacaatactgttccagatctctctcgcaggggctacaacctccgcaacatccaacgaggcaaccaactccaactatgtcccctacggtgaacttgctcacatctgatcccacctccactacttcccctaccacttcatgcctgacaacatatcactcgatctcagattctattgtactctatatgtcattttcatcagaattgatcaagaacaagaaagaagagattattatacccaggaaccatggggtaattagacatgccaagatcatttttagtttgatgaagatcggtgtggcagattccacagcaaatgattcttatgttcacatcctctggtccagtctctctgtaatcaaaacacacaaaagatgatgaaactgaaataaatcaaaacaaaacacaaagatgtaaaagaagaggaaactaattaaaaacctaagagtgtaagtgtaaggagagaggatcccagatgggtctctggcagcccagcctgttgttttcctctctgcctccattattcccatttttttgatgattctttcttctttcttatcttgatctgctgctttcacgcttttgctgtttatgtgtgtgtattactatatatatatatagagaaagttggaaacgtaacgtatgcgtatgtgtgatgaaataattggtgtttctgcatagcacacatttgatggctataattgagtgtaaatttgtgtatattattgacaaaattagtcaaaagcttaaaatcttttttagtcgttgaaagatccttctagaaaaagacattttttttcttcttcttttcatacgatggctcatggctgtgtagtttattagaattttaggtgaaaaaaatattagaagccaacaaaacttaaatgaaatttatttgcattcataattcattttaccagtttataacaacaacgtaatccaaaaagtaaaatgagaaagaatggaatttgtgtactttgaaaggaagaaaaaccactattgacgtggacacgtcggctaaaggagggtccacgggggttggtgaacaaacaatgtggggtctaatcgtgtgtttgctttggtttaaaatcatggttggccacgtgttgattcttgacctctctctgacatgaaactgtagcattgacggcccagatcagctgcgagaatacttcccacaaccatggaaattttacggcccagatcaacaaagaatcgatttgctctttactatttcgaagaacaaagagtgacagttatgaataatagaaaagaaggacaaagagtgtgtgaatggcttcacattaaaacaaaagcccattatgaatgacccattcacatttcacacccagtttgaaaaatcgaccgtccaattaagtaacattcaaaaacccaaaagataaacctctaattcacgaatcacaacagcagcatgagccgtttcatcacgacgttatctcagagtttcttggaaataatttgttgtagcggacttgtggctgtaaatggggccaatgcttaaatttacttgtctcgtctcttctacacgtcttctcttccgaccacacccttcattcaattcaacgtctcctctctggctctctctctcaaatatataaacaccaataatgtctccaatttgagatttttaactgaacccaagtcatg

SEQ ID NO: 18708 - DNA, 3000 bp, Unknown; identical to SEQ ID NO: 3008
  misc_feature (1)..( 3000): 2750-1469P.txt file - cDNA_ID_1819116; gDNA_ID_1620620; Annot_ID_47024

SEQ ID NO: 18709 - DNA, 3000 bp, Unknown; identical to SEQ ID NO: 3008
  misc_feature (1)..( 3000): 2750-1469P.txt file - cDNA_ID_1819116; gDNA_ID_1620620; Annot_ID_162275

SEQ ID NO: 18710 - DNA, 3000 bp, Unknown; identical to SEQ ID NO: 3008
  misc_feature (1)..( 3000): 2750-1469P.txt file - cDNA_ID_1819116; gDNA_ID_2926190; Annot_ID_140987

SEQ ID NO: 18711 - DNA, 3000 bp, Unknown; identical to SEQ ID NO: 3008
  misc_feature (1)..( 3000): 2750-1469P.txt file - cDNA_ID_1819116; gDNA_ID_2926190; Annot_ID_200959

SEQ ID NO: 18712 - DNA, 3003 bp, Unknown
  misc_feature (1)..( 3003): 2750-1469P.txt file - cDNA_ID_1819120; gDNA_ID_1620620; Annot_ID_47023
ctgaagcatacagacagattaaatatgtgaaaaaacattctcaaaataagtaaagatgaagttcgtctccaagttcacatttacctattggcgtattgaacaaatccgcaacgttttcctgcgggtattttcacatgaactagttcaccaaattgaccaaaaactgacttcaaatcatcttctgttacactttgatccacagctccaacaaaaatctggaatagagaacataacgcttcaatttcaacaatatatcccacagagaaaaaggcttaggcaacgtcaaagaaaaaaaaggcttagggaaaccaaaacaagttacgcactgttgtgttagttggatcactttctcctgaatttccttgagtgttctgatatgaagctgcaataaaacagtcaagagaaggtaaggaaaaaaacctcaaacatctatttatttaattaagctgacagtgcaaggacacagacactaacacaaacgcacacacacgacaatagcagtagcagaacttatccaaatcaagacccaaaattatcaacatataaagcaaatgccatacataggttacagctcgaagataaaggtaaagtgattctgaagttagttgctaattaatacaaaaaagcacattaaagatatactaggggaagtgcctgcaagatccaacttcgagaaattagagaatcggacctaaattctctagggtatcacaagtaacctaaattccttccaaggtctgacagtcttaccattgtaatcaacttttccgaaagacgaaatgtaacactaaaaaaggttgcaagtataaatttagaggcacaacgtaactgaaagaaggaaaaaaattgcagcactaactactggaaaaagatgaattgagaggtatgaaaaagatatcaaaacactctttaaggattcaaactggacaaaataaagcgaagagtaatgaactatgtaacatgaaaagaaataaaagatagggctaaaaattaaaaggaaagacttatgcttgataagtaagaaactggaaaataatttgcaaatggagtaaaagctttgtaattaacttcttctgaaaacataaccaactgacctaaatgaggccacgcaaggtggaatcattttcagctgaaatcagttccaggcccccgaaagagagcctcttgttctcctgcttaaagacaacatgagtttttttcttataagttttaggatgttttgcgatattaaattctttgaagagctgaaaggcaagaagcgggagaaaagggtagacagattctccagtaatcagaaagatagcagtaaaggagtaccccaaagaaaagacaatcaactaacatagacagtgtaagacaaagtgagtcatatcatcactcaacttattcataagtgatcagatatcaggctccttaatatcaaaacatacctggttgcattgtaagaggcttcttgttggcagcaggaccagtacgcataggccttgatgagcagtattgaccattcatttcagtcatggcacgaatctgctcactttcatccgcaaacctgacaaatccataacccttggaccgtccagtagtcctatcattcacaactttagctcccttgacagaggaatacacagctttaaacgtttcagtaagcatgtggtcggtaacatcaggtgccaagtctccaacaaaaactgtgtgctcaggcccttcagcctggcgtctctctccagctccaagctgagcccagttcaacctgaaggcctgctcactgctcggcatcggagcaccattgtaagtctgtaaattcctctcagctgtagcatggttcacaaactcaataaagccataaccttctgaatatccgttctgtttattgcgaataactttagctgctgtagcctgcaaccacaaaggatgaaactttcaatacttgtagaagaaaaacgagagactaaaaacagaaatcaacaggattttcaaaattacctcgccagtaagaccaaagacgttcatgagatagttctcatccatccatggctgcaagtcaccgatccacagggaccggatctcaccagctgatcctggattctgagatccaccaccaccatactgctgctgctgtggttgaccagaagacggtgcagactgctgattccatcctgcaggcggctgaccttgttgttgctgctggtgctgcatcatccacgactgctgctgctggaggtaagcttgttggtcggaaggaatctgccctggccctgttgcagcaccgttggaagctggaggtggctgctgcatcatgacgacgataacctagcaaaaggtacgactgtcgtagatgcaattaaagggttgagctcgaggacgtaagggcaaaagagagagagagagaaagattcgctgtcgctgtttcttttttatagtcaaaagttggttctaatatggcccaatataaaagtttgagctcggcccattataagagcactcgaacaacccggttaagtaagtctagggttgaccaaaaaaatcgatacgaaccggtcgggattggtttgggattgagatgcctgatttcgaactctcagcgtcgccgatatgttttgtcctgttaaaccctaaaactaaaaccccgcgaagagagaagagttctctgtagtgttcttttgatggcggaatcaatatcatcagacttggaagatcaaggtacgataatagcttgacatgtgcagactcttttagcaatatctgtttggttttttccaacaaaaaaaaaactaaccattagaattttttggaattaattgttggaatttttgagtcaattaataaaattttagctgaaatttgtctggctttacctttgaatgaagacttgtatcacttatttgtaattgccttgaaagtttttgtctttgagtagcttttaattctcttgaacagtgtggactggtggagaagtagtttcttactatctgattgaatactttgtttgatatatcaggaatg

SEQ ID NO: 18713 - DNA, 3003 bp, Unknown; identical to SEQ ID NO: 18712
  misc_feature (1)..( 3003): 2750-1469P.txt file - cDNA_ID_1819120; gDNA_ID_2926190; Annot_ID_140986

SEQ ID NO: 18714 - DNA, 3000 bp, Unknown; identical to SEQ ID NO: 3010
  misc_feature (1)..( 3000): 2750-1469P.txt file - cDNA_ID_1819124; gDNA_ID_1620620; Annot_ID_47022

SEQ ID NO: 18715 - DNA, 3000 bp, Unknown; identical to SEQ ID NO: 3010
  misc_feature (1)..( 3000): 2750-1469P.txt file - cDNA_ID_1819124; gDNA_ID_2926190; Annot_ID_140985

SEQ ID NO: 18716 - DNA, 3000 bp, Unknown; identical to SEQ ID NO: 3018
  misc_feature (1)..( 3000): 2750-1469P.txt file - cDNA_ID_1819128; gDNA_ID_1620620; Annot_ID_47021

SEQ ID NO: 18717 - DNA, 3000 bp, Unknown; identical to SEQ ID NO: 3018
  misc_feature (1)..( 3000): 2750-1469P.txt file - cDNA_ID_1819128; gDNA_ID_2926190; Annot_ID_140984

SEQ ID NO: 18718 - DNA, 3000 bp, Unknown; identical to SEQ ID NO: 3017
  misc_feature (1)..( 3000): 2750-1469P.txt file - cDNA_ID_1819132; gDNA_ID_1620620; Annot_ID_47020

SEQ ID NO: 18719 - DNA, 3000 bp, Unknown; identical to SEQ ID NO: 3017
  misc_feature (1)..( 3000): 2750-1469P.txt file - cDNA_ID_1819132; gDNA_ID_2926190; Annot_ID_140983

SEQ ID NO: 18720 - DNA, 3003 bp, Unknown
  misc_feature (1)..( 3003): 2750-1469P.txt file - cDNA_ID_1819136; gDNA_ID_1620620; Annot_ID_47019
gttgctcgtaggtgtttcagcttataaatacattttctaaacttatatccttttaaacgtcttaaaattattatttccttgtgtcattgatccttactgcaaacagtttatgactttgaggacttgattttatgaacttcgaagttgtgaatgaacaaagtcaagaattatttctgtttctgtgttagcaagtcaagaaatccgtatgcaaattttccatttaatatgtcgctcaagttcaaggcaaaacatttatcgtttttcttttgcctttatttccttgtcaagttctcaagaaggaagaggaggagaagaaagccagagtaggcaccggacgcaaaatcaccattggtaattaacattagagcccagaaaatttgtttcatttatgaattggtagcttaatgttcggtctccttgtgtaaaggtaaagttgatggtccagatttgacaagctttgttcgccaatttccaccagattcaaaaggtattacattttctctgccaatagattaattgagtcaccatagatgctgatgactaacttcttaggaatcccttgtgtaaatttgatagagattatgatggatatgcgtttatatttttgtggtgtttgacccatgaaatggtgtccattggctgatgattataatagttttgtgaaagaaacatcttttgaatgttccccatataaccattatgattgcggtagcttaaaagggcaacaaaattgttctcatgcaccattatatatcgtttaagtcatttgttgattcaagggctgaggttactacagttgctagatttcttataaccttaaaagagattatggttcgaccataaagtcgtggaagtaagactgacagttaagtttatttcctttttttgttaatgctttaaggtggtgaaccagaggaagctagtgaagaagcagataaatcaaggtgagtcatcatgattcataatatctccgcactaatcatatatgtgttaaatcttcttacattctattttttcctggatgcaaagcacaacatctttcagaagactaacataaccacatgttctcacattgctttacagggccaaggaacatgaacccgagatagtttctgcagaaccacccgaaccaaagtaagtctagccaacttgacattgttaatcctaaagttcagattctagctcacggatacgaaacatgactcgttctttctgatagttacagactgctactatgctgaaactgttctctatgaacataagttatgtattgtgtttggtatgctttaaattaaactaatgttaatgttgatgttgatgatgatgcaggacaacagagccatcaggatctggatcatcatttaggcccgggacatggcagccaccatcctaaacacatctctcttcacgcagatgacaaaccaacatactattcaattattttgtttgttgtactctacacaaccgattggtttgagccttacagatgagccataagaccagagagcttttcaagaccctaaaattgtgtcctttcacgctgtcattgaggacttagaagagtcaaaatgagaagccatcttcttatactttgttttgtttagggtgtttgtctcttggcataatgcttgagacttttagcctgccttgtccttcatagctgaagaggagcctagctaccttttgtttctcttcgttgacttgaataaaacagtttgattgaataacagttattcattttcatgtcatgatggtagtggatataagaaaaaacaaatacatagaataattattttaatgtttcagaggagaaatcctacttggcttgtgccagactcataacccaatcaaaacttcgtattaccaaaataagtgtagttctaaattttattctggtttaggctgtagttataaattactcattttagtttgtgaatataaaattactttctgcaaaagaaaatattctcatctttcgacgaaaagccaattattcgaatgttctcacgttggtctgtagctgtaaactttatagtttatataataaggtgttctactgttcttatataatttgcaagaacaaataatattaaatgcaaataaaaaatagtcaacggtccaaagtggatcataagccgtccgttcggtcgtctgaacttcatccaacggttaaaagaaatatacctgacgtggccttgggccattgtatattagtagtgagtgtgcccttggaaggttctgtaaaatgttttattcgcctctatcagaagcttgacgaaatctcttctccgtctctctctctctttccctcgtccattccacgatcttcttccaatctcaaatctcccattttctagtgtttcattttgatccttcttccttcctctggagatttctcaaatctcttcaactattttgatttgccgccatgtatcgacgcgccacttccggcgtgcgttctgcctccgcaaggctttcttcttccctctccaggatcgcctctagcgagacagcttcggtttcggctccatctgcgtcgtcgcttcgcaatcagacgaaccgatctaagagtttctcctcggctctccgctcctttcgagtttgctctgcttccacgcggtggagccatggtgggagctggggatcgcctgctagccttcgcgctcaagctaggaattccactccggttatggagaaatttgaacggaaatacgcaaccatgggtatgtctgtttgctttctctgacgttctaagaatgattgctcttaacttgtgtgacaagaatctgtgtttaccgcatatctgcttagatcgatttttcgctttaaaatgatgatctactgattctgatatgttctgattcaaagtaaaactagctagatgaacatttgatttgctcttgcattttggtttatgatttgtagatttagtctactaaatttcttttttgtatattctaaaaggacaagcaaattcatgtgttatgtgtcaattgaattatg

SEQ ID NO: 18721 - DNA, 3003 bp, Unknown; identical to SEQ ID NO: 18720
  misc_feature (1)..( 3003): 2750-1469P.txt file - cDNA_ID_1819136; gDNA_ID_2926190; Annot_ID_140982

SEQ ID NO: 18722 - DNA, 3000 bp, Unknown; identical to SEQ ID NO: 3003
  misc_feature (1)..( 3000): 2750-1469P.txt file - cDNA_ID_1819156; gDNA_ID_1620620; Annot_ID_47013

SEQ ID NO: 18723 - DNA, 3000 bp, Unknown; identical to SEQ ID NO: 3003
  misc_feature (1)..( 3000): 2750-1469P.txt file - cDNA_ID_1819156; gDNA_ID_2926190; Annot_ID_140976

SEQ ID NO: 18724 - DNA, 3003 bp, Unknown
  misc_feature (1)..( 3003): 2750-1469P.txt file - cDNA_ID_1819160; gDNA_ID_1620620; Annot_ID_47012
ctaaatcggttgacaagtcggaattttccggtacaccggcgtttatggccccagaagttgctcgtggtgaagaacagaggtttccggctgatgtgtgggctttgggatgtacgatgatcgagatgatgactggatcaagcccttggccggagttaaacgacgtcgttgctgcaatgtataagattggattttcaggcgagtcgccggcgattcccgcgtggatatcggataaagctaaagactttctgaagaattgtttaaaggaagatcaaaaacagagatggactgtggaagaattacttaaacatccatttcttgatgacgacgaagaatctcagacaagtgattgtttgaagaacaagacttcttctccaagcactgtgttggatcaacgattttgggattcatgcgaaagctccaaaagtcacttagtttcgattgatcatgaagacccttttgctgaatactcggaatctttggattcaccggctgatcggatcgagaaactcgccggagatgagttttcaagcttacttgattgggatacggaagacgatggcggatggattcaagtgagaggcgagaaacataaagaaaccgagaaacgcgacggcgacgaagacgtgatttgcgttgaagcaacgtcatcgtcgcaaacgattgaagaagttgaagattggatttcgaatcaagacagcttgttctcggaatattcctctgacgacatcattaataatttctactctaatgttgctattcaaggaaatttaattgcatttcattattgtactgatgaaggtgaaaatgtatccataaagaatatgtttcgtactaataacaaacatttgtttttcaaattgcaagctcatgttaaattcactaaccaagtctgatgaaacaatgtccatgtgttcaaacttcaaaataaaagaatctatgtacattagtacattacctaaatatttccaatgcaacatatgcgttaggttatgtgctaacgatcactattgtatggactctagaagacaattcaaattgcatatttcaaagttggaaacacaagtctttgtgttcttgttagaggttacgtcaatctataagataagattgactatagacgaagtcaaaactgtactttgtccaagatttatttacacacgaagtcatgtcaatacaattttgtgtgtgtttacctaaaccgcataagaccccgttatgttaacgcagacgactctctgggagtacataatcatagtcgtaaattaattactaagcaccaaaatacatatttgaacaagtaaataaaatgatatctaataactttagtcaactttcaccgtctgaaatctaaaaacacacatacaccgacactgataatttcgtcggtcttgagagttgatagttctactctatagacatgattattggagcagaacattcctactttgacaccgatacctaacaaaacaaattagtttatatcaataccgtacaatttattaggtaccgtttgtagaaatttgttgaaacattaattatatttttcttcccgtacttatccaaatacaacaatttaagaataccacttaatagaatgatatcctttggtcgacaatagctctaaatcactttcacttagtataaatgtattatgtatagtacaattttttttgattattttatatttaagtatttgtcttcttttaaatcattaaaacattgatatgaactgttgtaagctaatactattacaaaataaaataaaaccattgtttcttaccatcattctcattgccactatctttaatatttcataaaagcataacatataataaagtttacctacaaaatgaaaactgatcacaggtagaaataagttcgttgtgacttaaaagttgatgctgatgattgatgagtcagtgatgacgtcctggtgacattcatcaaacgcataacataccaaagttacttgtcatctctttttgtctatcttttagttttagtatgggtttgtgaattggtgatagtagtaagtggtgaatgcccaaatttgaccacttcatcgcataataaacttatataaaacaatctgataaaaatattcacaattactgcaatcaaattctatgatgaaaatggttattaagtttacctgcagaaacacatgctatgatgttctccaattcaaaataaatcaattcaaccgatccaaaaacctacataaatgttttgaatttatgtatgatgtaaatgtaatagtgtcttgttaaaactagagcatgttactaaatcattatatagaaatgagtcagatagaagaagtattaaaaagagttgacttgagaaaaaggatgggaacttgggaagagttattgttggcaaacacactcaataatagcaaatatcatataaaccttttatttttgtccttttctgttttgctcatctttcatgccttgcattagatggctggagttggtgtattacatataaaccgtaagcccttatatccattctccaatatttaatttcatctcaaattcaaactggtactgaaaatttattatttctgttgttatttctctaagagacttatctatatatatatctcctatgcatgatatactatatagaactttcaatatttttttttttttgatcaaagattattttcttttctttaacttgtgttttattaatcactttctatccgttgtaaatcatatatattaagagcatgagtctaaaatactcacttttggtgactagtaactttgctgtaccttcattttttttaaaaagagctacaagactctgtaagagtgaaacgaagcccaatcccattatctgttatgaaaagttcataaaagcccaattaatatacaaattcactacacgaggagaaacgacgtcgttagtggagtggtaagtgttgacaaagtgacgagtgacgacgaccttttgaattaacaatcgaagcagtgactgagtttgatatcaatg

SEQ ID NO: 18725 - DNA, 3003 bp, Unknown; identical to SEQ ID NO: 18724
  misc_feature (1)..( 3003): 2750-1469P.txt file - cDNA_ID_1819160; gDNA_ID_1620620; Annot_ID_162263

SEQ ID NO: 18726 - DNA, 3003 bp, Unknown; identical to SEQ ID NO: 18724
  misc_feature (1)..( 3003): 2750-1469P.txt file - cDNA_ID_1819160; gDNA_ID_2926190; Annot_ID_140975

SEQ ID NO: 18727 - DNA, 3003 bp, Unknown; identical to SEQ ID NO: 18724
  misc_feature (1)..( 3003): 2750-1469P.txt file - cDNA_ID_1819160; gDNA_ID_2926190; Annot_ID_200947

SEQ ID NO: 18728 - DNA, 3003 bp, Unknown
  misc_feature (1)..( 3003): 2750-1469P.txt file - cDNA_ID_1819170; gDNA_ID_1620620; Annot_ID_47009
aatattattattatattaacgaaattttctttttgactttttctgttcaacattaatttgtaaatttatgttgtctttatagataatatttacatggtcgtgtttattcatgggacgggggtgtggtcgtagcaactactacgaggctcaatttgggcaaatgactaccatcgttcgttcggtcgtttttttgcgaaactatgatataatttttaaatacatatattgagaaatatttagaccattgctttttgttcgttattttatgagacaaaactacaaaataaacaaaaaaaaaaccaaacaaggcaagaaacacaagttaagattcggaatctaagaaaaggatatagttcttgaaccacataatagtggtccattatttatttggcagtctctacgactacgatcgtacgtccctccttccatcaccgtttgttttatttattgtttcttttctttttttactttaaacaaccatttatcatgttttaagacctcgacatgtaattcgaattagtattgcattaagatttaaagagttacggcggtggatcggtggtagtcagtgcaagtaacggatcataattgcggttgaccaagcctctttcactggcctctttgtaaccatgaaagctgagatgctattggtacaccactaagtcccaaattcccaataatcgtgcgtcagtaaacatcaatttcgagaggacaagtatcaaaatgcgatatctgctgttacaaatattcaactcagttacaaagcccttaacaatgtattgatttctaattttctataaagtaactttgtgaatacacctaagtttatcaatgaagaataaaattgtttaaaataatcgacaaaataacattatacatgaattttacaacaagtgtttgagcatagtagctaagttgttttcttggggtactctcttggtccgaaaatggtggaaccaaccctcacattggtgcttcccatctcaatctgcagaaacatagtcaaagatcatcttccacatatatgtggttcctcggatgaaagaaagaacacattcaaatgattttcgatattgagttgattgcattttcgatattagaagagagacaaagatattaccgctagctcgaagtcaccagacatgcccatggacagttcaaattgatcctcagccattccaagtgccttgcatacatcagctctacagtttgaaagtgtctgtcccggtttatggggaaaagaataaaccttggtaagtaaaacttgtaggaataacccgagaacacgtaaaacaagtatccaatcaagtagtagaataccctgaagttctctggggtagacgtataatcaggcatcccaatagtcattaatccggagaataccagatttggacagtgatgtttcacatgtcttgctagctctacaacgctagaaggttcgattccagatttagctgcatccataatcaatcagtcagccaactgaagaggctggacaaggaaatcagcatagaggtaaaatactcacaaacttctccgcttgtgttcacttggaccaaaacctttagtggatgtctcccaagatttgaaacagctcgatctagatgatttgctacctgtgaaatcaatcccaagtgattgtataaccaaaataacctcctagtaaagtgaattgtgcaagttaaacgccacaacaacctctaatcgctagttataataccttttctccatccacaccatgaaccattgccaaatttgggactccagctgcaaacattggattaaacgactttcactttcactaaacccctaattcaatattaaagatggggataaaagtcagactcaatagcgttttggctttgttgctctgtaaatgccccacgaaatgccactctatatcttccggaagctgtatatcaatcaaacaaagtgaaggagaagctccattagcatcatcaaaagcacaaaatatatcacattcccagaaaatggagagacacatagtagttagtgattgaaggataaacattcggattttgaaatgaaatcgattatctagtgaagataacaaggattggagagaggaacctgtggagctttatcgatgatttcttgaacgtaattctcgccgaagcaacggtgacctgcgtcgtagatttggcggataagtgagacgggtttagtcttggagactggaaggaccctgacccgctcggcatctcttcctacttgctccgccgccttacgagctctaagaatcacagagcggagagcacttgcgacggttgcctccaccgcaggagctgccatcgccaatcgccactaacgcctgtcgtcaatttgggcttcttcgggagtaatgtttttgtcacgtaaattagtttatggcctttaattggataattcacggtccacacgttcaatactaattgcgattatttatctcttcacttttaatcaaaatttccaaggcagagacacatgtaagggttgatgtatatagtcatcaattcacgagattattggaatctttattgcataaacaatatcaaaattgtgtttttatatataccctttcaaaacgttatgggattcaaaattacacccacacccaccacttattgattggacataacatcattcaatgtaaaattacacccacctcttattcatgttttaattttcacttctgtatatatttttcgaatttcatgtattctgtttgtacttttttgggtcttatgttaagcccatttgtgggtttgtaaaagtctttgacaatatccaataaatcagtgaaaaaaaaaagaaaaaaaaaattattatcactgtaaacttcaaatcaattcaacttgtgctttacatgggtcttcgctggaccaatatgttttgtgggcctttcaagcccaacaatagttatctaccctagctcaaaaagagttatcttattctcattctctctctctctgccgcagctatcaatttactggagaagagatg

SEQ ID NO: 18729 - DNA, 3003 bp, Unknown; identical to SEQ ID NO: 18728
  misc_feature (1)..( 3003): 2750-1469P.txt file - cDNA_ID_1819170; gDNA_ID_2926190; Annot_ID_140972

SEQ ID NO: 18730 - DNA, 3000 bp, Unknown; identical to SEQ ID NO: 2992
  misc_feature (1)..( 3000): 2750-1469P.txt file - cDNA_ID_1819177; gDNA_ID_1620620; Annot_ID_47007

SEQ ID NO: 18731 - skipped

SEQ ID NO: 18732 - DNA, 3003 bp, Unknown; identical to SEQ ID NO: 15863
  misc_feature (1)..( 3003): 2750-1469P.txt file - cDNA_ID_1819196; gDNA_ID_1620620; Annot_ID_47001

SEQ ID NO: 18733 - DNA, 3003 bp, Unknown; identical to SEQ ID NO: 15863
  misc_feature (1)..( 3003): 2750-1469P.txt file - cDNA_ID_1819196; gDNA_ID_2926189; Annot_ID_140964

SEQ ID NO: 18734 - DNA, 3000 bp, Unknown; identical to SEQ ID NO: 2989
  misc_feature (1)..( 3000): 2750-1469P.txt file - cDNA_ID_1819200; gDNA_ID_1620620; Annot_ID_47000

SEQ ID NO: 18735 - DNA, 3000 bp, Unknown; identical to SEQ ID NO: 2989
  misc_feature (1)..( 3000): 2750-1469P.txt file - cDNA_ID_1819200; gDNA_ID_2926189; Annot_ID_140963

SEQ ID NO: 18736 - DNA, 3000 bp, Unknown; identical to SEQ ID NO: 2985
  misc_feature (1)..( 3000): 2750-1469P.txt file - cDNA_ID_1819223; gDNA_ID_1620620; Annot_ID_46991

SEQ ID NO: 18737 - DNA, 3000 bp, Unknown; identical to SEQ ID NO: 2998
  misc_feature (1)..( 3000): 2750-1469P.txt file - cDNA_ID_1819223; gDNA_ID_1620702; Annot_ID_165127

SEQ ID NO: 18738 - DNA, 3000 bp, Unknown; identical to SEQ ID NO: 2998
  misc_feature (1)..( 3000): 2750-1469P.txt file - cDNA_ID_1819223; gDNA_ID_1620620; Annot_ID_162237

SEQ ID NO: 18739 - DNA, 3000 bp, Unknown; identical to SEQ ID NO: 2985
  misc_feature (1)..( 3000): 2750-1469P.txt file - cDNA_ID_1819223; gDNA_ID_2926189; Annot_ID_140954

SEQ ID NO: 18740 - DNA, 3000 bp, Unknown; identical to SEQ ID NO: 2998
  misc_feature (1)..( 3000): 2750-1469P.txt file - cDNA_ID_1819223; gDNA_ID_2926189; Annot_ID_200900

SEQ ID NO: 18741 - DNA, 3003 bp, Unknown
  misc_feature (1)..( 3003): 2750-1469P.txt file - cDNA_ID_1819231; gDNA_ID_1620621; Annot_ID_47045
tctcctgaagtagattttgtgatacctgaaacgcattagcttttttgtaaagctcatcttgaataacggatatatcatgcatagctagctccaacaatggtttctctttctgcaactcctctcgtaaatcctccagcaattctttttggaccgatatttcccgctcaagcgcaaaatttttagcctcaacaactctgagctttactctctcactttcaacttcagtgtgcgcatccctcaagctttgcatatatgacaacacacttttcctctgttcctcgagttcctccaattgtttttccaatagtagctctttttcttccatttgctccctggaaaataccaaagcttcccgagaagaaataagctcgaatcttacatcagtcagaagctttttcactttcatgaagtcctccatggtttcattggcttctcctaaacgtttcacggtttcctctttaagcttattcacttcatcctgggctatcagccactcttctgtctgtttcttcaagttggcttctgtttctctaagcttttcttgttcaagtttcttcgtagccttagaaatctctaattcttcttccttctcctcaagagctctctgaagtgcatatatttcaccttcttgtctcttgacaacttcgttggctttgcttaagagttgtgacttgctttcaaattcagaaatagccatagaaacctccttgcttctgtttgcaatctcttgacgcatcttctctagctcttcctctttcaaagtcaaggacgattgcaaagcagcacgttcctcgtctctttcccttagcttatgctttaactcttctatctccctggcttgagaagctaactccacatttgcccgcttcagctcctcttgtagactctcatgcttcaacgaagcttcagagattgttttctcacgtttttctaactcctcctttgcccggttaagtttatttttgtcagagagaagcttcctctcagcatcgtgcaggtcctcttcccttttcaacaaggccactagcgcagcctcaaggtcagactcaagcacgccaaggtttgaataggggagatcatcatcgtcaggataaaccgagtgttgattggtttgtctctccaatctgtgtgtccgagcaaataatttatcgaaaagaacatttgcagactcagctgagccattgtcgttgatgttgggtcttgtattgtgcaagactgattgaacactcagtaaaagatgtctctttctccttgtaatgctcgggaatgcgacaagactcttctgcttatggtttactactcttgtcaaacaatactgcataagaaaaaatcatatggccgacatcaaaatcaaaatcaaaagtttgattattttggacagacactaatcaatatggatgcaagcaaacttattcaaattaaaggaacagtattgaaatttgcaatctttttaagccagaacaaggaacaatcagaacaaggccagcaaaagtcaaaaattcaagtttgataaagttaagagtaagtaaagtgttgtgaatcagcagcgatatataaatgaaaatataggggataatatagagaaaggtaaggaaacaaacatcgcagggagagggagaggagaaggaagcaagattcaagcgaatggcctgagagaaacccatcctgagagcataattatgcaatcgccatggagcttaaagacggaacaaaacccaaatccactggatcaaatttaacaagtgggcgttttggagaagaatgcttacgagaacaaatccaaggaagaagaagaagaatctagctagggaatggatattgttacaaaattcttttaccaaaaaaaaggatacaaaataataaatagaggctcgcgttggcttgcgagttgtggtcgccagtaaactcgaaagtcctttttgcccttattcataagatgcatgtcggcattgtccaaatacacggccaagggatctatttgtaaaaataatggactcttcttaattacgtacgtggtaacggttttctagtatgacaattctctttctttcgcgtagtcggctagtcgcgtggttagaaatgcttacacactaaagagtatgttatattaaactggaatataaatttaagaaactgaataaaagtcatcaggcccatgacattggcccaatagacccaatgaaaaaccaatccatcagctagttttcttaacatatcaacccaacgaggttgtatcttgttacatttgcaagtgaacttttttatcattaaaaaatgtaacaatggtatttttggtttagtgttcctaaaatatttgtttcccacataagattttatctacaccaaatagtccaattgtataatataatccatcttcacaaaagcattttaaaggatatcctaccttctaaattccggcgaaaaatatcttaaatctgaaaaagtgatttatcgtgaatagtgtaatgttagcaaaatcttaaacttcaaaaaatcgtaaaacataaagaattaagtgtgacggattaattaagatatcgaaaccaacacagtaatcctcatctatgacttggaaaaactcataagtggcaagtggagttcgagtttggtcattattgtgaaacaccaaacctaatccacttacaaattcattaaaaactacaaatttgtgtggtagtttttttttttttttgggaaatttatgtggtagttaattagttaacaaacaattatatataaatacaaattttgtttggagttaggtccgcttcagcctgcttaagcgattctaagcttagtcgtataatcgtattagcaaaagctcgaacagtttacttctttaccctggaaagtcttatcatcatcagttcgtgtcgtttgactttttaaactttgcaaggaagggttttgtggtggtttgggagaattaggcaattgttggtgatccgatttttctgggtttggttgggttccttttttattttttaataaaaaaaaaaaatg

SEQ ID NO: 18742 - DNA, 3000 bp, Unknown
  misc_feature (1)..( 3000): 2750-1469P.txt file - cDNA_ID_1819231; gDNA_ID_2926201; Annot_ID_141528
cctgaagtagattttgtgatacctgaaacgcattagcttttttgtaaagctcatcttgaataacggatatatcatgcatagctagctccaacaatggtttctctttctgcaactcctctcgtaaatcctccagcaattctttttggaccgatatttcccgctcaagcgcaaaatttttagcctcaacaactctgagctttactctctcactttcaacttcagtgtgcgcatccctcaagctttgcatatatgacaacacacttttcctctgttcctcgagttcctccaattgtttttccaatagtagctctttttcttccatttgctccctggaaaataccaaagcttcccgagaagaaataagctcgaatcttacatcagtcagaagctttttcactttcatgaagtcctccatggtttcattggcttctcctaaacgtttcacggtttcctctttaagcttattcacttcatcctgggctatcagccactcttctgtctgtttcttcaagttggcttctgtttctctaagcttttcttgttcaagtttcttcgtagccttagaaatctctaattcttcttccttctcctcaagagctctctgaagtgcatatatttcaccttcttgtctcttgacaacttcgttggctttgcttaagagttgtgacttgctttcaaattcagaaatagccatagaaacctccttgcttctgtttgcaatctcttgacgcatcttctctagctcttcctctttcaaagtcaaggacgattgcaaagcagcacgttcctcgtctctttcccttagcttatgctttaactcttctatctccctggcttgagaagctaactccacatttgcccgcttcagctcctcttgtagactctcatgcttcaacgaagcttcagagattgttttctcacgtttttctaactcctcctttgcccggttaagtttatttttgtcagagagaagcttcctctcagcatcgtgcaggtcctcttcccttttcaacaaggccactagcgcagcctcaaggtcagactcaagcacgccaaggtttgaataggggagatcatcatcgtcaggataaaccgagtgttgattggtttgtctctccaatctgtgtgtccgagcaaataatttatcgaaaagaacatttgcagactcagctgagccattgtcgttgatgttgggtcttgtattgtgcaagactgattgaacactcagtaaaagatgtctctttctccttgtaatgctcgggaatgcgacaagactcttctgcttatggtttactactcttgtcaaacaatactgcataagaaaaaatcatatggccgacatcaaaatcaaaatcaaaagtttgattattttggacagacactaatcaatatggatgcaagcaaacttattcaaattaaaggaacagtattgaaatttgcaatctttttaagccagaacaaggaacaatcagaacaaggccagcaaaagtcaaaaattcaagtttgataaagttaagagtaagtaaagtgttgtgaatcagcagcgatatataaatgaaaatataggggataatatagagaaaggtaaggaaacaaacatcgcagggagagggagaggagaaggaagcaagattcaagcgaatggcctgagagaaacccatcctgagagcataattatgcaatcgccatggagcttaaagacggaacaaaacccaaatccactggatcaaatttaacaagtgggcgttttggagaagaatgcttacgagaacaaatccaaggaagaagaagaagaatctagctagggaatggatattgttacaaaattcttttaccaaaaaaaaggatacaaaataataaatagaggctcgcgttggcttgcgagttgtggtcgccagtaaactcgaaagtcctttttgcccttattcataagatgcatgtcggcattgtccaaatacacggccaagggatctatttgtaaaaataatggactcttcttaattacgtacgtggtaacggttttctagtatgacaattctctttctttcgcgtagtcggctagtcgcgtggttagaaatgcttacacactaaagagtatgttatattaaactggaatataaatttaagaaactgaataaaagtcatcaggcccatgacattggcccaatagacccaatgaaaaaccaatccatcagctagttttcttaacatatcaacccaacgaggttgtatcttgttacatttgcaagtgaacttttttatcattaaaaaatgtaacaatggtatttttggtttagtgttcctaaaatatttgtttcccacataagattttatctacaccaaatagtccaattgtataatataatccatcttcacaaaagcattttaaaggatatcctaccttctaaattccggcgaaaaatatcttaaatctgaaaaagtgatttatcgtgaatagtgtaatgttagcaaaatcttaaacttcaaaaaatcgtaaaacataaagaattaagtgtgacggattaattaagatatcgaaaccaacacagtaatcctcatctatgacttggaaaaactcataagtggcaagtggagttcgagtttggtcattattgtgaaacaccaaacctaatccacttacaaattcattaaaaactacaaatttgtgtggtagtttttttttttttttgggaaatttatgtggtagttaattagttaacaaacaattatatataaatacaaattttgtttggagttaggtccgcttcagcctgcttaagcgattctaagcttagtcgtataatcgtattagcaaaagctcgaacagtttacttctttaccctggaaagtcttatcatcatcagttcgtgtcgtttgactttttaaactttgcaaggaagggttttgtggtggtttgggagaattaggcaattgttggtgatccgatttttctgggtttggttgggttccttttttattttttaataaaaaaaaaaaatg

SEQ ID NO: 18743 - DNA, 3000 bp, Unknown; identical to SEQ ID NO: 3043
  misc_feature (1)..( 3000): 2750-1469P.txt file - cDNA_ID_1819239; gDNA_ID_1620621; Annot_ID_47043

SEQ ID NO: 18744 - DNA, 3003 bp, Unknown
  misc_feature (1)..( 3003): 2750-1469P.txt file - cDNA_ID_1819239; gDNA_ID_2926201; Annot_ID_141530
aggagctgaagcgggcaaatgtggagttagcttctcaagccagggagatagaagagttaaagcataagctaagggaaagagacgaggaacgtgctgctttgcaatcgtccttgactttgaaagaggaagagctagagaagatgcgtcaagagattgcaaacagaagcaaggaggtttctatggctatttctgaatttgaaagcaagtcacaactcttaagcaaagccaacgaagttgtcaagagacaagaaggtgaaatatatgcacttcagagagctcttgaggagaaggaagaagaattagagatttctaaggctacgaagaaacttgaacaagaaaagcttagagaaacagaagccaacttgaagaaacagacagaagagtggctgatagcccaggatgaagtgaataagcttaaagaggaaaccgtgaaacgtttaggagaagccaatgaaaccatggaggacttcatgaaagtgaaaaagcttctgactgatgtaagattcgagcttatttcttctcgggaagctttggtattttccagggagcaaatggaagaaaaagagctactattggaaaaacaattggaggaactcgaggaacagaggaaaagtgtgttgtcatatatgcaaagcttgagggatgcgcacactgaagttgaaagtgagagagtaaagctcagagttgttgaggctaaaaattttgcgcttgagcgggaaatatcggtccaaaaagaattgctggaggatttacgagaggagttgcagaaagagaaaccattgttggagctagctatgcatgatatatccgttattcaagatgagctttacaaaaaagctaatgcgtttcaggtatcacaaaatctacttcaggagaaagagtcaagtttggtggaggccaaactagagattcagcatctgaagtccgaacaggcttctctagaactattactgcaagaaaaggatgaagaactcgctgaagctcgaaataaattgggagaagtgaaccaggaggtaacagagctaaaggcacttatgatcagtagagaagatcagcttatggaggcaactgagatgctgaaggagaaagatgtccaccttcacagaatagaaggtgagttgggcagttccaagctgaaagtcactgaagctgaaatggtggtggaaagaattgcagaattgacgaacagactgcttatgtcaaccaccaacggtcaaaatcagaatgcaatgaggattaacaatgagataagcattgactcaatgcagcaaccactagagaaacctcatgatgattacggaatggagaacaaacggctggtgatggagttaagcttcaccagagaaaatctacggatgaaagaaatggaagttctagcggtgcagagggctttgacatttaaagacgaagagatcaacgtggtcatgggaagattagaagccaaggagcaggaactcaagaaattgaaagaagaaacgatcaatgacagtgaagatttgaaagtgctatatgccttggcacaagagagagtcggggaaaaaacaatgggtgatctggccatagagatgcttcagcttgaggcagctaaccttgaagttgaagctgcgaccagtgcattacagaagcttgcaaaaatgagcacggaactgttaactcaagctgacatgagcattgaggccgacacaactcacactgtaatgccagagagagggtattcagaaggaagtaatgagtgtcttggtgaggtaaaaacagaagttgtcaggctctggtccttgacagagaaactcctggagaacgcaggaatcgttgctggtacatctacatgcatggaaggtgtaattttataaagctttgattaactttataagcctaatctgtatgattcttttgtggatatgtagaattactggcggttaaatatgtttacttgtcactgtgagcaagtctattggagagtcttaatcaagaactctttgcattttataataataaatattaaataatttaaagtttagagtttttattgaatctttacaattttttattgtccaatggtggtggagactttaagaggatttcttcaaaaaaaataaagattttaaaataaaatattataaagttttttatttgacaaaacttaataattattagaaataataaaattgtaaacatgcatcatgacataaaagcaaaaaaatatatagaaatgaaaatttgaaaaaggataatatttaagcttgattcggaccaaaattttgccatatatatactctgatactcaatcaaatcatatttcaatcgttcatgctaagtacaaaagtcgggttttgatacttaataattactacaaatattaaaattgtatacatacatcatgatataaaagcaaaaagaaaatatacaaatcaaaaaacttaaataacgactagatttaagcattattaaaacaatgcataatcctttttttatatagttttttctcagccagtcacaaagcaacacaactaaagtctttaacaaatgttaaaactctaagcttaggatcaatccttagcctaatatcttgttttcatttatttttattacattggaggtggtctaagtgatctcaaaactaagtgatttttaatgatttgtatttgtttattacgtagataaaattcagccgagagtggctgccaccacaaggttcttgccaagggtaatctctcgtttaggtgtcgttgatagaaaaaggtttgcgacgtaccctgggacttatgcctacaacagcatgtatacacagatagtaggccgttagagtgtaactgataggatcacccctactagcatcgccaaataccaaccttgcccctaaatttccttctctatttttttgagtaacttttttataaattttcaaactcgctcccgcttctgagtctttttccgtacgaaagagagagagatacgtctatgcgattctagggtttttccggcgaaatttctcagccaaagatg

SEQ ID NO: 18745 - DNA, 3003 bp, Unknown
  misc_feature (1)..( 3003): 2750-1469P.txt file - cDNA_ID_1819243; gDNA_ID_1620621; Annot_ID_47040
tgaagaacacatttaatctcggagcctacttgaacgactctcttaaaacatcacatggtatatgcagcgtccattacaagtaataatgaacataaccaaaccaaaagaggcaagcttgcatgattttgatgtccatggcatttcctcaacttaaagcaagaggagaagacccattattgaacagtcaacaagagcacagagaacccaaattcgaactacaagtagggaacaagggagttagcaaagatacagatgaccttcattaatcttaaaaagtatcagcttgagaacataggccacaatgagaatgaagagagggactaaagaggccccatgctctgtctggtgtcagcgctacatggtccaggacaagtatggacttccccaccccccggagacagaaaaccagcgtgtaattctgatcaggaaactgaatccagaaaggtgttcctccttcaggcatttggaccacagaacggcatgagctactaggtaagcttaagcttgctcttccagtttcgtgcaatacgaacatagcctggatcaatacgacttcttcttttaatactacttgagccacaaccatctgaagaacttgatgaatacagagacaaccgatgccacaaaatgtaactaatacaaaagccctaggtacctgcagtaacagaaaagataatatattccaagcaaagacagtgtgttttgcagtagtctccagcactttgatgcagatggtactttgagacagtatgtgaggaaaagattttggtgatcaattgttttcaacattaactgatttaacacaaatctttcattggcgacatcatagaatagcgattagggtatgaatttgatcacaagtgtctaaacatagataataagattatgacatgaaacatgacacaactagatacatgaaaggattaaaagtttctctccaccagattggaattcgtcaatgagttcttgtttgattgccaacaggtcctttgtgcataccctccaaataatttttcagtttctcccaactttgcaacgtagattcccaatcctggaacatggaaaaggcaaacaattcaaagtctttacttcttaaaatctaaatgagctcaatgtaatccaaaaaggattttacctcaaggttttccctaaactcttcgttgtcaataggaaaaaaatactcagctggaacaaaaaaaaaaaaacccaattcttaacaacaacaacaacaacaggaacaacatcaaaaggctaaagaaaaaaaggagagaaaagaaatcaatgttcgtgacatacaggctttgtatcctccataacctgctgaacctgtgcctagccatttgcacaccatcaaacccttttccggcaatcctgctgctgcctcaaccaatgaagaggacatggtggagaaagttctatctttagattggccagacctcttagtgctataggatctcgttccgcggccaaactgtaaacatccatcaaaaataaatcaatcactggaaagaacaagaccaggaaacattcatatgattcatgtcttcggctcaccttcgcgcacacggatccgaggttccttcatatcatcatcgtcatcatcgtcttgctcctccagccgaaaattagggcttttttgctccttccctcttttaataatatttcgatcgattgggaatttttattatttttgtactactgaacgaacccattcaataactttgctaggtgaccggcccaagcccatacgtttatactattgttcttttctttttctctgttttgtgcaaaatatttatatcattcttacgaaaattgatatgaggtacacatttttaatttttttcatatcattttacttttagtttttcaaattttaaaaaccaaatcgtttctctattttttattattattattttattgctctaatttttgtttggtgagtatcaaaataattgaatgttcttcgaattatttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatg

SEQ ID NO: 18746 - DNA, 3000 bp, Unknown
  misc_feature (1)..( 3000): 2750-1469P.txt file - cDNA_ID_1819243; gDNA_ID_2926201; Annot_ID_141533
agaacacatttaatctcggagcctacttgaacgactctcttaaaacatcacatggtatatgcagcgtccattacaagtaataatgaacataaccaaaccaaaagaggcaagcttgcatgattttgatgtccatggcatttcctcaacttaaagcaagaggagaagacccattattgaacagtcaacaagagcacagagaacccaaattcgaactacaagtagggaacaagggagttagcaaagatacagatgaccttcattaatcttaaaaagtatcagcttgagaacataggccacaatgagaatgaagagagggactaaagaggccccatgctctgtctggtgtcagcgctacatggtccaggacaagtatggacttccccaccccccggagacagaaaaccagcgtgtaattctgatcaggaaactgaatccagaaaggtgttcctccttcaggcatttggaccacagaacggcatgagctactaggtaagcttaagcttgctcttccagtttcgtgcaatacgaacatagcctggatcaatacgacttcttcttttaatactacttgagccacaaccatctgaagaacttgatgaatacagagacaaccgatgccacaaaatgtaactaatacaaaagccctaggtacctgcagtaacagaaaagataatatattccaagcaaagacagtgtgttttgcagtagtctccagcactttgatgcagatggtactttgagacagtatgtgaggaaaagattttggtgatcaattgttttcaacattaactgatttaacacaaatctttcattggcgacatcatagaatagcgattagggtatgaatttgatcacaagtgtctaaacatagataataagattatgacatgaaacatgacacaactagatacatgaaaggattaaaagtttctctccaccagattggaattcgtcaatgagttcttgtttgattgccaacaggtcctttgtgcataccctccaaataatttttcagtttctcccaactttgcaacgtagattcccaatcctggaacatggaaaaggcaaacaattcaaagtctttacttcttaaaatctaaatgagctcaatgtaatccaaaaaggattttacctcaaggttttccctaaactcttcgttgtcaataggaaaaaaatactcagctggaacaaaaaaaaaaaaacccaattcttaacaacaacaacaacaacaggaacaacatcaaaaggctaaagaaaaaaaggagagaaaagaaatcaatgttcgtgacatacaggctttgtatcctccataacctgctgaacctgtgcctagccatttgcacaccatcaaacccttttccggcaatcctgctgctgcctcaaccaatgaagaggacatggtggagaaagttctatctttagattggccagacctcttagtgctataggatctcgttccgcggccaaactgtaaacatccatcaaaaataaatcaatcactggaaagaacaagaccaggaaacattcatatgattcatgtcttcggctcaccttcgcgcacacggatccgaggttccttcatatcatcatcgtcatcatcgtcttgctcctccagccgaaaattagggcttttttgctccttccctcttttaataatatttcgatcgattgggaatttttattatttttgtactactgaacgaacccattcaataactttgctaggtgaccggcccaagcccatacgtttatactattgttcttttctttttctctgttttgtgcaaaatatttatatcattcttacgaaaattgatatgaggtacacatttttaatttttttcatatcattttacttttagtttttcaaattttaaaaaccaaatcgtttctctattttttattattattattttattgctctaatttttgtttggtgagtatcaaaataattgaatgttcttcgaattatttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatg

SEQ ID NO: 18747 - DNA, 3003 bp, Unknown
  misc_feature (1)..( 3003): 2750-1469P.txt file - cDNA_ID_1819251; gDNA_ID_1620621; Annot_ID_47038
agttttgacaacatagtgctttgttttgatgctctataatgtgttttatctgccatcattcagcttcggttcatccgccatatctcaaactactgcatgttaatggtgaagcataagagcaagacaccccgtgtttcttctttcaaacaactcaaactgtaagaacttttggtgttaaaatgtttttagcatttcattatccggaatctccatagtaatacatgtttttggaccaatcaggttctcaaccacaccggaaacccggaaaaagaacgtaataagggaagttgaagaagacggtgttgttgactccatccctcggagccaaccaagctttctagcaactgtattgggaggtttgctctcttacaagtcgacgccaagtcaacgaggtactaaatacagaaacgtgactgcaagtagagtttttaacaaactcattgcaaggtttcgtttcaagtgtaattccgagaaggatgtgtggaacagaaaaaaactcatatccgaaacctaaaaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcgatggctgctaattcgataatggcttcctccaaacccctaatctccctgtcatccaaccaacaaccaaaccgagtccaaattcccaaattcgccaaacttccccaaattcccaaatccctcacttcctccaccgatctccgtagcaaagcactatcactctcctccgccaccgccaaatccttagctttaatcgccgctttcgctcctccgtcgatggcggaggcgatggagaaagcacagctcttcgatttcaatctcacgcttccgatcatcgttgttgagtttctcttcttgatgttcgctctcgacaaggtctattactctccgcttggtaacttcatggatcaaagagacgcttccatcaaagagaagctcgcgagtgttaaggacacttcgactgaagtaaaggagctcgatgagcaagccgccgccgtgatgagagcagctagggctgagatcgccgccgcgcttaacaagatgaagaaggagactcaggtataaaagaaacaacaatgcactcagagtgaagaaattggtaaatggattgtgtattttttttgcaggttgaagtcgaggagaagctagcggagggaaggaagaaggtggaggaagagctaaaagaagctttggcgagcttggagagtcagaaagaagaaaccattaaagctttggattctcagattgctgctcttagtgaagacattgtcaagaaggttcttccttcttaaattatatttttgttaactgtgtaattctctgtctctctatctcaaaacttatttacaagaaattactgtaaatctcttcttcttcttcttctctgtttcttggattgttcgtcgttcaaagaagaacaatttttattttgtaagtttataaataattagctctcttctgtcattttagatgattaaagtacaagtatgtatatcgaggaattagttgttacggataaaatcttcatgcgagtcttatcgtcactagatttatgtctatttgaatcgattgaacaaaaacgcaaatggcaggagttgcttgtgtaaagagtagagagaaattgagttttcagagccaaacactccagctttgtccgaaagtgttcatagaaagttaagttgactcttccataacgagctcaggtccaacaacgaagcccaaacctcagttactctatcttattattgggccctaaaacgaaatgggccctaaagctaacgcgggtcggtgtttgattaaaacaaatgacggggcctccacgccttgttccttcttcttcttcttctcacgctcacggttctctttctcttctctgtctttttcagcttctgaagttacttgtttcagttcccgatgatcaattcttagtttttttggcttgttttcttcgtctctctttcatcaggcctttggagttttgtgttaccattttcgctcgcgtcattactggtgttagggttttcttcaaaagcttcttaatccgtcgaaattgctcttttctctccctcattgtcggttactttctttgacccttctcttatgcttcgtaagctgtgatttttttctctggtttcattgcaactctagttcaatttcagtttgatttcttcgcttaaatattttgttctatgagatctgagagttgtctttattgttggcttatttcaatcaaaacattggctggttaactttgattgactcatgattgattctatctagcattaattggttttctttgtatttggttactgttacttgttcttctacttctccacgattctacttctccacgatactgtctctgtcccttgttcgtatcgctaacttattcccatagtgggcacgtctctggtttctgacttttctcttcaattccatgtattgcgttttaccatgatgtttagtttcggaatcatttcttgctttctctatctgcttgtaagaatagttaacaagtgagaggaaagtcctttttgttgcttaaatagtttgatttctgttgttgagtttatgcgatatcccaactggtgaaactgtgtttattggttcagacagagataaatg

SEQ ID NO: 18748 - DNA, 3003 bp, Unknown; identical to SEQ ID NO: 18747
  misc_feature (1)..( 3003): 2750-1469P.txt file - cDNA_ID_1819251; gDNA_ID_1620621; Annot_ID_162314

SEQ ID NO: 18749 - DNA, 3000 bp, Unknown
  misc_feature (1)..( 3000): 2750-1469P.txt file - cDNA_ID_1819251; gDNA_ID_2926201; Annot_ID_141535
tttgacaacatagtgctttgttttgatgctctataatgtgttttatctgccatcattcagcttcggttcatccgccatatctcaaactactgcatgttaatggtgaagcataagagcaagacaccccgtgtttcttctttcaaacaactcaaactgtaagaacttttggtgttaaaatgtttttagcatttcattatccggaatctccatagtaatacatgtttttggaccaatcaggttctcaaccacaccggaaacccggaaaaagaacgtaataagggaagttgaagaagacggtgttgttgactccatccctcggagccaaccaagctttctagcaactgtattgggaggtttgctctcttacaagtcgacgccaagtcaacgaggtactaaatacagaaacgtgactgcaagtagagtttttaacaaactcattgcaaggtttcgtttcaagtgtaattccgagaaggatgtgtggaacagaaaaaaactcatatccgaaacctaaaaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcgatggctgctaattcgataatggcttcctccaaacccctaatctccctgtcatccaaccaacaaccaaaccgagtccaaattcccaaattcgccaaacttccccaaattcccaaatccctcacttcctccaccgatctccgtagcaaagcactatcactctcctccgccaccgccaaatccttagctttaatcgccgctttcgctcctccgtcgatggcggaggcgatggagaaagcacagctcttcgatttcaatctcacgcttccgatcatcgttgttgagtttctcttcttgatgttcgctctcgacaaggtctattactctccgcttggtaacttcatggatcaaagagacgcttccatcaaagagaagctcgcgagtgttaaggacacttcgactgaagtaaaggagctcgatgagcaagccgccgccgtgatgagagcagctagggctgagatcgccgccgcgcttaacaagatgaagaaggagactcaggtataaaagaaacaacaatgcactcagagtgaagaaattggtaaatggattgtgtattttttttgcaggttgaagtcgaggagaagctagcggagggaaggaagaaggtggaggaagagctaaaagaagctttggcgagcttggagagtcagaaagaagaaaccattaaagctttggattctcagattgctgctcttagtgaagacattgtcaagaaggttcttccttcttaaattatatttttgttaactgtgtaattctctgtctctctatctcaaaacttatttacaagaaattactgtaaatctcttcttcttcttcttctctgtttcttggattgttcgtcgttcaaagaagaacaatttttattttgtaagtttataaataattagctctcttctgtcattttagatgattaaagtacaagtatgtatatcgaggaattagttgttacggataaaatcttcatgcgagtcttatcgtcactagatttatgtctatttgaatcgattgaacaaaaacgcaaatggcaggagttgcttgtgtaaagagtagagagaaattgagttttcagagccaaacactccagctttgtccgaaagtgttcatagaaagttaagttgactcttccataacgagctcaggtccaacaacgaagcccaaacctcagttactctatcttattattgggccctaaaacgaaatgggccctaaagctaacgcgggtcggtgtttgattaaaacaaatgacggggcctccacgccttgttccttcttcttcttcttctcacgctcacggttctctttctcttctctgtctttttcagcttctgaagttacttgtttcagttcccgatgatcaattcttagtttttttggcttgttttcttcgtctctctttcatcaggcctttggagttttgtgttaccattttcgctcgcgtcattactggtgttagggttttcttcaaaagcttcttaatccgtcgaaattgctcttttctctccctcattgtcggttactttctttgacccttctcttatgcttcgtaagctgtgatttttttctctggtttcattgcaactctagttcaatttcagtttgatttcttcgcttaaatattttgttctatgagatctgagagttgtctttattgttggcttatttcaatcaaaacattggctggttaactttgattgactcatgattgattctatctagcattaattggttttctttgtatttggttactgttacttgttcttctacttctccacgattctacttctccacgatactgtctctgtcccttgttcgtatcgctaacttattcccatagtgggcacgtctctggtttctgacttttctcttcaattccatgtattgcgttttaccatgatgtttagtttcggaatcatttcttgctttctctatctgcttgtaagaatagttaacaagtgagaggaaagtcctttttgttgcttaaatagtttgatttctgttgttgagtttatgcgatatcccaactggtgaaactgtgtttattggttcagacagagataaatg

SEQ ID NO: 18750 - DNA, 3000 bp, Unknown; identical to SEQ ID NO: 18749
  misc_feature (1)..( 3000): 2750-1469P.txt file - cDNA_ID_1819251; gDNA_ID_2926201; Annot_ID_201880

SEQ ID NO: 18751 - DNA, 3003 bp, Unknown
  misc_feature (1)..( 3003): 2750-1469P.txt file - cDNA_ID_1819255; gDNA_ID_1620621; Annot_ID_47036
ttttatgcttttctgctttaaatacatcttataaattttatttttatattcaagatccaccttatctacactgtataacaagttctcacctacttttaatttcaaattttgatcaaaacataacattattacaaacgattatatcataaattccgctcattatataatgagcaaaacttgcaaaataaatttatggaaggatttacggctgctaacttgtgttagatgtgcgtctttaattcatacttttggcaatatgacaatcaacatattttaaaaaaaaaaattaagcatgtactaaaagaatgataaagtgcatctatactaagaaataagaagatgcatatttcgtcaagagacacatgattcaacgaatttagacatccaacatcaaaccaacacgaatattagtaatagacaagtttggttaatgttggaacggacaacgtcccatatttttgtttacattctatgtttccaatagaaaatttggtttcgcacggaaaaggtggaatttaagaatcattgtatacaatactataaatgtgatacttaaactgataactgtaagtaatactcctagcaaactctgatttttcagcttgtcataacttttgttaaccttttaagagacaaaactatcactagacatttatagcttgactcactatacaagtattgacttcatcagttgcaattttgtggggaagagttggatcaaattatgaataagggctattaagtacggtttgcctatcctgaggtactttgctctatatgggaaggaacatagttattactttttataaacataaattttgacaactgttgtttttattgtaaccaacaaattgaggatctttatagcttatagtttctttggattgattacgtaaactaattgaaacgactagtacctcctcccctatttgactaggatacaatcatacaacgtaacaggttgaattgccgacatatgattttattaaaaccagtgtttaaaaactgatattagactatctggtcgaaccaaattcatttataaacaaaataaagcaacacaattaccatgaagactagaaaaatacgataagtaaagctataaaaatatggtgttgtttcaatttttaattatcttgttttactcttaatattagataatgatattttagctgtatgcttgacattgacatatgttttgtttccatttaagaataaagcactgttggtacaaggttatatgctgtgtcttaactcttaacacaatattataacttaatccacaacctttattaagaactaatttcgtaagatatggatttggattacgaaagtgactgttgagtatgaagtctatatcatatattaatatgaaattaggttggtctcttcatgttttttagatcaaccaagcagaagagagtagagggggaaatatcaacgtgaatgtcacgtgaacggagtcgtgcgtgcgtgactactcgtggcgtaatgtcgggtcgaccactgaagtaatgggctttaaaagttgaaggaccatatccatatggctcttgtgggaaccactttacacttagtcttgctcgtgggatcgatctgttttttgtttcttccttttgctcaaaattgatctggttttgctattattatatcatgactactagcaaaacttacatttttacttatcccatcaacattttcagatcaatttttttgtaaacaagattaaagtgaaattggactaacaatgattttcaaattaggtgtgtatgccctgaaactcagtatctgcttcatcccgcgatcttccaaatataagaaaaaaacggtcacctaatttaccgacaacaaacctaatccactaagacattattcaagatctagaaacgaaaagtcatgagatataaagatgcacgtgggaggacaagggaaaggacagaaactgtttggttgggagacaaataagtgttacgaaaggggaagtgaataagtctctctttaaactcaaaacactgagaaaagagtttgagtgtttttgtgacagatttggcttactgtcttgtctccgtcaagttgtaaataccaaagtcttatcatgttttttctctgtctcctctactacaattttaagaattgtaccacaaaccgatccattcattcatcatccaagcttcttgattcaaactggcaacatgttaactcgttatagatgatagtttggtgagttctataaaattgcgattaaagttatttctcttacaatttttcttggaacattttatatatgtataacttgtacatgaacgtagctcaaaagctaagaaaaaggtagcgccataatcattatgatgaataaaataaaccccagtttctctgaaagtgttggtttttaccacaccatattctagaagttaatttattggggttctaccacaccatatgcaccatgtgattcatgttattgttctaattctaaaactttcactgcgattttaattataatggttcactaatcactatgaaaacattagatgaaaattactaacacgtgattcttccagaaatcccgaatctctcagttacacaaaaagtaatatttttgtcatgacccagctttttccaatgccgtacataagcatggggacaggcaactaaaaaagctacaccaatcaaggccttagttcataatcgaacaatcacgtttagcccaaactttaaatgggcttaaaataatgtgggccttgacccacaaatagaaaaacacgtgacattccctctttgataatgattgcaaaaaaacagaggtgtgtttactcaaacgtttcccgtgtcctctacggtcagtatcattctttcggtgacgctaatttctccggtggttggaggagaacaaagtctcaaagagacggcgaacgaagacgaagacgaggagcgtggagagagtagacggcgaacgaagacgaagacgaggagcgtggagagagtctacctctctcgacgatg

SEQ ID NO: 18752 - DNA, 3000 bp, Unknown
  misc_feature (1)..( 3000): 2750-1469P.txt file - cDNA_ID_1819255; gDNA_ID_2926201; Annot_ID_141537
tatgcttttctgctttaaatacatcttataaattttatttttatattcaagatccaccttatctacactgtataacaagttctcacctacttttaatttcaaattttgatcaaaacataacattattacaaacgattatatcataaattccgctcattatataatgagcaaaacttgcaaaataaatttatggaaggatttacggctgctaacttgtgttagatgtgcgtctttaattcatacttttggcaatatgacaatcaacatattttaaaaaaaaaaattaagcatgtactaaaagaatgataaagtgcatctatactaagaaataagaagatgcatatttcgtcaagagacacatgattcaacgaatttagacatccaacatcaaaccaacacgaatattagtaatagacaagtttggttaatgttggaacggacaacgtcccatatttttgtttacattctatgtttccaatagaaaatttggtttcgcacggaaaaggtggaatttaagaatcattgtatacaatactataaatgtgatacttaaactgataactgtaagtaatactcctagcaaactctgatttttcagcttgtcataacttttgttaaccttttaagagacaaaactatcactagacatttatagcttgactcactatacaagtattgacttcatcagttgcaattttgtggggaagagttggatcaaattatgaataagggctattaagtacggtttgcctatcctgaggtactttgctctatatgggaaggaacatagttattactttttataaacataaattttgacaactgttgtttttattgtaaccaacaaattgaggatctttatagcttatagtttctttggattgattacgtaaactaattgaaacgactagtacctcctcccctatttgactaggatacaatcatacaacgtaacaggttgaattgccgacatatgattttattaaaaccagtgtttaaaaactgatattagactatctggtcgaaccaaattcatttataaacaaaataaagcaacacaattaccatgaagactagaaaaatacgataagtaaagctataaaaatatggtgttgtttcaatttttaattatcttgttttactcttaatattagataatgatattttagctgtatgcttgacattgacatatgttttgtttccatttaagaataaagcactgttggtacaaggttatatgctgtgtcttaactcttaacacaatattataacttaatccacaacctttattaagaactaatttcgtaagatatggatttggattacgaaagtgactgttgagtatgaagtctatatcatatattaatatgaaattaggttggtctcttcatgttttttagatcaaccaagcagaagagagtagagggggaaatatcaacgtgaatgtcacgtgaacggagtcgtgcgtgcgtgactactcgtggcgtaatgtcgggtcgaccactgaagtaatgggctttaaaagttgaaggaccatatccatatggctcttgtgggaaccactttacacttagtcttgctcgtgggatcgatctgttttttgtttcttccttttgctcaaaattgatctggttttgctattattatatcatgactactagcaaaacttacatttttacttatcccatcaacattttcagatcaatttttttgtaaacaagattaaagtgaaattggactaacaatgattttcaaattaggtgtgtatgccctgaaactcagtatctgcttcatcccgcgatcttccaaatataagaaaaaaacggtcacctaatttaccgacaacaaacctaatccactaagacattattcaagatctagaaacgaaaagtcatgagatataaagatgcacgtgggaggacaagggaaaggacagaaactgtttggttgggagacaaataagtgttacgaaaggggaagtgaataagtctctctttaaactcaaaacactgagaaaagagtttgagtgtttttgtgacagatttggcttactgtcttgtctccgtcaagttgtaaataccaaagtcttatcatgttttttctctgtctcctctactacaattttaagaattgtaccacaaaccgatccattcattcatcatccaagcttcttgattcaaactggcaacatgttaactcgttatagatgatagtttggtgagttctataaaattgcgattaaagttatttctcttacaatttttcttggaacattttatatatgtataacttgtacatgaacgtagctcaaaagctaagaaaaaggtagcgccataatcattatgatgaataaaataaaccccagtttctctgaaagtgttggtttttaccacaccatattctagaagttaatttattggggttctaccacaccatatgcaccatgtgattcatgttattgttctaattctaaaactttcactgcgattttaattataatggttcactaatcactatgaaaacattagatgaaaattactaacacgtgattcttccagaaatcccgaatctctcagttacacaaaaagtaatatttttgtcatgacccagctttttccaatgccgtacataagcatggggacaggcaactaaaaaagctacaccaatcaaggccttagttcataatcgaacaatcacgtttagcccaaactttaaatgggcttaaaataatgtgggccttgacccacaaatagaaaaacacgtgacattccctctttgataatgattgcaaaaaaacagaggtgtgtttactcaaacgtttcccgtgtcctctacggtcagtatcattctttcggtgacgctaatttctccggtggttggaggagaacaaagtctcaaagagacggcgaacgaagacgaagacgaggagcgtggagagagtagacggcgaacgaagacgaagacgaggagcgtggagagagtctacctctctcgacgatg

SEQ ID NO: 18753 - DNA, 3000 bp, Unknown; identical to SEQ ID NO: 3029
  misc_feature (1)..( 3000): 2750-1469P.txt file - cDNA_ID_1819259; gDNA_ID_1620621; Annot_ID_47035

SEQ ID NO: 18754 - DNA, 3003 bp, Unknown
  misc_feature (1)..( 3003): 2750-1469P.txt file - cDNA_ID_1819259; gDNA_ID_2926201; Annot_ID_141538
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaaatg

SEQ ID NO: 18755 - DNA, 3000 bp, Unknown; identical to SEQ ID NO: 3027
  misc_feature (1)..( 3000): 2750-1469P.txt file - cDNA_ID_1819263; gDNA_ID_1620621; Annot_ID_47031

SEQ ID NO: 18756 - DNA, 3003 bp, Unknown
  misc_feature (1)..( 3003): 2750-1469P.txt file - cDNA_ID_1819267; gDNA_ID_1620622; Annot_ID_47074
gataggattgagctcattcaatggttgagaaagctaaattcattcatctcacaataaacacgaaatatttcgatgtttacacatcttctaattaaactgttttatcagttaaaagtagtaatattggcttattgacaaaaaaaaaaagtagtaatattggctttagttacttttatctgaaacaaaatgtacaattgggccttagatgagtaataaacaatagaacttgggcccaaccctccaccgggatgtttaataactgtgtcttttagtgtggttattaattaaaaaattaaccccttttggtgtgagccaaagaaagaaaaatagattaaagtctttcatatacatcaattaaaaaatgttcgatcaattaaaacgagccatgatgaactaatcatatacatcatcatccatcgtgaaaagctagctgttagttaataattacttaataataagaaagaaaaagaaaatgattgttattacttattagtactgctatatactactccatatggaatagtaactgctattatctggcgttctagagttgacatttaaatgtcatagttttatttagatgtggaaaatctagtaagagtaatagagtaggaagtgattaggaagcaaccgaacaagaagcatattttatgaccggtgtggttagcccttgtgggagacaagattacctcaatttttggctaatcttgattttcctcctccattttattattacttattttctttctttttattattatttttatcagcatctttctctttaattatttttcttaaaattaaacattacaccaaagtgttgctgttaatttctcatatttaaatgtgaatagatatatactatatactaatatacatgtgtgtatcctatatgagaccataagccaatgacagtaggtattagctaatgacaagtgacttccaataacttattaagaagtagaatctttacagatttgatgtttacatggatcttctagaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcgatg

SEQ ID NO: 18757 - DNA, 3003 bp, Unknown
  misc_feature (1)..( 3003): 2750-1469P.txt file - cDNA_ID_1819267; gDNA_ID_1620622; Annot_ID_162370
attgagctcattcaatggttgagaaagctaaattcattcatctcacaataaacacgaaatatttcgatgtttacacatcttctaattaaactgttttatcagttaaaagtagtaatattggcttattgacaaaaaaaaaaagtagtaatattggctttagttacttttatctgaaacaaaatgtacaattgggccttagatgagtaataaacaatagaacttgggcccaaccctccaccgggatgtttaataactgtgtcttttagtgtggttattaattaaaaaattaaccccttttggtgtgagccaaagaaagaaaaatagattaaagtctttcatatacatcaattaaaaaatgttcgatcaattaaaacgagccatgatgaactaatcatatacatcatcatccatcgtgaaaagctagctgttagttaataattacttaataataagaaagaaaaagaaaatgattgttattacttattagtactgctatatactactccatatggaatagtaactgctattatctggcgttctagagttgacatttaaatgtcatagttttatttagatgtggaaaatctagtaagagtaatagagtaggaagtgattaggaagcaaccgaacaagaagcatattttatgaccggtgtggttagcccttgtgggagacaagattacctcaatttttggctaatcttgattttcctcctccattttattattacttattttctttctttttattattatttttatcagcatctttctctttaattatttttcttaaaattaaacattacaccaaagtgttgctgttaatttctcatatttaaatgtgaatagatatatactatatactaatatacatgtgtgtatcctatatgagaccataagccaatgacagtaggtattagctaatgacaagtgacttccaataacttattaagaagtagaatctttacagatttgatgtttacatggatcttctagaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcgatgactatg

SEQ ID NO: 18758 - DNA, 3000 bp, Unknown; identical to SEQ ID NO: 3078
  misc_feature (1)..( 3000): 2750-1469P.txt file - cDNA_ID_1819267; gDNA_ID_1620623; Annot_ID_162405

SEQ ID NO: 18759 - DNA, 3000 bp, Unknown
  misc_feature (1)..( 3000): 2750-1469P.txt file - cDNA_ID_1819267; gDNA_ID_2926201; Annot_ID_141503
aggattgagctcattcaatggttgagaaagctaaattcattcatctcacaataaacacgaaatatttcgatgtttacacatcttctaattaaactgttttatcagttaaaagtagtaatattggcttattgacaaaaaaaaaaagtagtaatattggctttagttacttttatctgaaacaaaatgtacaattgggccttagatgagtaataaacaatagaacttgggcccaaccctccaccgggatgtttaataactgtgtcttttagtgtggttattaattaaaaaattaaccccttttggtgtgagccaaagaaagaaaaatagattaaagtctttcatatacatcaattaaaaaatgttcgatcaattaaaacgagccatgatgaactaatcatatacatcatcatccatcgtgaaaagctagctgttagttaataattacttaataataagaaagaaaaagaaaatgattgttattacttattagtactgctatatactactccatatggaatagtaactgctattatctggcgttctagagttgacatttaaatgtcatagttttatttagatgtggaaaatctagtaagagtaatagagtaggaagtgattaggaagcaaccgaacaagaagcatattttatgaccggtgtggttagcccttgtgggagacaagattacctcaatttttggctaatcttgattttcctcctccattttattattacttattttctttctttttattattatttttatcagcatctttctctttaattatttttcttaaaattaaacattacaccaaagtgttgctgttaatttctcatatttaaatgtgaatagatatatactatatactaatatacatgtgtgtatcctatatgagaccataagccaatgacagtaggtattagctaatgacaagtgacttccaataacttattaagaagtagaatctttacagatttgatgtttacatggatcttctagaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcgatg

SEQ ID NO: 18760 - DNA, 3000 bp, Unknown; identical to SEQ ID NO: 3078
  misc_feature (1)..( 3000): 2750-1469P.txt file - cDNA_ID_1819267; gDNA_ID_2926201; Annot_ID_201842

SEQ ID NO: 18761 - DNA, 3000 bp, Unknown; identical to SEQ ID NO: 3066
  misc_feature (1)..( 3000): 2750-1469P.txt file - cDNA_ID_1819285; gDNA_ID_1620622; Annot_ID_47068

SEQ ID NO: 18762 - DNA, 3003 bp, Unknown
  misc_feature (1)..( 3003): 2750-1469P.txt file - cDNA_ID_1819285; gDNA_ID_2926201; Annot_ID_141509
catacaaaaacaaaaaaatataattagtgtattttaaattatttgtgttttaatatattttttattttatcttttaaaacatgttttttatttgagttattattatgaattcagtattataaagtcatatcttcatttcaatttttttttgaatataatgttatataatatttctaaacacaagtagataacgttggtcaatatttggttaagataaatggtggaaaaatattcagaaatgttcaaaaatgttcgaccattttttttatttcaaaatgtacgtcagtaactatcgattttttttgaccatatacaatttgcgacccccgcctttcgacgacttgcttttggtcaaacagcagtaagataggcgtatgtctcatgcttacatggtattgaaccgataatatgtgtgtgtatatatagagagacagactatactttttaatcattcaaaactagaaatcaccaaacacacatctcttttgcacgctcaaaccactatggatacttccctcttttctttatttgttccaatccttgttttcgtttttattgctctttttaagaaatcaaagaaaccaaaacatgtaaaagctcctgcaccaagtggtgcgtggcccatcatcggtcatcttcaccttctcagtggcaaggaacagcttctttaccgaaccttaggaaaaatggctgaccagtacggtccagccatgtcgctacgacttgggagcagtgaaacatttgttgtgagcagttttgaggtggctaaagattgttttactgtgaacgacaaagccttggcttcacgtcctattactgcagccgcaaagcacatgggttacgattgtgctgttttcgggtttgcgccttatagcgctttctggcgtgagatgcgtaaaatcgcaaccctcgagctactttctaaccggcggcttcagatgctcaagcatgtccgtgtttctgagatctcaatgggtaattaaaaaaaaaaaaaaacgtatataataataattttcgatattgttaattttgttatgatgcgatattgacatattgtcacatgcatgcatgcagttatgcaagatttgtattccttgtgggtcaagaaaggtggttcagaaccagtaatggttgatctaaagagctggttagaggatatgagtctgaacatgatggtgagaatggtggccggaaagcgatactttggaggcggctcgttatcccctgaagatgccgaagaggcaaggcaatgcagaaagggcgtcgcaaatttctttcacctcgtcggtatattcaccgtgtccgatgcttttccgaaactagggtggtttgattttcaaggacatgagaaggagatgaagcaaacaggaagagaattagatgtgatccttgaaagatggattgaaaaccatcgacaacaacgaaaagtttcaggaacgaaacacaatgattcagacttcgtcgacgttatgctgtcgcttgcagaacaaggcaaattctcgcatcttcaacatgatgcaattactagcattaaatctacctgcctggtacatctttaactacacaaattttgatgttttttagatgaactagatatataaacctaaccaaattaactgggattttgtccaaaaattattgttttctaaaatacaaagttagttatataaacaagtttaggtggaaagacgtaaatgataacatgtttattttgtaagaaattacttcaaccttaaattgatgggattaggcgaatcctgattagatgatacttataagtatattgttttaatgtatgtcatataatgataataaattgaataacaggcactgattcttggaggaagtgagacttcaccatcaacccttacatgggccatttctcttcttctaaacaataaggacatgttaaagaaagcacaagatgagatcgacatccacgtcggcagagacaggaacgtcgaggattcagacatagaaaatctggtgtatattcaagcgattatcaaagaaacattgagattgtatccagctggtcctctcttaggccatcgagaggcgatagaagattgcacggtcgctggttacaacgttcgtcgcggcacaagaatgttagtgaatgtatggaaaatccaaagagatccgagggtttatatggagccaaacgaatttcgaccagagaggtttatcacaggagaagcaaaagagttcgatgtaagaggacaaaactttgagctgatgccatttggttcgggaagaagatcatgcccaggctcttcattggccatgcaagtgcttcatttaggtcttgctcgtttccttcaatcatttgacgtgaaaactgttatggatatgcctgttgatatgactgagagccctggcttaaccattcctaaagccacgcctcttgagattctgatcagtccacgtcttaaggaagggctttatgtgtgatctctgttccagaaacatatactatatgacttcaatatggtaattgaaggtgcattttaatttgtttttttaattttattttgaataaaacgtacgtttgttacgttgtgtacttttttaaaataaataaatgtggaaccaaatgtattctttaaaatatatgtattatttgatttcatctattgtgtaaaactttgtataatataatatatttgatttgacggcaaaaaaaacacaaacaaactgcattttcaattttgaactttgtaaattaacagaagcggaaatattttggggaaaaaaaaaaagaaaaaacagaaacggaagtaaataagctttttaggcatcgatcgaattttccaggaaaccccgagagaggggaagaagaaactgacgaagacgaagtcgaacccttaaaaatccggtagagcatccgattctccgttgctcgaaacctctcaatcgattttttaaaaatttatttgcgatgcattgagccgccgtcaaaagagagagagagagagagagagagagagagagagagagatg

SEQ ID NO: 18763 - DNA, 3000 bp, Unknown; identical to SEQ ID NO: 3065
  misc_feature (1)..( 3000): 2750-1469P.txt file - cDNA_ID_1819293; gDNA_ID_1620622; Annot_ID_47065

SEQ ID NO: 18764 - DNA, 3003 bp, Unknown
  misc_feature (1)..( 3003): 2750-1469P.txt file - cDNA_ID_1819293; gDNA_ID_2926201; Annot_ID_141512
tgtaaatgtctgaatgttccatttgagaaatgtcctcatcatgtgacacaagtttattaggctactcaagttagcttagaattaagaagctagaacatgtgaaaataaatagaaaacaaaaaagaggaaacaaaaactaataacagaacgagaagttgaaaccttttggatccaattaaatgaatatcgatgtaattccaaaatgttagttcatgtgttaatgtttgaagatctagtacatatgaataacatttgaaatcatttttgtttcatgcaattacataactacaagggttttcatcacatattgctaattaattttgagtttagaatccaaaacatttaaccgaaaatctaataattttaaaaagggtgatttactcatctataagactaactaaaaaaatacgtactaaattatttacaagagacaattgataactagagtatgaattagttgtttagacttacccatgtgtcaaagtcatattgacaaatggctcggttataactgatttatataccaataattgcatacaagtttgtttcttaaataaatcaagcaatattcataagattgcatgtgtattttctgcgaaactattagtacgaattcgtggatatgcaaatttaatgactatgcaaagtaggtgagaatgtaatagcgattagaatagctagggtttagcctaccaaccatggtaatccagtttcctaattatcgttagtttttgaatcccattcatgcttttatctatttttcaaccaatcatgtctttttaccaacaaagcatttccagtctaagcaatatggtaggtaactcggtacgataaacagaaagataatttattattcatctataaacgaataattggttctcacattactcatacagaggaaaaaaagggatatacaaaccctctctaaattatatagttttgaattcactgttgtttatcaacaacatatataactctcttacccaattcttattattgttcatacttcatagacattaacatgtacgtatagtgattgctacaatgaatggtatgtacagatattgagacagacagtagaaagggatgaatcgagtatttattaaagagaaaggaaagggccaatctatgcctagtttcaattatgaaactcaacccatgaactgatttaaatactttacctatcggataagacttttaagggtctaaaatattttccaactatttttcatttgcaacaaaccttaaagtaatatgctaaagagatcttttccaaaggtggaatgatttttttgatctaaaacggcccatcaaccaatcttcggtccattatcctgacatgattatttgggctacatttttttaagtcttttgcagtaaattgttgaaccaacaaaaataaagagttggagttggacctagtagctgatctgctgatgtgttggtgatggtcgtcgtgggttcctgtcttataaccctagaaaccaagccacttcatcattctcaaattcaatgctttactaaataatattattatcgaaatcaaaatactaatttagacgtatataaatctagaagcaaaccttaggtgaggtcgaaacagagatgaccttttgcgtgcactttaattaatatcttattacataaaatgtcacactttgagtaaactttacattattctctcatccataataaataaataaagcatactgggttttaggtcaggctgacgtcagcagtttctttgtgtttcattttttttttttttgtaatctaacgctccagatttgttgtcttctccacgagccctttgttgttgttggtaatggagattttcgctctaagtcattgtggcttcttcttctttatttagaaaccaattcatcaactccttcgttatttctaaatctctttgccactacctcttgttgctgcaattgaattggctcaaatcttcttcacttggtcgacgtaaagacgactttgacttggtttttaacttcacttctccgtcgaaaactatcccttctcttccgatcgaatcaatcggctctctctccacacaaaccaaggtaagggttaaccctctccggtgattatgctctgataaatttacttgctcggccattagtgttcagaaacttggtgatttatgcatgtttttttttgttcaaagaccgtagatttcggaattaggattgtaaaaattgaacctttacatcagtgtttttacaaagttataagctttacttggaaatcagtggttttttgggtcaaccaaagttgaaagatttgaagaagaatgaaactagttcgatttatatatcattttattgcttcttaagaaagtgtcgtccttggttctttatgaatttccaattgcagccaaatatgtcatgttattcacctaatttttgtattttccaattgcagccaaatatcttctcctgttactggagacaaacctgcatacatttctgtcatctctgttaaggtattacatttagtttacttgtttacttaatgtagctgcttattacatttttttcttcaagtctatattcttctttcaatagcattaaaagttatgtgtatcctcagattagatcttgctgactcgcaagtttttggattatttagcggtttaataagaattatatcttccttgaaattgtgcctaggtagtggaatcgttgttagcctactgtagctcagataggtgatggatcatttccgttcaattgaataatttgactatttaaggtttgcacttagttttgtctacagaatcaattcatcctttttcacagtcaagatattattctcattatcactattgtagacttcttggacttccatacattcatcagtcaacttttcgatggtgcgtttttatcacagtggcacaattatttaagaggctccatctccactgcaccactgagaagtttcgtgtggacatgtctaagcttagaattggtttggttgaaaactgaggagatg

SEQ ID NO: 18765 - DNA, 3000 bp, Unknown; identical to SEQ ID NO: 3051
  misc_feature (1)..( 3000): 2750-1469P.txt file - cDNA_ID_1819297; gDNA_ID_1620622; Annot_ID_47062

SEQ ID NO: 18766 - DNA, 3000 bp, Unknown; identical to SEQ ID NO: 3051
  misc_feature (1)..( 3000): 2750-1469P.txt file - cDNA_ID_1819297; gDNA_ID_1620622; Annot_ID_162353

SEQ ID NO: 18767 - DNA, 3003 bp, Unknown
  misc_feature (1)..( 3003): 2750-1469P.txt file - cDNA_ID_1819297; gDNA_ID_2926201; Annot_ID_141515
gaagaaagatgtcgattccgttagagccagtccgaagactcctctctcgtggagcggcggatctggaagtggtggcggctctgcttctccttccgccgatggattcgaggataacagtcgccaagctagctgctctacatctacaggatctggatctaaggtaactttctcttttccctatcgtgattttcaacttttgcctctcgatttagtcttctctctctatcttctttctctcaattacgaatccggtagctccggagagatggcaaatccgtcatctcgctggataatccgattccgatctggccgataaatctggatttagccgttcgtaattgagaagatccttggccgtctctctgtttttcttcattttttttcctaaaatccataaagtttagcctgacgtcatctctcgcacgcttcaattctcactagaacgtatttagtctgttttcttcaacttctaacaaattcaccggaaaaaattcctccgccgtgattcgccgatgacaccgtcggccggagccatcctgcttctaggttaaattcatctaatctccaaaaagtcaaagccactttaagcttaatttccttgttttctgctcattttttgtaattagaaaactctactaatcttctgtaacaaagcttaataagagacctgtttttctcggtacgcattgaaccggatcttgcgtggccggttagatgtggatttttagaaatcggtcaactttaattttgtcttgaggaataattaaagctccttttagattttgggggtagtacagcttaacagctagttggtcaaacgcgtccgcgttttattgaacgttttgatgctcgagacggtagcgttttgtgggttgaaagttgaaacgagtaaaatgatcttgtcggagagattggtatcacgtgatctttaaaagagtgatgacgatagatgacaatgcccatgacacggaataatcatgatgtggcatcaaatcctcactataaaaattctttcccaattatatatttgagattttttaattttatgctctatttggtttcttcgatatatttttcttacttgtttgaaatttctgttgtgggaaaagaaactttttaccggtatgttaaaataagatcttgggtattgattataaaagtaaaacagttgtcgttatcttcagccatttaatagttgactaatcaaatgcgtttttgttttgcaggtttttcccacaaacgaaatcaccagttgtttctccaagagattgaagaagaggaaggtaaatataaagtctcctttttgaatttcaagtacacactccaaaattcaaattttattgagctgatggttttttattcttttaatatttggcagtcatcttttgagcttaaaaatgaagagaacttgaagttgaaggagagacttgaccttgaaaaggtagattttcgttgctattctctgttttattatcatggttttcattgtattcttaaaaaaacccaatatttttccacaggagattgcaagtctccgagcaacattcgatgaacaaaaccttaggaaccaaaagctgaagaggattaaggtaacatttagattctccctaaccatctttacagtaatcagatattccagatcccttctctctatttgctggtctcatcgactcttgtgttttcttgtttcagcttgacttaaactcaggccgtgtcacaaacaagaaacctgttgatttgattcgtaaatcacaactcgagcggctacagggatcaaaatcttgcaaaaccagtgactcgcaaaatcaggggagtttcttcgtcctccctgatctcaacatggcgccatccgaggaagagatattgtacggaactagctaaaaactggcctatatgaagatttgcgatcgaattatagtgaagggaagaagggagctagagatgtcaactaagaaaagtgaatgtaataagtggtgtaatgaaactctcccgtcacattctggttttccgtttccttctttttttggggtaaaatgctcaattacttcttgattttttcttaggaagagggtgaaaattaggtttttactttttactccctccctccctccctctctgttttctttaatttgatgtgttagaagaaaaaatttgttttaaatagatggtgttatcaatttttaatgcaaaattaactacttttttttttctttctttctctttgtaccgatttaaaagcttttgttggaaattgtaaagaggaaaaagtaggacaactaatagactttttatgttccaaacattttcttcttcactattctccatacattattatattaaaaccctagtttccgctcaactaatccaagacaagaagatctatcaatctctttggacattcatttttctactatttaatttgaatttttataatataaacttgggaggtgtaatgctattggtgggttgtcggcgtgttcatggaaaaagattcgtttttaaatgcccaataaatttgagaaaaaattgccaacttgtttatgagcttattttctttttcatggatcccaagtcttttgtgtatagagattaaaaaaaaatgacattccttcatgtaaaaaagaaaaaaatatctgggttttaaaaatatctacaatgagtttaatggtaaatatacttatcataatttggagaataaagacctaaagaagaaaattacactctagaacagaagttttgtaagcaaatcattgctcacaaaacttgtgaattacagaattacaggctcttgtaggttgagttattttatgcttcattttggttacaggctttatgttgacattaaaacaaagagattgaagtagagtccaaaaaaaaaaaaaatatatataaatataaaattcaagattaattaaaaaatattggtcttcagagagataaataactaggggaaagagaaaacagtcttctcttctccgatcccaaaaacgcaggaaaacaatg

SEQ ID NO: 18768 - DNA, 3003 bp, Unknown; identical to SEQ ID NO: 18767
  misc_feature (1)..( 3003): 2750-1469P.txt file - cDNA_ID_1819297; gDNA_ID_2926201; Annot_ID_201857

SEQ ID NO: 18769 - DNA, 3000 bp, Unknown; identical to SEQ ID NO: 3061
  misc_feature (1)..( 3000): 2750-1469P.txt file - cDNA_ID_1819305; gDNA_ID_1620622; Annot_ID_47060

SEQ ID NO: 18770 - DNA, 3003 bp, Unknown
  misc_feature (1)..( 3003): 2750-1469P.txt file - cDNA_ID_1819305; gDNA_ID_2926201; Annot_ID_141517
tcttcatgaacctcttcgttccatgcccgacaacaattgggcagactatatgcgcacaggtgttgtggcaattctgcagaaccgtgtgggtaagttagtagtttgtttggaacactggaaatggcatacccattaatggcattcttttcttgccagccctgaatttcatctacttgttatatgacaacaatcctctcaagatacttaagaaacctgtcttgttcatgtgtagcaccttccgaaaagcttcatgcgttgattctggctgagaatatgatgtcaatattgggtgaaaagtggcttctcggcggggtaaaattacccaatgttgatattccagctgataggtaaatacaacatctttgtattacactctcacttaacctacattttcctagtgacataaagattaatatcattctgatttcttttgtaggtgtcttctgttggtattagagtcatcgcatgttgaaatttctgtattgttaaatgatctcgcttacaagaagtatgaagctcctaaagataattcaactgctgaagacattctcttgaagcaacggtatctacccatcgtgttttcactggtagaaaagatcatcaaatatatatcatctgctggtgaaaacgaaggtataacttagaccttaatcatgttttattaatgtttccaatctactatcagtagtcagtactagcatattcgatcccttttctttcacctttctgttattctatgttattcctaaaatcagtactatataaacatcataagagcttttagttattgctcaaatgtctattaactccgctgataaacagtgtatacatgcgtgtcagccttttcccttcatgaaagaattgggatttacgtattgatctttgcagggactctatctgacgaagctgtcttccaaaaggtgattaaaatacttaatgagacagtaggagcggtgttcgaatatctcagagatgcaaaggtactatacatatatgataacatcaaactcttaggaatgtcttattgtgcttgaaaatgtttttcatgttaattctgtttcatacaggaacatggaattaagaaaggaactgaccttcttgcatctgtgcgagtgattggaaggtatagataatcactctttttgtttcttcttatatctctcgttcgatttatttttgtttaaaatgtataccggattgtgtttatgtaatcatcatttatcattcaaatttgtgtaaggacatggattgtatccttaccactttggcaggtactgaacctttttttgtgttttcaacagctatcttgcggaaactcctgttgcgtgcaaagagcaggtccaggatcttctggattatatgctttcagtgaagggcgaagatgaatccaggtttgaaggcatcctgacttgatatattggttcttttacaaagcttgtttgagtcatgcctcccaggataacttggtctgaactattttgttttgacagcccgtttttgtctacttgcttcttgctcccaatgctttgccaaataacaatgaacgcagaaggatgtaaactcttggcctattcaagaggcgatgtagctgtgagttactcggctttataccttctttatactgatgacaatatgtttgaacaaatctgatttacagctttcttatatctctcagtatgctgaaccaaaatgtatttcaagtgggtgtttatcttgtatataatcttataaggagctgactgatttttcaatacaggtcgttgaatgtctaataaaattgattgagcgctgtggtgagagtgttgatgaggatcgaagcatattcttggcttgtgatacaatcatgaatattcttttgaaggtactctcttccctaagataggacctgtttacattttgccaattgctaaaccctataatgacttcacgttttaaatgttgagaacagagggaagaaataagcccgccggaaatttcaacatttgccagtctattgaaagctttggcatattgggcaggtaaaaaaaaagatttttactgcttctgctgatctgcctactaatttcttgacaaaaatcgaagaccatgtttaatatgtcaatttctctgttccttttgtcacagatgggagtaatgaccattcggtagtaatgatggctgcaagcatatgctctctgatctttgatttcacatcagaagatgctttacaacttagcagaagctccctggatagtttggcccggctcgttacaagaagcttgtcctcaagtggccaggtataataatccgtgacttgtcatagagtctcttgtacttgttttggtagagagaattgcttgttagtgaactgttgcttaccgttgcaggatatgtctgataccgcggatcttcttgaaatcataagagcaggtttggtttcaacatctctctcacttttttttcctcggcttctctttactttttaaatcgataaacacaacaagttttcttcttgctctaattgtgcttgtatgattatggaacaggatactctcggtggataaatcgatttcccaccattatgaaacatcccgttgtgcaatagaaactattagatttggtctcaggctgtttcgagggagagaaatagtcaaaaaaggaaattttgttcagtttattagctccacgttgttgtattatatacacttgagattataattcatggtttctctatttatgatgcttccccaccaagaaatgagatacgatatatagatatttatgcaagtctaaaatttgacttgttatatagaggcaaatctaaaagataaggttccgattatgaaggattcaaatctttaaacgacgccgtgtttccatataacagtaaacagaaacaaacgcgtttttcgttggttggataaatcctccttataaataaacaaacctttaaggaaggttagttgtcaaaagaatctgcgaaaaataagagagagagagagagaaacaggatcattcattatg

SEQ ID NO: 18771 - DNA, 3003 bp, Unknown
  misc_feature (1)..( 3003): 2750-1469P.txt file - cDNA_ID_1819332; gDNA_ID_1620622; Annot_ID_47052
tttgaaactgatagaatttgtttgttttctttgtatttcttataagtttgatatcaaactaatttagcgttaaccattaataatccttataaaacaattcacggtacaatattttcgaaactgaagcaaattgttttcttttcatatttatattttttacttattagaactaaattagttccgacaaaacaaaaagaactaacttagttttgcccgtgatattttgacaaaatttcattttgatccttataataatacagtattttaaaaataaatcaacgtagctatccgaaattaaatatttgtaatcagcggaggcgaaaaggtctccagctccagctaaactccaagaggagagagagagaaagagattcaattatatgcagagagaaaaagaagccaattggttctctctctctctctctctctctctgattgattgatccagcgattcgtctggctggctcggtttccgcgggaaaaccttcttcttcgttgaccttacacgagttttgttgattcggcagggggatcgacgacggagatggcgattctgtacgccctcgtggctcgtggcacggtggttctttctgagttcaccgccacctctacgaatgcgagcaccatcgccaaacagatcctcgagaaggtccctggagacaacgacagcaacgtctcctactctcaggatcgttacgtcttccacgttaaacgcaccgatggcctcaccgttctctgtatggccgaagaaaccgccggaagtacgtcctcccctttcttttacttctatggctaattttgaggaagtttccaactttggtgacagtggaattcaaaagtctaatccttttttgctctgaacgatcgctctgttattgaattcgagacctttggtcttatattgtgatgtgaatgaatttgatttttttggacataacatcaacacaattatatccgagaagctgtgcattagagagatgtgaatgtctttctaactcaaaagtcaaaacttttttatgtcagggagaattccttttgcctttttggaggatattcaccagagattcgtacggacttatggcagggctgttcatacagcactagcttatgcaatgaatgaggaattctctagagttctcagtcagcagattgactattactctaatgatcctaatgccgataggattaatcgtattaagggtgaaatgaatcaggtttgatgagtttgtcttacaagttcagtcggattgtgaagttgtttagagacatggttctgagtcttggcttcactgtttgacaatacatcctggtttttctttttggttttggataggtgcggggtgtcatgatagaaaacattgacaaagtcctagatagaggtgaacgtttggagcttcttgtcgataaaaccgccaatatgcaggggaatacattccggttcagaaagcaagctcgtcgttttagaagcaacgtctggtggagaaactgcaagctcacgtatgtttcctaaaaccttagtaaacaattttcagtattatgattgcaagactgtatactaaaactagtttttggcctaagaacacatttaactatagcaaaaagtactttaatcaccccaagttccacatttgtaatgtcaagtgagaattttttaagaatcgaacatagttcctaattcctaaccctttttgtctcttgcagggtcctcttaatactactactactggtgatcatatacattgcagtggcctttctctgccacggacctactctaccatcttgcatttaagtgcatctgtctcttaaggaatccatcccgattctgcgcgttgccacgactttttatctcctcatctgattgtaaaccttgtgttttcctgagcattttcatgtggcttaaaaagcttatgtttccaactcacgtatatgaaaaagtatacttatttatagagcaatgtaaaagctcattgctttgcgaagtgtgtgaatctttgttgacatcatgttctataaattacatacatagtggaaaagtgaacaggcttgctttgtctgatatgttcatacaactctttgaatcttcatgttctttgtttatgtgacttcctctctcgtatatccacaccaacttctgaagtcggcagttgaatgatcttgtacgtcgttgaccctacaaattcttgtcattttacaattgaagccatttgttgatcataaatcgaatgtaaatattagaaaagaaagataggagaacaagatacaacaagtgtcataaattgtcgtccgaaaataaaatatgggtatcatctctagttaaggccagacgcacctcattcaccaacttgacatcttgtcatgccacctaataatagctaaataaattatagtaggtggatttaaccttttatttatataatagcagcatttcaaatataaaattttgtttttatcaacaccatgtttactaactaaaaggatggaatttatatccatatatgatcaaaatactaaaatgtttggttgaaccaaaaaaaataaaaagcgtcgactttacggtttaaatatcgttacagaaaaagaagaaaagaaaagacggctacatcacgcttactaaaaattctacagtccaattaaagtcataacaaaattaatactatatatttattaaaaaaaacatgattatttactttccttacaaaaaaaaacaaaagtgtaaatatttcctggtctaacgctttccctctgcgtgccccgttccttccctcgcggttactcttccgttttatgtttttttttctgagatggtcaattttcccgtcgtctctgaattttccctttttctcttcttcactccaccgccttccccgaatcacttcctctgcctgatctaattcaatctccttcctagctcaaagaagtcaatttacacgagcagatctctgcactcaaaactcctggatcttcatttctgggcttcaatttagagtttttttatattaaatg

SEQ ID NO: 18772 - DNA, 3003 bp, Unknown; identical to SEQ ID NO: 18771
  misc_feature (1)..( 3003): 2750-1469P.txt file - cDNA_ID_1819332; gDNA_ID_1620622; Annot_ID_162341

SEQ ID NO: 18773 - DNA, 3000 bp, Unknown
  misc_feature (1)..( 3000): 2750-1469P.txt file - cDNA_ID_1819332; gDNA_ID_2926201; Annot_ID_141524
gaaactgatagaatttgtttgttttctttgtatttcttataagtttgatatcaaactaatttagcgttaaccattaataatccttataaaacaattcacggtacaatattttcgaaactgaagcaaattgttttcttttcatatttatattttttacttattagaactaaattagttccgacaaaacaaaaagaactaacttagttttgcccgtgatattttgacaaaatttcattttgatccttataataatacagtattttaaaaataaatcaacgtagctatccgaaattaaatatttgtaatcagcggaggcgaaaaggtctccagctccagctaaactccaagaggagagagagagaaagagattcaattatatgcagagagaaaaagaagccaattggttctctctctctctctctctctctctgattgattgatccagcgattcgtctggctggctcggtttccgcgggaaaaccttcttcttcgttgaccttacacgagttttgttgattcggcagggggatcgacgacggagatggcgattctgtacgccctcgtggctcgtggcacggtggttctttctgagttcaccgccacctctacgaatgcgagcaccatcgccaaacagatcctcgagaaggtccctggagacaacgacagcaacgtctcctactctcaggatcgttacgtcttccacgttaaacgcaccgatggcctcaccgttctctgtatggccgaagaaaccgccggaagtacgtcctcccctttcttttacttctatggctaattttgaggaagtttccaactttggtgacagtggaattcaaaagtctaatccttttttgctctgaacgatcgctctgttattgaattcgagacctttggtcttatattgtgatgtgaatgaatttgatttttttggacataacatcaacacaattatatccgagaagctgtgcattagagagatgtgaatgtctttctaactcaaaagtcaaaacttttttatgtcagggagaattccttttgcctttttggaggatattcaccagagattcgtacggacttatggcagggctgttcatacagcactagcttatgcaatgaatgaggaattctctagagttctcagtcagcagattgactattactctaatgatcctaatgccgataggattaatcgtattaagggtgaaatgaatcaggtttgatgagtttgtcttacaagttcagtcggattgtgaagttgtttagagacatggttctgagtcttggcttcactgtttgacaatacatcctggtttttctttttggttttggataggtgcggggtgtcatgatagaaaacattgacaaagtcctagatagaggtgaacgtttggagcttcttgtcgataaaaccgccaatatgcaggggaatacattccggttcagaaagcaagctcgtcgttttagaagcaacgtctggtggagaaactgcaagctcacgtatgtttcctaaaaccttagtaaacaattttcagtattatgattgcaagactgtatactaaaactagtttttggcctaagaacacatttaactatagcaaaaagtactttaatcaccccaagttccacatttgtaatgtcaagtgagaattttttaagaatcgaacatagttcctaattcctaaccctttttgtctcttgcagggtcctcttaatactactactactggtgatcatatacattgcagtggcctttctctgccacggacctactctaccatcttgcatttaagtgcatctgtctcttaaggaatccatcccgattctgcgcgttgccacgactttttatctcctcatctgattgtaaaccttgtgttttcctgagcattttcatgtggcttaaaaagcttatgtttccaactcacgtatatgaaaaagtatacttatttatagagcaatgtaaaagctcattgctttgcgaagtgtgtgaatctttgttgacatcatgttctataaattacatacatagtggaaaagtgaacaggcttgctttgtctgatatgttcatacaactctttgaatcttcatgttctttgtttatgtgacttcctctctcgtatatccacaccaacttctgaagtcggcagttgaatgatcttgtacgtcgttgaccctacaaattcttgtcattttacaattgaagccatttgttgatcataaatcgaatgtaaatattagaaaagaaagataggagaacaagatacaacaagtgtcataaattgtcgtccgaaaataaaatatgggtatcatctctagttaaggccagacgcacctcattcaccaacttgacatcttgtcatgccacctaataatagctaaataaattatagtaggtggatttaaccttttatttatataatagcagcatttcaaatataaaattttgtttttatcaacaccatgtttactaactaaaaggatggaatttatatccatatatgatcaaaatactaaaatgtttggttgaaccaaaaaaaataaaaagcgtcgactttacggtttaaatatcgttacagaaaaagaagaaaagaaaagacggctacatcacgcttactaaaaattctacagtccaattaaagtcataacaaaattaatactatatatttattaaaaaaaacatgattatttactttccttacaaaaaaaaacaaaagtgtaaatatttcctggtctaacgctttccctctgcgtgccccgttccttccctcgcggttactcttccgttttatgtttttttttctgagatggtcaattttcccgtcgtctctgaattttccctttttctcttcttcactccaccgccttccccgaatcacttcctctgcctgatctaattcaatctccttcctagctcaaagaagtcaatttacacgagcagatctctgcactcaaaactcctggatcttcatttctgggcttcaatttagagtttttttatattaaatg

SEQ ID NO: 18774 - DNA, 3000 bp, Unknown; identical to SEQ ID NO: 18773
  misc_feature (1)..( 3000): 2750-1469P.txt file - cDNA_ID_1819332; gDNA_ID_2926201; Annot_ID_201868

SEQ ID NO: 18775 - DNA, 3000 bp, Unknown; identical to SEQ ID NO: 3046
  misc_feature (1)..( 3000): 2750-1469P.txt file - cDNA_ID_1819336; gDNA_ID_1620622; Annot_ID_47050

SEQ ID NO: 18776 - DNA, 3003 bp, Unknown
  misc_feature (1)..( 3003): 2750-1469P.txt file - cDNA_ID_1819336; gDNA_ID_2926201; Annot_ID_141526
cgacttcagaagttggtgtggatatacgagagaggaagtcacataaacaaagaacatgaagattcaaagagttgtatgaacatatcagacaaagcaagcctgttcacttttccactatgtatgtaatttatagaacatgatgtcaacaaagattcacacacttcgcaaagcaatgagcttttacattgctctataaataagtatactttttcatatacgtgagttggaaacataagctttttaagccacatgaaaatgctcaggaaaacacaaggtttacaatcagatgaggagataaaaagtcgtggcaacgcgcagaatcgggatggattccttaagagacagatgcacttaaatgcaagatggtagagtaggtccgtggcagagaaaggccactgcaatgtatatgatcaccagtagtagtagtattaagaggaccctgcaagagacaaaaagggttaggaattaggaactatgttcgattcttaaaaaattctcacttgacattacaaatgtggaacttggggtgattaaagtactttttgctatagttaaatgtgttcttaggccaaaaactagttttagtatacagtcttgcaatcataatactgaaaattgtttactaaggttttaggaaacatacgtgagcttgcagtttctccaccagacgttgcttctaaaacgacgagcttgctttctgaaccggaatgtattcccctgcatattggcggttttatcgacaagaagctccaaacgttcacctctatctaggactttgtcaatgttttctatcatgacaccccgcacctatccaaaaccaaaaagaaaaaccaggatgtattgtcaaacagtgaagccaagactcagaaccatgtctctaaacaacttcacaatccgactgaacttgtaagacaaactcatcaaacctgattcatttcacccttaatacgattaatcctatcggcattaggatcattagagtaatagtcaatctgctgactgagaactctagagaattcctcattcattgcataagctagtgctgtatgaacagccctgccataagtccgtacgaatctctggtgaatatcctccaaaaaggcaaaaggaattctccctgacataaaaaagttttgacttttgagttagaaagacattcacatctctctaatgcacagcttctcggatataattgtgttgatgttatgtccaaaaaaatcaaattcattcacatcacaatataagaccaaaggtctcgaattcaataacagagcgatcgttcagagcaaaaaaggattagacttttgaattccactgtcaccaaagttggaaacttcctcaaaattagccatagaagtaaaagaaaggggaggacgtacttccggcggtttcttcggccatacagagaacggtgaggccatcggtgcgtttaacgtggaagacgtaacgatcctgagagtaggagacgttgctgtcgttgtctccagggaccttctcgaggatctgtttggcgatggtgctcgcattcgtagaggtggcggtgaactcagaaagaaccaccgtgccacgagccacgagggcgtacagaatcgccatctccgtcgtcgatccccctgccgaatcaacaaaactcgtgtaaggtcaacgaagaagaaggttttcccgcggaaaccgagccagccagacgaatcgctggatcaatcaatcagagagagagagagagagagagagaaccaattggcttctttttctctctgcatataattgaatctctttctctctctctcctcttggagtttagctggagctggagaccttttcgcctccgctgattacaaatatttaatttcggatagctacgttgatttatttttaaaatactgtattattataaggatcaaaatgaaattttgtcaaaatatcacgggcaaaactaagttagttctttttgttttgtcggaactaatttagttctaataagtaaaaaatataaatatgaaaagaaaacaatttgcttcagtttcgaaaatattgtaccgtgaattgttttataaggattattaatggttaacgctaaattagtttgatatcaaacttataagaaatacaaagaaaacaaacaaattctatcagtttcaaacaaatagagaaatctgagcaaaaagatcgaataattgtaatttatccgtggaagaagatgtgattttaaagtgtaaatttttacgaatatgaaggataaaatgtagggatgtgttcaaatcatcattaaatcagtttttttttttttagtgtggtagtgacgtaccaaacaaaaccaaaaagcggtctatttccttctggtttgaaacgatttgggtcaaaattgggtttcgagtttgaataagatatgagtgaataatatactaactttagccaaagacaaaaaaaaaaaaggaaaattaaaggcagaaaaatgaaaatgacatccaatgagctgagcctaaaccaaacatagccagagataagccttacaaaatgtacaacagatataaaatcccaattcccaactctaaaccaagacgtggttcacgacccaaaccgaatctcacgggaaaaagtgggacatatacacatatatacacggtaagcttcgcgcctccgtcaaatcacgtgttgtttcttctcggcttttccgttaaagtaaacgtcacaacaccgccgttaatcaccgtggtctgtgggaattcaacccagaggcagagaagaccctgagagacgccatctggtccttcttttgcctccatctgtgtcctctctctctctcctcgatctcacgacgatcttcataaaccctacgctctgcttactcttccatcatcttttgctcagatttcgtaatttgtggtttctcgatcgggatattagtactcgatcgtgtctccgattgattctgatcggaatatcaaattcggattccggagagctggagatagagagagacttaggtaaagtttggtggagatg

SEQ ID NO: 18777 - DNA, 192 bp, Unknown; identical to SEQ ID NO: 3057
  misc_feature (1)..( 192): 2750-1469P.txt file - cDNA_ID_1819344; gDNA_ID_1620622; Annot_ID_47075

SEQ ID NO: 18778 - DNA, 3003 bp, Unknown
  misc_feature (1)..( 3003): 2750-1469P.txt file - cDNA_ID_1819344; gDNA_ID_1620623; Annot_ID_47086
ccgttgacaacaagcaaggcagagttgaaatggctcaatcatacgatcaggtaaacaaacacattcctattttcgtggatatatagttacattaagaacccatattaacttatctttctccacacattttcagagtgttaatgagaagtcaggtgagtcattccagacatatttagatattcaaccgctgaatcgaatgccgagggagagctttaagcctctggaacctatcaatgaggaaataagcactaggctaagcgttgggacagatcatgatgtagagatggatgcagcggataacatcattgtgctggattgacatcaaaaatcattattacttctttcatgattgtgttgatcgttggctgattttctttactaagataccttttgctgatttttttttttttgtttgtcaaagttaccttttgctgaattttaattactaagttaccttttgctaaatttgtttgcatacagcgtagttgtcttgagttgcagagtatcatatttgtccatttatagtttcttaggtataaagcgtatatgaaccaaaatataaccaaatatattatggaaactaattgaaactgaagttatgatcatcttgggttttttcatcggataagtattagtttaaactagattgaatctactactcttgatcaaacaagcacacacaacttgaaataactccaaacaccatgagttcatagaaaatgatttcccactaatatctttgttaatgccaaactttatcattgcatgtcttttgcattaaaaatacttcatgggtgatgatcatcttcttttaattgaaccaaagaaacgtcttttgagctctctcaaaacccaagacacacatatgcatatatttatataaactgttgatttctctaatttagatatacatggaaagaacattccctaaccatatcaattaggttggatttgatcgtatttattgttctataggatatattagtaaaattaagaaacaaaagaaatagaaatgggaaatacaaaaagagaaaaagagaggagctgcagaaaacagggaaaatggtgggaaagaagagacaaaagagaaaggctttaaatccacgcttactccaacttccaaacatatacctacttctccactcttttccactttactcttttatacctatacccatcttatattatattacatgtacaaaaatattgttttcagttaaatctgcatttattctacagttcaacgcgattactgtagaataattttaagccaacgactgtttggaactaatttttcagtttgatacgagagcaataacaaaatttcaaagaaggtttttttggggttaaatgtcaaaccaaaactcgttttagacagtaaaaaatatatacgattaaactatagtctaatacatatacaaattttactttgcatatacaatttaattcttagtaaatccaaataagaatctaaatagatgataatgatcaaaatctgtatagagatgcacatagtaacttcgtgaattctaagtattagactaaattctcatatacagcatgcagatatgtcatatgcatgcatacacatttttacgcatttcagtccgtacgtatcgtgtatatacggtaacgatggttggatatacatgtgcatgtttcaaagttatgtacaccgaagggacaagctaggctgtgatgctcctaattcaagcttccttcttacgaatgtcaacttttatttaattttctttattgtggcctggccgaataatcaaagatataataaatatttagaggcaattattgattagtgtcctttaattctccttaaattgtttggtttttggtcggttggttccgagattttattttctgtgttaaaatgttactaaccaataacggttgaccctaattataagttctccaacaagatgtgaacttatttgctaattataaacgtgaacgctaaacataaacggaagatttatttggtttgagtttggcgtctgcatttacatgtcgtagtaatataaatttacattaaaaattaatgtttctatattaaagatgtgaattatttcgttttttcatgcacataaacgcatatgtattgtgttgaaactagacgaggctataatgaagacaactgttgtttctttttatctgcaacaatagtgtatatttgaccgttaatgtaataagttcatgataaggttgggaggatagcttccccgtgatggaggtcgtagggtttgtatgattgtgtacagtcttttcatttcacctagctaaccctattgacgcattgtgcaagtgtaagacagttcatacttcgtactactcttcaattatatatatttacaccacattatcaaccaaaatatatgtatttcaatccaactgtatactagacttttcgaaactaatataagattaatgttgaattatgttttcttcacaaaattctagcattagtacatttgaggtgaaaaaacacaaaattcatcctaatgaacacataaagaaaataaaattttaaaactcttcttcgtcaccgaatatttacaaataaaatgatatgtgtgtgtgtgaacctaatttaaagcctatgccaatgagcacatataggcttttgctctctttttttttttttttttttttaattatcacaatagcataaaatatgcaaaacggaagtacctttacaatcatttgtattcgaatttaaataaaaatgataaaacaccaccaatagtaagcaaaagataattagtgttgaaactaatcatccgtaagcatatagagcacttcgatgaaaattagagtattaaataaaattaaaataaaccctcaaaactatctgaagagacacatagagtggctccttggcatatgattaagctcccttaatttatcttctcgtatatatataggcattacacatcttacttattacattcacacacacccacattttacattcaactcttatacaatatg

SEQ ID NO: 18779 - DNA, 192 bp, Unknown; identical to SEQ ID NO: 3057
  misc_feature (1)..( 192): 2750-1469P.txt file - cDNA_ID_1819344; gDNA_ID_1620622; Annot_ID_162371

SEQ ID NO: 18780 - DNA, 3003 bp, Unknown
  misc_feature (1)..( 3003): 2750-1469P.txt file - cDNA_ID_1819344; gDNA_ID_1620623; Annot_ID_162404
agcaaggcagagttgaaatggctcaatcatacgatcaggtaaacaaacacattcctattttcgtggatatatagttacattaagaacccatattaacttatctttctccacacattttcagagtgttaatgagaagtcaggtgagtcattccagacatatttagatattcaaccgctgaatcgaatgccgagggagagctttaagcctctggaacctatcaatgaggaaataagcactaggctaagcgttgggacagatcatgatgtagagatggatgcagcggataacatcattgtgctggattgacatcaaaaatcattattacttctttcatgattgtgttgatcgttggctgattttctttactaagataccttttgctgatttttttttttttgtttgtcaaagttaccttttgctgaattttaattactaagttaccttttgctaaatttgtttgcatacagcgtagttgtcttgagttgcagagtatcatatttgtccatttatagtttcttaggtataaagcgtatatgaaccaaaatataaccaaatatattatggaaactaattgaaactgaagttatgatcatcttgggttttttcatcggataagtattagtttaaactagattgaatctactactcttgatcaaacaagcacacacaacttgaaataactccaaacaccatgagttcatagaaaatgatttcccactaatatctttgttaatgccaaactttatcattgcatgtcttttgcattaaaaatacttcatgggtgatgatcatcttcttttaattgaaccaaagaaacgtcttttgagctctctcaaaacccaagacacacatatgcatatatttatataaactgttgatttctctaatttagatatacatggaaagaacattccctaaccatatcaattaggttggatttgatcgtatttattgttctataggatatattagtaaaattaagaaacaaaagaaatagaaatgggaaatacaaaaagagaaaaagagaggagctgcagaaaacagggaaaatggtgggaaagaagagacaaaagagaaaggctttaaatccacgcttactccaacttccaaacatatacctacttctccactcttttccactttactcttttatacctatacccatcttatattatattacatgtacaaaaatattgttttcagttaaatctgcatttattctacagttcaacgcgattactgtagaataattttaagccaacgactgtttggaactaatttttcagtttgatacgagagcaataacaaaatttcaaagaaggtttttttggggttaaatgtcaaaccaaaactcgttttagacagtaaaaaatatatacgattaaactatagtctaatacatatacaaattttactttgcatatacaatttaattcttagtaaatccaaataagaatctaaatagatgataatgatcaaaatctgtatagagatgcacatagtaacttcgtgaattctaagtattagactaaattctcatatacagcatgcagatatgtcatatgcatgcatacacatttttacgcatttcagtccgtacgtatcgtgtatatacggtaacgatggttggatatacatgtgcatgtttcaaagttatgtacaccgaagggacaagctaggctgtgatgctcctaattcaagcttccttcttacgaatgtcaacttttatttaattttctttattgtggcctggccgaataatcaaagatataataaatatttagaggcaattattgattagtgtcctttaattctccttaaattgtttggtttttggtcggttggttccgagattttattttctgtgttaaaatgttactaaccaataacggttgaccctaattataagttctccaacaagatgtgaacttatttgctaattataaacgtgaacgctaaacataaacggaagatttatttggtttgagtttggcgtctgcatttacatgtcgtagtaatataaatttacattaaaaattaatgtttctatattaaagatgtgaattatttcgttttttcatgcacataaacgcatatgtattgtgttgaaactagacgaggctataatgaagacaactgttgtttctttttatctgcaacaatagtgtatatttgaccgttaatgtaataagttcatgataaggttgggaggatagcttccccgtgatggaggtcgtagggtttgtatgattgtgtacagtcttttcatttcacctagctaaccctattgacgcattgtgcaagtgtaagacagttcatacttcgtactactcttcaattatatatatttacaccacattatcaaccaaaatatatgtatttcaatccaactgtatactagacttttcgaaactaatataagattaatgttgaattatgttttcttcacaaaattctagcattagtacatttgaggtgaaaaaacacaaaattcatcctaatgaacacataaagaaaataaaattttaaaactcttcttcgtcaccgaatatttacaaataaaatgatatgtgtgtgtgtgaacctaatttaaagcctatgccaatgagcacatataggcttttgctctctttttttttttttttttttttaattatcacaatagcataaaatatgcaaaacggaagtacctttacaatcatttgtattcgaatttaaataaaaatgataaaacaccaccaatagtaagcaaaagataattagtgttgaaactaatcatccgtaagcatatagagcacttcgatgaaaattagagtattaaataaaattaaaataaaccctcaaaactatctgaagagacacatagagtggctccttggcatatgattaagctcccttaatttatcttctcgtatatatataggcattacacatcttacttattacattcacacacacccacattttacattcaactcttatacaatatgcccatgttaatg

SEQ ID NO: 18781 - DNA, 3003 bp, Unknown; identical to SEQ ID NO: 18778
  misc_feature (1)..( 3003): 2750-1469P.txt file - cDNA_ID_1819344; gDNA_ID_2926201; Annot_ID_141502

SEQ ID NO: 18782 - DNA, 3003 bp, Unknown; identical to SEQ ID NO: 18780
  misc_feature (1)..( 3003): 2750-1469P.txt file - cDNA_ID_1819344; gDNA_ID_2926201; Annot_ID_201841

SEQ ID NO: 18783 - DNA, 3000 bp, Unknown; identical to SEQ ID NO: 3074
  misc_feature (1)..( 3000): 2750-1469P.txt file - cDNA_ID_1819356; gDNA_ID_1620623; Annot_ID_47083

SEQ ID NO: 18784 - DNA, 3000 bp, Unknown; identical to SEQ ID NO: 3074
  misc_feature (1)..( 3000): 2750-1469P.txt file - cDNA_ID_1819356; gDNA_ID_2926200; Annot_ID_141499

SEQ ID NO: 18785 - DNA, 3003 bp, Unknown
  misc_feature (1)..( 3003): 2750-1469P.txt file - cDNA_ID_1819360; gDNA_ID_1620623; Annot_ID_47082
tgtttcaggaaaaagagaagtggtgtcgttagaccactcacagtgttaacatctggactagcggtaactatttgcttttcagatggcaaaaacttattctgcttgaattccatgtcacctgtcaagaaacaatgagtagctccaatcagagattgcatgtaaacaactatacaagttgcattgtttaaagaagaggttaccgatagctcgtgatagatttaagcttccattgactcgccctgcatgtataaagccaccagctttcaatatcctttctttctcagcttcaagatctggtttgtgatctctagaaagattataagcctgtagacaaaggacacacgttttgacaaaaaaattaaagacgccaaaaagtcttaatcaaacacttcaaaatggtattttacctgattctttctggatatcacacaacgtgagtcacctgcatttgcaacaaatagctgcttgtctctaacaacagctacgcatgccgtgctcccagaattaggtccagcaaaatcagaatgaggaccctgttttgacaacaaaagcacaaaccttagatcaaactttactgttgcttagtgatagaagcagtaatgcaggtagggaatatttacttcctcaaacgcccaagcatcaggtttattagcactgtccccacttcttggtgaccatataagcccttcaatcatcccactgaacttattgattttgtcaccaagtactgctaactctcgccaccctctttgtccttgcatcatctcatccattctacaatagccacaacgacaagacttcaatgcagaacttcaaacaaaaatagactctttttgctgtaaacttacctgaaaaatgctttttgaagagaagtccctacgtctccagctgcatacgcctcatcactaagaacctgctggtgtagatacttggcacagaacttagaaacaactttacctacaatagtagccaaaatcatttgagattccatgtacaacaagaacatgaatcaccaaaaaggttcagctatatcagtctacaagctcttaaaccaagttttaagccggagaaaatacaccaagaagacaaatgtttccttttttacctccatgaccatcatagacacccaagaaggaagtgttatcatcgagatcaagtattgcagcatgctaccaaagttataaaaaaaaaacattctttgaatcagtaaggaaacaaaatctgacaaaaagaagaaaggtttaaactttttgatgataatcactcacagcatcttccatggacgcacgccaaccttgcatagaggataaaccatatctgagtttatgattttcgccatcttctgagaacttgtctgtttttggagtacttagatatatacccatctctctctgcaacgaaaaaattagacatttcttcatgaatcaaaaaaagaaactattcttgattacaaaaacaaaatcaaaagagaattttgacaatggacccctgtgatcttaatcttttagagctaattaagaaatcaatctacaaacagaaaccaaaacagagagggctgaatcgataagagttttaaacataccaagatttgaaaacgtcaaaaggaagtaggtgatgaagttgtacgagaagcttggtttcctcacatatctggctggagaaaggaaagacctttggtaggagacagttttgattagaggaagacgaagaagaagaaagttttgatttgggatcaaattcagattgtcgtagccccaaaaagaagaagaagagaaaaagtctgttttgttttgccttagaaaagcaacgaaagttcttaagattttgttcgtgttctcttacttgccagcacaacacactatttttacttaacactaatacaataatgtattacctgactctttatgatttgttttagctgtattgcaattttcaactgtattatatgtttcaaagtcttatggagtaaattgatatatcaaacacacatacatgtcttgtgtcttcattaaattctgaaaagttaaatacatagtagattgtaagactatttgtggatggatatatatatatatatatatatatatatattttcttaaagatcataatgtcaaagtttcctaaaatttcagttgtatgaacggtaacttactatttttcctccacacaagggtccaaggagacatgtgcaagtaataaatgcaacacacataggaagacacacggctaccatcttccaccatggcaacaatgcgatatttggcaagatttgacggactccatacattactctactaccaaatcaaaagtattggtctcaagtacacctaaatcactttgcaattagccagaccactgtttcacaactaaacacgtcttcacccaaaaaatcggtctacaaacttgggacaggtaaactttagtaaaacattcatgaaaatagtgagtatacttggatccatatctcaggtctaatccaaacactctttgtgagtctatgacaagggtatatataacctcattttggagtccctaatagcataatctccttccagattgattcatccacctctttttagacgtgatgatttactccgtgttatcgtattatcaatcatttagattactactaccaaagagggctcgagaaataatatcgtatagttgcaactttgttgcatgataagctttgactagtcttcatcaaatccatagcttttgcaccgctcagcttttccgtacagcatttttgtcaaatgccatttttacttcttttcaaaattagtgaatataatatggaaaacgtgttctccctgtgacctatggaccttttatgggtgtaatatttgtggatatggaatttaaaatttcttaatgaagctgctatttagcgttaatttttaagtagctctcccttttccttagaacgtgtaacacttttgtatatgtagataatagtagaacgaaaaaaaactctttgtagagagattctgcttctatatg

SEQ ID NO: 18786 - DNA, 3003 bp, Unknown; identical to SEQ ID NO: 18785
  misc_feature (1)..( 3003): 2750-1469P.txt file - cDNA_ID_1819360; gDNA_ID_2926200; Annot_ID_141498

SEQ ID NO: 18787 - DNA, 3000 bp, Unknown; identical to SEQ ID NO: 3070
  misc_feature (1)..( 3000): 2750-1469P.txt file - cDNA_ID_1819373; gDNA_ID_1620623; Annot_ID_47076

SEQ ID NO: 18788 - DNA, 3000 bp, Unknown; identical to SEQ ID NO: 3070
  misc_feature (1)..( 3000): 2750-1469P.txt file - cDNA_ID_1819373; gDNA_ID_2926200; Annot_ID_141492

SEQ ID NO: 18789 - DNA, 3000 bp, Unknown; identical to SEQ ID NO: 3098
  misc_feature (1)..( 3000): 2750-1469P.txt file - cDNA_ID_1819377; gDNA_ID_1620624; Annot_ID_47105

SEQ ID NO: 18790 - DNA, 3000 bp, Unknown; identical to SEQ ID NO: 4267
  misc_feature (1)..( 3000): 2750-1469P.txt file - cDNA_ID_1819377; gDNA_ID_1620694; Annot_ID_48634

SEQ ID NO: 18791 - DNA, 3000 bp, Unknown; identical to SEQ ID NO: 4267
  misc_feature (1)..( 3000): 2750-1469P.txt file - cDNA_ID_1819377; gDNA_ID_1620694; Annot_ID_164867

SEQ ID NO: 18792 - DNA, 3000 bp, Unknown; identical to SEQ ID NO: 3098
  misc_feature (1)..( 3000): 2750-1469P.txt file - cDNA_ID_1819377; gDNA_ID_1620624; Annot_ID_162451

SEQ ID NO: 18793 - DNA, 3000 bp, Unknown
  misc_feature (1)..( 3000): 2750-1469P.txt file - cDNA_ID_1819377; gDNA_ID_2926208; Annot_ID_141844
actagtacatgctattatcttttttattttattaaatatttttgtccttcattctcaaccgttgccacattttctttgttaatgatcattatattattattatgaagtcgtttttggaatcctacaacattaacatacacaaatgtctttttgtgataccatacaaataatttgtttttctaaaacaaacaaaaaaatatcttttgtgataagcaaattgtgaatctgtgataacctcgcccacaaatcatatcacttattcgacaatttgtgataatttagcccacaatatttatgcactagctgatagaaagaaacatatccttatcactcacttactgtataaaatcccggattggccccatcaaatatacatcgctcttatcattaaccacatctggcaagtggtttaagctgtcaaatacaacacgactttgttgaacatatttttgtttctcaatctgtaatccaccgacgttcattttttggttaatcttttgtctgctgatctgatcatgtaaacctgacggaatcgaataacatatataactcaatctaattatgcaatgcaaaacaattatttgtgaataactcatttttaacccgttgaaagaaatgatggttttttaaagatacatgcaacctttaatctcctttattcatgcgtgtctgaatttgtatcacaggatagagtaacttacgaattttcttggattagattattagaacttcattttgccaaagaaaatattgcttacataataataaggaggcggctaaggataacatgaattacaatcgctatacaacacataattattacactttttgttcttcttaaaaataaatgttatccagctatattttcatccagcaaagccgtcaggcgttgtcgataagcttcaaaaaaagaactgatgaaattccgaaattcctcctccatattagcgtacgttacgttttatttaatttattttgcaaatgatattttcttcacttccagttatttttttatttttttaattggtagagtaaaaaaagatttattggcactctaatttttgacggttaacacacatatactgcaattatgtttaacaaaactaaaccgatcgatgaaatattctttacttggtcgatgaaaatagttgtctcatccgatgatccgaatgactctttccaagttggtaccttaaattgtggtatctgctgtattccatacgaaagtaaaccgcggaataactaaattcttaaaccatctttatcagaacaaagcaactaatctgcaaaattgtcagtgttgcaagctataaatgttccgtacaagctacaaataaagaaatacaaggcttagccgatgtgaaacgtacgttagagttgtacacgatatgttttgtgtgaatttgataaattcaaaaaaaaaattgttgtacaccttgatcctagtcatgctggttggtgtatattaatatattatatcagaaagtgactgtcattctattttaatgtgatatttacggtcaaagacatgttgcatgtaattgcgcgcgcaatgtatacgaccattttttgatgaagtaactcagcgggtaaacattctatcactttccatttcattggtaagtacaatattggattttcttttgtggtatgcactagtcggtatcagtcccgagatgtaattagagaaatatttgtaactagaacttttttccaactctttcgaatttttttttttttttttttttgccgtagatttggaatatgattctaacagaatatcaatacaatatagcaactttggctcactggtcactgcttcataacatgataacaaaactctcaagcaactactttcatctgaccctttttatgtcaaaaaaggtctttcgtctgaaccgaaaatcaaaccgagttggaagcttctagcaaagataatgagccgtactagtcacaactcacaagtcacactttcgaatttcaaacttcaattgaagatccgaatatccactgccgtagtttgtacgatactttcactcatttcatgttgtcatgtgtcgtacaacagtttccagtttcccattattatttaatgtttatttattaatatttggactttaattacggcaggttatactatatggtatgatagaatattttcttcattccactggattttgctaattatatatatttattccaaatcacaattttgatttatcgtcattacaaaaactaaaaagtaatgaccaaaataaaagatatgtaatttcagatattccgttctaactattctattctcttcctgattccattaccaaacactgagagacaaataagctactggccgctaattggctatcgctctctttacatcttcgaacataagcaatagttgaaaaatataactttactaaaaaaatacatatttttcgttaaaaaaaaccttgtggtcgtctatatactattctaataagtaaaaaaaaaaaaaaaaagtaacggaagcatgaactttcatgcctggaagaaactactggccaaaaccatccactaaatacaactaatgaagtaatcatcctagttgagcatattgtaatcatcacattcaagaaaaatatcccatggagaacaattttgcattatataaaaagttaattccttgtcgacttttatataacacaaacaagaaggagcacatcgtaaattcatcaccgcttctacaccttcaccgtacgtgtctctttcgtactttctcactatttgtcattctaattataaagtacaaaaaaatcaatagtttaattattaaattaatattaaaaataaatactttctactaaaagtctaaaatattataacatcgaagttgcgaaaaataaaataaaataaacgtaacatttcacctttaaaaccgtacgcagagtgctcaacgaacccaaacacactctaaaaatatcttctttctccttcttcttcattcttctcaatatctcctaaatg

SEQ ID NO: 18794 - DNA, 3000 bp, Unknown; identical to SEQ ID NO: 18793
  misc_feature (1)..( 3000): 2750-1469P.txt file - cDNA_ID_1819377; gDNA_ID_2926208; Annot_ID_202398

SEQ ID NO: 18795 - DNA, 3003 bp, Unknown
  misc_feature (1)..( 3003): 2750-1469P.txt file - cDNA_ID_1819388; gDNA_ID_1620624; Annot_ID_47101
gtttttgcattttcatgtgtatccgcgacaagcacaccaatgacctgaaatacaagattagcttagaaataagggaacgaaagcagtacatgaaaactttttaaacttatttgacgtaacaaaatcaatacatgctcctttacttttctggtatcacttcttctaagatacagataaactaaaagttccccattgaggtttattttcttacttgtcccacacacgtgaccacgtctgtagcaaataattcttcgtcggcaacaattggtccaatcatattattcccgggaacatctttggcaagaaacagaccaacaaaaccagatgaagatttggctgccgaatcatcaactgaaaggatgcgggcatgtggaactttacttagcactaaagcagcatgcaaggtacaaggcggcaatggggtatcatcagtatattctgcttcccctgtgacctagatgaatatacaagagtgttgagatacactctatggaccttcggcgagccaacagatggaccaaaatacctgcattcttgccgaaagatggacctctggcaagccaacagatgtaccctgttttactgtctcatagtcttgttttccaattctagagaaccgaggaacaagttgcacagctgacatatgcgagggtggaaaggtctctatagtgggatttacattatttacatgatgagtaacccataagaaaaatttaaagaagaagcttagggttagagatttgcgaaactccaccattcccccaggagcaccttccttaatcaagacatcactctgtatgaccttaagtgcgtcttgcagaagacatttattccaattcttaccaattagaagttcctcagtgtttcttgcacgcaacgaaagaggagccacaccaccataaacaatagatgcatcagaaacaaacaattgttgccctttctcttcaagaaacacacgcattccaccattgacaatagctatatcatcatccctgcgatgggcctgcttaaattctttcacatactctaaaggccttgtccatggaaggaataccgacaacaagatctcgttgcttcccatatccactttacgatagccaaggaagaaatcttttgcaggtatagatctaacatctccattgcagttgattatccgaaactctgctcttgaagccatccaaagaggatttaaatcagatattggactagctgtacagatgtttccaccaatgcaagcaacatttcttatttgtgtcccagcaaaccacttcagctgttcgataaaagccttgcatgctgatgtttcatgtgcaggacgctcctttactaccttcctgaataacctcaggagttcagaaagtctcaaagctgaaccaacctctatcccattgtcattgacattcaatgcgttgagttctgggacttgagcagcagagattagcaccggatactgtaacctctttagtctcatttcgattcccacctccgtgttaccaaccagtagttttgcatcaggaaaatttgctttgagttcaagcaagttctgaagacttacgggtctataccaggtaatcccctcatttccccctaactttaagggagctaacttcctcagcagaagttcagggggaaaaataagctccttatctgtatacttagctccatctatatcactataagagattgactgaaatctatcttcattacaagtagctgcttcacttgttgtttttgatccacaagaacaaggtttgccagtagatggacaaatatttgaaccgtcctgaaggctaagtgaagataaaccactgtatagagcatcatcagattttgcaaaaacccgaaacgcatcaatgatgggtctataaccagtacaacgacacaaatttcctgcaaggcattcttcaatctcctcctcagaaggtgagtttttacttgacctcaacaaggcatacatcgacatgacaaaaccgggagtacaaaacccacattgagaaccatgcgaagatgccaatgactcctgagagaaatagggagaattaggatcgcagaaatgagaaaaaaaaaatctggaagaagtaaaaccccacctgaagagggtgcaagccaagtttccgatgaccaactccttcaatggatattacatgcatcccttctacagagtagagaggtgctaggcaagcgttgacagcataatgcctgcaataaaagtttccggtatgaacagtataagaaggcctaaacttaagcaaagcagatgcaacctatgagagaaaaagatacgcacacacatgtctttgactctcggtcataactagacaccatcacggtgcaagacccacaaccaccttcgccgcatccgagctttgtcccggtcaatcctaaatctaaaggaaacaaaaaacgttttcaagaatcccaccacacaacaacctaaccctctaaattttgctgcattgtacaatttgtggcttctctactctatctaaacttagattagatataagcatttgaagaaatcaataatatagagttaaaagcacctctgagatattcgagaagcgtcatgtgagctaatccatcaggcaaaactctacgaacaccattaacgtacattattgcctccatgaactcgttctgctccatcttcactgaacccagacgaataactgttatccaataatggcaaatatccaataatggcaaaaatccaataattgcaaaatcttctctttttaaaatgttttttttttgttttcatttttcgacaaaaaatagaaaagcccaattattaagcccataaagaagaatgtagcccaaaataagcccaatattggagtcatcaatcaggtctgggacattgaaaaaactcagtaacagtctaacagaggaaacgcggcggaggaggttttacgactattttcccttcacttcttcatcttcttcctgcgccgcttttcaaacctattcgaccagacaaactcggaaatttcatattccatg

SEQ ID NO: 18796 - DNA, 3003 bp, Unknown; identical to SEQ ID NO: 18795
  misc_feature (1)..( 3003): 2750-1469P.txt file - cDNA_ID_1819388; gDNA_ID_1620624; Annot_ID_162447

SEQ ID NO: 18797 - DNA, 3003 bp, Unknown; identical to SEQ ID NO: 18795
  misc_feature (1)..( 3003): 2750-1469P.txt file - cDNA_ID_1819388; gDNA_ID_2926208; Annot_ID_141840

SEQ ID NO: 18798 - DNA, 3003 bp, Unknown; identical to SEQ ID NO: 18795
  misc_feature (1)..( 3003): 2750-1469P.txt file - cDNA_ID_1819388; gDNA_ID_2926208; Annot_ID_202394

SEQ ID NO: 18799 - DNA, 3000 bp, Unknown; identical to SEQ ID NO: 3091
  misc_feature (1)..( 3000): 2750-1469P.txt file - cDNA_ID_1819392; gDNA_ID_1620624; Annot_ID_47100

SEQ ID NO: 18800 - DNA, 3000 bp, Unknown; identical to SEQ ID NO: 3091
  misc_feature (1)..( 3000): 2750-1469P.txt file - cDNA_ID_1819392; gDNA_ID_1620624; Annot_ID_162446

SEQ ID NO: 18801 - DNA, 3000 bp, Unknown; identical to SEQ ID NO: 3091
  misc_feature (1)..( 3000): 2750-1469P.txt file - cDNA_ID_1819392; gDNA_ID_2926208; Annot_ID_141839

SEQ ID NO: 18802 - DNA, 3000 bp, Unknown; identical to SEQ ID NO: 3091
  misc_feature (1)..( 3000): 2750-1469P.txt file - cDNA_ID_1819392; gDNA_ID_2926208; Annot_ID_202393

SEQ ID NO: 18803 - DNA, 3000 bp, Unknown; identical to SEQ ID NO: 3090
  misc_feature (1)..( 3000): 2750-1469P.txt file - cDNA_ID_1819396; gDNA_ID_1620624; Annot_ID_47099

SEQ ID NO: 18804 - DNA, 3000 bp, Unknown; identical to SEQ ID NO: 3090
  misc_feature (1)..( 3000): 2750-1469P.txt file - cDNA_ID_1819396; gDNA_ID_1620624; Annot_ID_162445

SEQ ID NO: 18805 - DNA, 3000 bp, Unknown; identical to SEQ ID NO: 3090
  misc_feature (1)..( 3000): 2750-1469P.txt file - cDNA_ID_1819396; gDNA_ID_2926208; Annot_ID_141838

SEQ ID NO: 18806 - DNA, 3000 bp, Unknown; identical to SEQ ID NO: 3090
  misc_feature (1)..( 3000): 2750-1469P.txt file - cDNA_ID_1819396; gDNA_ID_2926208; Annot_ID_202392

SEQ ID NO: 18807 - DNA, 3000 bp, Unknown; identical to SEQ ID NO: 3088
  misc_feature (1)..( 3000): 2750-1469P.txt file - cDNA_ID_1819403; gDNA_ID_1620624; Annot_ID_47096

SEQ ID NO: 18808 - DNA, 3000 bp, Unknown; identical to SEQ ID NO: 3088
  misc_feature (1)..( 3000): 2750-1469P.txt file - cDNA_ID_1819403; gDNA_ID_1620624; Annot_ID_162442

SEQ ID NO: 18809 - DNA, 3000 bp, Unknown; identical to SEQ ID NO: 3088
  misc_feature (1)..( 3000): 2750-1469P.txt file - cDNA_ID_1819403; gDNA_ID_2926208; Annot_ID_141835

SEQ ID NO: 18810 - DNA, 3000 bp, Unknown; identical to SEQ ID NO: 3088
  misc_feature (1)..( 3000): 2750-1469P.txt file - cDNA_ID_1819403; gDNA_ID_2926208; Annot_ID_202389

SEQ ID NO: 18811 - DNA, 3000 bp, Unknown; identical to SEQ ID NO: 3087
  misc_feature (1)..( 3000): 2750-1469P.txt file - cDNA_ID_1819410; gDNA_ID_1620624; Annot_ID_47093

SEQ ID NO: 18812 - DNA, 3000 bp, Unknown; identical to SEQ ID NO: 3087
  misc_feature (1)..( 3000): 2750-1469P.txt file - cDNA_ID_1819410; gDNA_ID_2926208; Annot_ID_141832

SEQ ID NO: 18813 - DNA, 3000 bp, Unknown; identical to SEQ ID NO: 8485
  misc_feature (1)..( 3000): 2750-1469P.txt file - cDNA_ID_1819440; gDNA_ID_1971812; Annot_ID_58141

SEQ ID NO: 18814 - DNA, 3000 bp, Unknown; identical to SEQ ID NO: 8485
  misc_feature (1)..( 3000): 2750-1469P.txt file - cDNA_ID_1819440; gDNA_ID_2926173; Annot_ID_140189

SEQ ID NO: 18815 - DNA, 3003 bp, Unknown
  misc_feature (1)..( 3003): 2750-1469P.txt file - cDNA_ID_1819444; gDNA_ID_1971812; Annot_ID_58139
ctaaaattacattttgggctcagaaagaatttttgtttccgtattgggttacaatgctttattcactgagaatcaaagaatgtgtctgtttatttcttttgatgctacaaaaccaatgaattgagttatgaaggctatattagtggatctctctgtctgctacttattaccaaacaaatgaagaaagaatcatagtcttgaagaaacagagtttgtaagaattctctttagttcctttctcaatatcttcccagttggagattttggtatagagttgaccatcaccactttcctcaccttcctgtagggtgcaacctagaacacgtaatgtataataatgtattacattaatgatcagtgttttgaaatgggaaaagccattttgaattagtgggaacctaacctgagaagctacatagcttattacatcttcttctgaaagtgttgtttcttgtctccggacaacgaatgctaccggaatctctccacattcttcatttggggcactgaaatggaaagtttggatactttcagtagagtaacagactctgtcgaattctccaaaactggatttgcagtatctttcacttattaaactagtttagtaaatgatcaagatttgttttttcgaacttacgctgttactgcagcgtcgataatcaagggatgtgaaacaagaacagcctccaaatctgctggagcgatctgcaaaaaccataaatgcaaagaattaatatttcctaatttagagttggctgaaagagaaactgctgttcctttacctgaaagcctttgtactttataatctccttaatacggtcaacaataaacaagtaaccatcttcatcaaaataagcaatatccccagtacgtagccaactatcttcaactatactcatctgagttgcttttgggttattcaagtatcctgacagacaaatgaacggtgttcagattctctccaagtaaaattaaaactgttccataaaaatatgtagcacaaaatcaagaacaagataataagcctaatctatcaacacaagcaccaaataagccccacgaaagttggaagatccaatctatatttacatttattaggatgcaagtgtttctcagtgatttgaaccattgacaaaagactttattcatgaactgagaaggaaaatctcaactattttggtaaagaagtacagtaggaagaatctatctacctttcatgacaccgggaccttgtatccagagctctcctcggtttcctggtggaaggaaagaaccagagctccaatctactaccttggcttgcatattaggagccagtagtcccacagaagaatacctactaagcttttccgagttgaagccccgtgttccaactgcagttgattcagtcattccatatccctgcaacaaaatgtgatccattttatacacactttcagctaaatgtaaagaaaataatagtgtgagtcaaaaagtcatggcctcgttaaatcaattttagttgtttcttttgggaagagatgtcaaatttttctaaaaaatgtagattctacttcttattgagtttatgaatgaataacatttaattcagttttctaaaacgacatccaaaagtaaaattcagagacctgaatcaaatcgacatgaggaagagtctgaaggaaatcttcaatgaacttcctactcaaaggagctgctccagaagaaacttgcttcaaacttttaaacacttcaccacaaactccttttgccttctttgtcaatgccatcaacataggtggaacaaccgggaaatgagtgatcttaaacctttcaattacattaacaacatcagaagcatcaaacctcttcataacaacaatagttgatcccagagacaacaatcccatcacaaagagtgataacccgtagatatggcacaaaggcaaagctgctagataaacattactcgatcccggatattcgtactgagaagcttcaaacctcacaaaaagctccattgatgctatcaaattcctatgagttaacaaaactcctttactagctccagttgttccagatgaatacataattgcagctacatcgtcttgcttaatcaacggttttggtacaaacccaaaactttctttcataatggagtaaaacttcgggttttcgatacgaatcgaatcaaaatcgtaactttcagatacactaatcacactaacccccaaagaactcagcttctcaacgttttcagtagaagtaaaagctaatccaacactacactcactaacttgcttcttaatctctcctaaactactcgaaggattcatggtagtaacaatagcaccaagcgagatcaaagagaggaaaatcatcggaaaatagacggaattaggcaagacgagtgatacaacgtcaccttgacgaacacctaaaacgtgatagatcccagccgccattgattgaaccataatctgtagctcagtgtgagatattgagaacccggttaaggaatcgatgagcgctgtatcgccgtggtgtttgtgtgagaaaagagcggagacggcgtcgagatttgggtcgacggggaggtgtagggaagggaatttgctggtgtagattcctgttttagaagagaaccaaaagggagggttttggtgagacgtttgggttttaggatttggcggtatgtgaagatgtgtcgccgccattagagagaagcagagtttaagattctgcagcgatcaatatttacttctgatcgggaaataaaccaacgacggaatagtttagtaaaataattaatttagttgtaacactattattatgtactaattgcaattaattgatttcgaagaacagagagtgcaagaagatcacgtgtgacacgtgacagtctgttagcaaaaaaagtacaatagtcaaaaaatacacactcacttgatttcttccctttttcagttttgtttccctattggctactttggatcccttttagattctttatattctctgatg

SEQ ID NO: 18816 - DNA, 3003 bp, Unknown; identical to SEQ ID NO: 18815
  misc_feature (1)..( 3003): 2750-1469P.txt file - cDNA_ID_1819444; gDNA_ID_2926171; Annot_ID_140148

SEQ ID NO: 18817 - DNA, 3000 bp, Unknown; identical to SEQ ID NO: 8483
  misc_feature (1)..( 3000): 2750-1469P.txt file - cDNA_ID_1819448; gDNA_ID_1971812; Annot_ID_58138

SEQ ID NO: 18818 - DNA, 3000 bp, Unknown; identical to SEQ ID NO: 8483
  misc_feature (1)..( 3000): 2750-1469P.txt file - cDNA_ID_1819448; gDNA_ID_2926171; Annot_ID_140147

SEQ ID NO: 18819 - DNA, 3003 bp, Unknown
  misc_feature (1)..( 3003): 2750-1469P.txt file - cDNA_ID_1819460; gDNA_ID_1971812; Annot_ID_58135
gtgccaagggatgagacagttgggtttgtgattgatggcaaattgtaaacaaatgatgaattgttagggccagttgcataatcttgatcatgtgtcctgtgtcctgggaagtaatcgaacagctcagattgattctggttgggttcaaattgacgatgaagaatgatgttgaggtatggatgcatgtattaatggaggtagatggcaaaaataacattaaatggcaagaggaaacactatgtcatgaagatgaacatcatgattgacataatgtggtagttggaagttcataaattctgtgtctttttgttcatgcatcttcttcttcttcagtgacacagtaagaaaataatcactttgggaataaattgtgaagcatttgtccacaaagattctacctttctgtactaagtagccacccaaaggatatataagacgattttaaaatagatttggtaagtaatgatgtagagtggaccagtagaaaaacttataaatgaatttgttgttataatgtgactttgaggtttggagtcagtgactcataaatttgaagcatgatcttgtggggttttgtgacagagcaaataagttaaagcagccatgctggattctttttcaaataaagaaacatttcaaaaaatagaacagaaaaaatgatcatatctactacactaccaaccacatgcaaggaattatgaacactataaagcatgagtgtcattgaacatttgacaattcgtttgttttctcgagaataaaagataactttataaatggagattcattttaccatcttcttgatgaattcacaaattagaaattacaatcaagggtaaaaaacttgggggtaacttctacatatacatgtgtgtggttgtgtgtgttcataagaatgaaatcaactatcttcagagaaatatcttttgactctaacccgctcaccattgaagtagatgtatttgtattcagagaggtaccttctaaggatcagttttcgattttcttcttggttgagttccctgaaggctcgtgccactctcctcgcagagtcttcgtctgggctcaccttcagctcttccatgtctgcaaagacctaaaagagaacaaccgaaagaaaatgtatcttagaaccacgtcatacttcttgcagagaggtgtagagtatcttgaggagtatcttaagtgtaagatcaagataaattctcgagggaagaaagaaccttgttttacctcgataaccttatcgtgaaggtcatggtgagcatacaacgctatcatcctagcgaacaagcgtcttgggatggatcgtgtatgtgtgtgcagaatcatgttccataaggactctgcctcatcagccctttcgtccatatcaaatgccaataagaggatatcgtatgttcccattgtagcaccttgccctttgcttaacatccacttagccaactgagtttgtcactaaaccaatcaactcaggacaccatatttagcaaaactttacacttgacataggaagccgtattacttacttgaatcacacgatgccactgacttctctttcttaagatttgcaacgccttagctgcagcaataatgggaaattcaacctcccaagctacccatttattcaaagctccataaacagcctctttttcatttgggagtccagagagctacatatcaacaaggactactttatcatcgtttcacttatgaaaacatatgttttaacagaacttttcctcacttaccattcgaacaagattaagtgctttctgtccagacccagcagagtcattcttcttccacaagtgatgctctttcttccccactttctttatttccttgctacaatatcaacattcaacacaaaaacttactggtgaatcaaacagaaaaaaacaatgtcaaatgattactcaagaaagatatgcaaccaaacataagttaatttacatatattatatatataacttgaaatgtaacaaacaacaaacctgttcacagtggcaacataacctctgtccaatttcccagcttccttctctgagaacttcaaaacaatatcaccattatgacatgttgtaattcatttcacaagctatatagccattaaacagaaagtaactacaaaaacattttttttttacctttgatctgatgcaaaagccaaaccttttcgtcttcaacgaggagtaacttccgcaacgtggagattgaagcaaagaaaagcatataaattcttgagatttctgcaatttgaagaattcacatctgaatacatatatacaatcttatctcaagactgaaatatttgatggagagaataaagtaactcactgataagccttgcaatgggaatatcccttgagttggattcaagttacagagcgccattactttcacttccagtaacacaacgaagaactgaatttgaattttatgaaatggtaaatttttgaaactggagttgttgaagataagggataaaggtgatacctttactcaaaacagagcagatttggaagtaatacgatgcagcaagaacaaaaacacattcagagtttcacagaatcaatcgagtaataattgctagagagagattgcacgatgatcgattgagtttgagagagaagaatcgagtttagggatttcttagtaaaccgaggaaaattggtttagccaattacagaaccgatcaataaccgaatgaatttagtgtcactgtcagtttgtaatgggttagtgcctagtggtggagtctagaacgtgaatatattaatgggcctttttagacaaatctagcccaacagagagaaacgagttattgaaagttctgccatacttgatttttgattgtcaagtactcaaatagcataacttttctttctttatgtatatgattgagttattagtacttgattatttagttaaaatttcatttactatctcaaacttttctaacttctcttaatcacgattattagcaaattggtttccatg

SEQ ID NO: 18820 - DNA, 3003 bp, Unknown; identical to SEQ ID NO: 18819
  misc_feature (1)..( 3003): 2750-1469P.txt file - cDNA_ID_1819460; gDNA_ID_2926171; Annot_ID_140144

SEQ ID NO: 18821 - DNA, 3000 bp, Unknown; identical to SEQ ID NO: 8481
  misc_feature (1)..( 3000): 2750-1469P.txt file - cDNA_ID_1819463; gDNA_ID_1971812; Annot_ID_58134

SEQ ID NO: 18822 - DNA, 3000 bp, Unknown; identical to SEQ ID NO: 8481
  misc_feature (1)..( 3000): 2750-1469P.txt file - cDNA_ID_1819463; gDNA_ID_2926171; Annot_ID_140143

SEQ ID NO: 18823 - DNA, 3003 bp, Unknown
  misc_feature (1)..( 3003): 2750-1469P.txt file - cDNA_ID_1819469; gDNA_ID_1971812; Annot_ID_58132
cggaagaaaacgcaacgccactgcaaccgccacaaacgcaggaggatgatgaagaggaaaaggcaatgtatgctatctgggcagtaccggaggatgacgtggaggatcggcttcagaggttaatggaagggctcaggtcagagtttggcggtccagcatttgatcctcacttaaccctcgttggacctttcccttacaaacttacggccagcgaggctaaacggatgttcaagtcggcgtgtgaaggttttaaggtgtatcctgctaccgttgaccaagtctccgccggaacttcttactttcagtgtctctacgtatctctccggcacaccgtagaggtatattttacatgcataaactgaaacaaatctttaaccgaaattgaaacttataagctaccggacattgtttttgcgtttgtcttatgtttacaggtaatgaatgctgccggacatttcatggcccacttcaaacccttcaccggaaaatgtatgatctaatctcgattaatcggattttaatatttggttgggaagtaattaaaacgttattattgtgaaaaacactaaaaatcatattattaccaagaaacgtgtttttttgtttctttctctttctgtgtacgtgtatttgaaacgttggattgttgcagtttacgtgccacacatgagcatactctacggcgatttaacggagagggagaagaagaaagcgttagagaaagcttacacgcttgattcgagtctcgacggattgaattttaagataaatcgagttgcattatggataaccgatgcagacgttggatcgtgggtgaaagttgacgaacatactctaatttcttaaatgaaataaagtaaataaatattatggttttgggcctagtctccaatcttcctcttgtgctttgtgtgttgtgtgcaatttgtctccccttattcggttttcatctgctgcattggtttagtaaggtatgatgttccatggttcggctcaaatttgttatcggtttggtctaaatgtatctttgcctctggcttaattctatgttaatatgaacatagtttatggatcttgtgggaatattcctccttctgtttcttgttaagtgttttggtttatatcttgaagaagaatgacctagtcaaggatttgaatcattggactcttatcaaactgataatatcataataagatgattcaagatataatatttaaaagcacacaatcatgaatcaatttggagtctagttgacatttgttactaaattactaacaaaaggttcaaaaagtttgaattgacattaaagataagaatcattgataagggtgcaggaggaggaaaaagctataagtaaacaacttgtcattcgtcgaaactaaaatatgatagctatgtgcatatgttttaacatagatttaaaatttaatgtaaagttttttcatcataatttagtacgagtataggacaaaacttggtaagattttgctcgaatttcgtaaaatataatactttcttgaaactttttatttaagtaacgttgacattcatgtgacgtgtatgtatccaattttggttaataagatgctatgaaatctaattattatactttcattcaaccactattcgtatctaattaattagaatattcttttaattttagtaaaccaaatgagctatagaaaaacatctctataagagtagctaggaaccaatttggaatgtatagttgacatttgttactaaatcacttagagaaactccataaagttggattgaaatcaaaggagaagtaatattaaaatgttttcagcaggaacatatgagctataattagacaacttgtcatttaagacaacaaattgattatcatcatgtcttaagatacgaatgtcaaaatcttgaccttgcatgttagttgttatacataactggttgaaaagatagttaagtctaaaggttgacaaatgatgaaataaaaattagaaaaaatgttaaagccatacaaatccacatgttgtgaagttgaataagtaagttaaacgagttttggttctaaactgaaatttgacccccaaaaaaaagatgaggatgcagatgtcaatctttacctattcaatgtacaccacaataaattgaatcacattcttagcatgaaaccttatccaatttgtttgtatattttttccttggccaactaaagtggctattatcaagaaacaactaaagtaccctgtaaattgataaagaaaacaagtggaaaatatgtaaatatatcattttagaattcaaaccaaaatagaactcatgtaatcttataattcttatcccctttttaaaaagtctttaattttagacatgactttaaaaattcacgagccaggttggttacaaacttacaaaaactcgtcggcgcatgtaaaacgcagtcgtttaaccgaatcgaatccaaacacgtgcgggttcatccacaccgttaagtttcatctgacgctgtttacatcaacggctaagatttgttattctctcttttcgtcaacgcattgttaccgtggcgccagatatgacgtctatatacgcgcataaaatcacgtgacaaacacgcgctcaacaaaagctggttcttctccttttcctctccgatgactttcttaccgaccagcttagtcttctccattacggcatcattcacctataaatttcgccgctgggtttaattctctattcattcagaaccaaaaaagaagaaacctttttgattctctttgcgatttctttgttcaatctcttctcagattgtgtgaatcgggtttaaatcggggttttagggtctctgttttcaaaagggtaccaaaaagtttggagctttactgtagaaagatttgatttttcgttgacccactccgagattttcggatacaaatcagggttttagggtttttgttggaatggaagaggattatcaacagccgaggtttacgattggtaggcaatcatcaatg

SEQ ID NO: 18824 - DNA, 3003 bp, Unknown; identical to SEQ ID NO: 18823
  misc_feature (1)..( 3003): 2750-1469P.txt file - cDNA_ID_1819469; gDNA_ID_2926171; Annot_ID_140142

SEQ ID NO: 18825 - DNA, 3003 bp, Unknown
  misc_feature (1)..( 3003): 2750-1469P.txt file - cDNA_ID_1819477; gDNA_ID_1971812; Annot_ID_58130
cggagaacttgctggactagcagtaggatcaacagtgctacttaacgtgataattgccgggtaatatactattattaattactatcattttcttttttatatagttttctttatcgacagaaaatttgaaaatgatatatggttatgtttatctttatattaggccggtatcgggagcatcgatgaatccaggacgaagtttaggacctgcaatggtctacagttgctacagaggactttggatctacatagtttctccaattgttggtgcagtttcgggtgcgtgggtttataacatggttcgatatactgataagccattacgagaaataactaaaagcggttcttttttaaagacagtgcgaaacggtagctctcgttaagaaaaagaaaaacatgactatgttgtactagtcatcggaggttaagttgtatcactaaagaagtaactggaatattttgtattaaagtgtttttaaatttggattaccgcaaatggataaacatttatggtatgtgacgaatatgtaactgatctataacgagtttggccatatctaattacgtgctatatggttgtattaactgctatattatatctttctctttttatgcgaaagataatgtcgtcatatttatggtgctactgtatcgttacacctttgaaatcattaatgcaattttggatagaaagatccttagtttacgcaaaaattgtcaaaagttgcaatttagaactcgtcaaacaaagcacaaaagccggtgtcgcaaacattgccaagtgtgcaatactttgtccaagagcttaaaatccggccacgtgtcattttgtcgccattgttcgccacatcatcaatccgaatgacgtgtcacgcatggaatcattcacgtcatgctttcctcatgcaaacatcactcctctcttataagaccaaaagcaaaacactcgaaccaaactaaagaacaagaaaaaagggtgttgttacgatggcatcgagtgataaggttccggtggcgtgtccggcaagcagtggagatggaaaggagccaatgggaaatccgacgaaaaccactacggcgatgctagagaaaggaacggctatgatgcaatcgatgaaaccgatcaggcaaatgagcctccacgtgtgttcattcgcttgctatagccatgatcccggtcgtcagatcgaagttcatatttacggccaccgtgtaaaccaggatttcctccaatgtgctgtctacgattccaattcctctaaggctcatctcataggtaaatatacttcgacttcgatagtttgtttacatttttttgagttaagtttcattagctaccaattaaaaaacaatgcaatatatggattgatcacgtctcttatatactattccatgtcctctaatgtgtgttggatcctatgaggttgcgttgtgtttgtttattcgtttcacacattcacaattttatatgaaaataaaataaaactaaacttcatttttttcgtatgcactattaattttaggtttatataggcggtaaattaatggccatgcatattttttatgcgtataaatgttttctaagtttgagcattgaagctttttgctagagactaatgacttctgaattttgtttgttattgtattgaatctatagggatcgaatatatagtgtcggaaaagttattcgaaagtctctcaccggaggaacaaaagctttggcactcgcatgattacgaggttcatgattttcgatacattgtccgatatgtttattatttatctgaaaaacgaaaatgatcgaatgagagttgtttttagatccaaatggctcttctagtaactccaagggtccctgagctcgttgcgaaaccggagcttaaaaatcttgccaaatcttacgggaaattttggtgtacatggcagattgaccgaggtaataaactcatcttaatatgattttttttatatatttgatatgattatagatgatatgagtttagtaacttaggttttttgttgtcttgttataggggataaattaccactaggtgtaccatcactaatggtatcgccacaagacgtgaatctcgggagaatcaaaccggagttggtgaaaaagagagatgaagaacatggaatctcgactgaatcgttgaagccgtcaagagatgggatctgtggaccagagaagaagaacctggttgctgattattgggttaggtttaggaaaggctttgcgcttgatgttgttgaaacagatatgaagagaacagctcccttcccctaacttttgtgtgtgctttttttctcagacattaattatataagttttcgtaagcttacactagatgggttgtgtacttattatgttatggagtatgataatgtcataaacatgagaattttttcgctctttgttactcattcactcactctaaataggttgtgtaccctttttttttctggtttaagcaaaagagaaagacatgcatctagaagcccaaaaactctttgtgacaactgacaatgtagccttttaccttttgcatatcagtttcctaaaaagccttttcttaatatagaggtccattgcactccaaaggtgtgcgttcatgagcccatgtagttgataacttcatcgtatgtttatgtttactacatacgtcgtcgtcaagatggaattcacatctgattaaattcatttcctttgaaaaaaagattccttccaacatggctacaatccaacaccttcacttagaaaatttactactgaccaaaaccaagagcattttggtcgtattttaatatccttagtcgttgtctatgaataattaatatgacttacagctcgttggtcgtattttcatatctttattcgttgtctattaataattactatgacttattaacgtattccctgattagtacaactaatataaaatgttaatcttcttctcataatattcttgaagcaaattagcactgaccgatcgatccatg

SEQ ID NO: 18826 - DNA, 3003 bp, Unknown; identical to SEQ ID NO: 18825
  misc_feature (1)..( 3003): 2750-1469P.txt file - cDNA_ID_1819477; gDNA_ID_1971812; Annot_ID_175781

SEQ ID NO: 18827 - DNA, 3003 bp, Unknown; identical to SEQ ID NO: 18825
  misc_feature (1)..( 3003): 2750-1469P.txt file - cDNA_ID_1819477; gDNA_ID_2926171; Annot_ID_140140

SEQ ID NO: 18828 - DNA, 3003 bp, Unknown; identical to SEQ ID NO: 18825
  misc_feature (1)..( 3003): 2750-1469P.txt file - cDNA_ID_1819477; gDNA_ID_2926171; Annot_ID_199525

SEQ ID NO: 18829 - DNA, 3003 bp, Unknown
  misc_feature (1)..( 3003): 2750-1469P.txt file - cDNA_ID_1819481; gDNA_ID_1971812; Annot_ID_58129
gtattctaagaagtatatatatcaaaattaatgcttaacccattcaagaattcattcgttttattacaattgtatattacatattttcaaaaattcaatattttgtaccaaaatctggtgagaacataaaaacagagatatatgttttctcttgacaaaaaaaaaacagagagatattgtagttttcttaatagagccagcaatggtcaaatatatcatgtgaaatagtttctaaaatacatcatccttttcttcttaattaataaaatagtcaaataaaaaatcgtctccaatctttttctctctctggatttgccaataaattggggataaccagctaccaaactcattcacacaaagtcataacagtcgtttaaagtctgatccttttcatttttctttagtgtgtgaaaagagaaatacagttatggcggagatctcgggaaacggtggtgatgctagagacggagctgtggtggtcaatctcaaggaagaagacgaacaacaacaacaacaacaagctattcataaacccttgaagaaacaagactctctcctctctatctctgtccctttcttacaaaaggttttttacttttgtctttactcctgtaactctcaatctccaaaacctctttagttttgaagaagaaaaaatatgtcttacaaatctttagttttgctctgttttttaaattgtcaaattgctctgttttcagttgatggcggaggttttgggaacatacttcttgatattcgccggttgtgccgcggtggctgtaaacacacaacatgacaaagccgtgactcttccagggatcgccatcgtttggggacttaccgtcatggtccttgtttactctctcggtcacatctccggtgctcatttcaatccggccgtcacaatcgcattcgcttcttgcggccgtttccctcttaaacaggtctatactctatatccctatataaattataaactataaggattgatcaagtgttgcatttaagtatgatttttgagtttgataaaccaacattagacattattgtctttgtgtttgataggtttagtttaaccgtcgtttgattctttttgcacgaaactataggttataataaaagttataatgttttttaataattctttattggattttaaagaagttgcatcttttaagtttttcttgtgttgtatagtgtatactgtatacaacctttaaatcatttatatctttcactaatgactttattttttattagaattctttcagtaatgaatttgtacgatagacgtatttatgagcatatgcgagtcatgagtgattgagtgtagataatttcaaatgtatgcgtctacgactctacggtgatatatgagtatagccggaaaactagggggaatttgttttttgtttaactatttgttaaaaagttaaatgtatttttgttagtttccaaattgaaaattttaaaagtgtgtgtttaccatgtaacatttgtccgtatatataacttctccacacaaacaaagtcaaacaaaattgtgttatataaacgtcaaaatcttcacaatcttccaaaattgggtccctagttaatatgatatcgcatatcaaataattggtcactaaattttatttcttatatttttgtaggttccggcttatgtgatatcacaagtgatcggatcaacgctagcggcggcgactttacggctcttgttcggacttgatcaagatgtttgtagtgggaaacacgatgtgttcgtcggaacattaccatctggatcgaatttgcagtcgtttgtgatcgagtttatcattactttctacctaatgttcgttatttctggcgttgccaccgataatagagcggttagtattcgaaatcttcttatgttgcacgaaatgatataataatcaaatttgatggatatatgttagggattctaactattgtaagcaatgttcgttttaacttcagctaatgtgttatcctttttatactctagatcggagaacttgctggactagcagtaggatcaacagtgctacttaacgtgataattgccgggtaatatactattattaattactatcattttcttttttatatagttttctttatcgacagaaaatttgaaaatgatatatggttatgtttatctttatattaggccggtatcgggagcatcgatgaatccaggacgaagtttaggacctgcaatggtctacagttgctacagaggactttggatctacatagtttctccaattgttggtgcagtttcgggtgcgtgggtttataacatggttcgatatactgataagccattacgagaaataactaaaagcggttcttttttaaagacagtgcgaaacggtagctctcgttaagaaaaagaaaaacatgactatgttgtactagtcatcggaggttaagttgtatcactaaagaagtaactggaatattttgtattaaagtgtttttaaatttggattaccgcaaatggataaacatttatggtatgtgacgaatatgtaactgatctataacgagtttggccatatctaattacgtgctatatggttgtattaactgctatattatatctttctctttttatgcgaaagataatgtcgtcatatttatggtgctactgtatcgttacacctttgaaatcattaatgcaattttggatagaaagatccttagtttacgcaaaaattgtcaaaagttgcaatttagaactcgtcaaacaaagcacaaaagccggtgtcgcaaacattgccaagtgtgcaatactttgtccaagagcttaaaatccggccacgtgtcattttgtcgccattgttcgccacatcatcaatccgaatgacgtgtcacgcatggaatcattcacgtcatgctttcctcatgcaaacatcactcctctcttataagaccaaaagcaaaacactcgaaccaaactaaagaacaagaaaaaagggtgttgttacgatg

SEQ ID NO: 18830 - DNA, 3003 bp, Unknown; identical to SEQ ID NO: 18829
  misc_feature (1)..( 3003): 2750-1469P.txt file - cDNA_ID_1819481; gDNA_ID_2926171; Annot_ID_140139

SEQ ID NO: 18831 - DNA, 3000 bp, Unknown; identical to SEQ ID NO: 8477
  misc_feature (1)..( 3000): 2750-1469P.txt file - cDNA_ID_1819489; gDNA_ID_1971812; Annot_ID_58125

SEQ ID NO: 18832 - DNA, 3000 bp, Unknown; identical to SEQ ID NO: 8477
  misc_feature (1)..( 3000): 2750-1469P.txt file - cDNA_ID_1819489; gDNA_ID_1971812; Annot_ID_175776

SEQ ID NO: 18833 - DNA, 3000 bp, Unknown; identical to SEQ ID NO: 8477
  misc_feature (1)..( 3000): 2750-1469P.txt file - cDNA_ID_1819489; gDNA_ID_2926171; Annot_ID_140135

SEQ ID NO: 18834 - DNA, 3000 bp, Unknown; identical to SEQ ID NO: 8477
  misc_feature (1)..( 3000): 2750-1469P.txt file - cDNA_ID_1819489; gDNA_ID_2926171; Annot_ID_199520

SEQ ID NO: 18835 - DNA, 3000 bp, Unknown; identical to SEQ ID NO: 3113
  misc_feature (1)..( 3000): 2750-1469P.txt file - cDNA_ID_1819510; gDNA_ID_2214706; Annot_ID_136971

SEQ ID NO: 18836 - DNA, 3000 bp, Unknown; identical to SEQ ID NO: 3113
  misc_feature (1)..( 3000): 2750-1469P.txt file - cDNA_ID_1819510; gDNA_ID_1620626; Annot_ID_47146

SEQ ID NO: 18837 - DNA, 3003 bp, Unknown
  misc_feature (1)..( 3003): 2750-1469P.txt file - cDNA_ID_1819514; gDNA_ID_2214706; Annot_ID_136970
tatacatgtttctattaacttttcatttcctcaccctaacatcttgactgctaaaaaatgtcaataaaaatacaaaaatgttttctctctttcgtcttcataaacatttagtcattcttattttcccttttttttagtttgatttgttacaagaataacatttttatttttctgtgaatataatgaatacaattttattatattttaagttattttagtttgacggagtataaagtagtatacaaagtcgacgtacgacgataatgtacaaaacaaaagaaaaaatgagagctaactacaccaattatatgtatcgtatatccacgtataccaaccaacatatatatgacatggttaagcgacaacattttttacacatgtaactattataaatttttagtttatagcgtttacaaagacattatcataaaatttgattattacatgactgcataatttaacaaacatagaaccttattaaaatgcatgttccagtgcaatacatgtggattgatgttgaatgactctaaaagatattgttatgatacaacagtatctcaaaaaagattcagaccaaatattttattgttttaattattattattatttttttttttctataaatccgatatttccccaaaagccaaaagggtgatgtgagaccgttatacttgacatattttatatattttatttatataacctattttggatcgtttccaactataagatatggggttgataatttttgattgtacatgaagattttgtgtcctttgtattgtattctatagtcgaacttggaccacgtgtaataacaccggagcacgcattttataagctttatgctagtatccatacgattaaattatagttcatcatcatttgttatactatatattgatgtcacataataattcagatttaaatatggtaatgtgtttgtgaactatccaaaaaatttcaaagaaatataccaaaaatttaatagttaaaatctgaaaacaaagcatgtaatttaagctacaattgttattacatattgtaagggctacgcaattagttcttgacagttggttgactacataacacttgctgaaacctacgttttagcgttggatatctctctatatatttttggtcaatgtcgttggagattgaatcctagattaaatcctacaagaagaagaaagcttcatgagaagaagaagatgaagaaaagagaagaagccaagcttggaagaagagaagaagaagatgtcgtgaccaaaggaggaagaagagaataagaagttgtcgtgaccactgaccaaaggaggaagaagagtcaacgacacaaatccaacataagaacggagttggatttgtgttttgtaataaggccattgggccgtaagtgaattatagccccacaagtgttagtgggtttggttggttaagtttaagctaaataagttaaggtggatataacaaacatagttgcaccaatgcatctcagctcacctggtctaagcaacggtttcaagaagttgctcgcttctattgctccacgcctccacaagtagctcctacacaagagtaataactcattagtatagagacacaagattatacaagaaatacttagtagacataattgttcatctccagtgttaatcctcaataattgttcgatgcagtattcttctaatgagatgaaaaatcatttttatagagttaccacccatcaaaaccatttatacaaaacgttttacttggtcagagtaaaaaaatgcatacaagtattgtgtataaataaaaaggtcatctattaatgtataatctgaatcaaaaaaagaaagagcacctgcaccaataacaatgtgaatctcatcaatgaacaagattgtttgcccattcgaagcatatacttccttcaatattgttttaaaccttgtctcaaaatcttctccataattagcaccaacaaggagtgaacccacgtcaagagatttcagctccatgataaatagcgaaaccaagcaaagcatgttaaatcttcctctagcctctttgaggggaaaaggtaaataaacttaaatatttaaaaatatctaagtttatataataacaatattgggtaagtgaaaagtaattgtcattatttttgacacttatttttataagttagaagtaattataattttttcaaacaaaaaagtaagttttttgtgtgtgaaaaaataatgatattgagaaggtaatttaattagaggtgatattttataccttaagaagtgtattaaagttaataataaccataagttaaaattggtaagctaaatgttagaaatcatttgtgttgtctgaattttcaagtttcgttcgtttcggattactttcttcttctgcaaaaacagatcccaaccatttcaaaggttcgtcttctccttctcttccacactcttctctgcttcactttttactctatcttcgactagtaatatcgctttcgacttctcaaattacttctcaagttactatttttctcttcctttctttcaaattttcgttacaaactgagtttgaaactgtttgggttttgtaaagttttgatcttttcatgatattgcggtaagagattgttaattcgacttctgggtactcacatttcgatgctcaattgtttattcttatgggtaattttggctagggttttttccaatttctctctcgttctctttcacaaggttagtcgatcttgctcatgtggtatagagtttgatgaatcgagttgtttagtagctattgtacgaactatctcttgatatagttgtaaaggttttagattgggaacaaaaaatttcactgtgatgtttgtttaggtagtagagttcaattgtgtgaaactctaatttcatagtttgcttaagtctcagaactagcactgagtctattgttatatgtgttgtttatgtaagtttgttgttattgatgggagatatgttttgtgtgcagaaaatg

SEQ ID NO: 18838 - DNA, 3003 bp, Unknown; identical to SEQ ID NO: 18837
  misc_feature (1)..( 3003): 2750-1469P.txt file - cDNA_ID_1819514; gDNA_ID_1620626; Annot_ID_47145

SEQ ID NO: 18839 - DNA, 3003 bp, Unknown; identical to SEQ ID NO: 18837
  misc_feature (1)..( 3003): 2750-1469P.txt file - cDNA_ID_1819514; gDNA_ID_2214706; Annot_ID_189848

SEQ ID NO: 18840 - DNA, 3000 bp, Unknown; identical to SEQ ID NO: 3111
  misc_feature (1)..( 3000): 2750-1469P.txt file - cDNA_ID_1819518; gDNA_ID_2214706; Annot_ID_136969

SEQ ID NO: 18841 - DNA, 3000 bp, Unknown; identical to SEQ ID NO: 3111
  misc_feature (1)..( 3000): 2750-1469P.txt file - cDNA_ID_1819518; gDNA_ID_1620626; Annot_ID_47144

SEQ ID NO: 18842 - DNA, 3000 bp, Unknown; identical to SEQ ID NO: 3111
  misc_feature (1)..( 3000): 2750-1469P.txt file - cDNA_ID_1819518; gDNA_ID_2214706; Annot_ID_189846

SEQ ID NO: 18843 - DNA, 3000 bp, Unknown; identical to SEQ ID NO: 3111
  misc_feature (1)..( 3000): 2750-1469P.txt file - cDNA_ID_1819518; gDNA_ID_1620626; Annot_ID_162481

SEQ ID NO: 18844 - DNA, 3000 bp, Unknown; identical to SEQ ID NO: 3109
  misc_feature (1)..( 3000): 2750-1469P.txt file - cDNA_ID_1819530; gDNA_ID_2214706; Annot_ID_136966

SEQ ID NO: 18845 - DNA, 3000 bp, Unknown; identical to SEQ ID NO: 3109
  misc_feature (1)..( 3000): 2750-1469P.txt file - cDNA_ID_1819530; gDNA_ID_1620626; Annot_ID_47141

SEQ ID NO: 18846 - DNA, 3000 bp, Unknown; identical to SEQ ID NO: 3109
  misc_feature (1)..( 3000): 2750-1469P.txt file - cDNA_ID_1819530; gDNA_ID_2214706; Annot_ID_189843

SEQ ID NO: 18847 - DNA, 3000 bp, Unknown; identical to SEQ ID NO: 3109
  misc_feature (1)..( 3000): 2750-1469P.txt file - cDNA_ID_1819530; gDNA_ID_1620626; Annot_ID_162478

SEQ ID NO: 18848 - DNA, 3000 bp, Unknown; identical to SEQ ID NO: 3105
  misc_feature (1)..( 3000): 2750-1469P.txt file - cDNA_ID_1819545; gDNA_ID_1620626; Annot_ID_47133

SEQ ID NO: 18849 - DNA, 3000 bp, Unknown; identical to SEQ ID NO: 3131
  misc_feature (1)..( 3000): 2750-1469P.txt file - cDNA_ID_1819565; gDNA_ID_1620627; Annot_ID_47172

SEQ ID NO: 18850 - DNA, 3000 bp, Unknown; identical to SEQ ID NO: 3131
  misc_feature (1)..( 3000): 2750-1469P.txt file - cDNA_ID_1819565; gDNA_ID_1620627; Annot_ID_162528

SEQ ID NO: 18851 - DNA, 3000 bp, Unknown; identical to SEQ ID NO: 3131
  misc_feature (1)..( 3000): 2750-1469P.txt file - cDNA_ID_1819565; gDNA_ID_2926186; Annot_ID_140816

SEQ ID NO: 18852 - DNA, 3000 bp, Unknown; identical to SEQ ID NO: 3131
  misc_feature (1)..( 3000): 2750-1469P.txt file - cDNA_ID_1819565; gDNA_ID_2926186; Annot_ID_200657

SEQ ID NO: 18853 - DNA, 3003 bp, Unknown; identical to SEQ ID NO: 15859
  misc_feature (1)..( 3003): 2750-1469P.txt file - cDNA_ID_1819595; gDNA_ID_1620627; Annot_ID_47157

SEQ ID NO: 18854 - DNA, 3003 bp, Unknown; identical to SEQ ID NO: 15859
  misc_feature (1)..( 3003): 2750-1469P.txt file - cDNA_ID_1819595; gDNA_ID_1620627; Annot_ID_162506

SEQ ID NO: 18855 - DNA, 3003 bp, Unknown; identical to SEQ ID NO: 15859
  misc_feature (1)..( 3003): 2750-1469P.txt file - cDNA_ID_1819595; gDNA_ID_2926186; Annot_ID_140802

SEQ ID NO: 18856 - DNA, 3003 bp, Unknown; identical to SEQ ID NO: 15859
  misc_feature (1)..( 3003): 2750-1469P.txt file - cDNA_ID_1819595; gDNA_ID_2926186; Annot_ID_200638

SEQ ID NO: 18857 - DNA, 3000 bp, Unknown; identical to SEQ ID NO: 3126
  misc_feature (1)..( 3000): 2750-1469P.txt file - cDNA_ID_1819601; gDNA_ID_1620627; Annot_ID_47155

SEQ ID NO: 18858 - DNA, 3000 bp, Unknown; identical to SEQ ID NO: 3126
  misc_feature (1)..( 3000): 2750-1469P.txt file - cDNA_ID_1819601; gDNA_ID_1620681; Annot_ID_164451

SEQ ID NO: 18859 - DNA, 3000 bp, Unknown; identical to SEQ ID NO: 3126
  misc_feature (1)..( 3000): 2750-1469P.txt file - cDNA_ID_1819601; gDNA_ID_1620627; Annot_ID_162504

SEQ ID NO: 18860 - DNA, 3000 bp, Unknown; identical to SEQ ID NO: 3126
  misc_feature (1)..( 3000): 2750-1469P.txt file - cDNA_ID_1819601; gDNA_ID_2926186; Annot_ID_140800

SEQ ID NO: 18861 - DNA, 3000 bp, Unknown; identical to SEQ ID NO: 3126
  misc_feature (1)..( 3000): 2750-1469P.txt file - cDNA_ID_1819601; gDNA_ID_2926186; Annot_ID_200636

SEQ ID NO: 18862 - DNA, 3003 bp, Unknown
  misc_feature (1)..( 3003): 2750-1469P.txt file - cDNA_ID_1819608; gDNA_ID_1620627; Annot_ID_47153
aaccgagcaatttaggatgggatcaaacctcgtaaatggggcaggttcgctcatagttatggacatggccgtagaaagcaaggtctactttgtacttctgccacagtttttgtaggctttctcttcccataggctcttcaaaggttccttctttgccataccaatcattggtggaataaccaaggacacgatgagctataaaaatgagccaaggctgagtctttctatcaacagtggcaagacaattctcaatgaatttgtattgctccgtgccttctctccaatcgtgttcactgtctgctacacagaagcgaaacattccataatctgttttgtacctgcccattcaaccgaaatttgtaagataccgttctgaaacttgcaagaaaatgtcaatggtttaactaactttaccagaatttagctctgttctcagcaggaaagtagaacatggtctctgcaggaacaccacactctcctccggagtctgtaccggcataaaaagatccagtgtctggccaatcacgctcatggttgccactgcagtgaagaaaaggataacttaaagcactgcaagagtagagagtagaagcacaatgttgtagattttcttgttgactaacctggcgatcatgtagggtacagtagaagcaatgggctggacttgagctgtgaactgatcccactgggagagatacccattggaataagtgagatctccaatgtggaaaacaatgtcaatgtccttcaagtccttgatgacttggtctgttgtgttgagggaaccaggctggtaatcattgtactcattcgagccatctcgctcaccctgaaacatatttcaatcaaggaaaatcattttagatattagtctgagagcgcatggagatcataatggcctaaaagagacgataccatacctttcccatgtcaccaaatattatgacccgttgtttcgagtcttgtccaggataaggagaggacacaaaggtgtaattcttgctccaaattgtggaaccattgaccaagtcatggcctagcctgtatatgtatctgtaaaccaaaggattgagagttacatgtatgaaactatattagtgctcctggattagacgataaagaagcaaactaaagatttcatactcgcggtttggccaaagttctttcaagaaagaagtatggaagaaaccaggatcacgccaaccaacgccgcgagcaggattacctgtgtaaacatagcatgcatccacaaatcaaatctctagaatgatccagatgagtagtttcagatattccaggactgctggctcagagatcacagcgaaacaggacataccacacatgctgtttctgttaaaggtcaatgttccagctggtgatcttctagctggaagtccctttgcactccattcaatgaaaggaacagcctcatctatgttgtacccactagtccatgtcacggtcatctatcaaagatagaaaaataagcaagttttagctaaagatcccaaatattgtatagctgcttcagaagtctcaaggccattgagtggaaaaacttacttcgtcccaattcttccctaatgcaagacgcggatagacaggtgctttaggattgaagaaagctacaggattcgaaaccccgagaaggtgtggctgtgatattcaaaagatcaataattaagtccacttgatatacaaaatactaaactgagaaaaactatagttataacctacctcttgaactccattggaaaacagtgcaaaggagacatcagctctctgatttataatctggaacttgagagtcacattcccggacttcatgtaatctggatgagaattacaatacatgtactgccaaatagaaattaaaaggggaatgttacaccgggacttaaaaaaaaaaaaaaaatcactggtaaatatgtaataaaccaaaccttgatgggagaagagcatatgtaaggagttttctctttgccaccacttgttggccaacagttacccgaactaacaaacaacaaagacaagttaataatgcacaaatggcacgttcacaagttaacaaacacagatgcagattagaaaaaatactcgaattttgctggagagaaaactcctatccaatcatctgaagtgggcttggggttggagatagcaagatttacccattctgtatcttcaccctgtaagatcaaagtcatgacatcaataacatatctatttaagtttggtttttgtgataattacgtgaaatcaagaaaacatattcaagtctatcatacaatttttttgacatttaaaaaaaccatctcttaagagttaatatatatctgtcaaacaagaatctgacaagaacaataatatgatgaaagaatttgttattggaacctgggaaccaagaacttgaggcgaagcgtgaagtttgacagaactatctaaagcaagacttgtttcgtaaacattaatttgagcaagtgcttgatctccacgaccattggcatgatccaaacataagctcgagctgaacagtgcgagtaaacacagaagcacacctaaaactctagccatatttttttttgtttttcctttgttgtgactgagaaacaaaaccagaaaggtatatatatatatattataatcaggatatatctaggaatcccaaaattgattcatgtctatcgaattaaacaaaatcaaatattttctttcaccgtcaaatctttagtcaggaatattctaacagtttctttttaatattctaacagttttttcttaatgatagttcatactgttttaaaaacaaataatgataacggaaaaaacggattttcgttttattcagacttatgtacattaggctgatccgggtcggaccggctttgaaccggaaattaataaagcttgattgttaaatttggcaaccgtggcttcggtttcaatcgcgctgtaatcgcatcactaattcgggtcactttggaaagaaagaagaagaagatg

SEQ ID NO: 18863 - DNA, 3003 bp, Unknown; identical to SEQ ID NO: 18862
  misc_feature (1)..( 3003): 2750-1469P.txt file - cDNA_ID_1819608; gDNA_ID_2926186; Annot_ID_140798

SEQ ID NO: 18864 - DNA, 1154 bp, Unknown
  misc_feature (1)..( 1154): 2750-1469P.txt file - cDNA_ID_1819616; gDNA_ID_1620627; Annot_ID_47151
gaattcttgtgatcttgaacgagtatgaactgagttctccgtctaagaatttgaagactgatagaaaaatgtttatgcttggatactgaaaattcataagtagctcaattttgtcaggatattgcatccacaaaagcattagaaaaataaagacaggaagatccaatagatgcttaattcacctgtgcagactgtgatagcaatcgacaccacgggttctcaaacctactgtgtacatatgtccatctttcaaaacttgccttctcttgcaaaatcgctgttgagtatacaatccaaaccagaaaacaaagacgaattgaaaaaacaatctcaaaaggaatttaaattgggtccaagagcataaagatcgaacaagaataagagcaacggaccttgcgcaacaggtggtggttgcgacgtcgtagcagccgccgcagaggcatcaatctgggagtctccagaggttggagtagtgtcgcctaacacgcatttactagaatccgaaggaggtagtgtatcgccgccatcttccaactgaaacgaaaagtgaaatcgccaaaattgttcaaaccagaagctccagatggcactcgaaagatggataagaaataatgtctccgatcagaaaccttttggcgtttggatggagatttatctgcgggagaagatggagatctcttgccgctgcttccgtcgggcgggttattgttctcgccggaggtagaatcactccgtcccggtgacaccatgactcttctttcttccgattatttcaagagcaagatttgcgattctttgagagttgaagaatcaatgcgagagatgaattttgagagaacgtaacaagaaatgagagagcttatgtaaattggtgtatatataggcctttctcggtgggaaaaaattatagagaaactttgattaatgaaccatacctaaaccaaaccgtttagtattattaggaatcgaattttgtacttaacaaccaaaaccaaaccgatccggttcagttttacccacacctggttttaattttgaaccgcacaaccatccaaattccaaagctagagtctctcagagcgtttttaggtcgaaccagtccttaagggtccgaccaatagaacgtagttgctcgaactcttcttccaaaaatg

SEQ ID NO: 18865 - DNA, 3003 bp, Unknown
  misc_feature (1)..( 3003): 2750-1469P.txt file - cDNA_ID_1819616; gDNA_ID_2926186; Annot_ID_140796
agtatccgcaaaccagaaatccaagaagattgaagtagaatcttctgttgcaaacaatgtaatgggggcatgcctttcttcaaagtatgattcactgaacgaggtaaagtctccggctccaactgtagctgtgagtctgaatcagaagaagcagcaggagaaaggctagaagcaactcctccaccggctgacaaatccgagcttttcccttgatcaatgagctcaatactctgattgggaagcttacatgacttattagaagcaagtccatccctcagtgactcaacttccttagcagtcagagcctgcaggaaattgcagaacggatgcaccaggaattacttacagtaatctcatacccgtaatcaggaaaatagacaaataagtgtagatgcaaaaactttcctcttgtaaactaacaagcatataaaaaaaaaacagcttatatttaagtaacacatacaatatcttacccccaaaattggatagctgtcaaatattagcaatttcgcctcgaggtcacgggcaagtgctttagctaacgtctcttggtatatttcagaccctgaaacaactccaaccaaaaagcgaaaatgatgtttccggctaaagaagtacaggaaccacacaagcaagataccacaaacctgcgggaccagaaagcaatatccttggattcataggggtcatgtcggagacaaattggacatattcttttttcttcagatgtatatatgaagcatataataaggcagcctttgtatattcactgcaaaaataaagccttagtcagcatacacaaaacagagaacaaatgcaaagcgcctaaactaccaaagacaagaaagcagaattagacctcaaaattctatgatgatataaacagattcttaatggaagattcacatgcacatatcttaacactgcatgaatacctgaaaaaatatatctgacttggtcccatacctcaaataatagggaaaatttttgaatgaaacttccatgttttcgcctctaacaaaaccagcttgaatggcttctctgaatattgcagattgcagaccattgcctgatgttgaagcttgttgtgaattacttgtcacctcgtttttctcatccaatatctgataccagctttgttaatataatgcaaaatgctgttgatgacgccagggtacaagagaaacatagagtatttacctccattttggaatcttggttgttaacagaaaaaattccttccatgccgtcaacttggaccatcgactctggcgcttggtggctcttactggatgcatggatcaatctttcaagcgatgatataattgaatgacctgtcattctctctaggtctagaaactttcctgcaggaacctgaactgaaccaggttttgctgcaactataggcatttgctgatatacctggatagaaattaagggggaaacttatgtatattcctatggagatattcatctcaaaactgaaggaaaatttcttcttgcatataataaaaaaagtggaatcacatgaggatacgaaagcaatcctgcttaaaccaataaccacttcgtcaccagagtttagcacatggttgatattcccctcggcataatttccgtttatccacatatgtccattgtttcccatggtctctagaaccgctaaaacattgcctttgcgctgaacatgtgcacaaacaatgagaatacatactgaataaggagttcacatatctccacaaacaactcaaaagtagaaaaaatcatacgcacaggaattgcataggccagtttaaaatccagcagtgctaatgtttgagcgtaacattcaaggaaacaaaaatacctgaattcttgtgatcttgaacgagtatgaactgagttctccgtctaagaatttgaagactgatagaaaaatgtttatgcttggatactgaaaattcataagtagctcaattttgtcaggatattgcatccacaaaagcattagaaaaataaagacaggaagatccaatagatgcttaattcacctgtgcagactgtgatagcaatcgacaccacgggttctcaaacctactgtgtacatatgtccatctttcaaaacttgccttctcttgcaaaatcgctgttgagtatacaatccaaaccagaaaacaaagacgaattgaaaaaacaatctcaaaaggaatttaaattgggtccaagagcataaagatcgaacaagaataagagcaacggaccttgcgcaacaggtggtggttgcgacgtcgtagcagccgccgcagaggcatcaatctgggagtctccagaggttggagtagtgtcgcctaacacgcatttactagaatccgaaggaggtagtgtatcgccgccatcttccaactgaaacgaaaagtgaaatcgccaaaattgttcaaaccagaagctccagatggcactcgaaagatggataagaaataatgtctccgatcagaaaccttttggcgtttggatggagatttatctgcgggagaagatggagatctcttgccgctgcttccgtcgggcgggttattgttctcgccggaggtagaatcactccgtcccggtgacaccattgactcttctttcttccgattatttcaagagcaagatttgcgattctttgagagttgaagaatcaatgcgagagatgaattttgagagaacgtaacaagaaatgagagagcttatgtaaattggtgtatatataggcctttctcggtgggaaaaaattatagagaaactttgattaatgaaccatacctaaaccaaaccgtttagtattattaggaatcgaattttgtacttaacaaccaaaaccaaaccgatccggttcagttttacccacacctggttttaattttgaaccgcacaaccatccaaattccaaagctagagtctctcagagcgtttttaggtcgaaccagtccttaagggtccgaccaatagaacgtagttgctcgaactcttcttccaaaaatg

SEQ ID NO: 18866 - DNA, 3003 bp, Unknown
  misc_feature (1)..( 3003): 2750-1469P.txt file - cDNA_ID_1819623; gDNA_ID_1620628; Annot_ID_47197
gtgagaccttatggaccaaacctgatacattttctgcttgaactgattagattggatattaactgtaatccacctttaacagatgatgatgaaggaccagtatggaaactatgtggtgcagaagatattcgagacatgtacggctgatcagcgtttaacattgttcagccgagtgagaatgcatgcatctgcattgaagaaatacacatatgggaaacatattgttagtcgtttggaacagccctctattgaaggtatgaaattccccaatgtaagtcaagttcaaaagtgaggtgaataatcacaatctttaggaacaaaagggctttgctgttataccatataagctgaaacagggcgaagtacacaatcaaatatattttctatgctaaaaaatggtcggtgaatcgctcaagaatgacatgtcacatgtgcatatagaaatgtgtggtagcacaagactgaatagaataagatgggattggtagcacaagactgaatagaataagatgaggattggtatatggatcaggaagagttacacattgtgtttgttgtttctgcagaaaaccaagaattgaggagatgagtggctcttctgatttcaagacagtgggctgactcagattcactcaatacaattcgctttttcatgaaagctggatattcattgggaaggtcttagatgattgtgaaggacatcgatattgttgtttacttggaattttatcatagccgttgtgatgattgtgtggcatgttctgtaaatattcataactgtatcagtagtttacttcagatctgtaactggtttgtggaatttcacatggtattcgaaactttctagatactagagaatattattattgaagccaaacattacatgctaatcctgaaatagcctcctcttcctcaaatttcatgagctacagattcttatcacatttcaacactgttttgagactttctttcattcatctgacatgaggagccaaagtataggatcgaaagagaaacttgtcattactcacgaaatataattgaaagcagtgtagcatatcacacttgacaatggaagaaacaccccacacaaaaatggaaagctcaaaccaacacctccaaaatactatttcaatcttaaccaaagagatcgaatccgaagtctccttcttcctcttctgattcttctttcttcttctcatcttccttaggggcagctgcagcttcacccgcaccacctccacttgaggcagctcctccagcagagaatcctccaccaccaccaccaccaacaattacctacgccacaagaaattgattccaattgataaaaattacaatgcaaaacaggaattatacacaaatattgatttgtactagtttccggagccatgtaaactaaagtcacctactaaaacagagaaggcaaccaaaaacaaattgagtgatttagctattacaaagctgtaacctttaggtatcattgttaacctataaaacaagctacattgacgcaaaatcacatttgatgcaatgataagagaactatagtgagccatgacacttgtatcactgatcaacgaccataattactgtgaatgaatcattcatctgaaaatgcaagctctgattctcacacagtattgccaatttcaaagatgcacgatctcaaactgtaagcttgttcgagcaagagagacttatacctggaatacggcggaggtaggggagacaagagaaaacgaagactgaacgccaccggaggaatcagcggagagagatacctgaacgagcttacgctggagctcgtaggtagaagaagctgaagattcaagttctccttcgtgttgcttcgcgctccacgcgccgcctccattcttgcatacgaatgtgaatactcccatcttcttcaatgtctgctaaaatcgatggcgatagtgagagatttctggaaaaagtgacgatcgagagtggttttgtttttatatacgatgatgaacgaaagctcaaaaagaagttaagaaccctagttttttggaggtctctgagtaaaagactgttttacccatagtggacttataggtcttaaatgggccacttttgagagtaatgaatatatataggcctagagtgaatagcaacaacccaccaaggttctttcacttctttgaaaaaccaaaaaagcaaagatcaacaaaatttatcagattctacgagagtcatttcctaacacatgagatgatgagattattagagtatcacaactctcaactatgtttttccataaactatgcatcgcaccattcaccacatgatattgtaactcttaagtctaagccatgaaatcaacattgaagtaaaagaactcacatagtaaattggttttctattggtttatattttaacaaaattatactgtactcatgtcatctttatgtcaccaaatcacaaactaattttctacttttaaaacaaaacatctaccaattccaccacatatcctaaaaactgactcaaatctctcaaaatctaaaatttcctaaattccacaaaatcatccataatctttaatcctccttagttatgatatcaaaaaaccattttattttaagtatctaatttccttgccataaattttattctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatgatg

SEQ ID NO: 18867 - DNA, 3003 bp, Unknown; identical to SEQ ID NO: 18866
  misc_feature (1)..( 3003): 2750-1469P.txt file - cDNA_ID_1819623; gDNA_ID_2926188; Annot_ID_140876

SEQ ID NO: 18868 - DNA, 3003 bp, Unknown
  misc_feature (1)..( 3003): 2750-1469P.txt file - cDNA_ID_1819626; gDNA_ID_1620628; Annot_ID_47195
caagtcttccttctccagtgattgaattcgaaaacaagagagtacttaattaattccagcagtctattttctccaataatttcttgttagtattaaactagtgatataaaagttcccaaagaatctaaattttgttttggattggagttggcttcacgaccttttttttttttttaagttttagtattcattttatatgaatggaatggggcaatggaaagaaaaatagtccaagtgggtctcaaaaataaacgaatttagctctgtcaatcgcacttgtctcttcatgtcattcgccggtttgctccttccacgacggcggacgatctgcttttcgacattactgtcttttaattttcttttagttgcctatttttcgttgttgttgtccattacgccattattacttttactaaacaaataatattcaaaaatataacaactaaaaaggccaattgtttttaatgacccctaaatttgagaaattaggaaactggccatttgaactttgaagcgcctagaaataatgagctgcctgggaggcagagctacattacacagtgcggctgggcatctttttctgaggttaatgggccaagtggtccggcccgtataggcccttaaccaaaaaaaagaagaaagaaagaatcgtacatggaagtttgaggtgtctcttagcatcatgagccatagtgtacaaatgcatcaaaagattagactaaaaaagagttgtacgaatagtgtgatataagcagaatattcgtctttgaaacatcttatcattgcccaatttggatatgattcggctagtgaaatatgggtttatgtttcatcgaatagtagacatttatcttatgaaaagtgcattagcataaacgaatatatggcttccttaagaattcgttgtatttgtatctgactaatggagatttctttgtgcaagtagagtattgtttcttttttgtgtgtgcgggcatgtacttgtaaatgacttgtggaaatttcattattcaagtacaaatacaaagaaatttccattgattaagatgttggatagtagtagctagttcttttttcccttcgaaaaaattaaattaaatggaagatagatacatagcatctgctcggatattagtatgttgaagcctcaaaagggcctaatccaaacatcgcaattcatagtaatttagagtatgaccaaagtcaaccaatataactatctaaagttatttcagtttttctaattttcacatctataaagtaggaaaatgatttggattagtataaaactagcaaaaaagaaaatttaaattgtagagtttgtacctataagtgtagaccattaaattttgttctgcatctgatcaaatctatacaagatcaatattaatcctatacgaactataaatcatgagaaaatcctcccggaaaaagtaatccaaaagaaagattatgaaaataggcacactgagcagtaatcaaaatctgttttatcagatgagaaattgttctaatataatggatcaagattaaactccacacgtctcaggttttagtcgacaccatttttctttctgattttggacaagagcaaatcagcaaaatgtgagtgagtttctatggttttgtcacaaaacttttgtgtgtgggctcgttggatacacaaacaaagtcaaaggttagaaatttattgagttttgggtatttccggttttagttatgagtcacatattctttcacaaaattcagacccacgtttttagcaattgaattcaactttttgagttttcgtctgttttactttctcaatataaatttttaactttgatactatatataaatttttaatataatatgtaaacttgttgtacatgtttcagttatacttagtgttttaacaaataaaatacactcagtcaatcaaaaatcaactgagtttctaatgttaaaggagtatttatttttgtaattcagttaacacttctaatcattttcatgaaaagctttaaacatatgcttttagttttcaacaaacatattacaaaagctattaagttaatcttcaaagttattaagctaataacttataaacgatattttacacataataatgttagttgtagttagactaaccatgacttaatcacccaaagagaaaacaattctagaagactagaaggaacatagaaaattaaaaaatgatatttaaagaaagaaagtaataaaaatttggtaaaccgataatgaataaaaagtcaaactccataaacttcgcggaaaaagaaaagcaccgtaatggtggaaatatttttgccattaccggaaaaaaatccaaacattttaaaaatcccactgacttagccaaagatggtcactttttctctctcccccttgtctctctgagcaccagaatctagggtttcttcacagtgaatctttttttttttttttgcttcctcctcaataatcgccttctcgtaagtcaatcactctccctctcgtcacttctgctccctatgttaaaaagttcattcatttctgcttttctagggtttttttttgggatttcaaagtctagatttttcttctctgttctacttacactctgtttcttctctctttatctctctgcctctcttttgggtttctctgtttttttcttttaatggaggaccatttacatggtcatgtatttctatctgcgtggagatatttcgtaggctttaaagttttgtgcttgtttgtttatatgttctttactttaaagttctactctgttagtactctgtctgcggaattagattactggtagggatgtaaaaaaccttgaggaaaatggtagagattctgattagaagctatatatcatttgcttattccatagtggattgatttagcttgtttaaattccagttctttttgtgatagtccctttcttatttcattggtgataaatttgtctttaggtacttgtgtgaaagctcccttctttgtggagaaatg

SEQ ID NO: 18869 - DNA, 3003 bp, Unknown; identical to SEQ ID NO: 18868
  misc_feature (1)..( 3003): 2750-1469P.txt file - cDNA_ID_1819626; gDNA_ID_1620628; Annot_ID_162572

SEQ ID NO: 18870 - DNA, 3003 bp, Unknown; identical to SEQ ID NO: 18868
  misc_feature (1)..( 3003): 2750-1469P.txt file - cDNA_ID_1819626; gDNA_ID_2926188; Annot_ID_140874

SEQ ID NO: 18871 - DNA, 3003 bp, Unknown; identical to SEQ ID NO: 18868
  misc_feature (1)..( 3003): 2750-1469P.txt file - cDNA_ID_1819626; gDNA_ID_2926188; Annot_ID_200782

SEQ ID NO: 18872 - DNA, 3003 bp, Unknown
  misc_feature (1)..( 3003): 2750-1469P.txt file - cDNA_ID_1819638; gDNA_ID_1620628; Annot_ID_47189
ttggttcttggtcctccacaatcatccacaggtgggtaccaagacatcaaatcttctgctgaccaggaaaatcttaatcctttcgaagactggacaaacctaagtgagaatgactttttctcggaggaagagatccggcaaacaagccatgacttgttagcgaatgaggacatgcaacagttgctcttcagcatgggaggtggcaaaggagaagatggttttactttcccatcgtttatgcagaatacaccaatgatgcagggatatgatgaggagggccgtgggcgatcaggaaaagcggttgttggatggctgaaggtaaaagctgctatgagatggggattcttcataaggaggaaagctgctgagaggagagcacagattgtggagcttcatgataataacgatggtaaatgaatagtcaggttgcttgctagtgtatagaagccatgtacagtttagggatgtataacaacatcacttaccgatatggatttgcttgatttagcttattagacaagaatataatcgatgaaccatgagaaatttgaagactaaccttcagcagcaagacaagaagctgattttctgtctctttaagtttcaactttcaacttgcagatatattagaagactgactaagtatgggcctataagcccattaatgtctctactgaacgcccaacttgtgaaaaacatgtctctcatctcaattttgttttcttttcacatcaacttaaagctacgagaaccaaacaagtgatgtttttggtcaaacaggacgaaacatgtatacataaaaagaggtaattatgttcgataaacataggtataaataaactataagaatttgttacaacattctttagatttgatattaactgctgtttacatttgaagaactcagttagttatttaatattttattttatagggtctagaaattacttgcgtgtggggactgatcaccgattctaaagaaggctcatcctttggataatagtatgaaacttgtcaataaagataagtcatcacaagtagggagatcttagctgtgttccatacgcccatctagaaaaagcgacgatggtcaagattaaataactgtatttgaaaaaccaaaaccgcgtcaccaactccaaagccattaccattagccatcactttccatcttccagctgttcgaatcaggacgcccctttttcttcaccaaacccatcggccgataacgaaccttcctctctgactgcctctgctcttactataaatacaaccaatacgacctcatccaaaacccaacaaacctaagctcaaagcccaccaaaaagaaaacaatcacttagcaatggcgatgatcagttactccaccattgtggttgctctgcttgcttcttttatgatttgctctgtttccgccaattttcaacgagacgtagagataacttggggagacggacgtggacagatcacaaacaacggcgatcttcttacactctctctcgacaaagcttcaggctcaggattccaatccaagaacgaatatttgttcggtaaaatcgacatgcagatcaaactcgttgccggaaactccgctggaactgtcaccgcttactatgtaagtccatttcctttagtgttttcttaaagttcacatattaagagtgattaggctaaatgttttttttgtttggttctacagttgaaatcccctggatctacatgggacgagattgactttgagttcttgggaaacctaagtggtgatccttacacacttcatactaatgtctttacgcaaggaaaaggcgatagagaacaacaattcaaactctggttcgatcccactagtgatttccacacttactctatcctctggaacccacaacgcatcatgtaagtccaaaattataaaaaataaatcacacttactcttttgaatctaatcttgtttgttttttctatctattcagattctccgtggatggaactcccataagagaattcaagaacatggaatctcaaggaactctgtttcctaagaaccagccaatgagaatgtactctagtctatggaacgctgaagaatgggccacaaggggtggtctcgtcaaaaccgactggtctaaagctcccttcactgcttcctaccgcggcttcaacgaagaagcttgcgtcgtgatcaacggccagtcttcatgccctaacgtgtcaggacaagggagtactggttcgtggttgtctcaggagctagactcgacgggtcaagaacagatgagatgggtacagaataactacatgatttacaattactgtacggacgctaaaaggttccctcaaggtcttccacgcgagtgcttagctgcgtaaagcttttaaacaaatgatccaaagccatgaaaagtaatactattctttgattcatcttataaagtatctgatgtttggttacatctgttttttatttattctatgtaagtatatttgtattcgaatattgatcaatcactttaccaaaataaaacatttgaacgtacgatcagaaaagtttaagtcatagacctcaacgaaaagtaaaaacgaaaaagttactgtacattattttctgagattcttattattgattcctaagcataattaagctataaattatatgctattagactattaaataacccaatgttttatcaataagtagaatccttcaactcttctaatttataaatggccttttgatctaaactaatgtctagcacaaaaaaagaataataataataattgttttggtgacacagaaataatattccacgaacctgtctatgttgaaccgtgtaaggtcgaataactcgatttaaatattattacatacaaagtttaagactaccacgtcgataatgtgcctccacgaaactctctttatataaccacttatttccacttcatctaaatccatcgacaaagacttacctctcacggcgagaaacaacagagaatcggggaaaaatg

SEQ ID NO: 18873 - DNA, 3003 bp, Unknown; identical to SEQ ID NO: 18872
  misc_feature (1)..( 3003): 2750-1469P.txt file - cDNA_ID_1819638; gDNA_ID_1620628; Annot_ID_162563

SEQ ID NO: 18874 - DNA, 3003 bp, Unknown; identical to SEQ ID NO: 18872
  misc_feature (1)..( 3003): 2750-1469P.txt file - cDNA_ID_1819638; gDNA_ID_2926188; Annot_ID_140868

SEQ ID NO: 18875 - DNA, 3003 bp, Unknown; identical to SEQ ID NO: 18872
  misc_feature (1)..( 3003): 2750-1469P.txt file - cDNA_ID_1819638; gDNA_ID_2926188; Annot_ID_200774

SEQ ID NO: 18876 - DNA, 3003 bp, Unknown
  misc_feature (1)..( 3003): 2750-1469P.txt file - cDNA_ID_1819642; gDNA_ID_1620628; Annot_ID_47188
actgtttttttcagttctgtattttctccgaaacgaattggaggtccagatggccggaacttgcagctgcatttcaagtctagattatctctccctttattcactggaggaagagtggaaggagagcaaggtgctactatccatgttgtattgattgatgcaaacacgggtcgtcctgtaacagttggaccagaagcttccctgaagcttgaggttgttgttcttgggggtgactttaacaatgaagatgatgaagattggacccaggaagagtttgaaagtcatgttgtaaaagagcgtgaaggaaagagacctttgcttactggagacttgtttgttgttctcaaggaaggggtaggcactttgggtgagattgttttcacggataattcgagttggattagaagtcgcaagttcaggcttggtttgagggtaccctctgggtactgtgatggcatacgtatacgtgaagcaaaaacagaagctttctctgttaaagatcacaggggcgaatgtatgtgttttcttttcttgttctctttttgccttgtgcttgccacttgttttcttctaaatcaacatgttgttggattggttatgtgtagtgtacaagaagcattatccacctgctttgaatgatgaggtgtggaggttagagaagattggtaaagatggggcgtttcataagaggctaaccgctgcaggaatagtcactgtggaaggctttctgagacaattggtcagagattctacaaaattacgggctgtgagtgcctcctattacgtcaagctcattgttgttggatgagaacattcattcaatgctcatgagtaattatgattatttgatatttgtctagattcttggaagtggcatgtcaaataagatgtgggatttgctagtggagcatgcaaaaacatgtgtcctaagcggtaagctttatatctactatactgaagattcaaggtctgttggcgttgtattcaataacatctacgagttaagtggcctcataactgaagaccaatacttatctgctgattcactctctgaaagccaaaaggtctatttcattctccttattttcttacacttatttgcctcatgatgtttggtatattgttctggaaaactctgatttacagatttttgttttggtgatgtgtgattatatagttcagttctgttatatatatgcggtagtgtaaattttttggtgtttaaatctgaaaggtatatgtggatggactggtgaagaaagcgtatgaaaattggaaccaggtcgtggagtatgaaggcgaatctcttttaaacttaaaccagcctgagaggttggatatttctcagactgatcctgtaacagctctggcaagttactctacggtgcctcttagtcagtttcctgaattcgctatagaaggttggcaaatcagtcccttgtaatattactaaatctcaaatcttatgttctttgttctgtatcataagtttatattctacttctatctttactgcagggtataatcaaacgctgacaacagccctacctcataacccacaagcacaatttgattttgttccccagcaagatcagtttatcggaatacagcaacctcaaactcaaaccaacatagagaatgaaaatgtaactaggttggttcttggtcctccacaatcatccacaggtgggtaccaagacatcaaatcttctgctgaccaggaaaatcttaatcctttcgaagactggacaaacctaagtgagaatgactttttctcggaggaagagatccggcaaacaagccatgacttgttagcgaatgaggacatgcaacagttgctcttcagcatgggaggtggcaaaggagaagatggttttactttcccatcgtttatgcagaatacaccaatgatgcagggatatgatgaggagggccgtgggcgatcaggaaaagcggttgttggatggctgaaggtaaaagctgctatgagatggggattcttcataaggaggaaagctgctgagaggagagcacagattgtggagcttcatgataataacgatggtaaatgaatagtcaggttgcttgctagtgtatagaagccatgtacagtttagggatgtataacaacatcacttaccgatatggatttgcttgatttagcttattagacaagaatataatcgatgaaccatgagaaatttgaagactaaccttcagcagcaagacaagaagctgattttctgtctctttaagtttcaactttcaacttgcagatatattagaagactgactaagtatgggcctataagcccattaatgtctctactgaacgcccaacttgtgaaaaacatgtctctcatctcaattttgttttcttttcacatcaacttaaagctacgagaaccaaacaagtgatgtttttggtcaaacaggacgaaacatgtatacataaaaagaggtaattatgttcgataaacataggtataaataaactataagaatttgttacaacattctttagatttgatattaactgctgtttacatttgaagaactcagttagttatttaatattttattttatagggtctagaaattacttgcgtgtggggactgatcaccgattctaaagaaggctcatcctttggataatagtatgaaacttgtcaataaagataagtcatcacaagtagggagatcttagctgtgttccatacgcccatctagaaaaagcgacgatggtcaagattaaataactgtatttgaaaaaccaaaaccgcgtcaccaactccaaagccattaccattagccatcactttccatcttccagctgttcgaatcaggacgcccctttttcttcaccaaacccatcggccgataacgaaccttcctctctgactgcctctgctcttactataaatacaaccaatacgacctcatccaaaacccaacaaacctaagctcaaagcccaccaaaaagaaaacaatcacttagcaatg

SEQ ID NO: 18877 - DNA, 3003 bp, Unknown; identical to SEQ ID NO: 18876
  misc_feature (1)..( 3003): 2750-1469P.txt file - cDNA_ID_1819642; gDNA_ID_1620628; Annot_ID_162562

SEQ ID NO: 18878 - DNA, 3003 bp, Unknown; identical to SEQ ID NO: 18876
  misc_feature (1)..( 3003): 2750-1469P.txt file - cDNA_ID_1819642; gDNA_ID_2926188; Annot_ID_140867

SEQ ID NO: 18879 - DNA, 3003 bp, Unknown; identical to SEQ ID NO: 18876
  misc_feature (1)..( 3003): 2750-1469P.txt file - cDNA_ID_1819642; gDNA_ID_2926188; Annot_ID_200773

SEQ ID NO: 18880 - DNA, 3003 bp, Unknown
  misc_feature (1)..( 3003): 2750-1469P.txt file - cDNA_ID_1819675; gDNA_ID_1620629; Annot_ID_47215
acacggtgtgtggtcttcaactcgtcattcaatctttggtcattttatcctcaaaagtaaaagaaacttttttttcgttgttgtttgagatggagtggtggaagaagaagagtttacgagccataattaaaagggagagattggtccgaggacacgagagaggtgggacattgctagaagagatcatcaaatcttgcaatggcaaagcaaatcccatcaaaatattctccgctgatcaaatcctagaagccaccgacactttcagcgaatccaatcgtgtttctgaactattcgatgagattccatacgattggtattattcaggtaaaaacaataaccatcatcatcatcataaactgttactcatcaagaaatggagatatagatttagtgagcataacggaggaaacttttgccgtgacatagccatctcatcgattgttagtggtcataaaaacttcatgcaattggttggatgttgtcttgaatctgaacatccagttttggtttatcgtgcatcaaagaaacctactagtttagatctgaaaatggttgtgtcatggagacaaagattgaaaatagcagaggagattgcaactgctttagcttatcttcacactgcgtttccaagacctttcgtatataggattctgcgtttagaagatatcttattggatgatgaagatggtgttgctaagttgtgtaacttctcctactgtgtctctattccacaaggagaaacatttgtgaagcttggtaatggttgtataggtggagattatgattacatggatgataattatttgattaatggtattgtctcggagaaaactgatgcgtttggatttggtatttttatgcaaaagcttctgatgggagaagagagatttcatgagctttgttatgatcggagtgacttgacaacttttgaaaacagaagaaagtttgcaaaatgcattgatgagattgtcgattcaaacatgttagagaaaataggtgatgttacagaagaagagcgttgtcgaatggaagctttcattgtcctctcggaaagatgcattggtcttagaggggaagttccaaaaatggttgaagttgccaaagaactaaaaagattccttagagattcttcttcttcttgtggtgaaacaagtttatagattacatatcacatacttgttatagattatataaatggtttaaaaacagattttcaaggtttaaaacagattagcaagtccaagtttcatttttattctgtataaatttagaaattttcttttcaagatgttgcatatttttgtaggcttgtagccacgtttcttcttgtttacaaatcgttgacttcactttttaatttgacataaaaaaaaaaaaaaactaaaacactccataaaattaattaaaatcagaacatatggtagcatcgtccagtaacattacagtatcatgctcagagcagtttgtgcatcgccattacattcaaaagtctctcacgttttcaccacatcccttgagctgcctctctcactttttttttttttttcagtggaatctttctgtttcaatttagattccaaatattgacaacgatttgtggtggattgtgacaatttaacagattctaattagttttctaatggctgattgaaatagtggcacaattcgtcaatttcaatactattggggagcgatattaaataaaaattattgtagtacaaaaaataaaagtttgaatattcaaaggaaaatgtagacttttttttttgttggtaggaaggagagaatgtagactttttaattttacggagtcgtcgctgaaatcctaaccaatgataaagcgctacgttcacgtgagtctgattttcaattattaacataaaaaataaaataaagatttctggaaaaagcgaacacattgctatcaaacggggctagattggtaaattacgtaattgtctgttagaggagtgcgtcacccaccacggtctttctcaagacaatgaaacgataactaaaataaaaaggagacacgtacttaccgttttgcccacagccgtcacaaatcagattatttactggatttgaattagagatggtactgatccggttaaactcggtttggtcagagttgaagtcttgacttggttttgtttgaagaaaagtgaaaattgatgagaaaaccaaaagaaaccggttaagaagatcaaaccgggaatgggcggcgaatggtcagaaggttaagaaaggtagttaaaaatgagagaatcgaagcagaggaggaagatgacgcacacgagagagacgaccacttccataatcaatcaacaattgctttccttcccggccagccacagatctccgtggccatctctctctttctaattattacaaagaagcattattattattattttaattatataattattgtataatcaaatctctctctgtaagtaataattatcgtataaatcctccccattgttgagttaattagttcttgtaaacccatgacgttttccgtcaaagctggtgagtttttgtctctctctcagcttccttatgtttgtttgaatacgttctgtctctttctcgtgattcttcttgtaacttgtttaatactagctcaaatgtctgatttgtaatcatgtaaataattcttctaagtttggatcctttaatgtatgaaaacccatgattcaatgttacttactcctcttcattaatgtcttcgcatttcaactttgaaaactccattgtttctcggtcaaagctcactgctttttgtttatttatgtttcaataattgctcaattatggttgttgcccaaccttgtgggtctatctttcctttatttcagctcagtttctttgacgattccgtaaattccattactttgtgtttcgtgagcatgtgggttttatgtaatcaaactgcttcctttttctgattctcaggcggtcaactttgaaaactaacaacttcggatttccatcatg

SEQ ID NO: 18881 - DNA, 3000 bp, Unknown; identical to SEQ ID NO: 3173
  misc_feature (1)..( 3000): 2750-1469P.txt file - cDNA_ID_1819687; gDNA_ID_1620629; Annot_ID_47212

SEQ ID NO: 18882 - DNA, 3000 bp, Unknown; identical to SEQ ID NO: 3168
  misc_feature (1)..( 3000): 2750-1469P.txt file - cDNA_ID_1819695; gDNA_ID_1620629; Annot_ID_47210

SEQ ID NO: 18883 - DNA, 3003 bp, Unknown
  misc_feature (1)..( 3003): 2750-1469P.txt file - cDNA_ID_1819727; gDNA_ID_1620629; Annot_ID_47200
tctccaaaatgactacgttgtgaattgtgtgagcacgagttctccaacgacaccgttttcaacaagtaattgtaggttttctcacactagagtttatttacgtctaatcatcaatatatcactgagagtgaaatcggaatcacaaaaatggcgtcgacgaagccattgattgtcgcagcgaagacgctccgaaaccggatccacttccgatctggatccacatctactggtccaagccggtgggcgacaccgggtcacgaagaacgacccaaaggatatttcatgaaccggactccgccgcctccaggacagtcgcgcaagtgggaagattgggagcttccatgttacatcacaagcttcctcacgattgtaatcctcggagtgggtctcaatgccaaacctgatctttcaatcgagacctgggctcaccagaaagctcttgagcgcctcgagatggagaagcttgcatctgccggagattcatctggttaatcccaaaacttgggagatatgattcaatggttgatctggtatgtatgtgttttgtttgtttttccggggatttgaggagattttcccatttatgatgatgatcacgaatactagtgacctagggtttcgttttgttcctcctctcctcttcgttagtgtcgataaatatgttcatgaaataagcgatctttaactcttgacgatggttttatgtaactcaccttaatttttgatcatgtttcaaagctctcttgcctccaatcctttgcttataacttctcatatttggttacttttttaatattcttggagaaagtgatgaaaagtttattgcttttgctgacattgtatgattcatttgcttagaggggtctggtttgtttctgttcgttatcttatgactctgtgtggtacagtcccaacttcacattagtaatagtcagaagttataagtatagttctggttgggaaaagtttctctcttttgttttctagatataaaaatgtcgagacggttcattaccatagcttaagattctaggttctagcactatatacagtcatggagttaggtaatgaacactagattcctgtttgttttgtttccaaacatattggggggatagaatgattgcttgagtgtgcttcccagtttataaccattatgttagtggctgcgtgtgccgaattgcaagccactgtactaataccaagtgaaagaacatgagagtgtttgatatcggttttcggggaggaggttttgatgaagtacttggatatgtcgagggagagggaggtgcaaacataattacactcaagtaggtagatgaagttttagagtaacagtatacttcatgtcgctgcaggttctgatgaatagatttaggaataggtactgtcactttgaagattattacttgtctgatattttcattagccttcattgttgccttgtgaatcttctaggtaaccctaggttctgtgttggatccctaaatcttttcatctcattttggttgtttggattcttactctgtttcaatatctcccaagagtatgattctaaaatccttttcttcttttatacattgggatgtccaaaccgaacaaacaacgaaaaacgattgtagaaccggaaaatctaaaccgaaaccgagatttgatatccataccacacttgcatgatttgaccaaattggctcaactgaaaaagtgagtctcggtttacttgaatgtttgttggctgtttttgaatagtgaacggtaaaactggcgggtgtacttattgcttgctgccacctgcattgatatttcttaaatcgtatgcatctacatactacaggttccaaaatcacattaagtgcttcttgtcgtttcatattatatgtttataagatatcaaactagcaaaacttttgctttgattattttctagctgtatcttataataaagtttaatattatctcttgtgatctaccatccttagcttggccacacactctctgttcccttgtccacaatcgtaaactcaataatttcattttaaataaacgacaacagcttgttcacatataaaataacaaccatctcaaaataaaatcaagagttctgcttctctatccagttttattactaatttactactgcacaacatcatatatagccattgcaaaaaaatgttgcttctgcctttcacattttgttgtgtagaagcaagatcatagttactgtttagtgtttacaagtggggaaggcaaataagatctgaaggactaaagtgaaagtgacaatacggtcatcattactctgacctaaagtaaacgagtacaatgtgactggcgactcccggtaaacacttgaaccaccgacaaaaacttcccggtttatatgtaacggcatcattcacaacgaccgatcttcacggtccgtaccgtacacgatccatgtctgtagaaggagaaataaagtactagctttttacggttttcagaataaagaaaaaactcatttgctgaacaaaaaacggatttcttggtgatcccaaagtggaagaaagctctgtttcttcatccagattctcagtcactcgtaaattttcatttttttttttccttttttaatatctttcctctatttttcaaatatagaagatcaaaaatcattcttgtgaatgcactaatatctaatagcaactttgggaaattgtgagaatcttactgattgcttatgtggggacttgccgtttttagtattaaaaatgtaaatcattttttttccttttcatgtagattgaaacgaaccataacaagtgtcaataatgttgtcgttttccttatttcatatcctaatttgccttggatttcaggaatatacgcaactgagtttttgtcattttcttctgtttcagactattgatcacagctgttctttttttcaggcttttcttgaaagttgttaagtaactgttgctttggctgcaatggaggaaaactgaaaagagtttgatgatg

SEQ ID NO: 18884 - DNA, 3003 bp, Unknown; identical to SEQ ID NO: 18883
  misc_feature (1)..( 3003): 2750-1469P.txt file - cDNA_ID_1819727; gDNA_ID_1620629; Annot_ID_162601

SEQ ID NO: 18885 - DNA, 3000 bp, Unknown; identical to SEQ ID NO: 3182
  misc_feature (1)..( 3000): 2750-1469P.txt file - cDNA_ID_1819747; gDNA_ID_1620630; Annot_ID_47237

SEQ ID NO: 18886 - DNA, 3003 bp, Unknown
  misc_feature (1)..( 3003): 2750-1469P.txt file - cDNA_ID_1819747; gDNA_ID_2926193; Annot_ID_141149
gtttggtaaaaaatgttaaatataatgtatatcatttctatattaattctctcaatttctagtgtattttttttaaaaaaatatatgatcgatgagaccacacgtaaaaaaaatcggcaaattttgaactaaatagatacaaaaattcacaaaacttcaaatattttaggcgtttaatagtttaaatttcatactataaaatgatacaaacttgattttttatcaatttaaactaaacatatcagatttgaattaatagaaaaatttcaaatgaaattatcgatacatttacataggtgttgagtcatatacgggattagaatgtcttctagtagcgtcaaaatcatattttagtgaggatatattgataaaagaaaagaaaaatagatagctagctccataaatagtaaattttaagttccaccaaagtacttgaactggacatgtctataatatcttggaagtagaacttctgatgattatgactatatatctactataacgcttgtatacaccgtgaaaagtctatttcaaaacccatggaggagtgatcatttagcctcatgtaccctcaccgcatgttacctatttagaaactacaaggtgagatgttgaatttgagtgaccattatctttttgctttcttctttgtttttgccatacttgtcacttgtcatctcacattcacacttattctcaatctattttcatcaccttggcaaaaatcctagctagataggcatcatcttggattctagttatgtggtctggttgtgaatatttagctagctagaaatctatcacataggtagatatgcgtcaatatacatttacagtgccatttacttttcttttttacgaaattgcgtaacaagatttcatacgactttgatttaaaagttgtcaatcacaccaattttacatatttcgaccaaattcttattgtttttcaaataaaatacggtctactttgactatcagattaacccaaaaaatacctcaaaaaattgattatatccgaaaaaataattactttttggattaaaaatttttatcgaaaatcgttatcgtgagagttagatttaggtcttatttgaatctacttttgattaattagtatatataaatgggtcaaaatgatttgagagctgctttgaagatattagtgacaaagagtaaatgggtaacacatgcgaatggtcacaaattctgcagtggagaaatcactcatgttcaagggtccacattgttcatcttacacattaccaaagtctgcaaaaactagggtttgttcctttcacatgcctatgtctgttagatgaactacctctcgtgaaaagaaaaaaaatatattcctctacactaaacacaagaaagaagaaaccaacaaacacttgtatttaccacaaacaattttcaaagatttcatttacgtataagtcaattttccaagtccaaagtttaggatagatacgtaatcaaataaataatagacaatgtatgttataaaagtaggaactagtacttctctatcaagtaactaactatacaagctcatcaagttttttttttctttaatgtaatttgtttatagtttatcaagttttagttcttatatatactcaaatatgtacgtaaagaaaaaataattcgaatgtactggatttaatcattgggatggtaaagtttcgaatggaacactactgtacccatatctctatatccctttttatgtacctgcaaccccacacacacatatatatatatagtatgggcattttagttccaatccggctagagattcattctgattatgtataatatttataatgtttctagtatttagaaatttgatatttctgtgtaaaatttcttacacaatattttttcttatcattagattttgtaagcaaatacaaaccttaactagctagcttaatacattatttttgagttgtgtagaagaattccgaaattccacatatgtaaatgcctaaaataattaaaaagaaatagatatttagatcattcgctcggatacagattggatacgaatatctgaattttcttaagtgtttgatttgtaccaatcgttagtatttactcatacacgcatggatggacacagacaacactaggaacttgtacaaatgagagtacttgccaattcttttagtcagttttataatataattgtttataattaaaatgagttatgttttgtgtggtgcatgtatataatatttaatacatgtatgtgtgcatatatttatgtatgtcaatgcaacaaagatttgggcttataaatgaatgaagaaaatgttggtgggatatggacaaaaacaaattggagaaacaatgaaataattcgaacccatgacgttacaactagtcaaaagtccccacatgatcttatcaaacgtaggtccatggatgagttgttttcgatatcataaatttctcacgaattttgttatatggcctttaagtgtaaaatgacaaaacttgccaaacaaatcatagacccaatgcaatttagatatcattggtgaatggttatagtaagtttaatagctttcaattcaaaatcaattgaaatgaatggcttgacttatgttacttagttattattattaatttcatgatatttcttatgtgagattcgtaacatgtttcttcaaaataattcatctttcatctcatcttgtatgatatcatgatgagtgagatatgatttgttttcaagtcttataaagcctattaggcccagaaccacgaatacttttcagagaagaaaacgcccattagtaatagtataggcccattaagtattagaataacaaaaattcagattttttttgttggtcacgaaaatttagctttttaatttaataaaagaaaaatgggaaaagaggacaagtcacgtcacgagacaaattagcatagcacgcaaagaagaagaagaagaagaagctccaagaatctgtcgcagaaatcgccatg

SEQ ID NO: 18887 - DNA, 3000 bp, Unknown; identical to SEQ ID NO: 3191
  misc_feature (1)..( 3000): 2750-1469P.txt file - cDNA_ID_1819751; gDNA_ID_1620630; Annot_ID_47234

SEQ ID NO: 18888 - DNA, 3003 bp, Unknown
  misc_feature (1)..( 3003): 2750-1469P.txt file - cDNA_ID_1819751; gDNA_ID_2926193; Annot_ID_141152
aaaggtaattacgcatttccttggttcgattcgtctagggacttaatagtgtgcgaaatattagaggatccaaatgatgcgtaagataagtcttatgagaagtccattagccctcgtaactatgattttaggtactagtagaaattcaattgggtatatttggtgaattctagagctttataattttgttatcgtttaaggctgataatgatgaagacataatgtcatggctctatgtttttattgctctttcctgttattttttttatcaactgatattaaagaatatatacattatattggctggtccatttcagtttttcttttatttggtcccgatttgattttatgtacataaaacatgtagaaccaatagtagtgtggtcgttatctttctaataatcgaaggctcgaaaccatatattgattcttggttagcgtatcgtctcttttatgactgcataatttacatggcttgcctatgtgttacacattatctcgatttcgatttcacgttcttggtaacatattaaagaatttagtatacgaaacaataaattgcatggggaaaccgatattcataaccaacgataatttgacaacacaaaaatggatcatcattcgccattgcccactcggccatacattagaaggacaagttatatttatttgctctctgtgaatctaattaagttttttactcgtcagtgggaaacatatagtaattgttttgtttgcattaaaatgaaaatgtatatatataaataaaaatgtactgatatatctactatagtagacttagtagtaattgttgtgaaagtagcagaaacaaaggatatggttgttgtaacataccaaattttcatgaaagcattcattgtgaatgtgaagttgagcgtatctatccgtgcaaccaaaaatagaaagagatgaagtatatgatcataatctgatttcttttgcttttagcacactaatcattgaagtttaagcatcacatctcttttctattttcctttccttgacaaaacttgcgaatcgttttgatgttccatacgtcttttgccatcattcatacataagtaccaaccaactattattaaacttttatttgttaattatacacaatattgactatatatattattatttttaccacaaaaaaaatttaaaatttagactatatagtaccaaccaatatagtattaatttttttttattttttacaaaaaccaatgaataaatttgattttccgaatgtggtttcttaattaaatttatattatttcagttccaatatttatatatatagataataaaaacaaaagagataaaagaagagatattggaaacaaaagaaaatgaataattgagagaacacaaaagaggaagaaagagagtggagaagagaagagaagagaagagagcaacttcctccattttcttttggcttcctctctccttctcggtttgttttgtctgtacctgagagagtttcccctaacaaaaaaagactcttttttcctcaaaatccatttcgcttccgacgccattctcagtcggtgtgaacgcgtgagagaaagagagagatttggcttactttatctccggcgggcatctttttccggcggagtttccgatgtatctactctagctaagctcagctcttaactgttacaggtctctctctctctctctctctctcttcccccgagtaaaaaagccacaaaatgtctgaatcatttagctctgatctcactttccgatgctttttacctattttctcgtttcgatttctttgtttgcttttcactgttcttacttcaattagattctgatccctctttttaccctttctctctctctctttctctgcttttgcttttactgtttccttacaattgtgattgtattgagctaattttggtcggattcatttactcttctctttgtcaatttgcttgtttttgttaaagatgtgacatttattactaaaggtttcttctttttgggggaaacaaatttgagttcatagatagacttactagaggagtgttgtatcactgatgctggaatctggttaatgtaggcagatccacagtgcctgttgattgtttcttcctatcatcaatctcggaatttgagggggtcttattattaagggtgagtcaattttgatttgtaattttcacaaggagtttgtgttcagacttcagagcataaaaagtgactggcttgattgtgataggtcatgtgaaaaaatggtaactggttcatcttatcttttgttcagtcactataaagtgtccctctgattacagaatcttattctcctttctttttttccttacaaagttcttgttttgttatgcttgtcctgttcctctttgctgctagaaatattctcttcttctactctctcttcacttttcctggatcttttaggtttaaattttgaagcttgcagagctggaaagtttcttcattaggaatctttgcttgttagtttcgtgtcacctcagataataactaaatagctgtgaaactgcagggaccataatgaatgaactccgaggcagaaaggctcaaaagattgaaagtccagttccaggatgcttagggaagatggttaacctatttgatctaggaattgctgttaatgggaacaagttgcttacagataaaccacatcttgatggtaatcactagttccctctgtaattgctttgttcactagtcgaagctttctgttatgtttctgaactgagtaggatgtcctagtatccacctgtgttattgacacgaggtagtttcatggcaggatcctctctgtcaagaagtcgatctgatgtgactcgaatgccaggcccttcttataaaggccattcagaagctgaattggtacgtttggttaaataattagaaatagtatgcatgctagcaacagcgattttaatattcagaagctgaagtctattgcctgcactgtttgcacagattatg

SEQ ID NO: 18889 - DNA, 3000 bp, Unknown; identical to SEQ ID NO: 3179
  misc_feature (1)..( 3000): 2750-1469P.txt file - cDNA_ID_1819755; gDNA_ID_1620630; Annot_ID_47230

SEQ ID NO: 18890 - DNA, 3003 bp, Unknown
  misc_feature (1)..( 3003): 2750-1469P.txt file - cDNA_ID_1819755; gDNA_ID_2926193; Annot_ID_141156
taccagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccaggtgagtcagagctcccatatataggttaactttacgcaaacatgtcagcgcgtgttagtcacttgactcgtgcagtttagcagttgaagcttaatttgtatctttctgtttcttggcgtacagggaactgaagaagctcgtgattcgacgtctagtaagaggtcacgagctgcaataatgcataaactctccgaaagggttcttatgcttccattggaatttcaagattctgagtttgaataatggactatctgtttcatctcctttaaaacttgttttttttttgttaaacagagacggagacaaaagattaacgagatgatgaaggctttgcaagaactccttcctcgctgcacaaaggttattacagtttcttttttaattaactagttgttatttaactttaacgttgattctgattctgtgtctactctgatcagactgatagatcttccatgctggatgatgttatagagtacgtgaaatctctacagagccaaatacaggtatgtcctcaaaaacagaatgtgagtttgaacatggaaacagtttgaatgtccgcagattcatttcctggaagatttataaagtttagatgagatggcctaatagccctgttcttgaggtctttgcttcccaaattttgtagggtaaacatttaaggatctttaggtcatgagtgagatttcatatctgaatcgaggtttttatgccagatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctccaacaagttacgtctcttactcgcctcctttcgtagtcacatgacgtccgttgacttaacatacaaactataacatatatgatattacaagatttaatcatggactcaattctcaacaggtccatcatcatatccaccaccgcgctacccttttccaaacattcagacctttgacccatccagaattcgtttacaaagtccgcagcctaatctggtgtcgaaccaacctcagatgaatccctatagccagtttgttggtcaccaccggatccaacaacctcgtcctccattgcaggtaattcttcaccagtatcccattgtgcttattcctctctgtccctacgaacgcttacaagatccttttctaaaaaaaaatgtttttatagagtcaaacaagaccacaggtgagtttcagccaagcaagtagtagcaaagaacctgatgatcaggacaacaaaccaacaagttagtacgaatcagggaataaaggcttttcttgctagataagttaatagtcaagattgtgaatttcaatgggtaaagtcatcctacgttcacagtctcacagataaatttataacacatttaataatagattttttagaaatttgcaaaattaagggatagatttggcacaaactcattaacgtcacacaaaatatgtaaaaaaattaaaaggacgaggcagaaaaagatcatgttgttttctaacgtcgatacaaaaaactctgatcaagttctctttagatgtttttgtttattaaaaaaagaatgccaaaagagtcgacgcatagagtaatgacatcattgtggatgctgaaaacgtcatggtatgcataaagacacacttccgagagtgatagagagcttatcctatatatgctcctaaaatagactttctaaaagcacagaattttatcaatagaaggggaaagaaagaaatagcgactcaatgaatctggccctaaaagcaatttataaactctgttaactaagtggtttcttggaggtttctggggtatatagaagacaaaagtaactctttcttttttggtttttaataactcacaacaacaaaaacaaaacaaaaaaccttttcatgataaaaaggtaacatgtgtttggtttctctcatacatttgtttctaatctcagacataaataatttttgttcccgacttcaaaaccaacgatgattatatcattccacattcattttcttctacttcttccttctccttgatctcatttccctagaaaatccatctatcatgtaagttcctttgagattctctgctcttacttgcaagttttatcttgacatgtttgatgattaaggatttggtttgagattaggggtgaagatgatatagtggagctcttatggaagagtggccaagtcgttagaaccagtcaaacacagagaccctcctccaatacaccaccatctcttcctccaccacccattcttcgtggtagcggaagcggcaacggagaagaaaatgccccgcttccacttccacagccttcacctcccctccatcatcagaatcttttcattctggaagacgaaatgtcttcttggcttcaccattctcaccccggcgttacgtccaccccggcttcttctgtctccctgccaccaccacccaatgctccgtacagctccggttttttttttcctcttttaattctcttactttatg

SEQ ID NO: 18891 - DNA, 3000 bp, Unknown; identical to SEQ ID NO: 3177
  misc_feature (1)..( 3000): 2750-1469P.txt file - cDNA_ID_1819774; gDNA_ID_1620630; Annot_ID_47224

SEQ ID NO: 18892 - DNA, 3003 bp, Unknown
  misc_feature (1)..( 3003): 2750-1469P.txt file - cDNA_ID_1819774; gDNA_ID_2926193; Annot_ID_141161
atcaaactttttctcgtacaatgtttgtctatttaccattgatccagatttattgtgaatataatatacaagaatatttcaacacccaccgaaagttattcttgactgatcactggatttccttgcttaaatcattaaataaaaaaaccttaaaacacgttttaatgatgtcttgcacttttagaacgaactttataaactaatctaaatggagaatcgttgtttacaatgtttcaccacttcatgagtgtccaatctctgttatgtgaacgaaaacaaaccaaattaaatataatctatctaaaagtaaaaccaaaatgtatcaaaatttattttttggttaagcatgatttattaaatttttttcatgaaatcctaaaacaatgtaacggattttttttatctaagccctatgcagtatgcaacgagacgaaaatacctgattaaaaatatggaaatcgtaaggaacaatagagtaataaaacagattgatgacaaacgaagttactattggtaaaatttctgatttggaagaggagaagttgacaagttcatcgaccccatttatttgtggagtcttccccacgtatattcctcggcctctaccacaaccgcgtgagccagctaacagtgtccatcttcttatattttagtttttttttttttttctatctaatatttatttatcaaacacatgttggtgattggaaactaagaaacatacatattcatagtacctttccaggatagcattttctttatattaaagaagttagttctttaattgttatgttgtctaattcatgcatacaaagttcattagatgcacgtcaattgtcaaaactctatactttttggactacgtcaaaatttcgatttcttagaagttatatataaagaaagccttactgacaaacaaatggtgatcgaatagagttccaatccaaaacattccaaacacaaatcaaattcgtaagatggcgggtcttcaagcgaagacgttaatgttcgttctggcagctgccttagcgactcttggtcgcacatttgtggaggcagacttcagtaagaattttattgttacatggggtaaagatcacatgttcatgaatggtaccaaccttcgacttgtcctagacaaatctgcaggtatatagtaatcttataacacaataactttaaaatcagtccatttaattttagtctattatttcatgagaaacttgatagataaacatgtataactgtttttatgtttttgtttgtttttgcaggatctgctattaaatcaaaggtggctcatttgtttggaagcgtagaaatgctcatcaaacttgtgccagggaattctgctggaaccgttgcagcctattacgtaaaattttcttttgaactcgatcgatagaattacaaaaaaaataaaaaaaaatagaatcaatacgcaattcttttatatatagaaaaattagattaatgttttcagatttttctttgtagttatcgtctacgggaagtacacacgatgagatagacttcgagttcctaggaaatgcgactggtcagccgtacacgatccacaccaacttatatgctcaagggaaaggaaaccgcgaacaacaattccggccatggttcaacccgaccaatggtttccacaactataccatccattggaacccatccgaagttgtgtaagtaattaacttatggctatggcggtttcttaagtactttataaaaactccaaacaaatgctaagaaatggtactttctatcaatgaaataccacatcaaaaaaacttaagtaagattaaatgttacttagatagtttagtttgttactgtaaaacaacattaaagtacaaacacttcatgatgaatttttcttttagttccttaatgttttcgaaccttcaaaccaaaaaaactttaggaatctcaaacgattatatgtttttatttcctttctataaataaacgtgtcgcacaccatgttgtatatcttatataggtggttcgtcgatggaactccgatcagagtttttagaaactacgaaagtgaaggaatcgcatacccgaacaagcaaggtatgaaagtgtttgcgagtctatggaacgcagaagactgggcaacacaaggaggtcgagtgaagactaactggacgctagcaccatttgtggccgagggtcgtaggtacaaggcaagagcttgtttgtggaagggatcagtcagcatcaagcaatgtgtagatccaactatacggtctaattggtggacatcaccatcatttagtcagctcactgcttcgcagctgacgaagatgcaaaagataagagatggtttcatgatctatgattattgcaaggacactaacagatttaaaggtgttatgcctccggaatgctcgaagaagcaattctaattcaagtttccggccagcgggcggaacgaggagaggctccggcaatcatagcaccgcggtcgaggttaatggggacggactgtaaattcgtttttcattattttttttaataatttatttttctgaattgtttttgtgaggatttttgtgtgtctttgattcattgataactcgaatgagcaatcatgatgaagaagaagaagtttttttttttccattttttctttgttaaaatcctatacaaaaaaaaacaaattcaaaagctaaaaccctagtaaaaagagacaaaatccaatacaaaattatccccaaaattatccatatttagacacattgcgttgactttagaactagtggattagaaactccaccggtcctacgtggcaactaaatttcagtccacgtcaccgacacacaaattttcttagccttactataccatacaatttacgttaatgcccctattgtctcatctattcgcaaatttcaactctcaaattcaacgaagtaaaaaagccctaaattgatatctctatcccttgcgcatgatccagattcggttgtgatcggagctgccatg

SEQ ID NO: 18893 - DNA, 3000 bp, Unknown; identical to SEQ ID NO: 3176
  misc_feature (1)..( 3000): 2750-1469P.txt file - cDNA_ID_1819780; gDNA_ID_1620630; Annot_ID_47222

SEQ ID NO: 18894 - DNA, 3003 bp, Unknown
  misc_feature (1)..( 3003): 2750-1469P.txt file - cDNA_ID_1819780; gDNA_ID_2926193; Annot_ID_141163
tgctattttttagttttggtgctaaatatagatatgcctgtcttcctaacaataaactgtcatgctgcaggccgttcctgggtctagtaatgctcgtgcaataccaatggacacaagcaatcatcgaggtcagctcgagttataaattttaattgtgtcactttctgattaattttgtaatagtatatgatgtgttttttgttttctctcgactttcacactggactcaactggcatagagtgtttggctgatttagtttcccgttgcaactgtttatttcaatatcttgatgctaactctccgtttggcaggaggaactaagatttcacatgaagcccaagtctctgaccgtgtcagaccggctaatgccagtggtccaagcccacagattaataccgctgtagggaggagtctgggttttgatcaagtccacaagaatgtacgtgcttattcatttgcctcttccaaataaatgttgtatcctgcaaccctcccccttgtgttagcatctcatgcctgcatctgtgttgcttcagagttctgcatggttctctgcttaaagcttttacctgttttgcatggtcaattgtcatcaacgagctctatattgtgatatgaactacatatagcataaatgattaaaacacgatactgatcatcacgaaatatgctcttgaccattattttactgaaaacccattgcagatgaacatgccatcatccacttcattatctcctgcgggtacctcaaaaagaaatgtcagacccgaaacctcaaattctgggtttgggagcgggaataaaaccggcggttggacttcaccattcatgtcaccggggaaatgatgcaaaaaaagttggagtatatcattcatctgatctgctgagcaagattatgtgtgcctttgggtctaaactgtgatttctgcagtgaaaagctctagactgaggttgaagatctgaatggagtttttccatgaacagcttactgtttgacaaaaggcatgaagattatgtttgctttccttcaagattctcacaaatgactgacttcaacctttgtataaaatcttgcaaccgggcgtgtaatttggttcttgtgattcattctcccaagttttcttctataaaactttgttcgtatttctgtacgtagttccctgtgttggggcataacctgggtttgctgtgtcatcaacattgtttgcagaaaatcaagagcaaagcatgagcagcttcagcagagatgccttcaaaggcttgagtcaagagttgcttgtggcagggacatgtcaccatcaagctaatgtgcagctgacgagaacgtaaaaggataagctatggctagcttctggaatgctccgagaaacacttccccctttttttttctctgaatttcctattcagtttaatggtattctgtgtttgatttttcttactcgattttgtgcattgaaaaaaattatatcaaaaagcttgacttgatccaaacatgcattttcaattgctattattaaaaaaaaaaaacgtataaaattgtagtctcaatattgaaatacaaacacctagaattgatcgatttggtagagaactagttagtggattaaatttgggttggctgattttcgagccataaactatttcgattctcagctttcacacccggacttttgggcctttaaatttccaccatcaactttcatattcccaaaattacatcatctatttttggattcatgcttaaacatacatttccaattgaaccattcatttaaccgggattaaccacaaatccgcgtttactgtaccgcgattgcgattaacccaactaatacccagacccgttaagaaaacgacgtcgttttcatttcgtttaactcatcaaaaagagaaagaaaacgacgtcgttttcattcttcttctttaactctcaaatcgatttagtcgttcttctttaatctcgacactgtgaaattagggttcttgagagagaaagacaaaaggggatttggggttttcttcttcggttcgaatttttgggtctcgatttgggtttcgaatagggagaaatgaagaattggtgggaggaaagattgatttaccaaagcgatccagatgaccccgatttcgaacctccagagagtgacattgaagccgacgatggaagtgatagtggtgatagcggagtcgaggaggacgaagccaccagaatcgagggagaggacgtcgggatagatggagacagagcttctgatggagaggaaaatagagaagacgatggtgacatagcgtctgatggagacgtcaatctagaagacgatggagacagagatgaaagtcaaaagaagaggactaccaaatcgatttgagagttaaagaagaagaatgaaaacgacgtcgttttcttaacgggtctgggtattagtcgggttaatcacaatcgcggtacagtaaacgcggatttgtggttaatcccggttaaatgaatggttcaattgaaaatgtatgtttaatcatgaattcgaaagtagatgatgtaattttgaggaatatgaaaattgatggtggaaatttaagggcccaaaaatccgggagtgaaaactaagaatcgaaatagtttatgactcgaaaatcagccaacccattaaattttcgaaccttcatcattttgcagaccccaaaaacggaaatcatcaaatcatccaccgtgccagcgtgacattacaaaatcacgtaaataccctcgtgtttgtttataaggtaaaaaaagattggcggacccaaaatggtgcagtagttaggtgtacaaatttttttttgaaggatcactactacggctcaaacaagcctgggtccatgtcactaccaccgatgtcagtcaaacaaaaataataatatatgtttttaagttcctctaatttcaatcttctaaacaacaaccctaaatccttatctctatccttgcgcttgatccagattcggttctgattggagctgccatg

SEQ ID NO: 18895 - DNA, 3000 bp, Unknown; identical to SEQ ID NO: 3212
  misc_feature (1)..( 3000): 2750-1469P.txt file - cDNA_ID_1819788; gDNA_ID_1620631; Annot_ID_47263

SEQ ID NO: 18896 - DNA, 3000 bp, Unknown; identical to SEQ ID NO: 3212
  misc_feature (1)..( 3000): 2750-1469P.txt file - cDNA_ID_1819788; gDNA_ID_1620631; Annot_ID_162701

SEQ ID NO: 18897 - DNA, 3000 bp, Unknown; identical to SEQ ID NO: 3212
  misc_feature (1)..( 3000): 2750-1469P.txt file - cDNA_ID_1819788; gDNA_ID_2926182; Annot_ID_140619

SEQ ID NO: 18898 - DNA, 3000 bp, Unknown; identical to SEQ ID NO: 3212
  misc_feature (1)..( 3000): 2750-1469P.txt file - cDNA_ID_1819788; gDNA_ID_2926182; Annot_ID_200344

SEQ ID NO: 18899 - DNA, 3000 bp, Unknown; identical to SEQ ID NO: 3213
  misc_feature (1)..( 3000): 2750-1469P.txt file - cDNA_ID_1819792; gDNA_ID_1620631; Annot_ID_47262

SEQ ID NO: 18900 - DNA, 3000 bp, Unknown; identical to SEQ ID NO: 3213
  misc_feature (1)..( 3000): 2750-1469P.txt file - cDNA_ID_1819792; gDNA_ID_2926182; Annot_ID_140618

SEQ ID NO: 18901 - DNA, 3000 bp, Unknown; identical to SEQ ID NO: 3202
  misc_feature (1)..( 3000): 2750-1469P.txt file - cDNA_ID_1819796; gDNA_ID_1620631; Annot_ID_47260

SEQ ID NO: 18902 - DNA, 3000 bp, Unknown; identical to SEQ ID NO: 3202
  misc_feature (1)..( 3000): 2750-1469P.txt file - cDNA_ID_1819796; gDNA_ID_2926182; Annot_ID_140616

SEQ ID NO: 18903 - DNA, 3000 bp, Unknown; identical to SEQ ID NO: 3201
  misc_feature (1)..( 3000): 2750-1469P.txt file - cDNA_ID_1819804; gDNA_ID_1620631; Annot_ID_47257

SEQ ID NO: 18904 - DNA, 3000 bp, Unknown; identical to SEQ ID NO: 3201
  misc_feature (1)..( 3000): 2750-1469P.txt file - cDNA_ID_1819804; gDNA_ID_2926182; Annot_ID_140613

SEQ ID NO: 18905 - DNA, 3003 bp, Unknown
  misc_feature (1)..( 3003): 2750-1469P.txt file - cDNA_ID_1819814; gDNA_ID_1620631; Annot_ID_47254
aatcagaacttaagcgaaatccttcgaccactaaagaagaaaatccctaacaaatctcagagtttgtgttaatttcttctttccttacatcttttccagaagaaaaaaagctgaaagatgtggttttttggatcgaaaggagcatctggattctcttctcgttccacagcagaggaagtcacacatggtgttgatgggactggtctcactgccattgtcacaggttttcttctatcaatagtttcatgcccttttgcgacttgggtttgtctaaagttgtagacttttctataattatgaattgatttcatatgtagggtagagattttttacttttattgtttagacaattggaatttgatgtttttatgatcagggtctgtttttggttcggtcaaccctaataaatatatggaggtcatcaccgtttgttgttctaaagtttgtcttttttttttgccaataagtaacaagcttttgctcacaagaattggattgctatgtttggtgaattttaaagtacaacatgtttgggaccatttgatctgcaaataacatgtgctattagaaagttacatatatatacatacttgtctctgtttcagctgattctaagttatgttataatcacacactatacaatttctgaccaaaggaagaaaaaaaaaagatttgcttgtagatctcgtttcaatacttttgtgaagtgctgcttccttattttggttagattgagtatgtagtttagtatgcacatgttctgtatcagcctatcagggtattgaaaaggctaggaacgagcttaatctattagttgatacaacttaagaaagtgagatttctgaacatgttggatcctcaagttttgttttgtttgttttcatgttttttcaggagcatcaagtggtataggtgtagaaacagctcgtgttcttgcactgcgtggtgtgcatgtggttatggcggtgagaaacactggcgccggtgctaaagttaaggaagatattgtcaagcaagtccctggagctaaagttgatgtcatggagttagaactcagctcaatggaatctgtcaggaaatttgcatctgagtacaaatctgctggtcttccactcaacctcttgatgtaagctattgaaatatcgtggttcatctatagccgtttggatttattgacgtttatgttttgacttgtctcaattttgtaagcaacaatgccgggattatggcatgtccttttatgctctctaaggacaacatcgagctgcaattcgcaaccaaccatttaggtgagtatgataaccaaaccaacattatggctttgtcctacattttatataattagtttctaatcagtgcaacggtttttgtaatccaaatacatttcaggacattttctgcttaccaaacttctgttagatacaatgaagaacacatcacgtgaaagcaaaagagaaggaaggattgttaacgtatcatcagaagctcatcgttactcgtacccagaaggagtccgctttgataagatcaacgacgagtcaaggtactaatggtgaaccaaatagtataattctccgatcccatcttttcttctaaagccaacattcttccttgatttggtctccacatgcagttacagtagtatacgtgcttatggacaatctaaactctgcaatgtattgcacgccaacgagcttgcaaagcaactgaaggtaaactacactaaacaaagcaaagatgtagcaaatcaagaatctatgtttccatggttatcttcaattctggtatatgattaaaaacaggaagatggagtcaatataacagcaaattcacttcatccaggagccattatgacaaatctatggggctacttcaactcctatttggctggtaacttcttttctcggattcaactctcatcactccatgtttcataaggttacactcaaagtaaacaaacgcatacatatattttgagtctcttctgatctctctgtcaccggcttaatgcaggagctgttggtgcagtggctaaatatatggtcaagtctgttccgcaggtatgcatctaatttctgaacctcacactaataaccaatcacttgcaaacttgtcactaggtttctcagcttaagtaggagagaatgatacagcagtctagctttacggattgatttggtttttgttggtaatctggtttataatgtctgagtattcgacttggtagggggcggcaacaacttgctatgtggcattgaatccacaggttgcaggagttacaggggaatacttctcagatagcaacattgctaaaccaatagaacttgtcaaagatacagaattggcgaagaagctttgggatttcagcactaagcttactgattcgcaatgatgattaccgttgcagtagatagttgttcagggaacctttactttcgatgtctctattgtgacaatacttatttcagtctttattgatacaaaataaaatgtaaaaaacaaatctgaaatcatttccatttcaattctgcaaaaagatggtttatccaatttcagcctaaacaaaagtgttacttatctgttttctcattgactcaaaacagttgtctagtgaactaactcgtagacataagtaagtaagaaaccaaacagaaagagcttaaaacatcttctgattttggagttaactcatgttattggtgggagctattttaaggacatttgttaaatcctttaaaaagaaagttgttaataaatccccatcatttgactttggagatgcactattctacacttcaacctcaacctcgtgagacatgaggattaaagtaaagtaatcacatttctgtcacatatgaacaaataaagttatttaaatcagaataaaagcgaaatcgcttgaccactcaagaagagaaaaacgctaacaagtcccatagtttgtgtttattggacttctttcctctcatcttctccagcagaaacaaaaaaagctgaaagatg

SEQ ID NO: 18906 - DNA, 3003 bp, Unknown; identical to SEQ ID NO: 18905
  misc_feature (1)..( 3003): 2750-1469P.txt file - cDNA_ID_1819814; gDNA_ID_2926182; Annot_ID_140610

SEQ ID NO: 18907 - DNA, 3003 bp, Unknown
  misc_feature (1)..( 3003): 2750-1469P.txt file - cDNA_ID_1819818; gDNA_ID_1620631; Annot_ID_47253
gatgttactagttacacaaatatctaggctagatgtcctaatcatcttcaaaatattttgttgatgttttatcttaaataatcaaagtttttcaattattgtgggtgttgtatatatttaacataatcttaatccataaacaaaaagtaatataaaggtgttgcgggaaaaggttacttaatggttaagaagtttggcttatgatcatcccactttgtgaagtatggcatgaactttctttttaccgatattagagccaaatgaaagcggtttcttaatcgccaagttccaaccaaaaaacaaaaagcccacatttacgaaaaatactcttaaaccaacattttgaattcatatgatacaaagcttcaaatatccaaatcgaggaaattattttttaaaaaaaacaatacataacttttaaatataaattgcgaaaaaaggtaaagccactcatcaaaattcaaaagtgatgagattaaagcaagtgaagacgcatacattatcacattaaaagtagcaaacacaccaagaaattagataaaaagataacaaaataattccatccactttctttttcttttgttttgtcaagattttgttttttgtatttcagtcatacgtgtgaatgtatatcaacaacattgtttttaatgtataaaaatctcaactactataaagtagctgaatgatatgtgattaagatatatatcgagagagacaagccagcaagaattttcagcacacatacacacacaaaagattcaaagaatcatctagtaacaaataaaaaaggagagagaaggaaaatgaacagaatgagcaatacagtgataggattcttgaatatcctaacactaatttcctccatagttctattaggatcagctctatggatgggtaggagcaaaacgacatgcgagcattttcttcagaagccacttttgatcttaggcctagctatcttgatcttgtcagtagctggtctagtcggtgcatgttgtgacgtggcttgggtcttgtgggtgtacctcttcttcatggtcttcatcatagtcgcactcatgggtttgaccttgtttggattcatagtgactagccatagtggtggtgtggttgtcgatggtagggtttataaagagtttaagcttgaagcatatcacccttggcttaagacaagggtggtagatactaattattgggttactataaagacttgtctcttgggctcagtcacttgttccaagctcgctctttggactcctcttgattatctccaaaaagacttatctcctcttcaggtactcgttataatcattccaatttttttcataatcagtaaaattagtaaactagctagtcatttagagatttgtaacataaaaataagctagtgctaaacattacatgctaataataattcgagtaattgaaatattctgatatttggaaacagtctggatgctgcaaaccaccgacgtcgtgcgtttacaacacggacacggtgatacaacaagaccctgattgttaccggtggaacaacgcagcgacggtgctctgctatgattgtgacacgtgtagagctggcgttttagagactgtacgtcgcgattggcacaaactctctctagtgaacgtcattgttgttattttcctcatagctgtttactgtgttggctgttgcgcgtttaaaaacgccaaacgccctcaacattacggcttcccttatggacgttacggcatgtccaaatccagacctggatgggaacagtcctggtgagattaactgcttagagaattacaatattttttttcattgaatatacgtttataggtttgttctcttttctaatgcaacaattatttttattattttcgcggcatgtaggtcaaggtggtggcatgggagagatcggtattagtgaaaaatatttatgttaatgttttcgaatatcacggttcaactttttggtttccaatatataattattgattttgaacagaacataaattttttataatgaaatttctaattcgagaaaaaaaaatttagtcacttccgatccacaaaatctgagttaagaaattgaaaaaaaagagctaaatgttttatgtttatggaacattattttaaatgttattttaggtagtcaaatgggttatctttgggccagacattagtcattgaggaggcccacaaaggtatagaactagagtaacgaagccttgccttgaaggcaataatcgcttctcccacatcggaagtttgaggatggatactcgtctgtgacatagtataaataaagaacatggtcgaagcttgcaaattacttacctggacggggtcaactcgtgatcaagaagacgagtggcctaggctagtgaattccattgcacataacggaagggtgcttagcttaaggtcttcccttgtggaagagcctgcgtcattatttgtggcagagggggtttgcgttcgcgcagcccctaccattcccagtagttcaatcttttgttcatgaatacccatggcctaggctagtggcttcctgcacttgaggtgcgctaagcctaaggtttccccaaatggccaagtgggagatcctgcgtcattatttgttgccttggggggctgcgttcgcgcggcccattccatccgcaatagttcaatctttttagctctctggtaactgttataacatctgaggtctttctttaattgttcacgtttttggtggagctattttattgaaggttgttaatttgactttggagatgcaatcttctaatcaaatctccacgtgagaagcgaggattctctcctcgtcattatttatccttcccaattagagtaatcacacttttctgtcacatatgaattattaaaatcagaacttaagcgaaatccttcgaccactaaagaagaaaatccctaacaaatctcagagtttgtgttaatttcttctttccttacatcttttccagaagaaaaaaagctgaaagatg

SEQ ID NO: 18908 - DNA, 3003 bp, Unknown; identical to SEQ ID NO: 18907
  misc_feature (1)..( 3003): 2750-1469P.txt file - cDNA_ID_1819818; gDNA_ID_2926182; Annot_ID_140609

SEQ ID NO: 18909 - DNA, 3000 bp, Unknown; identical to SEQ ID NO: 3198
  misc_feature (1)..( 3000): 2750-1469P.txt file - cDNA_ID_1819822; gDNA_ID_1620631; Annot_ID_47250

SEQ ID NO: 18910 - DNA, 3000 bp, Unknown; identical to SEQ ID NO: 3198
  misc_feature (1)..( 3000): 2750-1469P.txt file - cDNA_ID_1819822; gDNA_ID_2926182; Annot_ID_140606

SEQ ID NO: 18911 - DNA, 3003 bp, Unknown
  misc_feature (1)..( 3003): 2750-1469P.txt file - cDNA_ID_1819841; gDNA_ID_1620632; Annot_ID_47288
gtgaacggacatgtgtacttccacttgaggagaagtcatgtcttttgcaatgttctaagcacacaaaagtttcatagaacaggtatgattcttgatttgatggaagctttaacgattgaggaggaggatgggatcaaatatgttggaacaggtctagaagagaagaagagaaaggcaatgagcatgatctaagctgtgtaagactaacaagacttacctacaatataagctgtgtagtctgttgaggaaaacattgatgagtctataagttgcatgtgaacttaaaaacagcaaagtttagagtttatgtgattacaattaatgatgctattacaaatttcaaacctcttcttgaatttagaattttaaaccttgataactaaatttcataaaatgcaatagagtagctagatgacaccctaatttgcatcctctgttccaatcatcatcatcgatcatagagcacagtcctacacatcgggcaagtgtttttgcggtttagccactccacgagacaaccattgtggaagacatgggaacaactcatgcgagtgggtgctgttttcgaactggagactagactctggagacaaatggaacacgactctgcgttcaaactctttgtttcctctacgctcatgaacccttgtagaaccatcctcgatatctttaatgctgcctcgtcgacacggacgtacttgtaagtaaccgcgacgctcacggtcaagtcaacaaaacctgagctgatagcacttgagatctttgggactaagtgatcgcacaaccaatggtcgtctctatggagtcgatcatggagtaacgattggatgtggtggtgactacaactagggagagtgtaattgatgggaagtgatttataggaaagcggagtggacgttgcggttcgatggccagtgccagggtttataaggatctcatccttaatggtattgacgatgaggaagatcgagtttgtatttccttgtgatggagagcgagagactctctcagcttggacctgaacgctcactacggctttgggaatgggatcattcatgtttgaaagaggcttctcaacacaaaacagaagaataagaatttgcaaatcgtaatgagagcaaattgagagagaagacaattgtgaatagctttagggttacgtagtgagtatatatatatgagctgtgttcaacggtcaatacatttcagattctagtttccttttgttctttgttaccaataaatttccttttttgccacaaagaaatttccgtttctttaattcttcttttgggatgatatctgttatttcttttgttattcaaaactacttgtattaactattaagagacattactcaaagtttgaatatttagatatcataattaaagaattcattcatatgatcattttttttttttgaatgaatgttagatttattaaaccaaaaaaagacctttgtacaatgaatgtaaccttatactaaaagttccgaattttttaaataaaagataccaaatacaataatcacttgggtcttccagcaccaaaccaacttcgcaagccatcctcaaatttggttgcggtttcctttagattagaaagtctgttccgaactatacgttcaatgtaagaagacatgagggtaggagacaagttttgttccccatgtcgacgcttatttctttcagaccatatggagtgcacacaaacttggaatacataccgtagaataaacctcaccgtgggggtgaatcttgaatccagcagcttagatacaatatcattgtatgaggtagtaaactgaccttgtaataaaccttctgcaatatcatatgatcatttctttttgaaaataatgttaaattatattcaatgaaaaatagcgtttgtacaactagtgcatcatgagattgaaatgagttacaagaatttgctacttaatttcgagagtcgaaccaagtttgtaatcccttatcataacgtctatctcctgtgagccgaatggttgaaaacctgtttctcatttgcttgtcaatccactctgttagtcgggtttgacggtttggagtttcaccatgccttctgcagttcctttctcgccatatagtataaatcactgtctgaaacacgtagcgggctatgaagctttccatacaatcacgccatggacctcaaactgaagagattaaaaagaatgccaatccgttgagtacttctctttgtagatgttttttgccactgcagcccatacttcagagcaaaagacacaagaaaagaaaagatggtctctagattctagagcgttgttgcagagaatacatgtcccaagagcgccactgttcctctgcaacatacgttccccagtagagagtctattactgaccgctaaccacacgcaaaaagaaaattttggggttgcatgtaaaccaaactccgttatgccaagtaaccgtgatgccctctttgcgaatatggttccaagtgtctctagtagagaacttgggttgtaaacatcgtgtttgcctctccacaatacaacatccggctctcttttgtgggtttgacgttttagttcgagcgcctcctccaacaagttcaatgtcacagtcctatgtctcctctgccgtctaaagtcccaagcctctgcaactgtcaatagcctgcttattcccatgtcaacaaaccttctgtttccaaccaagtccagcggcctacccatgttggaccatatgatcatttatctttttcagacatttttattcgcctaatcacttgttcactacttcattcatgttacctaatcttgacggtatattaattttactaattccaaatttgaagttattgagtttggtggtgtatatgtagataaatcttgtagatgttttctgctaaatatgtataagcaaaaagcatgtttaatttttcttaatgatcttagactaaggggagacaattgtcattaaaccttcaacctaaacctacctattataagacatg

SEQ ID NO: 18912 - DNA, 3003 bp, Unknown; identical to SEQ ID NO: 18911
  misc_feature (1)..( 3003): 2750-1469P.txt file - cDNA_ID_1819841; gDNA_ID_2926154; Annot_ID_139444

SEQ ID NO: 18913 - DNA, 3003 bp, Unknown
  misc_feature (1)..( 3003): 2750-1469P.txt file - cDNA_ID_1819850; gDNA_ID_1620632; Annot_ID_47285
tgcttcaatgaacattgtgatcacgatgacctaattcgaaactccataaacccaatgattttctcatactaatccaacgaaaccctagaacctagagaccagaagcttccagacaaaccctataacagagtctaatgatctaatcaaaaacccaatttcgaaaaatccaaaattggtaagagaaagggtaaaagaagctaactttctctggtgatttgtctgaaattcttgtactctccgccataagaggacgatccagaatcggagaaggacatcgcgtgaaatcgtcgacgaaatgttttttgatggaaagggaaagtagaatcgaatatcaaaaaaaaaaacagattcgcgaggaagaagaagaagaatgaaatttccgttgaaattgtggatctagggtttacttggtgacgaagacaacaacgacgttaaagagttgaagaaaacttggcgcttctagatttttgccgttcctgggtcggctccagcgagcccatgagttttcaaactttgaatgagttgttttctcagacgtgtgttaaagtcaaaatatagggacgaattatataatattataatagtcaaatgacaaacgtaaccttgatattaactaattttgcaaagtaagccactatatcaagatactttacagtaatcacccaactaattaaaatttgaaatatagcccccaagtcaaactatgattcactactttaatagttattaaaacttataactaaagccaaggaacatcaagcttagaatagaagcctagaacctaaatcgatttcgtagaccaaaactctaaatctttgtcaaactcgtaaacaaaaggtataaaaatcaaatatttaataatctaacttataatctaaaaacaaatcataaaatataaacaaaactgaaatccagattttagaataagtttaccaaacaaggttaacttttatccgatttttctcaaatttgttttaatatctttctagtttctgaataaaaaccaatccaatagttttgtgtttacaaatgtgaattatataccttttttgatagataaacgagaaaactatatgtgtttgtttttagtaaaaccaaatggcgaattttaaattattttattgcgatatatattgtcataattacgctatattgaggcttttatatttgtttgatgtttttatgtcaagtttcgtaagtataaataattttccatactttggttaatttgagggctgtttgcaattttacttatagtattattgcaactgatcttgctatatttatttatttatattctgttgaagtgatcttgcatttttatgtttacttttatcttccaaacttttagtttctacattcacatctttcttttacatttttcatctgttcttagttagttccaaatctttattttatcattatcattaaagaaaaacgttatgagacataaatcttgttgagttttaacttttaagtttaacctggttcaagcatgccgttttttctcaaattttatttctaacattttgatcaatctgcattctatgtaacaaaggcttttgtttgaatatattttttcatgcaaaaaagaaaacattttgatcaaactaataaggaacaagaaaaggtatagtgttaggtaatctttttttcttgttcatattttacagtgatttattacatcaaaaaaatttagcacataatgaacactacttattgtcgtattattaccaaactcacatatctcacatcactacacttctttaatttgttctacactacttaatgccttcaattaagatgaagtcgcttctgaattcaggttttttcttcgtagacagcttccaccgcaagaaaaacacaaccatgttaacaacaacaacgatcataatcaaccctacactgatcaataaataccacattttatctggagatatcatatcacagccattgagactaataagaaagagacatggagactggagaggcaacatcatccatagaaacgcccacatttctataatataatattctccagctggtaaaaagcaaaacaccatgacaaccagctgatgttgcaagatatatatctagagcgattaataaaccatcttggtcatggatgttttggtggttaacctctggagatcctagcaacagctttattgccttgattttgttctgacatgtttctatgtgcaaggcggtgttaccatttgatcacgtccgttcagttcttgtgtctctagcgattcagcaactacatgacgcagagtacttcgagttcttcatatctatcattcataaccgcaatgtgtagagcggtctcatcgttcacattaacatctctaacacaaccgggacaagccaatcataagatcaatctcctcttctcactaccatatgaaatggcgtcgtacatgttatcataataaagaatgtacctctcacatgcataccaaaaaaataaaccatgtattaaacaaaacaaacatattagtgtttattacaaaaaaaaattatactttcgtttcctagaagacgaacaaggtcaggatcattctcttaaacattgatacgaaaaaagaaaatttcctaacattctaaagctaatgaatgtaatcaacaactttattttcttatgtccgtaaaccaaatttctttggaaaatttactaaaatgctctgttagttataaatttagattattggtgactggtcgtcgtaataaacgggaagaaacgaccgaatcttaaaaaacatgttgtattgagaaaaaatctctcttttgtggtttggttcagtaatttcatcgaacacttgctaagcaaccgcataaacttccgtacttttattacacgtgtcgcaaaccaaagatagttcccattgacacgtattcgatcacgtggctttgtcctgagcttttctttctctaacgcaaatgtttaaccacagtggccacgaagaagaacgatactaacagagccttcacagagagatg

SEQ ID NO: 18914 - DNA, 3003 bp, Unknown; identical to SEQ ID NO: 18913
  misc_feature (1)..( 3003): 2750-1469P.txt file - cDNA_ID_1819850; gDNA_ID_2926154; Annot_ID_139441

SEQ ID NO: 18915 - DNA, 3003 bp, Unknown
  misc_feature (1)..( 3003): 2750-1469P.txt file - cDNA_ID_1819873; gDNA_ID_1620632; Annot_ID_47279
gcagaagataagtttcacaaagttatagagacagatcaagctagaacagagacaaacctgcttttagattctgatccagagcagagtcaagtgctctttgagcatcttcagttaaaggaggatgttccgggctaaagaaatacatatctgcctttcctagtaacttgaccgtttcttcacgcactttgtaaagcataatcttattcgcccgcaaaaactttgaagtaaaactagttcctgctcatcaaaatcaaacactatctcattccaaatatcactcactaccaagatcctagtaaccttttgtatcatctcaagcaataaaccagaagtaaagtaagtaagtaccttcaatcaaaatacccatgagaagtgcttcagttccagtatttggatacttgagcttcctagcttcaagctctcccattgcaaatgatttaattgccctccatgaccatctacattcacaacattaccctctaactttctttaaaaacctaaatcaacccaggaactttaaaaacaagcaattcaattcaatcttaggtctacaagaaacaacacttacttgggctttttcgcatcagaaaccactaaatctggattcctgcaacaaattaaagcacataattgaacaaaatcaaccacaattgcgaaaatggagcaacataaaattgatcaaaatcaactaaaatccgatcaaaactttagaaatttacgcggtgggtaagctggagatggcggatttatggattcttcttgggcgattagtttgtagagcggagactggagaagtgagagagagggatgaatcaacaacgcctaaccaaggattcgtcaatgcttttcttgtagagaagaagtataatggaacagatagtttcttcttagagaaagaatcgatttgtgagatgatcggattcgtcaaagcaaagttgcaagaagagtgagccgccattttcgcgagtgtgtctggataacgggaaaaatgaaagaacgtcaaattgggaaaggagaagaagagtcctggagaatgacgattgtcgaaacgatatcgtattcgttttataaatcttaaaactttcttatatgggcttaaaagatgtgaataaacccaacacaaaataagtttagttttgggcttattgcttatcattaaacgggcctatcaacgagtgaaagagtcaaaaacaaattttatcacaagacaaaaaattcaaatagtcaaaaagaaagtgaatgctgaaacctaatttattttctcacatatgtttgaatacgaatggtggatttcatgttttcactctgccttttaaaattctacctttcattttctaatagacacgagttaatgacaaccattagctttatcattaactaagttgattttttactactccgtttaaaagtttaatgccaacacaaattcaacacagttttcagaaaagtaaatccactatcatagtaaaccattgttagcttggaacaattatatatctttttagagaaattagtctcaaatatgattgggagtgagacaatctcggatggttgtatctatttttcttttactgaaaaatagagatttttttttttatgtcaatgctttttcaaaagtaaaaatctctatttgttagaaaaaatagaaatttttattttttattctatatataaaaaaactctattttagagataaaactatagatgagttagaatgaaataaatacaaaaataaagtatagagataaaaatagagatgagttggaaatgatatgaaggaatagattagaaagaatctatatatacatttttgcagccattttcgcaaataaatcctagacttgtacttatttacaatctaatgccattagcattaaatcttttttccaaaataattaattttactttaaatttttgatttaaattgtcaatcacattatcaatcaaatttaatcccaacaaacttcaaatcaatctcttaaaattagcataaacatatttgttaacaatattttaaaacaaagttttttgttaaaataaatattattcttactaaacgttttttgtttaaataaataaattttgtatttgaacttatttacaatgtcatgtcactgacattaattatttattaatgaaaatatttaattaaagatttaaatcttctaaatccttacttttagagttattatgtcattactttgtaagcaaaaatattattttttaaatattattatttatatatttaaaatttataaaacattattaatatttaaacttataaaaattttgatatatcataattttttaacatcagtttaaaaaaatcttaatttttgccgtcatattttatgattcaaaattttaaaaatgaacatatattaaccaattggcaaaaaatgtgtgggttcaacgtcccgcatcgacaaaaatatttagacaataatttataaacatatcataaataagatcaacattaatataaataaatgggttttttacaggacgaatttgacgggacgagtttggcaggacgttacttaataacaattgtaaattataaaataaaaatatattatagatatacaatttgcaaaaaaaaaattatactaactttaaaaagataaattgtctccgcagtgtaccgcggattaaaatctagttagaaaacaaaagcgttgtcattgattttattctattttaatttatatcgaatttttttgatatttcaacactaagattttttcacattttttaatttaagaatcttgaaattacttattaaagaaccaaatcaaaatttctaaagctctagttccttgacaagtggcgttgtttaagattttaaataatcctaatatctctagtaaaataaaataacagccaagtacgacttttttgtattcactctctctctcaaagattccgtctatagaatcattttcacaattagaaatccgaacccaaactcatcaattttacaaattctctcttatctctatg

SEQ ID NO: 18916 - DNA, 3003 bp, Unknown; identical to SEQ ID NO: 18915
  misc_feature (1)..( 3003): 2750-1469P.txt file - cDNA_ID_1819873; gDNA_ID_2926154; Annot_ID_139435

SEQ ID NO: 18917 - DNA, 3003 bp, Unknown
  misc_feature (1)..( 3003): 2750-1469P.txt file - cDNA_ID_1819889; gDNA_ID_1620632; Annot_ID_47274
ttctggaaaaacctctagttgtgagcaacctgagagtattagctcttgaagacatttcagcttataaagatcagaagaaagatgcttcagctttttgcagttcttcagattcagcaaagcaagtcttctaaaggtttgaatggattcgggaaggctctttataacagtgccatctaaaagtagaacttcaacattttccgagatcagtgggaatttctttaagctggagcagccactgagaataagagtttgcaaggattgagttttgattccttttggaagactcctaaggcttgtgcaatccctgagattgaggtatataagcttctccaaacaatttatcgttgacggcaattttttcaaacttgtacatccttctagattcaacctctcaagattatgagcattagccaaacccaaacactgacgtaaatttatagaatgactaaggtcgacccatttgagcattccaacatcctgtgaaaaaaaatacaaccacaagtcaaatttttgatgcaaatcaaaattcactttagcttaggactgatcaaactgacgtaaaacataccttttcatcatcccaaatttcttctaattgactatgtggcaatttaaggtctacaagattcttagggtcaaagtctagagggatactctgtagtggataaccatgccagtgtagatatgtaagctcgttaggaaggaaactaagtcccctccgcaagtgtagtttaaactctgcttcgcatccacgggaacaatgagaatcataaattttcaagtatttgagattgtacatcccttggaaggctttggcacttagacgcattgctcttagttttgatgtgtcgagaaaaatgcctcttatcttatcagttccctatcaatcaagtagtaaatgtacagtttttaattcaaagcatgatactgtaacataatacaaaattgtagacaatagaatatcatcaagatatgtcattactcattaccaggccttcggttagcaggtcacaaatatcttcactgtcccataatctgatatgccattggcactggttaccatgtcgtgatagccacctacagtctcttatacctattgtttctacttttaaactaatctccttggccatcgtttgcaacatgtcatgcatctcgatgcgattatcagaaagagtgatcagacatttgtcaacgagatcctttaccacgccagagacgtccacaccatgactgttgagaaggcttgtcacgtaatccacattctctgatctgaagaaacatgcaatatccagaaaaacattcttctgttcagtggtaagctcctcatagcttgtttctagaacttcgtagatatctccatgtgatctacttttcagtctatccagtttagcttcccagtacagatcatccctctcacaaagatcagatcctaacaccttaagagccaaagggtggcctttagcgtaatcaagaaccatatttgtcaaaccttcgaactctttcaaagggaaagagttactaaaagcattcaagctaaagagcttcaaggcttctctatcattcaatttcgggagcacgtattttcggcctttgatcgtctcaatcagtttactatctctagtagtaatgataattctacttcctccttgataccatttgcaatgccccataagatatctgatttgcttttcatcattcacatcatcaagcacaataagtagcctcttgctcttaagccgccgctcaaatctctcatgtgcatttccaggagctccaatctccaaatctctatcattaagtacagtggaaaagagtttctgcagcaaagattctaacccgcttctacctgaattttcgcggatattagtaaggaagcagctaccgtcgaactgaccacgcatacgtccatacaaacaatcagcaagagtcgttttcccaatcccaaccattccaacaatgcctatgatatgaacggtatccaaatcctcccatgataacaacttttcaagattcttcagacgcgattctatccccacgagaccttcgttcccgcttggagccaaatcattcaacttcttgaatgtgtcaacggctatttcatcaacaagtttggcctcagacgtgctaacaaaatgacaaaaaagctggatttagcataaactttaatagcatctctaagaagataaatgtagaactttgacacaaagacttggtaagtttttttgtgtgacattgatgacatcgatctagattttgcaaagttacctaatttccttgactacataacctaggatgttggatgctgaggcaagagcagccttccacgatgaaatttcttccggcgtaactccgggaaaagtcaattctggtaacttgaacggcaccgcaaaactattcctctgtttctcgacgtccgatttgtcaactttgtagaagattggtaccactagctgttggttgctgttcctacattcgaggatcttcactaactctcgaagacaccacgcagaatttgcatagttcgtggagaagacgatgattgcaatcttggatttctcgattctatcgaaaagcgcagtgagattgtctcctcgacggagtctgtcgtcgatgaatgagtcgattcctcttagacgaagtgctttttggagatgaccggtgaagttgttgcgtgtgtcaaagcctctgaaactgagaaacacatcgaactctgctgaagatggagaagatgattccatgggagaaaagctctgatccaatttgtccagttttaaagtcaacgatgagctgagaaaaacaaggcttgtggtttggtttctctcataattgcgagaccggacaaaaacaatttatccaatataaaatacttaattagtggcacgaaaaaaaaaacacgaaaagtcaacaaatcgatatgtgagcaaagtaaatttgtgtttttgattattggggttttaaaagttttcttcctcattcttcgtttgttaattttaaggatcgatg

SEQ ID NO: 18918 - DNA, 3003 bp, Unknown; identical to SEQ ID NO: 18917
  misc_feature (1)..( 3003): 2750-1469P.txt file - cDNA_ID_1819889; gDNA_ID_2926154; Annot_ID_139430

SEQ ID NO: 18919 - DNA, 3000 bp, Unknown
  misc_feature (1)..( 3000): 2750-1469P.txt file - cDNA_ID_1819897; gDNA_ID_1620632; Annot_ID_47272
caaagactaggacgttcactagaaatcccattgcctccgcactggtgtgatattaactttgttggacttgcgttatctgtagttgtctcattcaaggactatgaagacagtgcgaaacgtttctcggtaaagtgttgtggcaacttcgagaacaaagacagttccttcacgagatttgatttcactctcgcaggctggaacgaaccatgtggatcccttagccatgaatcaagaaagctcacttctgaccacgttttcatgggatacaacagttgttttctcgtcaaaaatgtccatggagagagtaacagctgttgctacacaaaggcttcgttcgaattctatgtgacagatgatgaaacaaggaagaagatagaaacttgtgaagtgataaaatgtgggatgagtttaatgtatgttcctgaagatgatgattgtatgttgctaaagaagacaaatatagttcagctgagtttgaagagcggaccaagttgttcctacgatcttgatgatgttatggatgacgttagacccaagagaggactttgccagtttgttggtggtgaagaaccaggttgtaagagaaggaaggaggagaagatcacagtgagatagaatcttaagttatgtcaaaaattttgttttattaaatgtcagtacacatcaccattaacagaaaaagagagaatgtgcaatactgatttaaactatggacagctactaaaataatcaggtaatcattatgtgcatccatatattcaagaaccgtatatctattaaagatcaacaatgacaacaagaaaacaaagatgatcttagaactttaaacttgtgaatgaatatcttggctttcattatgcagctagaaagaaccgaactttggagctataagctaatttcgaaatgtcgattccacatatggagctagaactacacacatacatagaagttaagagagcacttaccacggttgtcaaatcactcagagtgcattgtatggttgcataaacctcacatgtaaatctcaaacggcataatgtcacctgaaacttcataccaaaccaattttcaaagattaaacatatactggagaaaatgatgtaacatgtcaaagcacagtcaatttctaaacaaacactttaatctcaggagaaagaagaaaaacagattgcttggatcaaccaacctcgtggattctgaaactttgtgaatcttgtttcacgtttttttccatcaaatttataattttgataaatttggaatccaaatttcagagtatggccgaagagaagatggccggagaggtttcaagagatatccattaaaatccaagagcggtgaaagtgagaataggcgtttttgtgacgagtcgagaagaagaaaattcgatctcggaacagtagaaaagtagctcgcgggaaagatatcggaaatgttgccgtttcggtggtggaaggcattgcggcgatggcgtcgtcagattgtggtgacaaagacaaatcgaaattgaggaaattgggaaattgcgaaaaccgggtccacggagaatacggaatgtcgaccacagtggattattggtcggtgaaattaaacacgtataataaaattaaaataaaagctcaaaaagtgggaaacccgcgacaagctaacctccttatttgtggccacgtgtatggccaccatctcacttcgttgatgaatgtctagtaatgcctagtaagaaaccaacatatattattcaatttaaaaatatatgtatttaatattttacattaactataatatttaaatagtaattcagattaatattaatattaataaaataaataaattcttatcgagacaaatttaacggaacgaattttaaaaataatattaataaaaaaattaaaatatcattaatatattgttttaatatagtttaagttttaaatttattattttttgatactatcaatattatacatataaatcagtctgatttacaaaaattatataaaataaaatatatatagtaatataatgtttttagtaacaattaaattataaaatataaatatctcagaaaatgatataatttaaaaacttatatataataaataatttttaattttaatatttttattaaatattacatgagatgagttaagagattacaagacggtttatattgtggaacggattatagtagatgagtttgaatcaatatttataaatttttaaaatatcagtaatatgctggtttaatacgaattaaatcctcaagttttaattattgttcttaaattcgtggtatatgttacttaataacaatcgtaaacaaaacaaaaaaaatattatataaagataaataatttaaaattttatattttatatatatatatatatattagaaaaaaaaattatcatgcggtatattacggatttaaaatctggttttataatatacacctcccaatcaaaacaaattttacaactacaccaaaatatttgtccctaattattttgagaccttaaaatcttacaatgtaaaatttggtaggggccttaaattattattttttttctttctaacaatatccacacgcttttatgccgacatggtccaggtgttttcaaactacatattttattatttttcgtcaaccgtgaaataactattttatatttcctagaatttttggtaaactgaataaaaaatataaaaaaatgcaagtaacgacggaagaaatcataaagtaataagaaaataatttaaaagaatgggtacatgcgtcaagccatgacattaacaaacaaaccgaaaaaagaaaaaaactcatctttctccaaaatcacacaaatcttctttatttgttattctcaatccttccttcatccccaggtttctttcgattcgttgagtcattcaatttttccatcactgggtttttctctctgaatccgatcggagaatccagtcgattactaatctagcgctctctttttttctactcgatg

SEQ ID NO: 18920 - DNA, 3000 bp, Unknown; identical to SEQ ID NO: 18919
  misc_feature (1)..( 3000): 2750-1469P.txt file - cDNA_ID_1819897; gDNA_ID_1620632; Annot_ID_162720

SEQ ID NO: 18921 - DNA, 3000 bp, Unknown; identical to SEQ ID NO: 18919
  misc_feature (1)..( 3000): 2750-1469P.txt file - cDNA_ID_1819897; gDNA_ID_2926154; Annot_ID_139428

SEQ ID NO: 18922 - DNA, 3000 bp, Unknown; identical to SEQ ID NO: 18919
  misc_feature (1)..( 3000): 2750-1469P.txt file - cDNA_ID_1819897; gDNA_ID_2926154; Annot_ID_198266

SEQ ID NO: 18923 - DNA, 3000 bp, Unknown; identical to SEQ ID NO: 3219
  misc_feature (1)..( 3000): 2750-1469P.txt file - cDNA_ID_1819901; gDNA_ID_1620632; Annot_ID_47271

SEQ ID NO: 18924 - DNA, 3000 bp, Unknown; identical to SEQ ID NO: 3219
  misc_feature (1)..( 3000): 2750-1469P.txt file - cDNA_ID_1819901; gDNA_ID_2926154; Annot_ID_139427

SEQ ID NO: 18925 - DNA, 3000 bp, Unknown; identical to SEQ ID NO: 3218
  misc_feature (1)..( 3000): 2750-1469P.txt file - cDNA_ID_1819913; gDNA_ID_1620632; Annot_ID_47268

SEQ ID NO: 18926 - DNA, 3000 bp, Unknown; identical to SEQ ID NO: 3218
  misc_feature (1)..( 3000): 2750-1469P.txt file - cDNA_ID_1819913; gDNA_ID_2926154; Annot_ID_139424

SEQ ID NO: 18927 - DNA, 3003 bp, Unknown
  misc_feature (1)..( 3003): 2750-1469P.txt file - cDNA_ID_1819936; gDNA_ID_2926148; Annot_ID_139163
atttctggaccaatcggatatccacgggtttactaaaactctacccaataaggaaatttcctaaaattttaacccgccctaacccggttttttggttcgggtattgggttggttatcgggtccgtattttgtcagccctatcaaagataatctaatatatgctccaattaggtccacaaatataaccaaaatactatacaaagactaattctaagttaggccaaaaattagatccactaatacaaaggaaacatgtttcttaccaaaacaacttgtatacaaattttacacatttacttaaaactatatatgttatatttattataaaaataacatttttaaacaaagtcaatccaatgcagcattatatgctaatagtaaaaacattgaaaaatattatgacatcgcttttatactatactatttcttatgtaattgaaacaaagtatacaatttaatttatacaaaatattaatgctcgtgctgtatagcacgggttatgatctagtaacacttcatttccaaaggacaaatcataccattatatccaccttaggatcatggactcatggtgccagatattttgcatcattgccaagcagaatgaaagattttcctccacaagagatttgagtttataaatatttggtgagatttaacaaaaaaaaaaaatatatatatatatatatatatatatatatatatatatatttggtgagataagtcttaacttgctacattcaaagaaactaattaaaccaaaaaccaaacactaaaagaatagtaaatcgtcaatttcatattagatgagctaataaagcatcacagcaataaattttgtctatctccatcacttacaccctttttttgtagataatgtaatttcttcctcaagatctgaagaatcataaatcacatagtttagtcaatgttacaatacacacgactaaaagaaaaattacaaaattttattgatagaatttaaaatataccactagacactagacttttgtcttttcattagtcattaccgcttgatatttttactatcttacgcatgttatgaaagattataaagcttaggttttgggtagcaaaaaagggttaggaaaaagaaaaccatactatttgttatccgaaaatgtcaaactaattcctctaactgtggtaaaaggttataaaatcaaatcctctagattgatgtaagtgatttttaaatcgttattcggtcagatcacaagttaatgatgaacttttcagggttcaatacatggcgattttagccatggatccccaacgggatcatgggattacggtccaactgaccggtttggaccgggtcttaatatattgaacaaaatacaagaaatctctcattcacacgaatgattacatttcagaaaaagaaagaaaaaataactcaaaaaacttcacaccaatttgcatcacactatattacccattatttttctacaattatgtggtccacttttcaaatagttcactctcatcataaaccggccggggtccttcaaagctcatgcagttgtgcgttgtaaagatatattgtattccaacaactaattcttgccaaaacacttttggctaatgtcattttcattgaaaacaaagcattataaataggaatgatttgtcatttctggaatggaagaacttgggttttagttaacatttgtgcctaaccaacctctcgtttatgtactaaagcattgtccttgtgattgtgaataaccaatcgctcatttctgtgttagaacagtattgtttattttctgttatttgaatcatttccaatgagaaatgagttacataacacctttatttataaacacaaagatgcacacaaggagaagcaaaatcaataagaagaaaccactccacgtggcccgtcgtcagagttacataattggtgaacgactaaactcagaagaaacaacatgtaataagaaacacagaagcagaagcaaaagccaagcaacatttattttgtcgacaaaaaagccaagaaacattcaatgttgattttgtctaagtaaccaggtgtacatacattacccttaaccatacccaaaatcgtatgtactacgatatgtgtacgtaacagtatctatctacatttatattttataagacattattaaatgggaaacttatagtggctagtggctgctacttggctagcaattaacatcaataatttaataactcaaatgtgaaacatctcattcttctcctttattacaccaaaccatttctcattctttacttaccggtcaggtcaacaattctaccattccccatctttggttaagtttatcttttcattttaaagaaaatatatatgaatgttcatccaataattccaacttcttaaaattgttaatgaacattttaatcaatatataattttaatatcaattttataaataatagaaatgtgaaaaacgcaatttctttgctccttgtagcagtaacacaagtcaaagcaacatttgttttcatttgtttgtcagttagctattttatctacaataatatgttatgctttctgaacaataaataaatatagcattattagatatattcattctgtattttgatttgtccaattagtatatgacacgtctacaagatacatagatctttcattatttcactttctcatccaacgtctggtgaaccaaccattcaaaaatcaaaagtcaacttttaatgcacttgagttttggtcatgcattcatatacatacatatatacatagaagtcattacatgcattatactttacttatgtcaacatgttgcaaaagcactaagatgatatacgtatacatgcatattgcaaaaatcagtggtcccataccattttaagtcatcatgagcgtatgagagtaaattcttctcacatattaataacaacccttcaaagttataagatttttagagagagagctaccacgttttcgtatctccgggaacgatg

SEQ ID NO: 18928 - DNA, 3003 bp, Unknown; identical to SEQ ID NO: 18927
  misc_feature (1)..( 3003): 2750-1469P.txt file - cDNA_ID_1819936; gDNA_ID_1620633; Annot_ID_47305

SEQ ID NO: 18929 - DNA, 3003 bp, Unknown
  misc_feature (1)..( 3003): 2750-1469P.txt file - cDNA_ID_1819956; gDNA_ID_2926147; Annot_ID_197824
aaatattttaaaacataaaatgtcttgttaagtaactcatttacgtcaacgtgaaaatatatctatgtatatcagtttgattacctggtagcctgagtgtgagcagtagaaggggcaagaagcttggtaagaacctctgtacttatcagcaaattcaaatagctaccacaaaatagataatttatacgttaccttatgattgaactgatgtaatgatatttatagacttaattaattaatatgaatttacactcacggatttagcattgtttagtaatttggatgaatatgtagaatcaaccagtttgaaaacaagtgaggccgcggcaagagcggctgcggcttcacctgcggcttcggaaccgggggaagaggaagagatactatagagagttctaggtgtgtccatatcttctggtctctcccaacaactatgatctgaatttccatctcctacctatttacatccattaccaaaacagaaccaaaaataattaattgaatttcgatagtgaatttgttgaatattgtagaagtatatagtatataagatacgagatatatactatttgggacatttaacatgaaatgaaatatttgaataattctctatactagtatacctcaaaacaaaccaaaatgtgacagttcggcttggtttagacgtgtaaaccgaggggaaaagttagtttacctgtgtatatagcatgttggtcgacgtatgagcacggaggataaaattagttccccatttgatagtagaccggagataaccaagctggttaacgaaagtaatctcattctggtattcaagtgcagcccaactcaacaaggttgtggtaaatgacattggccacacaaattttacattgtcaccagcatcgtaatatcctccaatcaaattcacctgagaaatcaaacacccgaaaatttggttaagtctataagagataacataatgccaaaacttatgaaataaggttccatttcggaagacatatatgcatagatatagagatgtttatgaatatagtcggtttacattagctgatgcaccgtcagacaggccagaatcagctcgccatttaaccctttgattagtcgggagtttaccagatctttggccttcaaagaacaaaattgatttgttcagtgcatctccatagtcaagagcttccaagctttcgaaagccaagaacatcccaattaacattacaaccaagagtttgcccattttttattactagactgtttttagaaatgtttctctttcgaaatgggtttttaagtgttgcttgattttgcatgaaatgtgttttagagggtatttatagataccccatgcaagtaaagttgggtacgtaaattcattgcatgagatgtttcacgtaattttagggtaactttggatgtactgttattatgttctctaacaaaaattaagtttagatgataacggaattacaataaaatatttttgatatagcaagttgtagttattcacatcgtatctttttttttctaaccaccatactttatttttttctcttccatctctgaacgtttataaatcgttacttaatgaaggagttgtaatatattccattataaaggctgttttggctcatttacagcaaaacaaaacaaatattgaatcacactacttaatttttgtaaatggttatttattgttatcgttgttttttttaaaactaataaacaatatgtaaaacctatatcaatttaaatcggcttcttaagaaacaaatactttacgtcatgtaatttccataaatttggaaggtctgacgcaaatatattgctgtagtaatgtaaaaatacttcgtaattaacgatccaaagttgtgtatagttatgcatctgaaaacttgactttaaaatatatgaaaatatgagaagattttttttattactttttttttgtagaatgtaaaatttattgataaaagaagatagtgttactatgaatgcgacatgaaatatgaatgtttgaaagtttcgaaaaatttaaagtgttacactaaggagagattattgagtgcgagtttgaaaccagaaacgtaggccaccgtaccatcatagtcagaggaacccgtcatttgcgcttagtctatttcggacatatcaatgaattttatgagcatgtatgggggcaggagttggtgcctttccatgacgccgttcattgcgctctcacaataagctatgaattgtgagttgaaaatcataccgcaacacaaggacatcagcaacaaaataaccaacaactactcccatgtcaatacttcctcgtgagcctaagagtgcatatagattccccagagggcacaaggagacatgccaaaaataagtttcccttctagactttacctccattttgtgcagtggtcgagctaagtctcagtattttaagatttgtttccacatcaaggaaccagagtaagtgttaccacaaactgacaagagagaaccgttccgaagcaggtttttgtgtctccataaaacccataatgagtcattttccgagaccggtctccatattagcttcaagatacttatagtatttgtttcagatagcaaatgtaattccaaacctgcctcttggtttggtttacaaatgtcactccaagcaatctttgctttttctggttaagatccggacaaggccaaagaaaagcagacgtgagaatctcaaattcttttcacggtaatagtttggccaaaactgaaatatgaaaaacaaaaaggatttatttgcaaattctcaacaaaaagccacgtcatcaaatccttttcacggtgagtctctcttctacgtggcacaacccttaccgggaacctctctattctctcaatcgacaaacttgacttaaggattccaaacgtcgtcgcatgacttgtaactctgcaccattgctaatctaacatctcattctccaaaaactcaggaactcgaactatcttccacaactcacgaaaatg

SEQ ID NO: 18930 - DNA, 3003 bp, Unknown; identical to SEQ ID NO: 18929
  misc_feature (1)..( 3003): 2750-1469P.txt file - cDNA_ID_1819956; gDNA_ID_2926147; Annot_ID_139156

SEQ ID NO: 18931 - DNA, 3003 bp, Unknown; identical to SEQ ID NO: 18929
  misc_feature (1)..( 3003): 2750-1469P.txt file - cDNA_ID_1819956; gDNA_ID_1620633; Annot_ID_47298

SEQ ID NO: 18932 - DNA, 3003 bp, Unknown; identical to SEQ ID NO: 18929
  misc_feature (1)..( 3003): 2750-1469P.txt file - cDNA_ID_1819956; gDNA_ID_1620633; Annot_ID_162765

SEQ ID NO: 18933 - DNA, 3003 bp, Unknown
  misc_feature (1)..( 3003): 2750-1469P.txt file - cDNA_ID_1819964; gDNA_ID_2926147; Annot_ID_139154
tcgtgtattgattatgtgattatgtgaagtctttaattggtgaattttagatatgtgcataagaagtttagtatgcagtataaagcaacgattggtgctgattttgtaaccaaggagcttcagattggggaaaagcttgttactttacaggtttggggcctttttcttttggttttgaaattacttttcttcgagatttgtgtgttttactttttttttttttttttttgtggtttttagatttgggatactgctggacaagagagattccagagtcttggtgctgctttttatagaggagctgattgttgtgctttggtttatgatgttaatgtgttgaggtcttttgataatctcgaaacttggcatgaggagtttcttaaacaggttcgtatgacaatttccttctttctgtcacactttgttttggtatgatccatttgttatatgttttgctttgtgtgttatgttataggcatggaacataggaatgtggtagtttttgttttaataggaattgttagcttttgagtatttagagtcacaatcttcagatttttggttaacatttcgtttaaacaaaacccagagtcaaactctcttttttgatgatgttgtgggaagagtttttgattatcgtcgtatgtcttttggttctcaggactatagctgaagttttgttttcccgtgagtaacaagatgattgagcaatggaacatgttttttatgtttgaatgatcatttgcgtttttttacctagcggtttactggttaagccaagtatattactaacttgctttcgtgttcataacagttttagaattcatgactctataaaccctgttctctaatcagtgtgttttcctgcactcacactttcaatccttttaacaatgtataacatgctaacttgtattgactcccttttccatggcatcgttttgggactgtccaggcaagtccatcagatccaaagacatttccgtttatagtgcttggaaacaagattgacgtagatggagggagcagtagagtggtaagaggaagatcaagatatgtcttccatcgtgctttaactcttttactcagtcttgtttaattcctctctaactacaggtctctgataagaaagcagctgactggtgtgcttcaaatggtaacataccctatttcgagacatcagcaaaagatgacttcaatgtcgatgaggcattcttaaccattgccaaaaccgcccttgctaacgaacatgaacaggatatgtaagttttctttttggtttagctctactaaatgagagctcgaaagtgtctaattgttaaaccggagagtctgaatattgtagaatctcaatctaaatctgaatatgacgtttaaatgtagaaggcagatagtgtagcttaaagacagtgacattcttacatgtctatctgcgatttgtctacttctgaattccaaactcttgtgtgatccgaattggaaactaagaatgcattaaaaataaccgctgaatacttatacagtatgtacctcatacacaatggcttgggttaattgcagatacttccaaggcataccagatgcagtgactgaaaacgagccaaaaggcggtggttgcgcttgctgaaccacagatttgaggattcaatgacattcgtttttttgatgcattcatttgaaggttggtgtactcttgagttgcagaacgataagcttgtagaagcaattttttgtcattccatcatatattaattgattggagaagtctgtgtatgatcaatcgattctgctggatacaaattttatttttgtaagaagaaccattattgctcttaatccctatggcgatataaagttgcatgctacactatttcagtttggtttgactcaactgtcggatatgttactacatctatagttagaccatatgttcattttgcatgtatagtttttttcatagaaatattgtaaaactttgaagtcaaactttaacctagatcatgtgatattttaaaaaactttgtgaatgtaatacactcgaatagctattcaggtgacaaaacctaaacagagattgtcttaaacaattcagagaggatatagcatggtcgtctattttctttagttctcaggctgtattattacccggacgtgatctgattctagctgctacagtgtactatctccaacctggaggctacatccctgcagaagaaggtggtggactcagtgaatctgcaattatactttcaatgcaatcattacagctttgaagaactaagagagatatcattgtccttgcttttcttttgctatagcctaagtggttattgcctattggtcatgttggtgggtattgtactattgggtattgtactattgttcactcaagtatatgtatatgaccataaaaaaaaaaaaatggttattgcctattggtcagttttttcttttaagtttgacccaaatctttccataaattgtgataaaacttaattcataaaatatataaaatatattttatatgtcttttaaatagaagtattattagttaatcatgcagtgtatcattcatccagtgtattatatgttttttaaataaaagtattattaaaaaaaatgtcattttacgagacatggttatatggtaggacgggtttcgatcgatattaatacacaacgatatactagagataaaattgttgaattaacaatcgaaatacaattatacgatcttaaatactaaacaaaaaattaaaatttaaaaattagtttaaaaaatcgaccggtatatccaaattcaaacataagttttaccttaatgggccaacatatgggccttaaaaggctttggatctgttactattacactccacttgcaaaaacctatcttcttcttcttcttcgctgaacaacaaacaacgcttcacaaaaccttccgataaacctcacaaccctcttcctcctcacactacagtaagaaaaacacgcgcgaaagctatg

SEQ ID NO: 18934 - DNA, 3003 bp, Unknown; identical to SEQ ID NO: 18933
  misc_feature (1)..( 3003): 2750-1469P.txt file - cDNA_ID_1819964; gDNA_ID_1620633; Annot_ID_47296

SEQ ID NO: 18935 - DNA, 3003 bp, Unknown
  misc_feature (1)..( 3003): 2750-1469P.txt file - cDNA_ID_1819979; gDNA_ID_2926147; Annot_ID_139149
ctcttttatcctttttaattttctatttaatttttgctaccaaacaatctattaaaatcaaccaatcatatgcattctctttcttatatcattaatcacttaaacctacaaaaaacgctggacaactgaaaccaataggtacaactatgttgatggacttctacgaaaaacatataattacatatcgttttctttttctctttcattttcaagttataataaaaaagacttcagtcatacgtgttgcttataatggatactattaattttcttgtcgtatttatacaaattaatatgttttgtattggtacaactaagtacaacccgcacaactaaggtctattcacttggctagttttcagaatattataaaatatgaaaatttaaaaccaaactaagaaaacttaaataatgcatacacaattgtaatgaaattacataattagtttttgacaaaaatcatattttctaaattaatgaaactcttatcacaaaatctaacattcatacattaacaaccttatactttcatggttactttgtatattttaacaaaacaaattaaaaaatttaaatacttgtaattagataaatataaatacactgatacaaagtaatggtattttgatgggggaataccatatgttccatccataaaatttaattttgagttgataacaactagatttattatattctcgatattgtacaactatgacaaaaaatgtgcaaccgaatacaactgtacaactatgggcaatatatttttcagatatttatagatattttttagatatttgtagatattttataataaaaattagctttattcttttgtgataaaaatatttatttattttttgtcatcaaaaatatttaattttatagttaaataaactattttgttccctttcaaactttttttttccttttcaaaacactgttgtttaataaaataaaatactaacattcataattttttgtgttttgttttggatcaaaatacgttgatgtgttgattcatatttattttggagttttttttgacaaaaaatcttagattcatacataaacccagatacatagttgtacatgagcgtaccagttgtacctaaacgcttagatctattatcttagaaaccgaaagacagccgaacaattgtatctaaaccaaaaacccaacataattatatctaaaaatttagccacaattatacctaaaaccaaaaacacaatactatctaaagactcaaacacgaagtcttattgttctcgttgtcattctccttctcaatttctttctccttagctttctccttcttcccttttcttctagtttttatcattcaaaagcaatctcataatattttgttttaatgcatttcacaaactatctctaaggaacaaaattcaaattcattcgaatcccaattgtaatcctaaaaactaagtcataacagctattacaagaggcttttaagggacaatttcgattttaaatcgataattaactcaaatttgaatctatatatacatttttgcagcaattttgtgaaataaatgttatagttggaacttatttacaatggctgccactggattttaatgtttgtttttgataattagaaaaaaaatcttcaaattaaatatttgacttttaacaatcttccctaaatctctccacattaactacacgattagttactgaaataaaacttccaaaatatttaatatcatttatttactacaaaattatcattttttatattgtttttctccatgactataacaatttaattataatcgtcaaaccgcagagatatttgatagcatttaattattacaaaattacaaaatatttagacaataattcataaacatatcataaataagattaacattaataaaataaatgttttttttatgggacgggttggcgggacgggtttggcaggacgttacttaataacaattgtaaactataaaataaaaatatttatagatagatacaatttgcaaacttttatgtatactaactttaaaaaataaattgtttccgcggtgtaccgcggattaaaatctagttgtactcataaaaatccaaattataatcgaaattttatccaaaatccatcatttttaaacaaaatcaaagagaaaaagagatcaaactatcaaatctaataagaaataaaaccctaattaaacacaacaccatcaatcatcatatatggaatagagatggatctttggattgatagaaacaaatgaaaaggtaaaaaagatggatctttggattgatagaaagaatgaaaaggcaaaaagaagacgaaagattatacatggaatagagagaagagagtaaagagaagaagaagaagaaacaaatcaaaagttttgtttttgttgaattgagagaaaaataaattgaagatgaaaaaaatttgatatgagaaattagatttttttttgttgagaataaaagatccaaaattgttatggatctagatccaacatagaggttgggttgtaaataagtaaaaaactctagttttacttgtcttttactattattctgaattaaaataaataaataaacatatgttttttataaaggggctaactagagaatctttgaagctaagggggtggactagataaaaatccaaaatgaagcaaatgacctaactgctgtttgcaacatcatttggttcatttgctgttagctaaccttagtttttgataaccatagtccataggctaaatatcacagaatggtaaagtgtaagccatttcgtcaacgctacacctaaacggcatgaagttggagcttctaattaagaagaacccggtcgggtcaaaattcgggtcactcttctcgggttccccctctaattcaccctctttttttcattcactccacaattacaattacagtcgatggacgacagagccaccgaaccatcacggcgagtctaaaaatactcagagctcctataaatg

SEQ ID NO: 18936 - DNA, 3003 bp, Unknown; identical to SEQ ID NO: 18935
  misc_feature (1)..( 3003): 2750-1469P.txt file - cDNA_ID_1819979; gDNA_ID_1620633; Annot_ID_47291

SEQ ID NO: 18937 - DNA, 3003 bp, Unknown
  misc_feature (1)..( 3003): 2750-1469P.txt file - cDNA_ID_1820001; gDNA_ID_1620634; Annot_ID_47323
gcctaaattttggaaaatatgcatgacagacattcgaaacttcagatccaaatcaaaccgaaattgaaatttgtcaaatatctaaaccgaattgaacacgagcggtttttgagaatatgaaattgggcagagcaattcaaactcaaaaattcaacaattccagaagaactttctcagaaaagtttcgacggaagaaaaagcaaaacgatgaacgtcactcttttggtcgcagacgccgtttggtcgaacattgaatcaaccggttcaggtacttcaccattttactacttctctctttccttttccttgtttacgacattttattccgttgaattttccatctttttctgcagtaaccgaagaacagctctcaatgtcagttctctcttatacatagctgggattctttatttttcccgaaaatatttattgatttttcttcagtcgtttggtatgattagggtttatcgatttaattttgcaaatacagcttgcagctgttgtttggtaagaatcttgagaaagccaccagaataatcgacaagagaggcgtcaagaaaatatctggcttacccagtggaagatccatctttcaggtttcaacagttctctctggttaataaaagcaatcatatttgattatctaagaagatttgtttttttgtttgggttttcaggttgtgggggaatctcagaagagagaagagtatctctgcttcccaggagattactgtggatgttattctttcttctatgatgttgtaagcagaggagagcaccaatgtgtaagattcttaatcagaatgcttccttttctgtttagagattttgtatcaatgttactgacttgttatattctacttttctcttttggctagtgtaaacatcaattggctgcgaggttggcttcttctttgggtacatacaacgaaatcgaggtttctgatgaccatcttgccttgatgctctcaaagatctgaagctttcaatacaactacatgtcttaggcttataagtgccagtaacctgggaatgatctgtgtctttgagaattatatggatcaagattcttcacatgtttgatgaacaatgttgcttcaccttttatgtttaacttgctgtatataagtcttgaactgctatattttcaacttcttaattcagtggaagaaaactatgaactttgtaaaagtagtattcatgcataaaacttttagtgactcgtatacaaagattaattaatcaaaaaagcgtagaatggaaacaaactcaatgatcaaagaaaggaacaagtggatttagagttagtgtgaagaagggcggggaatggggtggacagagaatttcatgttgtggttgcattcgttgtggtctccactggcgaagtagtaagtctgaaccttacggagaagcaacttgaagcctcttgatgatgaacctcctcgtgcaaccagcttcttgcctctggccacattgcatctcttgaagctcttcatgtctgggagcaagtagacgtcgttcttcttcttgttacggtgcttcgtcttggattgggtttgatcatcgttgttgtacttgaaaacaagaacatcgctgacgtagaatggggcatgctttgctgtccattctgtgtaaccgtatccgtttttccatacagtaaccgcaatctttcttccagccggtattggagccgtgtggttgtgtgtagagccagtgatgctggagtggtttgagccagagctgtgattgttgtgtgtagaaccaacgatgcttgagtgatttgagccagagctgtgattcttgtgtgtagaaccaagtatgcttgagtggtttgagccagagctgtgattgttatgtgtagagccagtgctgcttgagtggtttgagccagtgctgcttgagtggtttgagccagagctgtaaccgttgtgtctagagccattgccgcttgaatggttcgagccagtagaggtgtgaccgttgtgtgtagagccagtggcacttgaatgattcgagccagagctgtgaccgttgtgtgtagaaccagtgccgcttgaatggtttgagccagagctgcttccccaaccccagtttgtatctgttccgtcggagctccatccccaaccccagcttgaaccacccgagttggagtctgaaccacctgaacccgagccagaagaaccgccagagttgccggatctccatccccaacccccgttcgaaccggactggccagaaccccaactccagctccatgcttcagcactcccggagaacacgaacgcagtaaccatgaggacgacgagtaacttacgtccacaataaagaaccatcatcgtgtcttcttcttcgttttttttctctctcttttttttttatggcttttgtgagctcttcagagtttagagtttcggtatttatagagtaatgagagtcggttcccattatttagtgaatataattttatttgtttttttagtaacagtaataggatttttttctttttcttggatcaaatagtaataggattttaaaagtggataaatctagctttagttattattgtttgaattttgatgagtcttttttttttttttttttgcatatacgattaacattgcttaaggatattgtatatatctttaacacacaaaaaaaaagatatagtatacatagttttgtttgatattctttttattttcgcacaaaaaaaaaaaaaaaatcttatttatactataatgaatctaaacatctgtccacctttaatccaagtacctctcccaactactgcgactaaatgacccatttgcctaaatgtagtcctttaccttactgaaaatagcgaggacaaatcagtcattcaccgccctaaaacacgctttgacatgtatttatccatttactgttattttatctgtaagaaatccaaataaactcatttctgtaaattaggaaacttctgagaaagtgacgaaagcgaagaaggtttcggaagtaaatatg

SEQ ID NO: 18938 - DNA, 3003 bp, Unknown; identical to SEQ ID NO: 18937
  misc_feature (1)..( 3003): 2750-1469P.txt file - cDNA_ID_1820001; gDNA_ID_2926206; Annot_ID_141743

SEQ ID NO: 18939 - DNA, 3000 bp, Unknown
  misc_feature (1)..( 3000): 2750-1469P.txt file - cDNA_ID_1820009; gDNA_ID_1620634; Annot_ID_47320
ctaacaagaacatgactacaaaatcaattcaagaggcaatttacaaacctgaacatgttcacaaagaccaaaacttcatagcaaaattcgaatcttttaatattgaaatgatcagggtaatagagatctcataagttttgaccatcaaaaacgtagtcaaagagtcaaaagaagaaagaatcctaaaacaagtttagggaaggaagagtgggattataacttactgtgcatataaggaaagagatgtctgttaacgaatctagaagcttcaggtccaccatgaccatcgtatacaccgacgtaagtagcagaagaagatgtgaaaacctgactctgatcttcaagcctggaattggcttgaaccaccgcgatcgaataatcaccgccagcgtgaggtctcaattccgattgccagagtaaaccatcaccactagctctgcttcccaaacaccgttcgagaggccgtgctaaagctcgcaacatcacaacctacttagggtttttctatacagagagattctgagtgcagtagagttagagagaaagagataacaagattttcgattcgattggatgagagaaatcgaaaggtttttttttattgaattttgattcgttcgtttttgtttgatctgatcggttttaagggattcgtgtgtgtgttgagttggtggtggtaaaagaaaaccgcgtgaggaagaagaagaagaatattgatagagatgacttgtacttgtgccgtttcttagaaggctacgtagactacgcgtcgttttgttttaatttcgccctcccccttctctttttttttgcagtttttttcaacgcgttgtttatttttgttattcttctccatttagctttatttttctcaataaatagacaaagttttggcccaaacataaacgtcattgccgtatattatactaaaatatctttcttctggaacaattcaaaaacttaaattctgattcggtccaacaaaaaaatatctaaattcaacagctacttttatttctttttgaaataggagatattatattaatgtagtgtataatatatatatttatttatatgtgatttacagagtcaatgtttgaatattatttagaaatagtagacccttttgaaatataaattcatgtctacgatgagtaaagaatcaattaaattgttcatgtctacaaaaatgtttacatcgtctgcaaatagcaataaattaattctattttgtgtcttatatattttgtatttgaatatatcagtgggaaattgttataatgagcgaataatgaatgggtaaggatgagtaacctgtagccaacgtgtagctgatatatttgcttgtcaactaagaaagacggataacaactgaatacaatttcttgctaataatctagtcatcttagtatctatattattattaacctaattttattatcacgttaccgtttccggtataagaaaaaaaacatgttctggtcaaaacaaatctttgtgtgctgtgttctagagcatactattaaaacgatgaatattattgcttatggagtaatttatatttaattacaagtggcacatttttatttggttgttataaaaaggtttgcattttgggattaagaaattgacgtggaaggacttatatatatacgcggaagcaactggaaattcattggcccaagttgtcgaacttttttgatcatgatgtttacctttacatttataacattatggatgcgtatttatcgttgttatggatcatagggtgattttcaacatatatagatccattcattttattttttttaacatttgcatatccactcatattataccgatgcatacaagattcatcaaacaaaaaaaaacttaattagtactactattatttctgtcaatgctcactaagaatctctctagtatcacatctctcttcagtgaacaatgctctgtgaaccccaagaaccaaacattaaatgagtcaccttctttcttaaacaacagttctatagcccacaaagagagctccttgaaccttcttctcgacacaaaggctacttgaatcttcttcttgcttattcttttctaaactcaaatctctatatgaaaatcatttgtagaatggttacacattttatttggttatcaaaaagaagttgcaagaatatagactattagttaagaaaataaactcatttgaaatttcgttggataatgtattgatctcggcttaagactctctaatttgactgtatataattaataaataatcattctttactttttaaccataaacacaattcaatgttggactacatatccaccttacattctaagatcgattccaagtcattatcgacagcctgaatgaagcaaaacaactcaaaagaagcccacctaattcaaatcacaaaaacgttcaagttccatcgaaccaaaacttaaaccactctacgcaaccaaacttcaaccaaaaaaaaggataaattcggcgcatttttttgtatttgttgaccagtgaagaaaatgacaaactggtcaacgagatctgatcattaaactataaaacaatatattttaaagtaaatagaaatttgtggtgcttcattggatcgacgaaaggcgtcccgatattgaggttcgttacgccggcgaagattttcatcggaaacttatctgatcgtttacgccggcgaagatttccatcggaaacttaatctgatcggaaggaagaaggctcgatgaagagcagattgaagagctacaggaggaagaagctagggttagccacagttatcgtcttctgttctctctgtttcctcttcggtttctatggctccactctactttctcaggtgtggaaactctctgatcttttactctgtactctttagatgtgattggagtctttagcttggttttgtgactaatcgagggttctatgtttgggatcagaatgtgcctcgtgttaaacccaggttgagaatgttggatatg

SEQ ID NO: 18940 - DNA, 3000 bp, Unknown; identical to SEQ ID NO: 18939
  misc_feature (1)..( 3000): 2750-1469P.txt file - cDNA_ID_1820009; gDNA_ID_2926206; Annot_ID_141740

SEQ ID NO: 18941 - DNA, 3000 bp, Unknown; identical to SEQ ID NO: 3245
  misc_feature (1)..( 3000): 2750-1469P.txt file - cDNA_ID_1820013; gDNA_ID_1620634; Annot_ID_47319

SEQ ID NO: 18942 - DNA, 3000 bp, Unknown; identical to SEQ ID NO: 3245
  misc_feature (1)..( 3000): 2750-1469P.txt file - cDNA_ID_1820013; gDNA_ID_2926206; Annot_ID_141739

SEQ ID NO: 18943 - DNA, 3003 bp, Unknown
  misc_feature (1)..( 3003): 2750-1469P.txt file - cDNA_ID_1820048; gDNA_ID_1620635; Annot_ID_47357
ctatacatattacgtctaaaatgttgatggaccgatcctagtagtcttttttattagaaaaatataaaagttaacagtgagattatatttgaacataaataatcttaaatacagtaaaaggaagaaaatagataaagaaatgggatgaccaaccaacaaaagccatcacctatcatataaaaagataatacattttctactactttagcttcaaggatcttaataacacttcgttaccacttgatcaagagaaacaaaaagaaaagctgttcataaaaactctctatcaatggctgctccaatcgccataggaacacgaggaaccatcggatcgcttgtacgtaaagaaatcgactacttcaaaaacttctctacatgtcatccccaattcgatccacggagaggcaattcggaagaaaacaaaaatacatttaaacaaagagatcggtcatcatcacggttgggttcttggttctctaaaactaaatggagaaagaagaagcggcagactcgtggtggcggtggcaagttttttccgagtatgtgctcggcggtggaggtttccggcgagaatcgagttccgggtttcaactataggatcttgaagagtgatcatcagaagggcttgcgtgtgtagaaaggagtcatcatttatgtggattacggtaaagacaatgagatctacatacagtttttcaaatttaaaataatgtctcattgtgttacatacttacaagttacaatgtcaatgagcatatattcgaacttttaaaatgaaaaaagaaaaaaaagtttatgctcaaggaattcctttttcgtttgatccggtctggtctatattcaaatttggattcggttctattcccggtttaaacgtggtatatcgtcgaatacctttatattccacatatatatggatcctacgtagcacaagtcaaaagtcaatcttcaaatgctcgagtactttattttcaggcctcaactttgttgatgctaaaacaaaattgtgcttgtatatattttttactctgaaactggtcttgttggaacagtgaacatggatttgaaggtgacgttatacaaaacttggacaagagctcacatcttgaattccaaaaaagagacgatgttatcatatttgtcacaggtgactaagattttgctcttggctctgtacgtagtagccacctgattaattcatcaactagagtttgagagcacacaactccaatatggaccactaatgaaaagttccttagctcttgaattctggttataaaagatcttgttgaattttgtgggtttctcagttggttaatgacttcaacacgcttatggagctcgatacaaggagagaagaaccattgcttcgattccgagatcatagtgttggatacttaataatcttcacacagtcatgtacaacacatagaatccagagatcaataagagaatggagcgaacgtattttgatggctgttgagttcaactacagcaaactcttgctgtctctatacaacaagaacccgtagtttgcgctgcggtggtctacaaaattatgtcatggcttggccgttttcggaatgctaaagatttgtctagttctgacgaaatttgaggtggaaagtgatgatgaagccacatggacggtcaaaatcgaaatgattgaaatttttgtttataatacacgttctacgtttctttcattagattctttgatgaattcatcagtttttgttcgtttcattcttttgttccttttgtcgtaattttaaacggaataatactatgattttatgaaccttatataacaactaaaagtgtccgaacaagcccttattgacgcacacacgtttttatgtctacaaaattccggatatatcaagcaagtatcatcaacacgtctccaacactcatacacggtcaagccgcctacctaactcaccttgttacaaaacaatatcttatggcatgtgttacacgatttcaaatatgtatatgaataatttataattcttaaatcttcatattactgaaattaactcgttttaacagattgaatgaaaatatatattatccttcatttgtattcgttttttttttggtcacaatgacaataattctactataagaatatcgaaatatatatggagaattccttaaagattagatagacctaccaattaaaagctgctggtaccactaagttttagttcgaacatttgtattaaacccaactctactcttttcgcattttccatctagaataacatctaaaatatgtctataatatatttttatggaaatagataaataattcataattattatatggtgacaaatcaaattaaaagacgttttgaaacttcttttttgactaaacgagctcacagttctctttctcatcacatctctatcattagaaaaaaatattgttaataatgtacatgtttttttttctttttttggggtcaaatttggattcactcaaaatagttaaaacatagaatcccatgtatcaaaaaagaaaaaaataacacctaaccctataaataaaagattttatacaataaagatcttatgtttttttatcagagaaaaacatgtcttgtttttataattctgacttcttagtaacaaatcatgcatatatgaaattcaacaaatttgaacccaaaaatagagaggtgaaatattaaatgaccaaaacaaatgataaaataattcagaggacgtgtgagggaacaagccagaagctacactatcgaaaagatcgcatcaatctcaaccgttggatctttccttcatcatcatctctctctctctctttctcttccatctgacctgtgatgtgagtttgcagatattcaaacaactcaatcctcattccctttgtttcgcctctctggatttcgaagagctgagagattagggtttctcgattttcgagattagagtctaatccccaccaccagcatagctgatatcctggaggagagaatg

SEQ ID NO: 18944 - DNA, 3003 bp, Unknown; identical to SEQ ID NO: 18943
  misc_feature (1)..( 3003): 2750-1469P.txt file - cDNA_ID_1820048; gDNA_ID_2926178; Annot_ID_140452

SEQ ID NO: 18945 - DNA, 3000 bp, Unknown; identical to SEQ ID NO: 3257
  misc_feature (1)..( 3000): 2750-1469P.txt file - cDNA_ID_1820069; gDNA_ID_1620635; Annot_ID_47349

SEQ ID NO: 18946 - DNA, 3000 bp, Unknown; identical to SEQ ID NO: 3257
  misc_feature (1)..( 3000): 2750-1469P.txt file - cDNA_ID_1820069; gDNA_ID_1620635; Annot_ID_162865

SEQ ID NO: 18947 - DNA, 3000 bp, Unknown; identical to SEQ ID NO: 3257
  misc_feature (1)..( 3000): 2750-1469P.txt file - cDNA_ID_1820069; gDNA_ID_2926178; Annot_ID_140444

SEQ ID NO: 18948 - DNA, 3000 bp, Unknown; identical to SEQ ID NO: 3256
  misc_feature (1)..( 3000): 2750-1469P.txt file - cDNA_ID_1820081; gDNA_ID_1620635; Annot_ID_47346

SEQ ID NO: 18949 - DNA, 3000 bp, Unknown; identical to SEQ ID NO: 3256
  misc_feature (1)..( 3000): 2750-1469P.txt file - cDNA_ID_1820081; gDNA_ID_2926178; Annot_ID_140441

SEQ ID NO: 18950 - DNA, 3003 bp, Unknown
  misc_feature (1)..( 3003): 2750-1469P.txt file - cDNA_ID_1820085; gDNA_ID_1620635; Annot_ID_47345
tacagtttcagaaagggaatatcccaaactgattcattaaacagtttactccaaaacctaagcaccacagatttcatatatagacagaaaaaaaaaattaagagtcctctccggttacacctacaagtccaggctccatggttatcacagatgttctcctgcaagaagcatatataggtataaggaaacttaattgacatggttatcacagacgtttctatccctcttgatataattcccctatgtaccagtaccacacccacaaatcacagaaacatatagttaactacagtacattactagaattatcacaaacctgcaaatattttctcttctgcgaccaatgtcttggaacaggaactgtattccggtacgacttcaaaaacactaacagctttggatctgctgaagtcgcgtcccagacctgaaaattgtaaaacagaacttatgaatatacaatagatatctacacaacgagataaaccttggtactatgaacacaatagagaagcatccatacctcaacaacatcaggcctagcggaaacctgcttcagctcagcaatcttcattctccgttgaagctgaggaaacagaaattcagaatattcagaatctaaagaatgcaataaaacaaattgagaggtaataataaggtttgagctatacctttttcttcttattagagatgcctttctctttgttctgattatcctgctcgtcgtcgtctgaatcagaatcagagttaaccttctttttgacatcttctttctcctcagactcatctttcgtaccgtcttcttcagaggcaagaggttcgcggaagttgaacttctcgaagatttccttaaactcatcgttaaaaccatcttcaaattcagcttgctctggaacatactctatcacaatctgctcacaaacctatcaaagagaaacatataccaaaaatcatcagcaaacgataaacaatcacaaaccctaagaaaaaccctagaacacctctccatgaatcgagtacgagaagatgagcacaaagttaacctgtggctggggatctgtattctctttggattcagaagcagcagaaacgtccgatgcatctacatcggcttgggatgctttgttgttcttcttctgcttccgtctgcggcggcgacggtcaatctcacgagatttcttagaggaagcggaggtgtttccgttggagacatcaccgttagaaacgacgctatgaacgagtgcgacggttgaatcggcggtcatattcggtgttctctctgaatcggtgatgtgaaaagagagattgagaggagaaggaagaacgacggaaatcgaggatatacgtatatgaacaagagtcggtttgctgaaattctctctgattctatttccggtttggcataaggcccatataagtagaagacgaatatatctgccaataggcccaacactttatatttttcttcgagtgtaagaattgttttgtagaagaccatctactagtaactaatagaaaatttcaaaggaaatgtatggaacaatattcaaacactactataaatgttggcacgagttaactctacattattcgtaaaaatgttctattgaacttttaaaattataaaattacagtttacacaatgtcttgaaattttgaagaaagttataagtatcaaaattgtatatatgtgggtatttgagatttaaataaaattctctgactaacaacaaaacttttaataaaatttaaatgttttagtttattattcgtaaaaatttagtttttacatgaattgaggtaatttttattcactttgagattttattaatgtgagcacgactcccggtgtatgttatcggttgtttattatgcaattagaacaatatacattgtgcctttttagtttcaaaattgttttcataagacattaggaaagaacacggaaaaaaaagacattaggaaagaattttgtaacggcttttgtacgtaacggttatttttaaacaaggaaaaaaatactgtctataaaaaaaaattatctttacgtagttgtgtattttagaaaacaaaataaatcattttttatttactaaactattattttataaggaaaagattgaaaagagtaggggaaagatatatgtgaaaaaatattcatgcttggtagataaaaaatatttcacaaataaagagacaagtatatgtcaaaaatatcatgtcttttgaataaataatcttctaaaaaaaaagaattagatgaactataaatatcttgtggtatatgaatccttgacactgtaaaaatcaaaacatgagatcagaaacacaagtataaaagtacattacaagtacggtatgaatcgaaaaaaaaacagaatttgacaggttttgagctgataaaaactatttcaggcttttattaatttttaaaaatagtattaattgtttttaaaataagacataaataaaaaaaagaacggttaaagaaaatgaaggggcccttcgtgttttgttttcccttaaaaaaaccaaggacaaaggcataatgccgtattcacaatcttgactcttcgttatctggatctagggtttctctcgatttttagaacgccacaaaacctaataaacttttcccagatacacaaacaaactcatcatcaaccaaggaagaagaaagaaactagggtttttttttgtggattcatcatcggtattttacagatctatattcaaagggaacaaaatcttaaggaacaaacactaaattttcattctttctcttatttacccatttatcaaaaatcttccttttgttttcctgattcttgctaaagaaaaaaactcggatccaattcataaactagtgtggactggtgatcaatctatcaattctggccaagggacaacaaaaagtttagattttgatgaaccaattttgagatgagacaatagacatccattgatctgtaaactttaagaaggagaaggagaaaagaaagtatg

SEQ ID NO: 18951 - DNA, 3003 bp, Unknown; identical to SEQ ID NO: 18950
  misc_feature (1)..( 3003): 2750-1469P.txt file - cDNA_ID_1820085; gDNA_ID_2926178; Annot_ID_140440

SEQ ID NO: 18952 - DNA, 3000 bp, Unknown; identical to SEQ ID NO: 3254
  misc_feature (1)..( 3000): 2750-1469P.txt file - cDNA_ID_1820089; gDNA_ID_1620635; Annot_ID_47344

SEQ ID NO: 18953 - DNA, 3000 bp, Unknown; identical to SEQ ID NO: 3254
  misc_feature (1)..( 3000): 2750-1469P.txt file - cDNA_ID_1820089; gDNA_ID_2926178; Annot_ID_140439

SEQ ID NO: 18954 - DNA, 3000 bp, Unknown
  misc_feature (1)..( 3000): 2750-1469P.txt file - cDNA_ID_1820097; gDNA_ID_1620635; Annot_ID_47342
acggtacacatacagccacaatagctggtggctcatttgtccccaacgtgagctactttggtttagcccaaggtactgatatatatatatatatatatattatttcaccacagaagttagcttaagagtcaaggtactagttttataagacaatagtttgtttcctttttaaccgatgtgtgattcttatcaggtcttgtccgaggtggtgctcctcgagcccgaatagcctcgtacaaggcgtgttggaacgtaatgagagatgaaggaggaggaactgatggaagatgcacatctgctgatatgtggaaggcttttgatgatgctatacatgatggggttgatgttttgtcggtttctatcgggggaggtattcccgaggattcggaagtcgataagctcgattatatcgcggcttttcacgcggtggctaaagggattacggttgtggctgctgcgggtaacgaagggcctggtgctcacactgttgacaatgttgctccttggcttttgactgttgctgcaactactcttgaccggtcttttcctacaaagatcacacttgggaataatcaaaccctcttcgtacgttttactagttagagaaaacagttcaaagtttggagttcttttttgagtaacttgttgttcttttgttcgttcgtttttaggctgaatctctgttcactggaccggagatttcaaccggtttagctttcttggactcagacagtgatgacactgttgatgtgaaggggaaaacagttcttgttttcgatagtgcaactccaattgcagggaaaggtgtagcagcagtgatcctagcccaaaagcctgatgatcttctttctcgatgcaatggtgtaccatgcatttttccagattacgagtttggaactgagattttaaaatacatacgtaccaccaggtctctatcttgaaacaaaaacactctcttaactacacaagtgcatgtatatatatacatcattgatcgtcgtgccaacagatctcccacggtgagaattactgcagctactacactaactggtcagcctgcaacaactaaggttgctgcattctcatgtagagggcctaattcggtttcaccagccattctcaaggttattaagccattgcgtctcttatcaatgtttacttcaaaaggtttaacgtttctgagtaaactttgctaaatatgtggtcatgttttactctgtagcctgatatagcagctccgggtgtgagcatactcgcggcaataagtccgcttaatccagaagaacagaacggatttggacttctttcagggacatcaatgtcaactcctgttgtttctggaataatagctctcctaaaatctcttcaccctaagtggtctcctgctgcagtgagatcagctttggtcacaacaggttcctgcttcttcttattcttcttttccataaacaaaccgttacagactatcatctgtttcttttgtagcttggaggacaagtccatctggagaaccaatctttgctgaaggatcaaacaagaagcttgcagatccatttgactatggaggaggacttgtaaaccctgaaaaagctgctaaaccaggacttgtctacgatatggggattgtggattacatcaagtatatgtgttctgcgggttacaacgactcttcaatctctcgtgtgctcggtaaaaagactaattgcccaattcctaagccatcaatgcttgatatcaacttaccttcaatcacaattccaaatcttgagaaagaagtcacactcacaagaactgtaaccaatgttggacccatcaagtcagtctatagagctgtgatcgagtctcctctcggtataactctcaccgtgaacccaaccacactcgtgtttaagtctgcagctaagagagtactcactttctcggttaaggctaaaacaagtcacaaagtcaacactggctacttctttggaagcttaacatggagtgatggtgttcatgatgttataatccctgtctctgttaagacaacgatttcgatgtaataaaaagagccatatgatgctcattgtgtttgttcttatgtaatttgttgcaaatctaagtctaaaatgtcaaatcaagattcaagatcatcataataaaagatcaaatcacaaataccttagaatctcttataaaagatcatgatcataacctatagctgtaacattacatacaaatatataatcatcatattgactatatattataaagatgtgatattttagtgtacacataaatgcaaaaaatggaactggtttgctctcctgtgatcctatatatattaaagttcagaatataatctgttttactaaaatgagtaattcagacaatcatgatctaccaacttatacagatacctaatctactctattagttagaaatgattgatatcctcttatactcagctgaaattaaagtaggtacactattagtatatctataataagaaagacatcaataataagaaagacgacaattgtaagagttaaaactgagccctcttgagatccatggcgggaaataacgttacacaagagataaaaccggtatgattcagaattaccataccgatattgagccgaataaaccaataattgaattcgaatcttacgcaatagttcactccctaaagacacactatgtatataataaagcttctcttcgacagaatcacacacacttctcactgcataaaatggagaactctttcctaagttccaaacttgtgtttctattggcaattgctttggtcctatttctgaacacagagctgagttttcttacagctgaaggagcctcagatagtaacagcaaggtatgtaaatgtaactaaattaaaacggtgttctattttgcgaaaaatcgctaagaatttactgatatttctaactttttcggtggttttttggcggatttataaggtttatatagtgtatcttggccaaagggaacacgatg

SEQ ID NO: 18955 - DNA, 3000 bp, Unknown; identical to SEQ ID NO: 18954
  misc_feature (1)..( 3000): 2750-1469P.txt file - cDNA_ID_1820097; gDNA_ID_2926178; Annot_ID_140437

SEQ ID NO: 18956 - DNA, 3000 bp, Unknown; identical to SEQ ID NO: 3251
  misc_feature (1)..( 3000): 2750-1469P.txt file - cDNA_ID_1820101; gDNA_ID_1620635; Annot_ID_47341

SEQ ID NO: 18957 - DNA, 3000 bp, Unknown; identical to SEQ ID NO: 3251
  misc_feature (1)..( 3000): 2750-1469P.txt file - cDNA_ID_1820101; gDNA_ID_1620635; Annot_ID_162854

SEQ ID NO: 18958 - DNA, 3000 bp, Unknown; identical to SEQ ID NO: 3251
  misc_feature (1)..( 3000): 2750-1469P.txt file - cDNA_ID_1820101; gDNA_ID_2926178; Annot_ID_140436

SEQ ID NO: 18959 - DNA, 3000 bp, Unknown; identical to SEQ ID NO: 3251
  misc_feature (1)..( 3000): 2750-1469P.txt file - cDNA_ID_1820101; gDNA_ID_2926178; Annot_ID_200008

SEQ ID NO: 18960 - DNA, 3003 bp, Unknown
  misc_feature (1)..( 3003): 2750-1469P.txt file - cDNA_ID_1820105; gDNA_ID_1620636; Annot_ID_47387
aggaaacacgaagacttacgagtgctggacacgagatcgaacttctctggagcagaattctccggtggagaagaagaggaagctgaagactttgaaggtgaaatggaattagccaactgtagctgagaggacaatcggaactcaggaacggaatatctgattccaccgggaaatctccatgaacggtgaagagaacaagggaagatgagaaaaggaggagcttgaagagaaagaatcaaatgatcggccataacttaaacattgaagtctgtaacaaagagtgtcacagaaatggtttagagtagacgaagaagatgataattgggtgacgttacaaccggtggtaaccctctgtttctatcagatgtgttcgcttcacagatattttgtggctaccgtttttttttcataattgggctataaaaatcatatctttttgactcttctcttctctatccattctctgccgaactagtcgtcaatcgaaatcccaaagatcagcgatggtgactctaaacgcttcttctcctctcacgaccaagtcgttcctcccctaccgtcacgctcctcgccgtccaatctctttctcccctgtcttcgccgttcattcgactgaccccaagaaatctacccaatcagcctccgcttcggttaaatggagtctagagagttggaagtcgaagaaagctttgcaattgccggattatcctgatcagaaggatgttgattcggttctacagacgctttcttcttttcctcctatagttttcgctggtgaggctaggaaactagaggataagcttggtcaagcggctatgggtcaagcctttatgcttcaaggtggtgattgtgctgagagtttcaaggaatttaacgctaataacattagagacacctttagggttcttcttcagatgggtgttgttctcatgttcggtggccagttaccagttatcaaggtcgattctttacctggagatttttctgtgtgatgaatctctagttagggatagtttatgattttgtgggttttaagttttcaggtgggaagaatggctggtcagtttgcgaagccgagatcagacccatttgaggagaaagatggtgtgaagctgccgagttacagaggagataacataaatggtgatgcttttgatgagaaatcgaggattcctgatcctcataggatggttagagcgtacacacagtctgtggctacgttgaatctcttgagagcatttgctactggaggttatgcagctatgcagagagttagccagtggaaccttgatttcacgcaacatagtgaacagggtgacaggtttataaacttctctccttgtttataatcttgtttgttatgatgttaaccaattgagaatacacttttcttaagtcagaaacggtttcttatttcttgatgttgttgtgacaaaacaggtaccgtgaattggctaatagagttgatgaggctttgggattcatgggtgcagctggacttactagtgctcacccgatcatgactactactgagttttggacatcccatgagtgtttgttattgccttatgagcaagcactcacaagagaggattcaacatctggactttactatgattgctctgcgcacatgctttgggttggagaacgaactcgccaacttgatggtgctcatgttgagtttctgaggggaatcgctaaccccctcggaatcaaggtatgtgatcatcaagtctcttggtttggttaattggaataggagtaagtttcatagctttgttcgtatagaaaaaaacactgagatgtagactcaagaactgttgttaactctataggataccctgcaggtctcaattgcctggtattaaagatattggaaaaccattacaaagaggctacaacagatttttgtatgagaaaatgacagatgttgattgatgtactttgatgcaggtgagtgataaaatggtccctagtgaactggttaagctgatagagatactaaaccctcagaacaagcctggaaggattacggttatagtgagaatgggagctgagaatatgcgggtcaagcttcctaatttgatcagagcagtccgtggagccggtcagattgtgacttgggttagtgatccaatgcacggaaacacaatcatggctcctggtgggctaaaaactcgttctttcgatgcaatcagggtaatcattcgaacttacttcttcatccaactctatgcataatcttgcttatgattcatgtagttacccattaaattatatggtgtatcaggcggaattgagagcgttcttcgacgtccatgatcaagaagggagtttccctggcggggttcatttagaaatgactggtcaaaacgtgacagaatgtgtcggagggtcacgcaccatcacttacaacgatctaagctcacgctaccacactcactgtgacccaagactcaacgcatctcagtctctggagcttgcattcatcattgcagagcgtctgcgaaagagaaggcttggttccgggaatcttccgtcatctattggagtctagagaacaagaaaatacttatccgagctaggatgtgtgtgtatagaggctgatctctacttattaagttgccaagttaaatgagcttgtgtactgttaaaagtaagatattgttgtttttgtgtgttgggttatgattttgtctgaaataagtggctgactttataaacccgtaaatctctacgtcacgcttgcaacaaaaattcgatatttgattcaatcacagaaaagtcctcccattaaggtgtaaatttttgactcaaataccacaaagcataaaccttttgacaaaccaaaagttgtatgaagaaaattggaaaactctgaatgccatttccacacgtggacactattcgtttagagaacacttaaacaaacgcaggaggcctggaaaaaagaaagataacgggactcgagagattgagattacggagccacccactttcatg

SEQ ID NO: 18961 - DNA, 3 bp, Unknown
  misc_feature (1)..( 3): 2750-1469P.txt file - cDNA_ID_1820105; gDNA_ID_1620704; Annot_ID_165178
gct

SEQ ID NO: 18962 - DNA, 3003 bp, Unknown; identical to SEQ ID NO: 18960
  misc_feature (1)..( 3003): 2750-1469P.txt file - cDNA_ID_1820105; gDNA_ID_1620636; Annot_ID_162921

SEQ ID NO: 18963 - DNA, 3003 bp, Unknown; identical to SEQ ID NO: 18960
  misc_feature (1)..( 3003): 2750-1469P.txt file - cDNA_ID_1820105; gDNA_ID_2926204; Annot_ID_141660

SEQ ID NO: 18964 - DNA, 3003 bp, Unknown; identical to SEQ ID NO: 18960
  misc_feature (1)..( 3003): 2750-1469P.txt file - cDNA_ID_1820105; gDNA_ID_2926204; Annot_ID_202071

SEQ ID NO: 18965 - DNA, 3000 bp, Unknown; identical to SEQ ID NO: 3299
  misc_feature (1)..( 3000): 2750-1469P.txt file - cDNA_ID_1820109; gDNA_ID_1620636; Annot_ID_47385

SEQ ID NO: 18966 - DNA, 3000 bp, Unknown; identical to SEQ ID NO: 3299
  misc_feature (1)..( 3000): 2750-1469P.txt file - cDNA_ID_1820109; gDNA_ID_2926204; Annot_ID_141658

SEQ ID NO: 18967 - DNA, 3000 bp, Unknown; identical to SEQ ID NO: 3297
  misc_feature (1)..( 3000): 2750-1469P.txt file - cDNA_ID_1820119; gDNA_ID_1620636; Annot_ID_47382

SEQ ID NO: 18968 - DNA, 3000 bp, Unknown; identical to SEQ ID NO: 3297
  misc_feature (1)..( 3000): 2750-1469P.txt file - cDNA_ID_1820119; gDNA_ID_2926204; Annot_ID_141655

SEQ ID NO: 18969 - DNA, 3003 bp, Unknown
  misc_feature (1)..( 3003): 2750-1469P.txt file - cDNA_ID_1820131; gDNA_ID_1620636; Annot_ID_47379
tcacctgaattcggaactttgtgttgttccagtaaaattaagcgaacacaaggatagagttctgattccttttacgaaagctcataattaaaatagaccatattatacaacatcctagtctccaagagaacaccttttcatctagtaaaataacgtagcatctatttggcgacactactttctgactcctacaaatgtaacacgttgcacgaatagcttttacaggaagacaaacacgatcaaggaaactaaagacaataattaggctgcttattaaaaacgtattaaaagaagagagtagaatatggtgcatacaagaaacggagtttcttaagtcggccgagagttgatggaataggcccgcttaaattgttcaagtaaagatccaagctcaccaattccgtcagatttccaagctgttctgggattgtcccagtaatgttattgctataaagctccctgtcattaccattctttaatattaatttcaccataagatcggaaagatatataactaataatctatgataatgcaaaattatgcagttatttggaacattgtaacatttttaacatcccacatacaccaaaagttaaaagacggccttttaaagaaaagatgacttacaagtactgcaagtttggaagctgaccaagttgcattacgagctgtccagatagatttgcattcccaaggtcactgagcaaaaatgaagttcaagtaaattctcagtagatgcgaaaatccgaatcatcttggctagatatagaaagaaacttacacacgtgtaacactattgtcgctattgcaagtaacatgaaaccatgtacatggagtaacaagagtagcatcccaactttgaagcaccttattagggtcggctaaactgtttttcagtgcacttagagcatcacctacaattaaccaaagaagaagaaaaaatcaaactttgcaatcatcaagtgtcacgaggatacataatcactggaatcagtcgaaacagatgtaacccaaatataactcaagtcaatacagcaaaacaagtaacagataagttaaaaatgccttctttaggtgagaacaagctctcataagcctatactaatcaaaatactcaacaagggaaactaatttaattggaaagaatgaaaaattgaaagagaatgagagagaaaggggaaaccttcggcgttgcccgagactctgagaaccaaatccaaaacgagaatcaaccaaaagaagcaagggatcattaatcttcgttccattttatcctcaagagattaaaaacaaaccctagaactatccctcatcagagaaaatccatcattgttaaaacccctgataaaagggatctcgaatccttcgattaagctaccacccacacaaggtaataccaagatgatgaaattagaagcagaatacgagaaaagccctctcaacgcgtatccacccgttgacttaatttgaagagaaaatcaaaatacccaaatcgattaatcgcggaaaccaaaaaagcaaaaaaaaaagaaactgaagctagacttttccgattagaaggaacgccgagatcgctgaccgttgactacttaatgctgagaagagagaaaactgagatagagaaaacgaaaggaggaagaagatatttcctggaaatatactaaaaaagggtcgaaacaaagagagatgagagagaggagagaaaccaagttatcgccgagagcaaggaaggaagacgaattttaattattttctttgcttaaagaagggattttactgggttgagttgttgtactgtgaaaactatattaaaaaaatgacatttaagattgagaaaacgacaaagaggatgatgacgtggacgagcattttcaaagcttttttagagctagtcaaagtcaaagacgcacgacttcattccgaatcatgtttgttatgttcgcccaccttatcatcatccatcatatgacattagatataaaccatgatggtcatgaactcatgatagttgatagtgagttatataccatcatcataatcctaattaccggcccagctctattttttcgggcttttattgtttattgggcttggtcttaatagcaagttcgtttattccaaagatgagcaaaagcttttttgatttttttattcttttttaaagattatagctctaaaaaattacaattcaatattgaaaaatgtaagctgaataatccatctggtccaatgaattaaacaaaacaaaaaacattattgtatcatatataatttactggttgatagtttaactatttatgccatttaatatttttaaaagaacaaaagtaattttgaggaaaaatgaaataaaaaacaaaaaacacaaacggacagagtatatgttgccagcaataaaatacggacatataccttagtttggcattaaaaaacaaaacaaaaacacaacaaacaactcagtacagtaggctatttaaaggcccatcagattaagacttggaagtctgacgagattgtaacgcctcacaatccttcctacccgtgagtccgtgaccgattgtgtatcatccatcttctttcttcttctttcttcttctttcttcttcttttatatataaaccaaaatataattcgtgaagactttcactttctccttgccactttttgacgattcacatgcaccatccaatattttagtgcccttttcacgacatatctgtgtctgtatccaattttcttatttactactacttttttctatttatatatacaaaaataatcaaagagagagacgaattttcgaggtaaggtatctatcgactttctatcttcctccacctttgtttgttgtcaccaccacactacgctaatcattgccacacacatgcataattctctccaaccatctaaaagtcccactttagcattcttctgtttgtaattttatctcagagcttgcttcatgggcttttgagttttctctctgtttccaaaaaacaatg

SEQ ID NO: 18970 - DNA, 3003 bp, Unknown; identical to SEQ ID NO: 18969
  misc_feature (1)..( 3003): 2750-1469P.txt file - cDNA_ID_1820131; gDNA_ID_2926204; Annot_ID_141652

SEQ ID NO: 18971 - DNA, 3000 bp, Unknown; identical to SEQ ID NO: 3291
  misc_feature (1)..( 3000): 2750-1469P.txt file - cDNA_ID_1820135; gDNA_ID_1620636; Annot_ID_47378

SEQ ID NO: 18972 - DNA, 3000 bp, Unknown; identical to SEQ ID NO: 3291
  misc_feature (1)..( 3000): 2750-1469P.txt file - cDNA_ID_1820135; gDNA_ID_2926204; Annot_ID_141651

SEQ ID NO: 18973 - DNA, 3000 bp, Unknown; identical to SEQ ID NO: 3278
  misc_feature (1)..( 3000): 2750-1469P.txt file - cDNA_ID_1820139; gDNA_ID_1620636; Annot_ID_47375

SEQ ID NO: 18974 - DNA, 3000 bp, Unknown; identical to SEQ ID NO: 3278
  misc_feature (1)..( 3000): 2750-1469P.txt file - cDNA_ID_1820139; gDNA_ID_1620636; Annot_ID_162907

SEQ ID NO: 18975 - DNA, 3000 bp, Unknown; identical to SEQ ID NO: 3278
  misc_feature (1)..( 3000): 2750-1469P.txt file - cDNA_ID_1820139; gDNA_ID_2926204; Annot_ID_141648

SEQ ID NO: 18976 - DNA, 3000 bp, Unknown; identical to SEQ ID NO: 3278
  misc_feature (1)..( 3000): 2750-1469P.txt file - cDNA_ID_1820139; gDNA_ID_2926204; Annot_ID_202057

SEQ ID NO: 18977 - DNA, 3003 bp, Unknown
  misc_feature (1)..( 3003): 2750-1469P.txt file - cDNA_ID_1820143; gDNA_ID_1620636; Annot_ID_47374
cgtatctgaagcagctctgttggttttttgttattcagttgttaagtacacagctgatgagattaggaaaatggaggaatctattcggattcgaagatcgaaggaacctactctgattcttcaattggttagtggctttttaaaatggaactcgaagatgcacattggctcttctcacaatgtttgatttccttgttaggtgaagaagctcaagcatgaggtttccactgcagaatctagtactgaactatctcctaatgttaaacacaaactagttgatgagatcctccagcgtttgaaaagctttgaggacaaatctaatgttactcagcttagaggtttgtgctactctactatgcccattagcttcatgacatttatttttcaaactgccacaaacttgcatttcatgacttttcctgatctagctgcttaggatttgtcttattacctctttggaatgtcatggtgatttgtcttattacctaacctgtgtaagattttgttggtatcaatagctcagtttagtaaatatttcattatcattcatgtagaagtggatttttgctcaataatgcatatggttatcaggatagtaaaataggctcacaaatttcagacctttctgcatgcactatcacatactagacagaacaattgattttagcgggattttcaatggagattttttcatgcctagtttttctattcttcttgtataagttcatcaggtctatggaacataagctctaacacccacttaagttctgttataatctatgcattgatgatcatatgctatgtacatgaaacatttgagccacagaaactctagcggtggtgccattgtatacataatcttttcgatgttctttagattctcagtagcttacctaacatgttcgtatgtctcaacatgcttctctaattcctttctactgcatcagaaaaagtatgctcaagaattccaaaaagtcatgatatttacctttttgacttgttaaaagtagatttttcattctattcacttcacttgaacaactcttaacatttattatgtgctgactaggctaatgcgcaatgtgcgttaattcttagttatttacaagagttattggaaaaaggtggaaggtaggaatgggttaatttatttggttagagagaggtgacaaaattctaataatccagactttgaagacactggatttctttttgatgcttcaaactgagttctattgttttcccttgtagtattcgtaatgcacgtagacttgttaatgttttcgcctacaatagttttccttttgacacattcatgttatctctgtagtgacctttaataccttcttatcttcatttggcaaacagaagttgtagaaacgtggcgcaatgagaagctggaggaagctaaagagctaattcaagggcaaaatggagtaaattccacccttatagtggaggaagcaggtattactcctttagaaagattactgagtttctcaccttgagcaaagattcatttatggagtcctcccgatactctatccttgttttgtataattagagagaaaactaatttttgttctgtaattatctagggatgcttgtaagagctttggagttggagtgggatgtgctgtctgaagaaatcggtttctggttacctgctgaggttaccaatgtagaacatgatgataaacctgaaggagaggaagagcctggtaatgttttcaaaattttctacattcttgatctctgcttttgcatttatttgggtggaaaagtgtggtgacactggcgaattcaaatctcatgaagttgtgcattttttccgtagaggaaatattggcaggcagaccagtgccagctgtatgtaatgcagagcttcacacagattatggtggtgctgcagtgagatgggggcttacacatcataaagagagtgcagctgattgttgccaggcttgcttagaccaggcaaagcgtgcgaaacctggagaaacgagatgcaatatttgggtttattgcccatctgagtttggttgtttctctccagatatttatgagcataaacatcaggagtgttggcttaaatacgtaagaacttacctcgtacacatactactttacccaattttcagtttccttgagattactcgtccaagttggactggaagcttggctcatatccaatatgtctatgtgaattgcaggcagagaagccaaaacagaatttcaaagacagatattctgagacatacagaaacaaccacccaaaagcgccatctatcgttccatgggtttcaggtgttgtaacggcttgagcaaaacccatgtggacagattgatgggagaaataggagatagttttggtttttttttctcagctgtgttaccattttcagagtcttgaaaattggagtaccgtaccaaagatgcaaacatcttttggccagatgtatacgagggaatagaatgttttgttgtttttgttgattggctttaaacacttgtggtcgaagtcgaatatggtgtaaggaatcatgtttttgttcaagcttgttcgattctatagtggatgattaaaaagctatctataaacatgacgaatgtctgtctcctgttatatgatcagatcaaatgtttatgtctggtctgtaattatgtcacaaaacatcacagtaaaactctgaaatgaaataatggttgaaatataggaactaaaaaaaacaaagcagaaattacggagggaaaagagaaaacagaggagtgtgttcatcttttgcttccggggttgtctctattctaaatatagactttccaattgtgtacctctcttttcttgtcttcttaatcagaaaatcaataattctcttctactttcttcatttttccctttctcttgtaagtctctcttttcattgattctttctattggtggcgagcttcgttcaatcgttttagcatttctcttgtaagtttcggccttgctttcctccgatg

SEQ ID NO: 18978 - DNA, 3003 bp, Unknown; identical to SEQ ID NO: 18977
  misc_feature (1)..( 3003): 2750-1469P.txt file - cDNA_ID_1820143; gDNA_ID_1620636; Annot_ID_162906

SEQ ID NO: 18979 - DNA, 3003 bp, Unknown; identical to SEQ ID NO: 18977
  misc_feature (1)..( 3003): 2750-1469P.txt file - cDNA_ID_1820143; gDNA_ID_2926204; Annot_ID_141647

SEQ ID NO: 18980 - DNA, 3003 bp, Unknown; identical to SEQ ID NO: 18977
  misc_feature (1)..( 3003): 2750-1469P.txt file - cDNA_ID_1820143; gDNA_ID_2926204; Annot_ID_202056

SEQ ID NO: 18981 - DNA, 3000 bp, Unknown; identical to SEQ ID NO: 3274
  misc_feature (1)..( 3000): 2750-1469P.txt file - cDNA_ID_1820147; gDNA_ID_1620636; Annot_ID_47372

SEQ ID NO: 18982 - DNA, 3000 bp, Unknown; identical to SEQ ID NO: 3274
  misc_feature (1)..( 3000): 2750-1469P.txt file - cDNA_ID_1820147; gDNA_ID_2926204; Annot_ID_141645

SEQ ID NO: 18983 - DNA, 3000 bp, Unknown; identical to SEQ ID NO: 3273
  misc_feature (1)..( 3000): 2750-1469P.txt file - cDNA_ID_1820169; gDNA_ID_1620636; Annot_ID_47365

SEQ ID NO: 18984 - DNA, 3000 bp, Unknown; identical to SEQ ID NO: 3273
  misc_feature (1)..( 3000): 2750-1469P.txt file - cDNA_ID_1820169; gDNA_ID_2926204; Annot_ID_141638

SEQ ID NO: 18985 - DNA, 3000 bp, Unknown; identical to SEQ ID NO: 3272
  misc_feature (1)..( 3000): 2750-1469P.txt file - cDNA_ID_1820181; gDNA_ID_1620636; Annot_ID_47362

SEQ ID NO: 18986 - DNA, 3000 bp, Unknown; identical to SEQ ID NO: 3272
  misc_feature (1)..( 3000): 2750-1469P.txt file - cDNA_ID_1820181; gDNA_ID_2926204; Annot_ID_141635

SEQ ID NO: 18987 - DNA, 3000 bp, Unknown; identical to SEQ ID NO: 3271
  misc_feature (1)..( 3000): 2750-1469P.txt file - cDNA_ID_1820185; gDNA_ID_1620636; Annot_ID_47361

SEQ ID NO: 18988 - DNA, 3000 bp, Unknown; identical to SEQ ID NO: 3271
  misc_feature (1)..( 3000): 2750-1469P.txt file - cDNA_ID_1820185; gDNA_ID_2926204; Annot_ID_141634

SEQ ID NO: 18989 - DNA, 3000 bp, Unknown; identical to SEQ ID NO: 3311
  misc_feature (1)..( 3000): 2750-1469P.txt file - cDNA_ID_1820193; gDNA_ID_1620637; Annot_ID_47401

SEQ ID NO: 18990 - DNA, 3000 bp, Unknown; identical to SEQ ID NO: 3311
  misc_feature (1)..( 3000): 2750-1469P.txt file - cDNA_ID_1820193; gDNA_ID_2926156; Annot_ID_139550

SEQ ID NO: 18991 - DNA, 3000 bp, Unknown; identical to SEQ ID NO: 3310
  misc_feature (1)..( 3000): 2750-1469P.txt file - cDNA_ID_1820210; gDNA_ID_1620637; Annot_ID_47395

SEQ ID NO: 18992 - DNA, 3000 bp, Unknown; identical to SEQ ID NO: 3310
  misc_feature (1)..( 3000): 2750-1469P.txt file - cDNA_ID_1820210; gDNA_ID_2926156; Annot_ID_139544

SEQ ID NO: 18993 - DNA, 3003 bp, Unknown
  misc_feature (1)..( 3003): 2750-1469P.txt file - cDNA_ID_1820236; gDNA_ID_1971820; Annot_ID_58325
cttcagaagctgtatcttggttgtaatacttcattcggaagtctttcttataatgatggtttgaagggtggtgagctactggattccatcggcaacctcaaatatttgaaggttttgagtcttcgtggttgcaatctctttggaaagattccttcttcactcggaaatctttcttatctcactcatcttgatctttcttttaatgatttcaccggtgtgataccagattcgatgggcaatctcaactatttgagggttttgaatcttggtaaatgcaatttctatggaaaggttccttcttcactcggaaatctttcttatctcgctcaacttgatctttcctataatgatttcacccgtgaaggaccagattcaatggggaaccttaaccgactaaccgatatgcttctcaagttgaactcgctcaccgatatcgaccttggttctaaccagttgaaaggtatgctcccatctaacatgagtagcctctccaaactggagtatttttatattggtggaaattcattttctggatccattccctcttctctcttcatgatcccttcgttggttgaacttgacctgcaaagaaaccacttcagcgctcttgagattgggaatatctcttcacaatctaaacttcaagtattaattcttggaggaaataatttcaatccggacattgttgatttgagtattttctcacctctcttgtcacttggttatttggatgtttcagggattaatttgaagatcagttcaaccgtcagtcttccctcacccatagaatacttggttttatcgtcgtgtaatatttccgagtttcccaaatttctacgtaaccaaaccaagttgtattctttagacatctctgccaatcaaattgaaggccaagtaccggagtggttatggagtctgccagagttgcagtctattaacatctctcataattctttcaatggtttcgaaggaccagcagatgttattcaaggaggtggagaactatatatgcttgacataagttcaaacatattccaggatccatttcctttgttaccagtagactctatgaatttcttgttcagctccaataatcgattttcgggagagattcctaaaacaatatgcgaattggataatcttgtgatgcttgttttgtcaaacaacaacttcagcggttctattcctcggtgttttgagaatttacatctttatgtcttgcatcttcggaataacaacctctctggtatttttccagaggaagctatcagtgatcgcttgcaatcacttgatgttggtcacaatcttttctcaggagaacttcccaaatcattgatcaactgcagtgcactcgagtttctatacgtggaagataaccgaatcagtgacacgtttccatcctggttggaattgttgcccaattttcagattcttgtccttcgttctaacgagttctatgggccaatattttctcctggagattctttgagtttccccaggttgcgaatctttgatatttcggaaaatcgcttcactggagtcttgccatcagattactttgcgccttggagtgcaatgtcgtcagtcgtggatagaataattcagcattttttccagggatactatcataactctgtggttctgacgaacaaaggattaaatatggagctggttgggagtggtttcacaatctacaaaaccattgatgtctccggaaacagactcgaaggagacatccccgagtccatcagtcttctcaaggaactgattgtgctcaacatgtcaaacaacgctttcacaggccatattccaccatctctatcaaacttgagcaatctccaatcattggatctatctcaaaacagattatccggcagtatcccaggagagctcggggaactcacatttctagcgcggatgaacttctcttacaacaggcttgaaggtccaataccacaaaccactcagattcaaacccaggatagttcttctttcacagagaatcctggactctgtggtcttcctctaaaaaaaaactgcggcggaaaagaagaagcaacaaagcaagagcaagatgaggaaaaggaagaagaagaacaagtatttagctggatcgcagctgcaataggctacgtacctggtgttgtgtgtggactcaccatcggccacattctggtttcacacaaacgtgactggttcatgagaattgtttccctctttacttaagtaagcattcaataaactttctcaagacttgtttgaaaatcatattatcaatctacattctacacttatttgaaagataaaatatctccttgtccttttaaattaatgttctaatatcgtcgtaacgaatttggtctgcaacgttttatatgtagaaacaaaaactgtataatagttatagcatgaaactttgattaagaattagtagtggttacagaggattgttgtattacagaggattaattttatgaacaaaacaaaaagaaaccaatacagtagaaccgaaacggtctaaatttaaatgtttgtgtatatgtgtaactctaatgttttgagttgtattataagtgtgttatgcattcgagttagttctattagtttcctataatttcgttacaatactactgtatctctctgtcctcttctcttctttgctttcatttttttttcagattcagttccatcatcacaacaaagaaccctaaatcaatttcacattacgtttcatcaccaagaaaaaaaaacggaaaaaaatcatttattacgtcttctacatttcttgattttgttttggtgtacaaaaatggaagagatgaaaaaggtttgatacgattcgaatattctattgctacttctctagcttccagatattttcttctttttgattttgtttcatttactggtgatttgattttattattgtggacaaggtaacgtataaaaagtgaaatttttgtgggtctttttctttgattcgctaatcttttgagaaacatg

SEQ ID NO: 18994 - DNA, 3003 bp, Unknown; identical to SEQ ID NO: 18993
  misc_feature (1)..( 3003): 2750-1469P.txt file - cDNA_ID_1820236; gDNA_ID_2926158; Annot_ID_139615

SEQ ID NO: 18995 - DNA, 3003 bp, Unknown
  misc_feature (1)..( 3003): 2750-1469P.txt file - cDNA_ID_1820248; gDNA_ID_1971820; Annot_ID_58322
atgacttaataaagacgtttccttatcctttatcaaatctttacatctgtattcaaagttagaatcaacgatctaagaagaagagcttaccatgaacccactagtttctggacggttaaagggaccagaactagatacaatattcacaagaattgcatctacttgactagattaggtgtatcatatcatttgatgctaactcttggggttataggctaacctttaagcttcctccttcacgttatgagccactgacagcatcaggaaggtccttaagaacctaagcaaatgtaataatgttctccattagcttcttactcaccgaagataacctccaggttttcgacaagtaacagtattataattagaacgatgtgagatttttgcttcaaggtcgttgagtgtgagaagatggtttttcgttgttgttaccttgtaaagatgccatgaagcataagcatccgttgctgcgtattgtaactgctgctttgacagaggataaaactcccagttcccaagcctgattctgtttggcttcaggagctgcaaagtaacagtcagattttcaaagcgaaatagatcaatattctcacttttgatacagcagaacagaagagagttgtactgctatttctaggaagactggaaatatgataaatccagttctcactactgttatcaaaacttaaatcaagcttttgaaatcaaccagacaaggtgaataacagatacctctttgcaaacaagtgtctcagttagtgaggcaaggccccattttttatctccaccaattttttggttggctaaatctgaaagatcctcaacatctttgatactaactccatagtcatggaaaagcttcacagagtcaccatcaattccaatacctacctatatatatgtatcagaactacgttaattgagcatccatggcaaacaacaagaacttcgaccacttcaaaaaaaaaaataacaaacctttacaagtgttgaatcttcaataagatgttggagactttgagggataccagaatgaaaaatatgcataacatcacaataattactatctacacatatctggacagtcgcaaccttccccgggagaacacctgaaaataacacaaagtttcacaaaatattattagttaagatcacaaaaacctcacaaaggttcatgaatgtgtcaaaaagcattatcaagcaactatcattacaacacatatgagtagactagtctaagagatattattagtagaacaaagcttgcagcaatgagattctagactacacaaaactgcaatagtaggcatctacactttcctccgaacattcagaaaggaaacaacgaccataaagctctattcgatataaagcaagagcatcatcattctatcatcaagatatataaagagaaattagaaaagacaacatatgatccatagagataaaatacagttcgagatgcatatcacattgcatactttaagaaatgcaatcgaaaaagacaaaacttgcaatcagacacaaaacggaaaacagaagggttaacaaaagcaccttttctaaaacttggtctccactcaatatccaagccaacaaaagctattccagattcatctctcttggtatcaagaactttaataagctgcattgctcgcttatcaacctcagtagcagtcttgctatacaaaatcctaccaccaaacctcattgctggaaaattcctagctgcaacaaagtatacacattattaagttgctccgcccacataattcaaacaacacactattacgaaaaaaatcttaatcctataaattacggcatgaacagattaatacattgtaaagaacttggaattcgaatcaaatggtgagacaactaatgaattgacattttcaaagcaaaaagaagttgaaattggaaaatagaacagaaagatctctgggatttgaagaagtttcatacctcggcaacgggagagaggaaatcgtttataagatgtagaagaagtgatggaacgaggcaattggcgacggatattattggggatttgatttggatcctcctcgtggccatggacggaggttgtagcttgtacggtcggagcagcagaggaagaagaagaagaagaacgggagaaattgtaggaagcttcgatggcgtcgatagcgagaagctcttcctctgtaaaagcgtcgtcgatccaatttgacgatgacatttcttttactgaaacaaaaaaataaaaattaatgctttggacgagtctcgtcggcccctttaaatgtttgtattgtttgtttttaattttaaacgttcccacactgtacaatatagttgtgtgttttaaattgcccgagacacgctttatacaatttttgtatgattttgattattcatcacgtaaccataacctttgcttcacattagaattgtcccatgttagggatattggcataacgatgtatcagatcatgtcgatgagaaaccaaattcaatctttcagaaacttaaacccatcccatacaaacaaccacacttttgttgacaaatggagcaaccaattcctcttattttcattcaacagtagacactctttcattttcaacaaaaaaacactcctttgactaagtagaaactgtcgatggccacacgcgaaaaatgatgatgaattcttataacactcctccacagatgtagtaagtgtcatccaaggatctagcaattaagagtcagatattcaattttctgtggaagcaattatccttcccaggagacttgtcaagtcaagcaacgatcaattcgtttcacagaagaaataaaacaaggatgcattcttgtagtgagaggaggatgatgacagtaatatggagcttgtgtttaatcttctgcctctctaactcaatacttgccattgctaaagacttgtgtcttcccgaccagagggatgctcttttagagttcaaaaacgagttctacgtccaagagttcgatccccatatg

SEQ ID NO: 18996 - DNA, 3003 bp, Unknown; identical to SEQ ID NO: 18995
  misc_feature (1)..( 3003): 2750-1469P.txt file - cDNA_ID_1820248; gDNA_ID_2926158; Annot_ID_139612

SEQ ID NO: 18997 - DNA, 3000 bp, Unknown; identical to SEQ ID NO: 8613
  misc_feature (1)..( 3000): 2750-1469P.txt file - cDNA_ID_1820259; gDNA_ID_1971820; Annot_ID_58318

SEQ ID NO: 18998 - DNA, 3000 bp, Unknown; identical to SEQ ID NO: 8606
  misc_feature (1)..( 3000): 2750-1469P.txt file - cDNA_ID_1820259; gDNA_ID_1971820; Annot_ID_176137

SEQ ID NO: 18999 - DNA, 3000 bp, Unknown; identical to SEQ ID NO: 8613
  misc_feature (1)..( 3000): 2750-1469P.txt file - cDNA_ID_1820259; gDNA_ID_2926158; Annot_ID_139608

SEQ ID NO: 19000 - DNA, 3000 bp, Unknown; identical to SEQ ID NO: 8606
  misc_feature (1)..( 3000): 2750-1469P.txt file - cDNA_ID_1820259; gDNA_ID_2926158; Annot_ID_198564

SEQ ID NO: 19001 - DNA, 3000 bp, Unknown
  misc_feature (1)..( 3000): 2750-1469P.txt file - cDNA_ID_1820271; gDNA_ID_1971820; Annot_ID_58314
aaaggtatgctcccatctaacatgagtagcctctccaaactggaggcttttgatattagtggaaattcattttctggaaccattccctcttctctcttcatgatcccttcgttgattctacttcacctgggaagaaacgacttcagcggtccttttgagattgggaatatctcttcaccatctaatcttcaactattaaacattggaagaaacaatttcaatccggacattgttgatttgagtattttctcacctctcttgtcacttggttatttggatgtttcagggattaatttgaagatcagttcaaccgtcagtcttccctcacccatagaatacttgggtctattgtcgtgcaatatttccgagtttcccaaatttctacgtaaccaaaccagtttggagtatttagacatctctgccaatcaaattgaaggccaagtaccggagtggttatggagtctgccagagttgcggtatgttaacatttctcataattctttcaatggtttcgaaggaccagcagatgttattcaaggaggtcgagaattacttgtgcttgacataagttcaaacatattccaggatccatttcctttgttaccagtagtctctatgaattacttgttcagctccaataatcgattctcgggagagattcctaaaacaatatgcgaattggataatcttcggatacttgttttgtcaaacaacaacttcagcggttctattcctcggtgttttgagaatttacatctttatgtcttgcaccttcggaataacaacctctctggtatttttccagaggaagctatcagtcatcacttgcaatcatttgatgttggtcacaatcttttctcaggagaacttcccaaatcattgatcaactgcagtgatatcgagtttctaaacgtggaagataacagaatcaatgacacgtttccatcctggttggaattgttgcccaatcttcagattcttgtccttcgttctaacgagttctatgggccaatattttctcctggagattctttaagtttctccaggttgcgaatctttgatatttcggaaaatcgcttcactggagttttgccgtcagattactttgttggttggagtgtaatgtcatcagtcgtggacattgatggtagaataattcagtatacagttacaggaattgaccgggacttctaccataagtctgtagctctcataaacaaaggattaaagatggagctggttgggagtggtttcacaatctacaaaaccatcgatgtctcgggaaacagactcgaaggagacatccccgagtccatcggtcttctcaaagaagtgattgtgctcagcatgtcaaacaacgctttcacaggccatattccaccatctctatcaaacttgagcaatctccaatcattggatctttctcaaaacagattatccggcagtatcccaggagagctcggaaaactcacgtttctagagtggatgaacttctcgcacaacaggcttgaaggtccaataccagaaaccactcagattcaaacccaagatagttcttctttcacagagaatcccgggctttgcggtgctcctctcctaaaaaaatgtggtggagaagaagaagcaacaaagcaagaacaagatgaagacaaggaagaggaagatcaagtatttagctggatagcagctgcaataggctacgtacctggtgttgtgtgtggactcaccatcggccacattctggtttcacacaaacgtgactggttcatgagaattgtttccttctttacttaagtaagcattcaataaactttctcaagacttgtttgaaaatcatattatcaatctacattcttacacttatttgaaagataaaatatctccttgtccttttaaattaatgttctaatatcgtcgtaaggaatttggtctgcaacgttttatatgtagaaacaaaaactgtataatagttatagcatgaaactttgattaagaattagaagtggttacagaggattgttgtattacagaggattaattttatgaacaaaaaaaaaagaaaccaataaagtagaaccgaaacggtctaaatttaaatgtttgtgtatatgtgtaactctaatgttttgagttgtattataagtgtgttatgcattcgagttagttctattagtttcctataatttcgttacaatactactgtatctctctgtcctcttctcttctttgctttcatttttttttcagattcagttccatcatcacaacaaagaaccctaaatcaatttcacattacgtttcatcaccaagaaaaaaaaacggaaaaaaatcatttattacgtcttctacatttcttgatttttttttggtgtacaaaaatggaagagatgaaaaaggtttgatacgattcgaatattctattgctacttctctagcttccagatattttcttctttttgattttgtttcatttactggtgatttgattttattattgtggacaaggtaacgtataaaaagtgaaattttttgtgggtcttaattttttttcttttgattcgttaatcttttgagaaacaattcgaaagatcctagattttgtatagtcgcagctgtttcttgtgacattgtttgtttatatgttaagatttgtcgttttcctttgcttctatctccctgtctcggtgtaatctacttgtgcgccatttgtctggttatcgaattttctgccacaaagaattttttgaaaactcagattttttttgttttcagaacatgattggtgaggcaattgctaaaattaaatagtacttatgtgttttatgttgattttttgattagaaaatggacattttgtccgattcttatttgtttgtgttttttttttttgtagacgcaataagctatcttcagcctaaactttctggaaattttcgtcattagtaacctgaaattatcttaacttgtatataagcaagactataaatattagcaaagatg

SEQ ID NO: 19002 - DNA, 3000 bp, Unknown; identical to SEQ ID NO: 19001
  misc_feature (1)..( 3000): 2750-1469P.txt file - cDNA_ID_1820271; gDNA_ID_2926158; Annot_ID_139604

SEQ ID NO: 19003 - DNA, 3003 bp, Unknown
  misc_feature (1)..( 3003): 2750-1469P.txt file - cDNA_ID_1820283; gDNA_ID_1971820; Annot_ID_58309
aacttatggccattgaaggcaaggtaagcgttgaaattatgtctatatcctgcagagcttctatgttcactgtcaatagcgtatagatatatcttttgatgtcttgtagatcaatgcatttattcactgcttcgttggggctagaagaattgtgaccctgcatgatttggaagtggcaatatgccggaacgagtttgttgattctttcgatgatctggaattgggacctttgctgcagcatccactggttttgctgtattttccatcgatatccagttctactggaccagttaagatcactagtgaggagataatatcatttcttgatagctatctgcacacttatatgacagaagatgttaagctcgatgaatttctgaattttgttgcaagtcaaaagtcagttacaagcaaggaaaagcttggtgtgcgtattcagagcttgcggtatgatattgttcttttttggattatctaaacttggttatgagttaaataattttgatattacagtaaggttggtattaatgttggatctggttgttcttagtatgaactgcattagctgattttatgtgatttaatgcatttttataggatgtatgtatctttcattctagacgcgaagagacaagaaggtgaaacactgaaagtcttactgactgagctgcatcagaagtatcacatcccctcatcaaagaaacaacagcgagataaatctctaactgtctctgagcgagctgactcatttgctttacatcataaggattattgtggcaagcatataagatttgattcttcaagctcagatgaaaatgataatgtttatgaggttagaaatcttaatagttctgaccatatcaatagttgtccatatccatctgttgcggaagagatgaagcgtcttgggggctccaataagaaaaggaagggtgaaagacgtaatcatgaaaaatctgattcctccaaactgcttagaaaatccccctctaaattacaaggacatgcgaaacaagagatacctaaattggctgatgattctgaagctaagaaggttttcagtgtcgatgaggctgattttacactttctgaaggagatttaagattgttcatttcaacttggaaggacacatgtaaagagctaagcatttcaacggtaagttcatgttgagattgtatgactgttttaatctgagagtgaattatcttaagtgaggtgtgagggggcttcatgtttgtttattttctaatactctcttttattattgtagtttgtcgagaaaatgttgtctttttacaacttggggggctctgaaggaagagctcagattaaaagagctaaagcgatgtcatcatttccgtttgttggattactaaatgtcgctgtgagtggtcatactacttttgtttaaagtgttttgcatttttcttgttttcttgctttcattaattcaattgaagaattttgtcaaaaatctctgttaatgcctcctatttacttttgttcatgccattcacattaagtgtacttggaggtcaaatcctcctaatctgacgtcttttttttctttgcaacacttgttttttctctctctgtgaaatagctgttttctggtatctcctaatttggatagaacagatggatgtttggttactactttttttttttaatccatcaaatgtttatgaaaaataactgcacatatattttcaaagtgaaggatgcgagattacgtttgctatatatttacatccatactcattttttgcttcacctttccgtttttactttttttttctttacccatttttttcccctcttattttgctttgtgttgcttttcccagtttgaaaagattttttgtagtttcaccgtgtaacacaggctcactattttctatgatatctccttttaaattctgaagaaatgctgaatttaaaagttagacgattttcactcatacttttacagtgttttaagttgttgctcttgttgtttttctatctctgctcttgaactaagacttagcacccagttgcaaagtcttggagttgagctcagcaaatgtggaaacttccctagttcggctttgctctttgatacatcacaatgtcactgaggcaagctggataaggacaaaaatactacagactgtggatcattcaaaactcgtgccccttgtcacctccagacccccacttattaaattaattaatggaaaccttccaacatctcatgttgcagatgttgctattatgaaaattcctttgttattcctgtttacacctgaaatttaacattgcatttgtagcatctcaatttttttacctggttctgtgtcttgtgcaaaaatcttgttgttcaatgtttgagaagtgtctgcattgtcgttattcgattctctttatttattcctggcaatcagaagaaaataaaaccacaacagtgcaagagtctcttaggtgcagtgggaaatttgtttcaggcaatagcatctcgtgtttcttatttatgatcaattcatttcatttactttgctgattgaaaaatttgcacatgtttgctgtgattgagtagtaactttattttaccccttctattcaggagtttctttatggactttgtttacttcgttttttaatttggtttgtttactataataaagaaatatgatgcattttcaaatgtaggatatagattagaaaattgaaatgtgttacaccttgtttggcgaaagagtgctgttttgtgttgttctgaaaggctatacctttttatttacgttgagcaaaaaaaaagtgaaaatattctctgttaaattgaaagctaacttgccctggaagcatttcatattatgtttaattgtaataataaatatatgaacaaaaagaaatattgatattctctcatttgcttgcatggattgggttctaacttgcttacagatgagcttcctatacccattgtctcttatttttgctttattgtttttcttcctatg

SEQ ID NO: 19004 - DNA, 3003 bp, Unknown; identical to SEQ ID NO: 19003
  misc_feature (1)..( 3003): 2750-1469P.txt file - cDNA_ID_1820283; gDNA_ID_2926158; Annot_ID_139599

SEQ ID NO: 19005 - DNA, 3000 bp, Unknown; identical to SEQ ID NO: 8602
  misc_feature (1)..( 3000): 2750-1469P.txt file - cDNA_ID_1820291; gDNA_ID_1971820; Annot_ID_58306

SEQ ID NO: 19006 - DNA, 3000 bp, Unknown; identical to SEQ ID NO: 8602
  misc_feature (1)..( 3000): 2750-1469P.txt file - cDNA_ID_1820291; gDNA_ID_2926158; Annot_ID_139596

SEQ ID NO: 19007 - DNA, 3003 bp, Unknown
  misc_feature (1)..( 3003): 2750-1469P.txt file - cDNA_ID_1820310; gDNA_ID_1971820; Annot_ID_58301
tactatcaattttctttataaaaaaaaaaaaaaaaaaaaaaaaaaaaaactagactaatttttatttgtgtactgtatacattattttctaaaacaaatgtctagacattatagtattttataaacacttacacaacaccaaatgtttgtcttaaccccgactaaaaaggacatatgtgttgttaatgctggatcaccggtggttttgttagtgtctacccttatttgtatggaaaaacactgccatagcccataaggtaacttataaggacatcaaagcttttggtgtttgactgcttaaatgttcagtctccagattccagcacatgcatttctcgaatacttgactaatggtgaagctagcattttttaataactttgccttaccaatcatggtggttggcggaattaatcatggtggtaagcgagagactttattttatccaaaaaaaaaatgagagacgtaaaattagaactatttttagttataatagttatattttattattttgtctcaattattctccccgcccctctatgtagacgtgtgaatattagagagattgataacgaactcctcacaacatcatatctcaagttcaccacccaaaagaaaaaacacacacacatcttagagagatgaaagagactaattttggcgagaaaacgcgcgttctggtagttggtgggacgggatcattggggaggaggattgtaagtgcgtgtttggctgagggacacgagacttatgttctccagcggccggagattggagtggacatcgagaaggtgcagctacttctttctttcaaaagactcggcgcacatcttgtggaaggctcattctccgatcaccaaagccttgtctctgccgtaaagcaagtcgacgtggttgtctccgccatgtccggtgtccacttccgcacccacaacatccccgttcagctcaagctcgtcgcagccatcaaagaggccggtaacgtcaaggtaaaaggactcatacatcactaaacacttttctttctagtgtagttgttacctttttcatcagagtttaaagcaatttaaaataccgattatcgtagctggtattccaaaaaagttgctttggcatatatacaacataaattaatagtatatgtgttaaaaaaatatgaaggtacaatgtatctgtctgcatcaatgacatatgcatcttttgaaaatagctgatatattacggctatattttgctaacaatcgcaaatgaattgaatttaactctatagacatatactcatttttaaaaatttaataattttcttggaaaagataaagatccgtttgtaagataattgtgtaacacaaaagtcacctttttggcttaccaataacaaagttttaataagcttgcatgcattattgttcaaagactatctaaaggtttttgaaataataataaatcattttagaaaaaaaaacaaaattatacaaccaatcttgtcggatgtttttttaataatattgactgtcttagcttatgttcggtggtgcttacactaaaaaattaaaatatttcagtgaaactacttacaataagttaaaaaatatttcagcgtttcttaccatcagaatttggaatggatccgtcacgtatgggacatgccatgccaccaggaagtgaaacatttgatcaaaaaatggaaatacgaaatgcaattaaggccgccgggatctcccacacatacctcgtcggtgcttgttttgccgcatacttcggcggaaatttatctcaaatgggaactttgttccctccgaaaaacaaagttgatatttatggggacggaaatgttaaaggttagaagaactcttatggaacgctctctcttcatatttttcttttttctatttgtgtcacttttataatcatgaaaattctaaaaaatctatttttgttcccattggttttattatagtggtgttcgtagatgaagatgacatggcaaaatatacagcgaagacgcttaatgatccccgaacgttgaataaaactgtgtatgttagacctaccgacaacattctcacacaaatggaactagttcagatatgggagaaactaaccgaaaaagagttggagaagacctatgtttcaggaaacgactttcttgctgacattgaaggtaaatctaatcatcatctagtaaccaaattaaacaaacctagcttttggattatagatttctatcacatctcttaaataaagcattggattaatgtaaggttggtttagtattaaaaccgaaatgtaaaagttggtcatgccaagtatttattttctatatatcacatctcataaattaaagtagacgtttttgtcttttagattctagtaaattatgagaaagagttgaatttagaccaagtatttattttctattaaatgtgaaaatgtttattatatacatgcagataaggagatatcacaccaagcgggactaggacacttttatcacatatactacgaaggttgtctcacagatcatgaagttggagacgacgaagaagctactaaactctatccggatgtgaagtacaaacgcatggatgaatatttgaaaattttcgtataatgttacatatatgtgaaacacatcgccatttccttatttttatgttttaccatggccttttgttttgtttgcttgaagatgttttccgaatttattttaaaatttaaatgtttcagttatggatatgtctggttatatatagatatacatataatctcaagggtccgaaaatttccaaaagtaaactcaagggtctgaaaagataatttggaaatttaagtccttttcctagaataccaccgataatataagggctttatacacaaatacacaagagatacttcgagaagagattaaaaaataaataacataaaaaaatggaaattatcttcccgccatgtgtatgtggtaactaacaaaagcttcgattactttatcctctcactctctaatg

SEQ ID NO: 19008 - DNA, 3003 bp, Unknown; identical to SEQ ID NO: 19007
  misc_feature (1)..( 3003): 2750-1469P.txt file - cDNA_ID_1820310; gDNA_ID_2926158; Annot_ID_139592

SEQ ID NO: 19009 - DNA, 3000 bp, Unknown; identical to SEQ ID NO: 8588
  misc_feature (1)..( 3000): 2750-1469P.txt file - cDNA_ID_1820318; gDNA_ID_1971820; Annot_ID_58298

SEQ ID NO: 19010 - DNA, 3000 bp, Unknown; identical to SEQ ID NO: 8588
  misc_feature (1)..( 3000): 2750-1469P.txt file - cDNA_ID_1820318; gDNA_ID_2926158; Annot_ID_139589

SEQ ID NO: 19011 - DNA, 3000 bp, Unknown; identical to SEQ ID NO: 8587
  misc_feature (1)..( 3000): 2750-1469P.txt file - cDNA_ID_1820322; gDNA_ID_1971820; Annot_ID_58297

SEQ ID NO: 19012 - DNA, 3000 bp, Unknown; identical to SEQ ID NO: 8587
  misc_feature (1)..( 3000): 2750-1469P.txt file - cDNA_ID_1820322; gDNA_ID_2926158; Annot_ID_139588

SEQ ID NO: 19013 - DNA, 3000 bp, Unknown; identical to SEQ ID NO: 3321
  misc_feature (1)..( 3000): 2750-1469P.txt file - cDNA_ID_1820347; gDNA_ID_1620639; Annot_ID_47444

SEQ ID NO: 19014 - DNA, 3000 bp, Unknown; identical to SEQ ID NO: 3313
  misc_feature (1)..( 3000): 2750-1469P.txt file - cDNA_ID_1820358; gDNA_ID_1620639; Annot_ID_47438

SEQ ID NO: 19015 - DNA, 3000 bp, Unknown; identical to SEQ ID NO: 3312
  misc_feature (1)..( 3000): 2750-1469P.txt file - cDNA_ID_1820368; gDNA_ID_2213670; Annot_ID_132771

SEQ ID NO: 19016 - DNA, 3000 bp, Unknown; identical to SEQ ID NO: 3312
  misc_feature (1)..( 3000): 2750-1469P.txt file - cDNA_ID_1820368; gDNA_ID_1620639; Annot_ID_47435

SEQ ID NO: 19017 - DNA, 3000 bp, Unknown; identical to SEQ ID NO: 3312
  misc_feature (1)..( 3000): 2750-1469P.txt file - cDNA_ID_1820368; gDNA_ID_2213670; Annot_ID_182278

SEQ ID NO: 19018 - DNA, 3000 bp, Unknown; identical to SEQ ID NO: 3312
  misc_feature (1)..( 3000): 2750-1469P.txt file - cDNA_ID_1820368; gDNA_ID_1620639; Annot_ID_162972

SEQ ID NO: 19019 - DNA, 3003 bp, Unknown
  misc_feature (1)..( 3003): 2750-1469P.txt file - cDNA_ID_1820386; gDNA_ID_1620635; Annot_ID_47337
gaacaaataaaccgtggagcattggtcaataacaacactctttactctttcttccgtttgctcgaaccatctagtctaagagaaagaaaaaatactaaagagaaagaagaagaggacttgaatacggaagcttgagagaatgaaagcgatcgtgatctcggagccaggtaagccggaggttctgcaactccgtgatgtggcagacccagaagttaaagacgatgaggttctcatcagagttctcgctactgctttgaatcgtgcagatactctccaaagacttggcctttataatccaccacctggctcaagcccttaccttggtctcgaatgttctgggaccattgaatccgtcggtaaaggcgtctctcgatggaaagtcggagaccaggtagatatatattcctgtgatttcgtttctggaaattagggactaatcctcaattttggttttagggtttggtgtctctgtgttaagttatccgagcttggatttaggatacagaacatttgaatacactgctcagtgctcacactcatgttcttaatgatttaggattcataacatctgaatttgaatgacttggtttctgtctagttgcaattcgtttacatttgtttagctgttgaggcttcttatatttttgtgttggattggatttagttttactctaggcttaagcaagtaaattacttttgaagtataaagttattgtcttggattacttctgactgtctttgtctcaggtgtgtgctcttctttctggaggaggttatgcagagaaagtttctgttcctgctggacaaattttcccaattcccgctggtatctctctaaaggatgcagcggctttccctgaagtggcatgcactgtttggtctactgtcttcatgatgggccgtctctctgttggtgaatcattcttggtatttcaacttctcttctctttttatgtataaaaacagtttctatggtctggtaaaagccaatccttttacggtcaattctagaggcttttatctattactttgctttgcatttgtcttctctcttgggctgttttgttttctttcttgtctatgtccttgctaatgtttgatagtatctgaaattttagattcatggaggttcaagtgggattgggacatttgctattcagatagctaaacatctgggagtgagagtatttgtcacagctggttggtctgagcttcaatatattgataacctttatgtacttttttccgaaattgttcaaattttcttttaactaacagggagtgatgaaaagctagctgcgtgcaaagaactcggggctgatgtttgtataaattacaaaaccgaggattttgttgcaaaggtaaaagcggaaaccgatgggaaaggagtggatgttatcttggactgcattggggcaccgtatttgcagaaaaatctcgacagcttaaactttgatggaaggttatgtattatcggtttaatgggaggagccaatgcagaaataaaactaagtagtctgcttccaaagcgtctcactgtcttaggtacttaacacaatcaatcaatcatctctcaaaatcaatactgagagtctgagacctattgataattcttgatctgttttgttcctacaggagctgcattaagaccaagaagccctgaaaacaaagcagttgttgtaagggaagtcgagaagaatgtctggccagcgatagaagcagggaaggtaaaaccagtgatttacaagtatttaccattgtcacaagcagcagaaggtcatagccttatggagagtagcaaccatattggtaagattctccttgagacttgattctctgcaaagggagaaatgttcagagacaagagtcatggtcaataatcaataaaatctggtcgattctgttcatagatatctctttacaagagttctgtttgttggcttttatgtatctctgatttggtcaaaaagacactgtaactatggaacatatatagtatcaaataagctgttgtataccaaacattgatttcgaagtagaatatgattttgtaagaagtttttatttattttgggcttaaaaagtgtatttatttttgttaattgtttgatttaataaggatttttaccacctgaggcaaagaccatgaatatcaaaggcaacaacagttttgacttctctcgttttcatcggtccgtttgtacttcttctgataaaaacaaaaattttgcaaaatctaacaacaaaatctttgattcgacaaactttgtaacaaaaaaaatcgaaactttgcaatttttacagaatgagttcgtcgctgcgacagtggtttgctagagtactcgtgcttacacagctcatcaatggagctctgtgttggggaaaagaaggtcactacacagtctgcaaaatagccgaggtcaaaattgattcatgtaattagattctgagctcgaactctaaagttgctgaaagcactgtgattcatgtaaatttgatatctttggtaccaaattaaagatcgaattagctctgcaactgtcacaaatactctaggagattactgttatggtggagtctagatagatactaaacctttgatttggattgaaatttttctgtagacaaggtagtaccttttgtgttatctttgataatgccatttttagtcctcagagctactttgaggaagaaactgtagctgcggtgaagaaacttctacctaaatcagctgatggagatctagcatctgtttgctcatggcctgatgagattaagcaccattggcaatggcgatggactagccctttgcactatgttgacacacctgattacagatgcaactacgagtattgtcgtccgtttattcttccctcttccaattgcttacctgttttcatatccgaaatccaatctatatgttgtgtttgtgaaggggattgccatgatactcataagaatcaagaccggtgtgtgacaggagctattttcaattacactatg

SEQ ID NO: 19020 - DNA, 3003 bp, Unknown; identical to SEQ ID NO: 19019
  misc_feature (1)..( 3003): 2750-1469P.txt file - cDNA_ID_1820386; gDNA_ID_1620640; Annot_ID_47477

SEQ ID NO: 19021 - DNA, 3003 bp, Unknown; identical to SEQ ID NO: 19019
  misc_feature (1)..( 3003): 2750-1469P.txt file - cDNA_ID_1820386; gDNA_ID_2926178; Annot_ID_140432

SEQ ID NO: 19022 - DNA, 3000 bp, Unknown; identical to SEQ ID NO: 3331
  misc_feature (1)..( 3000): 2750-1469P.txt file - cDNA_ID_1820413; gDNA_ID_1620640; Annot_ID_47466

SEQ ID NO: 19023 - DNA, 3000 bp, Unknown; identical to SEQ ID NO: 3331
  misc_feature (1)..( 3000): 2750-1469P.txt file - cDNA_ID_1820413; gDNA_ID_1620640; Annot_ID_163021

SEQ ID NO: 19024 - DNA, 3000 bp, Unknown; identical to SEQ ID NO: 3331
  misc_feature (1)..( 3000): 2750-1469P.txt file - cDNA_ID_1820413; gDNA_ID_2926178; Annot_ID_140422

SEQ ID NO: 19025 - DNA, 3000 bp, Unknown; identical to SEQ ID NO: 3331
  misc_feature (1)..( 3000): 2750-1469P.txt file - cDNA_ID_1820413; gDNA_ID_2926178; Annot_ID_199992

SEQ ID NO: 19026 - DNA, 3003 bp, Unknown
  misc_feature (1)..( 3003): 2750-1469P.txt file - cDNA_ID_1820417; gDNA_ID_1620640; Annot_ID_47465
catgtaaaaaagaaatgtaaacttgggtttgatgataatgaattgttcatgttaaggactaataaaaacagagaagaaagtgtactaaaatcgaaatttgagctctccaattactaaatcggtgctaaatgaaccggtcggtcgtttctatatttgattcgttcggtttatcctttaaccggtcgaaccgaagcttcttttgttcgtatgaagaaaactaaaatccaaatctctctctggtacaccatgagaggagctctgttcagaaatgcatctctctgcgctcgcagaatcattctttcttctaggatctcccccaatgttccctttctcactccaatcgccgctccggctcctcccaaattcagatttttcagttccgaatccggtgagaactcgactactgccactgagtcttcgccgactgattcatccgataagaaggatctcgttgtaaaggatgtcagcaacaaaggtaacagactctatcctctcttcaagcttgtttggttacctcacacttgaaatggccttgtattagttgaaatgtgtgagtctaattctcatctcgccatttctgaatgcctcacagttttcaattgatccttcgatataagattcgtagcttcttatctcctgaactactaggtaatcgtttgaaattgactttatatgttggattttgtggtctcagagcttaaaagccgtatagacaagtctttcaatgagggtaatgaagatgctttacctggagttattgaagcacttctacagagaagacttgtagacaaacacgcagagactgatgatgaattgatggaaaaaatcgagagtctacctttcaaagatgatgtcaaggatgaagattttgaatccgatttcgaagaagcgcattctactgacgaagaacttgaggatttgtacaactctcccgagtatgtagctgaaaagatgaggaagaaagaatttttcaacatggacgataacaagtgggatcacatgattagagaaggtatccaacatggctgtcttaccgatactaaacaatgcgaggagattctcgaggatatgctcaaatgggaccagcttcttcctggtaatgctcttttatttttcaatcttcccgttcatcgactcacatccttagacatagattaggttgattaatagactattgtgcctcgttatagctaaacacactctcttagtggaacttatcttttgtagttaacctttctatttggattttaatgaatcatggtagtagaaccattcttcttttcttaactctttcaaggtaatgtactatgtcggatttgttgcttctcggatcagtagggctgtttagagaatatattggtttgttcctgttatgcgtatgtatgaacatcctctaactgtgtatcttcattcagatgacttgaagaaaaaagttgaagcaaagtttaatgagctcggggatatgtgtgaaagaggtgaaattgaggccgaagcagcttatgagcttttcaaggaatttgaagatgagatggtaattcagtatggggatcagatggaagctgagggtcctccccaatttggtgaaacagatacttctgacaggaatactgacttggatgatccctccggtaaaggcccaatcctcaggtggcaatcaaggatagtttttgctcctggaggtgatgcgtggcatccaaagaacaggaaagttaaaatgtctgttacagtgaaagagcttgggctctcaaatcatcaggctaaaaggctaagggaacttgtgggaaaaagataccattcagggaaagatgagcttacaatcacctgcgagaggtatataaactataaatcttaagcttttcgcgagacaagaatgttgaatcatgtaatgtttttgtcctgtcacaggtttgaacaccgagaagaaaacaggaaagactgcttgagaactctttacgggttgatagaggaagctgggaaagccaacaagatcgctgaagacataagaacttcatatgtaaaacagagactccgagccagtccagcttttatgcagaaactacaagccaagatcataaggtctaaagaatcaaatgccatcaacgcttgaaaaaaacttttcccggttcgcgcctttcttcttgtctcaccaaataatctgtggatcgtcttcttttggcaatcatttgatccggtacgggttttcagatcgatgaagaatctttgatggtaactcctattttagtttggtttgcttcttgtatctcatgaagacatgaaccttggctgtgctgttggtaactccatttgtcttcgtcgggaaactataaacagaacagtccgaccactttttcatgctaacttctagattcataatgcaatgttggtaaaaatagacaatgaatgaaactttttcatgtataaaaaatatggaaacttggggttgataatgaattgttcatgttaagactaaaataaaaaacagaagagggtgcttgtgtggttagtctcaattgttaaatcaacaattaagttctccgattaggcgttgaattaaccggtcgcccgtttttaattttcatcgttcgattttcaacttaacctgtccaccagaaggtcccttttgtgcctaattttgatgaaatgtcgtcatttcgtcgttgaagctacaacacaaaatacaaaacgttgtagttagattgctgaatctctttgtaccggtcaaactcggtcataccgagtatcaatccgaatgatccggtaggaccgggattttaattaggaatccgaatctctaaattccagatgctaccttatacgtgtacgtcttctccgcccttcttattcatttctactctgctgcgttatttctccgtcgtcctcaactcatcgccggcgtttaccatccgctagatccgtcgcctctccggtcgactatttatatggaatcgtaaatttacagacactaataagaatagtttgacaaaatctgtagctggaataatg

SEQ ID NO: 19027 - DNA, 3003 bp, Unknown; identical to SEQ ID NO: 19026
  misc_feature (1)..( 3003): 2750-1469P.txt file - cDNA_ID_1820417; gDNA_ID_2926178; Annot_ID_140421

SEQ ID NO: 19028 - DNA, 3003 bp, Unknown
  misc_feature (1)..( 3003): 2750-1469P.txt file - cDNA_ID_1820421; gDNA_ID_1620640; Annot_ID_47464
ggatttggcagatatcatcattgaatttgctaagagtgatatcagagcaagaaggatgttcaatagaagagttgaatgctggcaaaatatgtgattggttccttaaggacaagctgaagagagagcataacattgaatctgctgttcttcaatgggatgatcccgattttcctttttaaatatccttattttttacattcaagccacacaaaagtatgatcattaacaaggtgaatatgtatcgtaagtcttaattagtctattgtggtctgactaggaaaatataaaccttttgttaagtcctacaataaaacgtattcaacaattccaaatattatccatgactgaaatacataaagaaaaggtttaaattttatctagaaaccaggaaaaaagacaacagtaaacaaacaattaaaaaagaaaagactttgaaagaaaatccaaaagttgtagaagaaaagacttaaataaacacaaagagaatccaatacgctgtcgtttttgagcaaagtctctatcgacttttttccttccgttaatcaagccatcggatattaaataattacaaaattattttcagacaaaacacggacgcgaaatcaaccaattaaatccacttctctctcaccatctcacgtccgatctctcctctctgagctctcatcacgagtcaacccctttctccgtcgaaattcgcatgcttaaactctgagagaagaagatgactatgacggaggagaaaccaacttccgacggcaaaggaggttggggtttcttcaagattccatttcgtaactcaagcggtcacagaaacgccgcttcaagtgctgctacttctccgtttccatctggagcttcttcttcttctacttcttctcatctacataaccatcatcaacatcatcatcaacatcaccatcagcaccatcatcagcttggttataacggtcctcacggtgatggatcgggtcaaaatcaacatccgactccttctccttcagtttcatctgttgctaagtcttttcttcctactaaacgaagattgaagcttgatccttctgagaaactctattttccttgtgagcttttttcgaatctcattttgatcggagtagtttctctggaattacagtctttttttcattgtctagggtttgtttctgaagatttgagatccattgacactagtctaaaatttctatcttttagtagaatttgagtatttgactgatctgattatgtggattgatacataagtttgataattgactcaataggaaacataaagtttgaaactttttggaagttaagagcagaatcttgacattggattataattctaacttaccattactctaaatatggtcttcctttaagcattctgaaattaggagtcttttatagatacgaatgattttagctatcaaatgattttgcaggaaggttttggtgtatacttaggccatgttttttttttcttcatgatttggattttggaagtttagttgttttctgttacaagtaatgctgtggagtactgaattagattattactttgttttgaagatgagcctgggaagcaagttaggagtgctattaagattaaaaatacaagcaaatcacatgtagccttcaaggtttgttttttgatctaaagcgttttggttattgggtctttggcattattgtatatgagcttactcgttgctctttcagtttcaaacaactgcgccgaagagttgctttatgcgtccacctggtgctattcttgctcctggagagactattattgctactggtatttgttttttttgttttctcgcctctgttcttattcttcttgatgaggctatcagaacaatggcttattcaatgtttctctgattgaaatgtgcagtgtttaaatttgttgagcctcctgagaataatgagaagccaatggatcaaaggagcagagtgaagtttaaaatcatgagcctgaaggtgaaaggtccaatggactatgtgcctgagctggtatgttgatcttctgatcttatctattagctgatctttgaacatgaaaacagtagtaacatatccgaatccagatagaacataagatattgacccatctctaaaacataagatatcaatgactagactaagaatgtgttttggtctgagtagaggtttccagttaccttttaaggcacaaacatataaccaagcattccactgaatgctgtttccatctaaaagacatatcgattgcttttgtttttgtttttttctcagttcgatgagcaaaaggatgatgtctctaaggagcaaatattgcgtgtgattttcttggatcctgagcgctccaaccctgtgagtatccgaataattttgcttatgatgacgattctattattttacgacctccctctttaataatctatgtgataaatgacataggcattggaaaaactgaagcgtcaattagcagaagcggatgcagcggtggaggcacgaaagaaacctccagaggaaacaggtccaaagatgattggagaagggcttgtgatcgatgaatgggtcagtctcatttgctatccagtgtctcttccattagatgattgtgaaaatctgacattgtttttgtcttacctctaataaaaacacagaaggagcgtagagagagatatcttgcacagcaacaaggcgaaggagctgactctgtctgagagactaaaagagttttctcaggacaaaaacaagtgcgcttgtgaagatgaagaagaagggaccgctatattgaatttatatgctaacttctagattcatgatgcaatatataaggatcatgctggtaaaaaaaaaagacaatgaaggaaacttttttcatgtaaaaaagaaatgtaaacttgggtttgatgataatgaattgttcatgttaaggactaataaaaacagagaagaaagtgtactaaaatcgaaatttgagctctccaattactaaatcggtgctaaatg

SEQ ID NO: 19029 - DNA, 3003 bp, Unknown; identical to SEQ ID NO: 19028
  misc_feature (1)..( 3003): 2750-1469P.txt file - cDNA_ID_1820421; gDNA_ID_2926178; Annot_ID_140420

SEQ ID NO: 19030 - DNA, 3003 bp, Unknown
  misc_feature (1)..( 3003): 2750-1469P.txt file - cDNA_ID_1820425; gDNA_ID_1620640; Annot_ID_47463
acaacatactagtaactagtacttgagtttccttagaacatacaccattcttacaatagttttgttattagatgttcccgttttgtgtataatttgattcttcttctatatggtcttgtattgtggaaaacgattattggggagcaaagaaacatacaccaaaaaaaatatgatcaaaatttttagtgtgtggaacctttcgaaaaccctacgatgttcaagtaagaaattgcaattatatgagatattatatatatatgcaattgttcttagtatttaggtgtttagaatatatactttagaccgttttaagatgtttgttaaaagttagtcttcttctaattagaaacatcttcttttgtttttatgaagtaagtgataagatatacatataatttacctcgaccaagtttgaatacttgctaggttaccatgtcatgtttaatcgtccacatgagatatctgtgtgactgtgtcttcggttcgatgtggctaattttctagaacatgttatcaaaagcaaacgttgttgtaattggctgatactgaggaaaatgcagtttggcaatgacaagaaccacacatatatacaatattgatatctattgaataattatacaatattaaattcctttgcattattcatttgtttcgtataaactaaaacctttgaactctaaatagttgaaaggagcagagtcagcagacaaggaccaaagatcccttcgaccacacatataaaacgatataatttgatacgaaatcgtaatggttgtgcagttgatgttgccacttaagacacttacgtaagacttcatgcaaatataatttaatatacgtacctcttgaatttacgtgttagtttgattatatatatattggtcatttttttggtatttgctcgataatagagttgatgggaaaccttgataatattaaaaattatcatatgaattttggaggaaagacagcaacacactcgagaactctctggaaaattgcgttttcactttttttgttttccaggattagttgatctaaaatctataatatatattaataaatacaacctaataaacaaaaattatttatgtttcagttaatgtaacccattaatatagaagtaatctcgtaaatatggagttgattaaaaatatgtacttaatcaaattcatctatatatatatatatgtgtatatatatatatatatatatatatgaattatattacgatcaaattatcttagcttttaaaataaaatttttttatcttagctcttattcaaaagtctttattccatcacaaggttatgttatcttttgtatttttattttattttatacaaggacttccaagttccaacatttcaatttctaagtacatgcatatcttattaaatagtgatttaaatacacaaaaatatgaaataaattctaaacaaggtccactctataaaagaagaaaacccacaaattccaaagcccaaattaaaacaccaaaagagcccaaaatacaaactcattcttcaccactaaaatattccaaagcaaagcaacgaacataacggataagtgttatcctcatctagtcatcttcaccctctaactcaccgagaaagaaaagtaaagagagtttggtgtcactatgaacattgccattcataattaccgtcactcaaaattcatcgtaaatcctcacatagacaagacttttgcaaggactcgacaggcaagatcaaataatattacattcatgacaagtactcatggaagaagaagaacgatgggactttgtttggtaagagcaagtgccgagaccggagaagaagaatccgacgatcaaaacaagcctgagagaagaagtttcttgagcttagcagaagctggtctagtcgaaatctcaggccttggtgcacacgagaagtttctctgtcgactaacggtaaattaaatcataaatttatccctacatattataaaccctccaataccaaattttaattgcaatctattaataaatctcttacattgttttgaaatatattggtatggttaagataggaaatgaaacattaattttacataggaaattgaaaccatatgtagttgtgaaacaaaagaaaatcttataacacgtcctcaagaaatgaagtgtgattaacagtctatagtaaacatatgtacattaagtaaataactggaatatcatttttcttagaagcatgtacattgatttatagatgtttcgtatgaacttcttcttatattttggaactggatttggcagatatcatcattgaatttgctaagagtgatatcagagcaagaaggatgttcaatagaagagttgaatgctggcaaaatatgtgattggttccttaaggacaagctgaagagagagcataacattgaatctgctgttcttcaatgggatgatcccgattttcctttttaaatatccttattttttacattcaagccacacaaaagtatgatcattaacaaggtgaatatgtatcgtaagtcttaattagtctattgtggtctgactaggaaaatataaaccttttgttaagtcctacaataaaacgtattcaacaattccaaatattatccatgactgaaatacataaagaaaaggtttaaattttatctagaaaccaggaaaaaagacaacagtaaacaaacaattaaaaaagaaaagactttgaaagaaaatccaaaagttgtagaagaaaagacttaaataaacacaaagagaatccaatacgctgtcgtttttgagcaaagtctctatcgacttttttccttccgttaatcaagccatcggatattaaataattacaaaattattttcagacaaaacacggacgcgaaatcaaccaattaaatccacttctctctcaccatctcacgtccgatctctcctctctgagctctcatcacgagtcaacccctttctccgtcgaaattcgcatgcttaaactctgagagaagaagatg

SEQ ID NO: 19031 - DNA, 3003 bp, Unknown; identical to SEQ ID NO: 19030
  misc_feature (1)..( 3003): 2750-1469P.txt file - cDNA_ID_1820425; gDNA_ID_2926178; Annot_ID_140419

SEQ ID NO: 19032 - DNA, 3000 bp, Unknown; identical to SEQ ID NO: 3324
  misc_feature (1)..( 3000): 2750-1469P.txt file - cDNA_ID_1820428; gDNA_ID_1620732; Annot_ID_49418

SEQ ID NO: 19033 - DNA, 3000 bp, Unknown; identical to SEQ ID NO: 3324
  misc_feature (1)..( 3000): 2750-1469P.txt file - cDNA_ID_1820428; gDNA_ID_1620640; Annot_ID_47458

SEQ ID NO: 19034 - DNA, 3000 bp, Unknown; identical to SEQ ID NO: 3324
  misc_feature (1)..( 3000): 2750-1469P.txt file - cDNA_ID_1820428; gDNA_ID_2926178; Annot_ID_140414

SEQ ID NO: 19035 - DNA, 3003 bp, Unknown
  misc_feature (1)..( 3003): 2750-1469P.txt file - cDNA_ID_1820432; gDNA_ID_1971811; Annot_ID_58117
tttactgttgttttgtttgagttcaaagatttaaactttagtctgctatgttattagccaataggactttatgggttatgctgcaaaaatacattttgagcagaaagatatattttttttacaaagaaagattaaaagtttaatctctcaagtaatctttgctccattattggatgtttttaggttgctactttgccttaaaagcgtggcacgcgcagcaagcaggcgcggctgcagttcttgtggcggataatgtagacgagccattgttgacaatggattcaccagaggagagcaaagatgcggatggtttcatagagaagctaacaatcccatcggtgttaatcgataaatcatttggagatgacttaagacaagggtttcagaaagggaaaaacatagttataaaactagattggagagagtctgtgcctcatcctgataagagagtagaatatgagctgtggactaatagcaatgatgagtgtggtgcacggtgtgatgaacagatggactttgtcaagaactttaaaggtcatgctcagatactcgaaaaaggcggttataccgcgtttacgccgcattatattacttggttttgcccttttcagtttataaacagtccacattgtaagtctcagtgtataaaccatgggaggtattgtgctcctgaccctgaggataatttcagagaagggtatgaagggaaagatgttgtgcttgagaatctgagacagctttgtgtgcatagagttgcgaatgagagtagcaggccttgggtttggtgggattatgttaccgattttcattctcgatgttcgatgaaggagaagaaatacagcatagattgtgctgagagtgtcatcaaatctctgagtaagaatcttttttcttttcctttttagattttaaagaaagagagtcttctttgtttaggttatgaatctttaagacttttttcagatttacctattgagaagatcaagaaatgcattggtgatcctgaggctgatacagagaaccaagttctgagaactgagcaagtatctcaggttagtttcttaatctatctttatttagagttttgaagaaacatttcagaggtttggttactaactgtaactatttcaagattggccgaggaaaccggggagatgttacgatattgccaacattagtcatcaataacgctcaatatcgaggtttggtacttgatattttttcagtttcactctctctttatgaagatgctgaagtttctgttgttattggttgcaattgtgaagggagattggagagaaccgcggttttaaaggcgatatgcgctggttttaatgaaacatcggagcctgccatttgcttaaacacaggtctagagacaaatgagtgccttgaaaacaatggtggttgctggcaggatacaaaagcaaacatcactgcttgtcaagtatgtcgtaaaaccgagcttaccacatcacatctcaccactatattgaatatcagtatcaatttgtttggaattgttttgaaaactagagaaaatgtgaaaatctagagagatattttctagtcctataatacttgaatcttttttgtttgatcaggacacattcagaggaagactctgcgagtgtccggttgtaaaaggtgttcaatataaaggagacgggtacacttcatgtacacgtaagttgttcacacatttcacacaacatagctctcaaatgttgagaccggtttcttgaatagtctctggtttgtgattgagctttgcagcttatgggcctgcgaggtgtactatgaacaatggaggttgctggtctgacacaaggaacggcttaactttctctgcttgctcagtttagtgattctcttgtcataagccaaaccctcccttacaaagttcttgttttcagttcaatcatctctttgttatttatgaaaaattaggactctgtatctactggctgcaaatgtcctgaaggtttccaaggcgacggtttgacgtgtgaaggtacataactcttaacttatcgattaaaatctcgaaagaaaccacataatcatattaccaacaatgtaattatgttttctgatttggctctattgcagatattaacgaatgtaaagagcgttcggtatgtcaatgtagcggttgcagatgcaagaactcatggggtggatacaaatgcagctgttctggtgaccggctttacataaacgatcaagatacttgtataggtaaaattttatcaatcaagatttaagagtactcaaattccataacagtatctaattaatatacattgatgattgtttgttacagagagatatggatccaaaacggcatggtggctcacattcttgatactggctatcgttgcagtagccggtttagctggttatatattctacaaataccggttcagggtactactactctttctgattccacaaaagcatttttgtacttaataacggttttaggattaccaaactaacttttctttggtgttcctattaacagtcttacatggactcagagattatgacgatcatgtcacagtatatgccacttgagagccaaagagctcgtgaagttccatcagaagccgagccttttacactctaatagtatatgaccaaagtaaccaaaactgtcatacacaaagaaatgtttgagatcaattaatgtacatatgaattatactgtaaaaataaaagagtgagatagagttgtgtatattttcatggcaaaaaaataaataatttggatgtaaagagacttttgaagaaaataaaacaaatattgctttcattgagagttgaactcaagacctcccgcttactaaacgggtgctctaaccaactgagctatgaaagcttcttgcaacatattattccaaataaattatatcgtaaactaagagttaaaatcttgaaaacaaaggataacgatcttcgtctccctctgctaaacccattttcttctgttgaggaatg

SEQ ID NO: 19036 - DNA, 3003 bp, Unknown; identical to SEQ ID NO: 19035
  misc_feature (1)..( 3003): 2750-1469P.txt file - cDNA_ID_1820432; gDNA_ID_1620645; Annot_ID_47570

SEQ ID NO: 19037 - DNA, 3003 bp, Unknown; identical to SEQ ID NO: 19035
  misc_feature (1)..( 3003): 2750-1469P.txt file - cDNA_ID_1820432; gDNA_ID_2926175; Annot_ID_140290

SEQ ID NO: 19038 - DNA, 3003 bp, Unknown
  misc_feature (1)..( 3003): 2750-1469P.txt file - cDNA_ID_1820436; gDNA_ID_1971811; Annot_ID_58116
gagtcaaaattgtgtacagtcagaaattgtaagtttgtgccctacaagatcaaaagaagcaaagacaaaaataaggatctggtgagagtactccgacagaaacaaagttcacttgaatcgtactagaacgaacgtgtaggaatatattacattttgcagattgtagcaatgaagtccaactctaccgaagaggattatatttggatgaggtcctccatattttgcaatgtcagccctttgtttaatgtagtatttgttataatcaaacttttcttctctctaaacaaaacacagaatctataagctttaaaatgcaaatatctctatgagtgatgagacctaaagttcatacatccacaatcaaatccaattacccgattagcccaaacatgtcgtgggatggaggatgaagattcttgtggtctctgatcttccagcttctcattactctgcgatggttcctcgaccaagtctctggcttcttgcttccacattccgttacccatttcttggcaaatatataaaccctatattaataaacttttaagagacttggaacttaagattcaaaccctaatttggaatacaaatctatgcgcgttaagccaaaccacatcattaattaagaacactgtcaatacacaacatgtgagcagcgaagaccacaacagagggaagtgattgagaacagcagatctaagctcatattcaacatgcatagaagaagaaaaccaattttgcatcaagagatactgaaaaatctttcattcataagagttccaagattccataaaaacaacaactatttggaagaagatgaaatggagacatctcaagttctgttccaatgtaaaatacagaccaactaagttcggtttcagaactcaccttcttcacctatgaaatttgacgagatcgcaagaagaatatacaatggattcagtgtttcgtaatcggtgagaaaaagacaaataaataagcttgatgatagcttgttagaccttagagaatagaagattgggtttaaaggctattctctcctttttctttttcatcgactcaactttatggactaatatatgcaatctcatctctttgttctaatttggacaaatacttttagctttttagacatttgttatatgtcacaatgcaattgataaagatataaatttgttgacaatgaatgcataggttcagaaccataaacaccttcaaattattaaaactcaaaaatagaaagtagaaacccaaaaggtagtttcatcagcacacaaaactcaatcctgttaatttaaaagtaacgaaataaagcaattgcaaaattatagtagtcattacaactccacctatatcatgattgatgaagcctccctaagttacatgaatctttctggtggtgagatcaaaactctacttgttcgaggccttgttagacagcttcttcaccggtttcatgcttcttcttgacggaatctgcctcgactttgcgacagtgaaagtagaaaaactgaagcagaataagaaaatcaagaacagcacatcctcctgaatcaactagccatggtagattcggttcgattttcgaccattcgacgctgttcactagtatgcttgcaacataagtcacattgccaatgaatgcaaagaagaacattaatggattcaatccctcaacatttcctctccttacattcatacatatttgaggaagccttccacccatgtaaatcgccgccattgcccaacccaaccacattccaatattgttgttttctcctaagttaccgctagagacctccaaaagctttcttgctcctgctcctccaactacaaacactctatctttccctctcaaatccatacttcttgaaccactcaatacgttgaatgatccaagaaacaagaacaccgagaccacacatagcaacgatttggtagaaggacgcttagcttcttcacgaagcaaaggctcttctacatcaaccatctgatgattccttcggtttttcatcaaccgcgggtaaatatgcccgtagtatatagattgaacatagagaacaagtgtagccagagtatacaacactgccgtgtagaattgaactggaagactagctggttccatcaagcagccaacaacattaaagatatcaccaagcatccatgttgttaagaaggttatagagactccttcaatggacttttgattgtagttagtcataatctgcggtatctcggcaacactccaactgataacactgatgataccaagagatagtgacaaatcatctcgaatcatcgttcttcacgtatgatacagccgaataaacctgttaaaaccctaaatacgaaattacaagtagctgaataatattgagcaatgaacaactcctcttataaaggtaagaagagagttagaagatgaataggaaaagggttttgaaactacaatgaccagattctaagaggaataggaaaggttttcagaattcagattggagaaaacgaatcctatgaatgaattaggttaaaatttttagtttctttctctatataattaaaatttgatatttatcaaaaacaaattaaataattaaaaggatatatccaaataattagaaaaaataagaatctaagtatatatcttgtttatacacgcaatgtttatctcttcaaagtctaggcttttgatcgagtctcctactatactaataccaccaaccaatttaaaaaaaaaacaagtagaaatttaacaaaagtctaacatcttccaaattttttccattttctaaaattatgttttgagtttgacgtttctttgttatttatataaactatagtatgctatcatcttcaatcagaaacagttccacagaagttttctgttttaacttttcctctgtttttgatttttctctctgaatctctccttcatttccccgggaaatagtaccagaaaggttatcatcgatcaaactcttcttggtggattcttcagagatg

SEQ ID NO: 19039 - DNA, 3003 bp, Unknown; identical to SEQ ID NO: 19038
  misc_feature (1)..( 3003): 2750-1469P.txt file - cDNA_ID_1820436; gDNA_ID_1971811; Annot_ID_175761

SEQ ID NO: 19040 - DNA, 3003 bp, Unknown; identical to SEQ ID NO: 19038
  misc_feature (1)..( 3003): 2750-1469P.txt file - cDNA_ID_1820436; gDNA_ID_2926175; Annot_ID_140289

SEQ ID NO: 19041 - DNA, 3003 bp, Unknown; identical to SEQ ID NO: 19038
  misc_feature (1)..( 3003): 2750-1469P.txt file - cDNA_ID_1820436; gDNA_ID_2926175; Annot_ID_199786

SEQ ID NO: 19042 - DNA, 3000 bp, Unknown; identical to SEQ ID NO: 8464
  misc_feature (1)..( 3000): 2750-1469P.txt file - cDNA_ID_1820456; gDNA_ID_1971811; Annot_ID_58111

SEQ ID NO: 19043 - DNA, 3000 bp, Unknown; identical to SEQ ID NO: 8464
  misc_feature (1)..( 3000): 2750-1469P.txt file - cDNA_ID_1820456; gDNA_ID_1971811; Annot_ID_175755

SEQ ID NO: 19044 - DNA, 3000 bp, Unknown; identical to SEQ ID NO: 8464
  misc_feature (1)..( 3000): 2750-1469P.txt file - cDNA_ID_1820456; gDNA_ID_2926175; Annot_ID_140284

SEQ ID NO: 19045 - DNA, 3000 bp, Unknown; identical to SEQ ID NO: 8464
  misc_feature (1)..( 3000): 2750-1469P.txt file - cDNA_ID_1820456; gDNA_ID_2926175; Annot_ID_199780

SEQ ID NO: 19046 - DNA, 3003 bp, Unknown
  misc_feature (1)..( 3003): 2750-1469P.txt file - cDNA_ID_1820476; gDNA_ID_1971811; Annot_ID_58102
gcatactgtggacaagctgcttatcttgtgattcataaggaacattatcaagacgcgttctatgcatctatcccgggtttgccttaaatctttttaaaacattactggtcttgaagtcatcatacatagtgctcttataaaacagtgaaactcttttttgctttgactccacagatagtgtctattggccaatgtttatagtcgcgacaggagctgctattgttgggagccaagctacgatctccgggacttattcgatcgtcaagcaggccgtggctcatggatgttttcctcgagtaaaaattgttcatacttccaagaagttcctcggtcagatctattgtcctgatattaactggatactcatgctcggctgcatcgcggttactgctagtttcaaaaagcagagccaaataggaaatgcatacggtaagatgacaacaacttcaaaatacaagaaaaattattttagtcaatgttaatcgttttaagttagttatcataagaatttttggataatctgtactaaaagaattttggtttatgataatgataatctttaaccgtgactgttttgttttcttggacaaattagggactgcggttgttctcgtgatgcttgtgaccacattactaatggtgctgataatgctactcgtgtggcattgccactggatccttgtccttatattcacctttctctccttctttgtggagttatcgtacttctcagccgtgatctttaaaatcgatgaaggaggatgggtgccgctcatcatagcagcgatatctcttttagtaatgtcagtctggcattacgcaacagtcaagaaatatgagtttgaaatgcacagtaaagtgtccatgagttggatactcggcctcggtcccagcctcgggcttgtccgtgtcccggggatcgggttagtctacacggaattagcaagtggtgttcctcacattttctctcatttcatcaccaacctccccgcgattcattcggttgtagtctttgtctgcgtcaagtaccttccggtttacaccgtccctgaagaagagaggtttcttgtgaagagaatcggaccaaaaacattccggatgttccgatgtgtagccaggtactgtactttattcttctctgttctttagtagggttgacaaaatcaataaggagttttaagacccttgaaatatctcaaacatttttaacagatatggttacaaagatctacacaagaaagacgatgatttcgagaacaaactgctgactaaactctcctcattcattcgaatcgaaactatgatggagccaacttcaaactcaagcacctacagcagcacgtattccgtcaaccatacacaagattccaccgtagacttgatccacaacaacaacaaccacaaccacaacaacaacatggatatgttctcatcgatggtggactacacggtatcaactttagacacgatagtttccgctgaatcactgcataacacggtgagtttcagtcaggacaacacggtagaggaggaggagacggatgagttggagtttctaaagacttgtaaagagtcaggtgttgttcatataatggggaacaccgtggtgaaagcaagaactggatcatggcttccaaaaaagattgcgattgattatgtttatgcatttcttgctaagatttgtagggccaatagtgttatcttacatgttcctcatgaaacccttttaaacgttggacaagtcttttatgtttagtttagtttttattattttgctttgtaaaacaattacagagaaagggtaataaaaggataccaaatttaagatcataccactgaaactgttactggcctaggtcacgtagaagttctctattgaaagtcctgacccaatccaatcacgcccaagaagcaatccgatcatgtaaaaaacttaagttttatttatcataacatttgcaacatttagtaatttacattatatgcgaactttatatctctagttacatttagatcaccatatttatatttaagactttcatcataaaggttttcacttttcacttgttttggaccaaaacttttggtaattcacaacagtcaagtcaacatgtccgattcaatctataaccacaagaatatgatgtcttatttaggagaggtcaacattataatcaatctttaacttttccctacgcaaattcaactagaggaccaatagaaacaggtatacacaattgccatttttcttagagcttttcctagttgaatattgtagcgaattattgacctttcaacgctatgtaactatatcgttacgatcccctaaaccgaacagtttaaactggcagtagttaaccgattaagcccctacagctgaaccgttgtacttgttgtagcatattataccaaattgggaacagaacctacggataccgagtttaagagaaatgtgatatagttacgtctacctagaatccgaatttgtacggttccctagatcttggtttggtaattatattattaattaagccactaatgactagtttcttagtctcgctaatcgaccaatatgaagtaatctcactcaaatacaattttcccaatcggttcgtcagaacgtgattgtcagaaatcaaaatcgtttacttttctcgccatagcactgatattttcgataaaaacaaatctgttcgcgtattatattgttttattatgctcatttcgacacacaacaaaaccgaaccggtaaaaaatatatgaaccggtttggtcatcatattacactgatatgtatattcaaaggaaacttcccatgcggaagaagaaaatatcttcattaagttacaatcacaatattcgttacaattttcttgacaagttaagttatataattaagggaaataggaaaacaaaattcaaaagaaaaatcaagactattaaatgaggctatataagtaacatgtacaaagaaggaaaaagggattcatagccaaaaccatg

SEQ ID NO: 19047 - DNA, 3003 bp, Unknown; identical to SEQ ID NO: 19046
  misc_feature (1)..( 3003): 2750-1469P.txt file - cDNA_ID_1820476; gDNA_ID_2926175; Annot_ID_140275

SEQ ID NO: 19048 - DNA, 3003 bp, Unknown
  misc_feature (1)..( 3003): 2750-1469P.txt file - cDNA_ID_1820480; gDNA_ID_1971811; Annot_ID_58101
tgtgttttactatgtttgcaagagttttcatcatcaggagattgataaatccgctttgcacgatcatctcggtgggtatctcggtgaatatgtgcctcttaagagcaacattcaaatggagaactttgaagtttgactgcatcatcaaacagagtaaatcaggttttttgcagtttgaaaatgtctttgtatgtttgtaatatttgtaatcttttcactaagtgaatttttgttttttacttgcatatccaatgtaacgagggaagagacttgtttttacagagtttctgttacttgttagatacttcttgttcttgcattcaggttatacaatgatatgagagaatattttgacaaaagaaaatgggctatataatggttcaagagtctggttgtgttctgtttcattgagctaattagtttcaagatgaatactctgcttcattctacattatacttgggagatatatgactttgatcttgtaggtatgagttgtgaattacttccatgaatgctcattattaatgtattaccatgtacaagcaatgactcaaagagtggcaacaacaaattcctcaaaagaacttgacttggggactgtgagcaaaatatcacaccactcaactttcccatacgtaggaagccaacgagactgaggcggaaaactacgacttgtaccgacaccattagattccttgttgtgcgactcttactagactaaaacgggaagtgaaccatcttgaactagggctggggattcgagttggtccacggctcagagtaaaccaacgtggcttagagctaccatggaacattaaacagagataaggacaactctcggtgcttcctaatagtctccgggtacggggtatcgtgaagatccgtggaggcgaggagagagcagaatatcttggaagctaaggagagagttgggtagtacaacctcgaaaggcgggctaaacagttcatccgtatatgttaatttaccatagttttgtttttcgtagtttttctattgaatggactcaaattaatatcgtgtgaaacttttgaaaatactgaaaaggcccttttagtgcaataattcaaattgaatatgaccttgaattgttttaaaatcatttttcttctcttgattgaacctaattgaactacaaaactatggtcaaaatatatgaatggtattgagtctattgagttttgtcctactcatataatttggcagttcatgaaaagaaatggatcttaagtggaatatgcgtcacctgtcataattataggttgaatgatgaatgtttagttttatttgtcaactatttttttttcgaggataatgtttgttttttgtcttttccagtacgataatgcttaaactaacattctcaactatcaaaacattccaacgtataccgaaatgaaagttgacgtgataaatccgatcaagaacacagcttcttaacgtggctactgtcgtcgaccgacgtttattaaattaagttttcttatatacataaaattcgttcaatttaaattaatgtggtgaattcgcaagtttaaaatttcacagaaaaaatgttttttataactataaacgcttaatctcatgcacgttctcttttcaggagatatgtaactaactaatgtattccatgatgaatgtttgggaaaattaattatagtggatacttgttataaaacttgtatgagtcaatggccttaatatttgataagtatacttaaaactttatttggacattaaaccgccactaattttccatagcacatatagtcaacttaacaaattataggttagtgttgtttggtaataaattagtaatttagtaaaccaaacaatttataaccattttattcaatcagtgtaggcaaagaatcttgaaatagtgttttctattcttatgtatatatttgacaacgtggtgttttgtcaaccaataaaattttctaacaccataacataaatctaaacttgacatgttaaatttccttagcttagtgaaacttgattaaattatgcccttccaatttttctcaccatttttaccctccaaaatttcttaaacattccacacatcaactatttcacagctttacaatgacgagccatcactttcgtacaacaacaaaagtaataatagattttctggtacatgtatcgaaaagttgtgcggcctgcgtcagaaaaatctaagaaaaaaacaaagagtaaacaaaaatatccaaacagtgaatctaataataaattctgtttactttctgcaaaaaataggataaaatcgaatttaattctttttatcgaaagtcggaaatatatcctatgtcgcaatcaattaatgtacatatgcaagaaatttaaattaaaaaaaaaagaacgcaaaaaaagaaaaagaaaaagagagagagaaagaaagaaatcgagtttaactgctcgtgtctctctgtgccactcgtcttcagttttgtcagcgtcttcataacttataaagtcctatcgatctctcttcttctttctttggccactctctgtgtctttctttgttaataatatctcaaagaataagaaaaaaaaaaagaaaagaacaaaaaaaagcacaagtttcttgaaaccgtgttgttttcgtgtaatatacacagttgttacagattctctccttttgggtttctttttgtaatcatcatttgattgactgattctctgttctttttttcccaaaaagagagtccttttattacaaaaaaaatattaaggttctgttttgtttggtttagcttttttatccaattccatcagaaccagagttgtttgttgctgctctgtaatatactcgagtcaatctttatacttaaggaaaaaaaaagtttcaatctttggtttcatctcaggcgaaaattgctacaaatggtaatcgatttctagggctctgactggttttgattaaaggaatcaattcaggggaatttcgagttcttttgttacaaaaatg

SEQ ID NO: 19049 - DNA, 3003 bp, Unknown; identical to SEQ ID NO: 19048
  misc_feature (1)..( 3003): 2750-1469P.txt file - cDNA_ID_1820480; gDNA_ID_2926175; Annot_ID_140274

SEQ ID NO: 19050 - DNA, 3003 bp, Unknown
  misc_feature (1)..( 3003): 2750-1469P.txt file - cDNA_ID_1820484; gDNA_ID_1971811; Annot_ID_58100
ccgtgtgcttgtgattttcgatactcattctgaagaatttagtatgctccaagtacctggagatatcttttggaaatataatggtcttctagaatacggtgggaaaatagctattttaaactataccaaagttgatatcgaaggtgtgatggaactatgggttgtggaagatgaagagaagaatctttggagcagtaagatattggtggtcaatcctttgcaactgcagatggtcaatagcattattagtttgacggtactaggaacaactcgaaacggcgaagttatcttggtacctggtcctgaagacaaaactgttttcaacattttactctatgatttacaaaagaatcatattagaaaaatcgaaatcaaaggaggaccagaccgctatcttaacaatatttgggaagtcgttggaatggatgatgttgagaacttaatgtatctttaagttcattggcttgtgtgttaattttttttcttttttaccaatttgtttttctattattttagttgttttgttatgctacctaatttaattgtgaagaattcgaaaaatattggacacgattagggttgtcaatcgggcctccccgcgcccaaatggaccatccgcatcctgcccgcttttcttctgatccgcgacggacctgcctgccaacgaccgcggtcttgaaaagcgagtcctaacccgccccgcagagcccatcggttagacgggctggcccgcggacattagtaaaactcctttttttaatcctccgtctgctgctttctagtgtcctgacttgtgcgaaatagggatgagcttgtcatcaattcataaaaccaatttaaccaatgtagttcttgattggtttaatcaaggttcaacattgaggggtccgaattcttgattaaaccaatttagattagctaaatagaatcgaagcataatctcaagccaaaaactaattcgattttggtagattctcaacaaaaaccgaatcactcaggaacatcataactatttcaataccaaaactcggaatcaaaagtgatcaagcacaaaaacagatcaacattagtaatatttcacaaacatcaatcgatcttgctagagtaacataatttttggcaagaatcaatcacagatctaagatcaatcagctatgtgatcgattgtaagtatattagagcatcgaaagcataatctcaacacaatttggtcgaatctagcaaaaaaacacccaaaatttcacacaaaaacctatcaattttggtagatttcaacaattagaactcaaagaagctaaatctactctttagaaccatgatcgatccctattacaccaaatttcgaaacaaaaacgcaaaatctgatggaattttggatcaaattcaactttggatctatctacatgaatcatcaagcttccacaatcgaattgaacaatatattatccaaaactgaagagaaatggttaccagaagaacttgggagagaatttctcttcatggcttccttgagagagagtgagaattagaaattttgaaatttgtttctgagagagagagtgcgcttaacggcaaatgaaagtttctcgtctcagatatttatttggcttaagcgggaaagcccacactttatttttccgtacaacagaaaaaacaaaaataaatactattgtttcagacggacacgtgtaatatcgcattagcccagtggctttgatacctcgtctgcccagccctgggttcgaatctggtttaatacccatattcgttatctttttccttcttccacgctcaaactatttcctcttttaaaaactcatacaatatcatattcgaaaaacaaaatgcgacctctttttttttttttttccctgtttctaccattttttaaaaacacatgaaagaaaagaagaaatgcaaagtctccttttaattcaaatatatctacaaatatccaaaaaatatgaataaaaacaaaccagattcaaagctacacatcaaacaaaaagcaagacaacgatccaataatcatttgatctctcatattggcaacgttgtcaatacttaggaaacgttggagagaagaagcaacatatttgatgagatggtttccctgtttatatagaggaggatattttccaaatttttttggaaaaagcagagcataaaggctaataaagctcgcaaacaaaaatcaaaagcaaaaaaaaaatagtttttctgcattttcaaaagtttgatttttatgtcacaacttgttaatgtttggagctgatgttgcgctgagttttgaatgttttgatttaaatgattcgcttccttatctgaagctgttttgcttgcaattttgaggtttttgtgctctgattttgctgactccaagtttgttgtacgcgatatggaagcaagaaaagagaggaaaggaaaggacatagatgctggttcagttaaagaccggatttaacatccctctcaagcaagaaaacggaaaccctttttgaaatactaaatttttaagtccactactacaaaaattaaaactcattccttttatatgtagtctcgattcatattttcaaaaaatttaaacaattgaaacaaatagtatctgtataaattaataaaatattatgatccaacagtaataatttatagaatttttacggtgtagtgttaaaaaaaagttttactgtatataccacttcttatatcaatctaggaatgaataaatattattatcctgagttatttattcttgccatcatatatatatatatataatatttttttctgatcaacttattaatcttgttctctaatttgtattaagtaataaactaattatttcctaatatagaattggtctctatcccaataaagaaaatgaagtcaccttcttcttcctcttttctcctgtgttgatgaaaaagcttcaagattcaatcaaatcatcaaaaaaaaaaactataacttctattgatcttgatatctaaatccgccatg

SEQ ID NO: 19051 - DNA, 3003 bp, Unknown; identical to SEQ ID NO: 19050
  misc_feature (1)..( 3003): 2750-1469P.txt file - cDNA_ID_1820484; gDNA_ID_2926175; Annot_ID_140273

SEQ ID NO: 19052 - DNA, 3000 bp, Unknown; identical to SEQ ID NO: 3355
  misc_feature (1)..( 3000): 2750-1469P.txt file - cDNA_ID_1820514; gDNA_ID_1620642; Annot_ID_47519

SEQ ID NO: 19053 - DNA, 3000 bp, Unknown; identical to SEQ ID NO: 3355
  misc_feature (1)..( 3000): 2750-1469P.txt file - cDNA_ID_1820514; gDNA_ID_1620642; Annot_ID_163074

SEQ ID NO: 19054 - DNA, 3000 bp, Unknown; identical to SEQ ID NO: 3355
  misc_feature (1)..( 3000): 2750-1469P.txt file - cDNA_ID_1820514; gDNA_ID_2926195; Annot_ID_141229

SEQ ID NO: 19055 - DNA, 3000 bp, Unknown; identical to SEQ ID NO: 3355
  misc_feature (1)..( 3000): 2750-1469P.txt file - cDNA_ID_1820514; gDNA_ID_2926195; Annot_ID_201372

SEQ ID NO: 19056 - DNA, 3000 bp, Unknown; identical to SEQ ID NO: 3353
  misc_feature (1)..( 3000): 2750-1469P.txt file - cDNA_ID_1820526; gDNA_ID_1620642; Annot_ID_47514

SEQ ID NO: 19057 - DNA, 3000 bp, Unknown; identical to SEQ ID NO: 3353
  misc_feature (1)..( 3000): 2750-1469P.txt file - cDNA_ID_1820526; gDNA_ID_1971821; Annot_ID_176187

SEQ ID NO: 19058 - DNA, 3000 bp, Unknown; identical to SEQ ID NO: 3353
  misc_feature (1)..( 3000): 2750-1469P.txt file - cDNA_ID_1820526; gDNA_ID_1620642; Annot_ID_163066

SEQ ID NO: 19059 - DNA, 3000 bp, Unknown; identical to SEQ ID NO: 3353
  misc_feature (1)..( 3000): 2750-1469P.txt file - cDNA_ID_1820526; gDNA_ID_2926195; Annot_ID_141224

SEQ ID NO: 19060 - DNA, 3000 bp, Unknown; identical to SEQ ID NO: 3353
  misc_feature (1)..( 3000): 2750-1469P.txt file - cDNA_ID_1820526; gDNA_ID_2926195; Annot_ID_201366

SEQ ID NO: 19061 - DNA, 3003 bp, Unknown
  misc_feature (1)..( 3003): 2750-1469P.txt file - cDNA_ID_1820530; gDNA_ID_1620642; Annot_ID_47513
tatgtgtcccagctgaagtaacaagtgaagaggttccctcgtcagaaactcccaaggtagtagaagaagaagtgatagctaccaaagctgaagatgattcgccggaaaaagaagagcaaacggaaacacttgctgcagcagctgaagctgaagaggtggttcctccaattccagaaaccaaaagtaagttgactaaaaatcactagattgtaattttttttgtgtgctacttctcatattggtttattatgatcagtatcagtttatcagaatcatttaaaaagattatacaatgtttgtatcttagaactctatccaaggtaacatatacagctaaagcgttggggatactccaaattatagtagagaccttaaccacataaatagtcacatgaactacgtgttctaaaaaaatccagaataatcaaattcatgaagttttgtttgatggagcaaaaggtgataagaaacatataagaccacaaagataaagacattttagttcattgtgtaatgattactagcattgacccttttcttctaccggtgaccaggtgaagaggaaattgttgagaactctattcctccaaactcagccactgatgaagtttcatctccagaagctttagcaagtgaagaggttgagaaggagcaagtggttgccgaaacacctgttgatgaagtcaagactcctgcacctgtagtcacagaagcttcttctgaggaaagtggcaacaccgctactgctgaaagcatcaaaggtccttcttttgtccatcctttacctgttttacttcctgactcatgacctaatggtttatgtgagattccatctcctaacacaaaaatgtaacaggcatttcaccagctctagtgaagcagctgagagaagaaacaggggcaggaatgatggactgcaagaatgctctttcagagagtgagggcgatatggtcaaagctcaagagtacctccgcaagaagggactagcgagcgcagataagaaagcaagcagagccacatccgagggaagaattggtgcttatatccacgacagcagaatcggtgtcctcttggaggttaattgtgagactgattttgtctcacgtggcgacattttcaaggaacttgttgatgatctggcgatgcaggtaactccaagtttctagctgaaacattttcttcgttttgctataactgagaatataatttgacctgacatgtaggtggctgcgtgtcctcaagtagagtatcttgtaacagaagatgtttcagaagaaattgtgaagaaagaaaaagagatagagatgcaaaaggaagatcttttgtcgaaaccggaacaaataagggagaagatagtggacggtcggataaagaaaaggctagattcacttgcattgcttgagcaaccatacattaaagacgataaggtgatagttaaggatcttgtaaagcagaggattgcaaccattggagaaaacatcaaagtgaagagatttgtgaggtacactctcggagaaggccttgagaagaaaagccaggactttgctgctgaggttgctgcccaaactgcagctaaaccgaaagctaaagaagagccaaaagctgaagaggccaaggaagctgttgcaaggtgagaaattttttatagtctttgctcttcttgacatgaattcttataatgttggctatagaaagattcaaactttttgcaatacggcactgcagcccaccaactacagtggtttcagctgctcttgtaaagcaactgcgtgaagagacaggagctggaatgatggattgcaagaaggcattggcggcgacaggaggagatcttgagaaagcacaagaattcctcagaaagaagggtctctcatcagctgataaaaaatcaagccggcttgcatcagaagggagaatcggttcgtacatccacgattctcggattggagttctgatagaagtgaactgtgagactgactttgtcggaagaagcgaaaaattcaaggaattggttgatgatcttgcaatgcaagcagtggctaatccacaggtaagaaaatgtcctcagctgaaacaatggcataaattggttgttggtctctgacctgaaatgtctacgtgcaggtgcaatatgtttcaatagaggacattccagaggagataaagcagaaagaaaaagagattgagatgcaaagagaggatcttttgtcgaaaccagagaacataagggagaagattgtggaaggaagaatctcaaagaggcttggagaatgggcattgcttgagcagccttacatcaaagacgacagtgttctggtgaaggatctggtgaagcaaacagtggctactcttggggaaaacatcaaagtcagaaggtttgtgaagtttactcttggagaagataactgatgagacagacgaagtaaagttttcaaataagggagctctgttttgtgtcatggagtttaaagtaaaagtcttcctttttgttttgtagacaaaatcttcagtattcacattttgattagtttttaatcaaaacctgtaattttttgttcatgaaaatatgagatttgcattatataaatgtgcatttagtgacaatgtgacattatacactaaattcggagaaagattggttataatgaaattttaaaccttattttaaatagaagtttcaaatgaatttccctgaagaagtgaaactaaataaaataattttttgtttccttttggatattatatctaaatataaaaatcaaaccgaccgaattactacatacactacaataatgtttttttccttttataatttgtgggctaaaaaaggtcggtcggcccattttgagcccaataaaatttagggatagataaagacataaagtaacgaacgatattccgaggttgtcatttgctaaggaaaaaaaaaacgaaaacgtgtgtctgtctcttctcgtagcgtctctcaagctcaggttcgtgaacattccaatctctcaatg

SEQ ID NO: 19062 - DNA, 3003 bp, Unknown; identical to SEQ ID NO: 19061
  misc_feature (1)..( 3003): 2750-1469P.txt file - cDNA_ID_1820530; gDNA_ID_2926195; Annot_ID_141223

SEQ ID NO: 19063 - DNA, 3003 bp, Unknown
  misc_feature (1)..( 3003): 2750-1469P.txt file - cDNA_ID_1820534; gDNA_ID_1620642; Annot_ID_47512
tttcggtaatctattgtgcaaacatcggctaaatagtaattacacaggttcttttaagttttaacaaatcgaaacttacttcataatgtgaagagaggagataattcaaaagttactaagtgtcgcttagcgcccatgcgagacaaatggttctgtaaacgtcaatgtagccaccgaacagggctctgcaagggactcagctgcttcaccgaagccttcaatggctccaacgttctccctagctttcacaatgtcaaacaagttgtttggtagctgagccacaccgtccaagaactggatgacgctcgacatgcttggtctgacggctgcaaccggatgcgaacagaacaagccgagcttcagaaccagtgctacttgctcctcaaggtacttatcatcctgctttaccctctcatcaaccacttgcaatatgtcatcttcccaacaatctagcacccaatccgtaagaaccatctcgctcggcgaagatgctcgtggcaagacgggtcttcgcccgcaagtaatctctaacattagtattccaaacgcgaatacatcagaacttgtgcttgccttccctgttcttgaaagctctggtgagatgtatccaaacgtaccagccacgttagaggtttgaggatcaaacccgtgttcacagagctttgcgagaccaaaatcaccgagctttccgttcatagaatcatcaagaagaacgtttgctggcttaatgtctctgtgaataatgacttgaacccactggtggtgtaaatagcagagaccagaagcaacatctttgatgatcttgaatctttgtgaccaatcaagactctgttctggttggtggtagagaaacttatcaagactgccttttggcatacagtcgtaaaccaaatagagttctcctttgcgcctacagtagccaagaagccgaactagattaggatgtctgagacgcccaatggtcgcgatctctgccacaaactctctcattccttgtcttgaatcatgagaaactttcttcaccgcgatgtccatgttagacgtcgataatgtacctttatatacttttccaaaccctcctttaccaagaagctcgctgttcctgaaaccctttgtggcaatgtaaagatccttgtaagcaaacctatgtggaccaaactgaacctcccagtcttcaagaacttccattaacttcttccttttcaagaaaagcatatagcttatggtcaagaagacgaggatggcgaggctggttaaactcaaactaatagccaagatctttttcacacttgtactccgagagtctctaggaagttttggaagacgagaaatatctatatttgaagctgtcccattgagcttgaaggtccaaccaagaatatagtgagatgaacgaagacggcctgtggctgaagtgaagccaacatacatagagtcgaaaagatatggagataaatctttggttagagaaagcaatggaatctttggcttagggagatgaataggatggattgtgacgttaagttgtctccttgaggaatcatattcaatccaggcttgtataggtttttgatttatgaggcggatgtttttgaaagtaccatcatcgtcttcgtaataacctgctgtagaagctttctctgagctcaagctattgatgtcaataccaacatggttattatccatgtcatcaaattcttgattttgaaatgtatcaaactcaactgctacaatatgattagagggatctccattgtttgtcaaattaaagagccctagatattgtgaggatgaactatagggcaagcctttggtgggagagatgacaaatgcaagtccatggccatcaagtgcattaacattagagactatagcgaaaacaaaggtagtggagaaagacgaaacggtaccgtttggtgagttcttgaatctaactggagagttgtagaaaacgtgaccatatgagaattcagacgaatttgtgagcttcatcaagcctttggagttagtaattgcaattccagagttgtcgtacaagtaaccattaaaaccaaactctccttcttcactctgagaaagtgctttgttggagaagaattgcagcaccagaagaagcactagtacaaaaaatttcatcgttttgcaattcttttttcctctcatgaatgatcttaccataagtttttctttttttggtcaaaaccatatgattataatatgaaaaagatctaaataggctttatctgtatgacttggagggtcaaaaactaaagtcttttagactcttagtaataaaatgttgaataagtcttgttcgacgcctcttattgatttattaagaaattgaccagcatgaaaaggaggcattgctactatgtaatgtctgggggggagtttcacatcgatataggctattgatgggccttagtatgaagcccgtaagcccatattgaagctcgagtcttgatggcgcaggagagagagaaaaagacaatcacctgtagtaatctttgaagactcttatctcctctatccaccaagagagggaaaacgaaataaaaatagcacaggggagagacaaaatgagataaggatttgaagcctctcaccactctcctcgttttcgcttcgtgcttatttgtcaaacgcgaacatttcaccgaaacttagcgacttttctcgctttactctttctgggagcaatttctcagagcataggcgagcttaaaggtagctccttttcttagctttgctcaaatgggtttcttagttactcttcttatgtttccgtgataagatggttcgaaatttactagctttcttaatggaaatttttgagtttttctagttagactacaatgaaatttcaattcgaaattgagaaaaagagtggtccttttcttcatatgctttcagattagtctgtgttgttgtctgaggaaagcttgtaattttgacagtgtgtaatggttttctatgtgtaggtgacagttcttagctatg

SEQ ID NO: 19064 - DNA, 3003 bp, Unknown; identical to SEQ ID NO: 19063
  misc_feature (1)..( 3003): 2750-1469P.txt file - cDNA_ID_1820534; gDNA_ID_1620642; Annot_ID_163064

SEQ ID NO: 19065 - DNA, 3003 bp, Unknown; identical to SEQ ID NO: 19063
  misc_feature (1)..( 3003): 2750-1469P.txt file - cDNA_ID_1820534; gDNA_ID_2926195; Annot_ID_141222

SEQ ID NO: 19066 - DNA, 3003 bp, Unknown; identical to SEQ ID NO: 19063
  misc_feature (1)..( 3003): 2750-1469P.txt file - cDNA_ID_1820534; gDNA_ID_2926195; Annot_ID_201364

SEQ ID NO: 19067 - DNA, 3003 bp, Unknown
  misc_feature (1)..( 3003): 2750-1469P.txt file - cDNA_ID_1820542; gDNA_ID_1620642; Annot_ID_47510
gatgaagtcattttgatttattttttttttttttttttttttttttgtgtgtgtgttttcctgcttatgaaatagaatagttcaaaaccttgcactatataaatatagagtagtttactatatatcgtttctcagaaattcagaatatatggattaatgtttatttatatgctatatatgataggatatgttattgactgagagtcattatattctataactttgattatttgttatggttatttttttcctggtcaacttctcttttgttttaaaatttaatttaattgataattttgtttaggtaagtagtttatgaagagacaaactgaatacaatatattttggaaaaaaatactgcaaataaagagcattaatttcgttacagtttgttactattgcatttcaacgaatccaatatattgttattaatttcaataacgtaacgtaaaactctgaatactttaccagctacttttatatagttaacaaaaaagtatgccaatactgtatatataactttagtttaagtaaaactaggttaatgaaagaaacagttactttaacatatttattactttatacattaaatttattcgattatagatttcaaattatagtactgttcataatcacaatctaaaccacaatattaaaaaaaaaaaaaatcacataataaactcaaaactaatactagcttacaccacagtataaattagaatttttttatttttaatatattatcacacaaccatctagtttcatcatttaatgtgaccaacctttcagcttcaattctaattaacctatgatcacgtaaatgatttgcagcatgactcttcattaatgcgatgtaataatatcaaaattaccgtttcactttcccactataaaaagaagtaacaataaaaattcttcctaaagtttttgcttgcccggaaaaaaaatgaattacatcaaacaatttatcttggcaatttgcttttatctagtcttaacatgtcaagatcatgttttagcccgcgacaccaccacgagagacatcgtagtcccgaagatttccgagtggcaagttacggttgctaacggtttgaccactggtgaaactcttttcatccattgtaagtctaaggaaaacgatctaggtgatattaacctgaagttcttagatagattttcttggaattttggagaaaatatgcttcactcaactttgttttggtgctatatgagcaaagatgatggtcatatgaatgtaaaagtgttttgggatgatgttattctatttcatagatgtgattggaagaattgtgtttggaccgcaaagaatgatggcctttatctttggaattctgcaatcggtgaagatgtactgtcggagaaatggaaatctggatggtgaaaacatatttttgatttgttggtaattttttaactattatatgtatctgttaattttggcaggcaaaaaaaactgaagtaatactttacttttgtcataaattctctcttatttttttgtatttttcatcgaagatttttgttttcttcgatcgtgtcttggattcaattgtttttggactgttcaagacaatggtttgctgctttataatccacctcatcatagaggttttagattgatatataaaggggattcaccatgattcaattcattgttgaagtcgagagatctttgaaagtttattcgagtataatccatattaaagaaaattcaaccatgtattttgatcacgatatactaataattaattatcagtatgagattttatgtatttgttatttatgggggactcatgggtcaatcatttctaagaaagtatggatcatggattcgttttcgttcaacttatttatgaccatatatacaagtactaatggtgacactagaatacattgtatgacaatagtctcttgaaaacaaagtcaaagcattaaatatagagatcggagtcaacaatttagagtttatagaattaaaaggaaaggaggataagaagaagaagaagaagaaaaacttagcaaatatatgaacaaatatataaagacattgtaacacatttacctctgacataagtttttttacatttgacaagaaagattttagaaaaatgggaaaatctttgctaagtttatttgttatcctcctttcgtttgattctataaactcttatttgatgcctcctctcttcagaaaattcaatgtccaaatagtaaatcaacttgagtttcacaagatactgaaagttcattgcaagagcaaatctcacaatttcccaatcacatatcttaaaattggtgaaagttttcagtttaaatttaaaatttatccaaaaactcagtattggtgtaatttatggcaggtgagaaaacacatttttaacttttttatacatttctttacatattgtcatgtataaaaattaagatgagtatcagtgattgtactataaatttttgaccaactttttatttcatctttgtttgttatagggaccaaattacaaacaccatgtggtttttgatgcgtttcgtccagacaaagattttatagatggtacatgtactggtatgcatcctaatgtatgtagatggactgcaaaagaagaaggagtctatgtccgcaacaaaaagttcgaaggagaatatttcatgtatacatgggatggtccatcaaaacttggaaacatctctccagtgtctgcacctacaagtgaatcagaattggactcatcagtctaaccccacatagatctaaaaaaaattatatcatgatgtataatctttggtatcaataattgtatgttggtttcaattacaagcccaactattgtttgggcctaatatttatatatgggccttagtcaaagattaaaaaaaaaacatttcttcttcccaaagccagaaaatatcagtacaagagtacaagagagaaagaaaggaacctcgaactcagagaaattgagagaagagagaagaatcatg

SEQ ID NO: 19068 - DNA, 3003 bp, Unknown; identical to SEQ ID NO: 19067
  misc_feature (1)..( 3003): 2750-1469P.txt file - cDNA_ID_1820542; gDNA_ID_1971821; Annot_ID_176184

SEQ ID NO: 19069 - DNA, 3003 bp, Unknown; identical to SEQ ID NO: 19067
  misc_feature (1)..( 3003): 2750-1469P.txt file - cDNA_ID_1820542; gDNA_ID_1620642; Annot_ID_163062

SEQ ID NO: 19070 - DNA, 3003 bp, Unknown; identical to SEQ ID NO: 19067
  misc_feature (1)..( 3003): 2750-1469P.txt file - cDNA_ID_1820542; gDNA_ID_2926195; Annot_ID_141220

SEQ ID NO: 19071 - DNA, 3003 bp, Unknown; identical to SEQ ID NO: 19067
  misc_feature (1)..( 3003): 2750-1469P.txt file - cDNA_ID_1820542; gDNA_ID_2926195; Annot_ID_201362

SEQ ID NO: 19072 - DNA, 3000 bp, Unknown; identical to SEQ ID NO: 3349
  misc_feature (1)..( 3000): 2750-1469P.txt file - cDNA_ID_1820546; gDNA_ID_1620642; Annot_ID_47507

SEQ ID NO: 19073 - DNA, 3000 bp, Unknown; identical to SEQ ID NO: 3349
  misc_feature (1)..( 3000): 2750-1469P.txt file - cDNA_ID_1820546; gDNA_ID_2926195; Annot_ID_141217

SEQ ID NO: 19074 - DNA, 3000 bp, Unknown; identical to SEQ ID NO: 3373
  misc_feature (1)..( 3000): 2750-1469P.txt file - cDNA_ID_1820574; gDNA_ID_1620643; Annot_ID_47537

SEQ ID NO: 19075 - DNA, 3000 bp, Unknown; identical to SEQ ID NO: 3373
  misc_feature (1)..( 3000): 2750-1469P.txt file - cDNA_ID_1820574; gDNA_ID_2926213; Annot_ID_142104

SEQ ID NO: 19076 - DNA, 3000 bp, Unknown; identical to SEQ ID NO: 3378
  misc_feature (1)..( 3000): 2750-1469P.txt file - cDNA_ID_1820585; gDNA_ID_1620643; Annot_ID_47532

SEQ ID NO: 19077 - DNA, 3000 bp, Unknown; identical to SEQ ID NO: 3378
  misc_feature (1)..( 3000): 2750-1469P.txt file - cDNA_ID_1820585; gDNA_ID_2926213; Annot_ID_142099

SEQ ID NO: 19078 - DNA, 3003 bp, Unknown
  misc_feature (1)..( 3003): 2750-1469P.txt file - cDNA_ID_1820589; gDNA_ID_1620643; Annot_ID_47531
atgagttatgggttgacccaacccattttattatgagttgagttgagttggattacccattttgacacttctaatcttatgtaagatttttttcattatagttatacttttgatgggaatttttttttttttgttaaacatttttgatgggacatccgatataataattctggtgaagagctattttttttatctaaagatttttagttagagaggtgttaatagttatacttaactaataaacgccgagaaaacaacagtaacaactcaattaacaaagactcgttaaaagtaaaatacgtttatattaaagatttaaagtgataggcaaaatgaaaaagaaaatggctaaccatgctcatcgtttatattatttaattttcggatcttcattaggcttataaatttatttttagttgttaacaaaaagatttctctttatactttagcttttgtaatcttgtttggccaaactctttttgaatatatattacatttattggtgagcacattgattattttatgtagccaactaaaccatcatcactatattggtgtctacgtactgtctacttaagtactgttaatggaccacgatttttaagatataaacttacaaaatacatgtttcaatcaaataatgataatcgttgatagttcaaccaattacactaaaaaacattagaggagaaagtggaccaaatcctgaatttgattgccaatgacgggggaaaacatagtgaaaatgtttaagctccgaattaaaaagaacatagaccgtcgtttgaattggtttactatctttacgttcaatcttatatcgatttgttttggtataatttcattttgataaatccaaaatggtttaaatcagattgtatcctatgttcctaactactagttagaataataatctatttttaatattgattttaattcttctgatggagtatataatagtgctcgacaatgtcataatcagtacaaaataaatcacctaccaacctgaactatatgttatatattttgaggggccacgtcaagtgtgccgtttatttttgtgtttatgattgtttaatatttgtgcgtgtgatggtgtttcttgcttagtttccacttaatacacaatcaaatatcaagtggaactatttatgaaaattgttcttcgagaagaattctgaccctaaaaggtcatttgagggcttgaggcttattgtttccaaattacaccagtaaacaagggtttttttttgtcaacaaagattattgtaattcgaatttcgtctacaataaaacaaattttcttactaaaacaaaacaattagctgacggttgatatttcggcttttgagtttaattaactaattggtgattatgttgatgatctttcacacctaatgaagtgtcatgtatatgtatatatgtatatacttatgtatatataaaacgtacatataatcatttgtcatatatatcatcatgtattgcatgactaaactacccttaaaagaggaatacgatagacatgacctttaggaatttgtttttttcttctaaatggattccttcgcttctttttagcctcgtagtgaatttgaacattgcagttatttctagtaagatattttttctgtatttttcggaaaatgttaaaaactaattatacacaatttactttctctctcaactcttattttacgttactgttttttttttcctcttgcaaaattagagctgctgtatttacatttactagtaatttggtagatagacagttaatgtagtatatagatggggttgagggcaaatgattacttgggagatggtgcaatgcatcagagtgatgatgtggaatttaataagtgtgaatttatgggcaaaggaagggaactagtagtagaaagggaaataaatacagtacaagtaagaggaaaacgaaaagagagatagaaaccataataatgagttaacgcagacatagccgccattttcaacttctcactcccacttacaacttctccttctgggcaagttttccacatcaatgctcgtcttaatcaccattaatctctactcatcattaatacgttgaagcccactatttcaaaatttactaggagtatttattcgtgaaaaacatttaaatgtccctaattataagagatttaatttcatatttattgtattaaagagaatttacattagctgtcaaaaaaaaaaaaaaaagagaattaacattattttacagaacataaaattttgaaaatagatagcgccactgcatgtaagaacatacaaatttctttttttcaacaaaatctatttatatttcttctttttttgaacattatgtgtagtttgtagtaaactaaaaagtgtgaccaacacaatttaaatcattcgattttgtagcaaaaacatttttgttccaatttccaagcagcaaatatggtaggaatataaattctttactatttttcctcttaacacataaaagtaaaaaaagcattcaatgatcagttaaaatctggttagaattctaccttatcatttagaactagctaatatttaaattcatatatacaaaaaataaaatgggaactgtagagactagagactataaatagaggattgagaagaagaacttttaaagctctatcaatcatgaactactcgccttctccaacttttaaaactcatcataaatagtaaaaaagtagccggaaaaataaaataaaaagtctatttctctttcctttaaaatccaaatcctataaactcatagctttctctgttctttacttatacctcacgttatacatatatatagagtttctataaatgcttctctttcctctcgaacaaatcttcctcacttctctcatttccacactcaccttcctctctatatattaaaccctatctacttaactcttcttctaactctaatctctctctctatttactctgcttctgttctcactctgaaagaaccaaaacatg

SEQ ID NO: 19079 - DNA, 3003 bp, Unknown; identical to SEQ ID NO: 19078
  misc_feature (1)..( 3003): 2750-1469P.txt file - cDNA_ID_1820589; gDNA_ID_1620643; Annot_ID_163104

SEQ ID NO: 19080 - DNA, 3003 bp, Unknown; identical to SEQ ID NO: 19078
  misc_feature (1)..( 3003): 2750-1469P.txt file - cDNA_ID_1820589; gDNA_ID_2926213; Annot_ID_142098

SEQ ID NO: 19081 - DNA, 3003 bp, Unknown; identical to SEQ ID NO: 19078
  misc_feature (1)..( 3003): 2750-1469P.txt file - cDNA_ID_1820589; gDNA_ID_2926213; Annot_ID_202783

SEQ ID NO: 19082 - DNA, 3003 bp, Unknown
  misc_feature (1)..( 3003): 2750-1469P.txt file - cDNA_ID_1820595; gDNA_ID_1620643; Annot_ID_47529
aaaacgtctcaagatatggtgaaatctgcaatctttttttactgtctttttgttatgatagataaggaatctgcaagaaccaatgatcactcttttcactgtatcaaggacaaaagaaagagagaaaacaaaagagttatacagagagaaaacgtgaatagagagatcactgtacttattgggttttgatctttgatggctccactgagtccaagagtagtggtgaaggtggatttgaagaagaagccatggcagcaggaccagccattgcacaatagatggcatccggagataccaccagtagcagaggtcaaggctggtgagtttttccgggtagaaatgattgatgcaatgggaggtgttatcaaagacaatgactctgcaagcgatatcaagaacctagtcctaactactgtaagtgggttttgtgagaaacatgtgaaaaatcaataatgaaacaatgagtttacttttaaagaaaaacaacttttggtgatatattgtacagactcatcacctaagtgggccgattagggttgtagatgaggaaggtgttgcagctaaagcaggtgatcttcttgctgttgagatatgcaacttgggtcctcttccaggagatgaatggggattcactggttcgtttgatagagagaatggtggcggtttcttgactgaccatttcccttgtgcgaccaaagctatttggtactttgaagggatctatgcctactctcctcagattcctggtaagaagaaaacaattcaatgtcttctatcaagaaacttagtagcataaccatgtagctttccttgttatgattcgttctgttgaatattcaaatgctaatattaccccatcatggcaggagtacgatttccgggtttgacacacccaggagtcattggcactgcaccatcgaatgaactcttgagaatatggaatgatagggaaagacaattagaagaaagtggtgttgagtccctaacactatgtgaggtagtgcatcagcggccattagcatgcctaccaacaactaaaggatgtctcctcgggaatgtacgctattttctgatgctataacaaagtttttgaactgtataaatagtgcttacctctgaattcccagggattcttacataatcctcttgtagattgaagaaggaacaccagaatgggaaaggattgcaaacgaggctgcgaggacaataccaggaagagaaaacggaggaaactgtgacattaaaaacctaagcagaggctctaaaatatatcttccagtatttgttgaaggggctaatctaagcacaggagacatgcatttctcacaaggtgatggtgagatctcgttctgcggagccatcgagatgagtggatttctagaactcaagtatataacaaataagttctctcgactatgcattctcagatgttcttgtatttgtgcagcgtattataaacaattctgaccagataccatgttgtaactccttaataggtgtgaaatcataagaaatgggatgcaagagtaccttacgccaatgggacctacccctctccatgtaaacccaatctttgagataggaccagtggaaccgaggttctcagagtggcttgtcttcgaaggtatcagtgtcgatgagagcggaaaacagcattacctagatgcaacagttgcttacaaacgggcagttctcaacgccatagactatcttttcaaatttggttactcaaaagaacaggtacttgtctttgcagcttgatgtttcttccagaatctagttgatcacacaccaaacatccataaattaaaactacaaagacagaagtgatcaagagaatatggtgtgaacaggtgtacctcttactctcatgttgtccatgtgaaggaagactatctgggatagttgattctccgaatgccgttgctacactagcaatacctacagccatctttgatcaggtatcaattttgcccctctgttctttgcataagtcaaaaagcttctgtataaacctcttgagtttactctgttcttcaccctcgtctctcaataatttgttagcaactgaaaagataggaatgcaaatatgttaattgcgtttgtatgttaatgcaggatattaggccaaagaatcggaaggttccagtaggacctcgggttgtgaggaaaccagatgtactgaagagcacatatgatggaaagcttccaattacaaagaatccaagttcttcctcttagcttctacaaaaaaattaaaattaaaatttagaagctaataccaagattgtataatcaagcatatgttccaataataaagcaataacttggtgttttctttagttggcgtcttggagattccacataaagcaactcacgaaacgagaaagcacacaaagggttaaatttgcaccattcaccgagtaaatccaagatcttcgacataatatagacaagcaactctctagatagtataatcagaaatgtttaaagagagaaatggtttttttttgttggttgcaaattccaaaatcaagaaactatagaaattggaaggtaaatgatatgcgtccttaatctatatgcactatctacagattctgtctcaaaaatagcttactttgaattgcaaaactgcgcaattactaagtcgaatgtaatattcctctctccggacattagaaagaccttattcagaacataagttaagaaaatgtcattttcaacttcttgtcatctatgcattaccacacacagacacaaagagacatacgtgtcttatggcattataagatgaatgacagtcatttgtctagatatagaaaagtctacaatatggtgaaagagggatcttttactgtcctttagttgtagataaggaatctgcaagagcaatgattccttaatacaagaggggaaaacaaaaaacaaaaatatattaacatagaacgtgtgagtagagagagaatataaattaccgtacttattgggttcggtttgatg

SEQ ID NO: 19083 - DNA, 3003 bp, Unknown; identical to SEQ ID NO: 19082
  misc_feature (1)..( 3003): 2750-1469P.txt file - cDNA_ID_1820595; gDNA_ID_2926213; Annot_ID_142096

SEQ ID NO: 19084 - DNA, 3003 bp, Unknown
  misc_feature (1)..( 3003): 2750-1469P.txt file - cDNA_ID_1820598; gDNA_ID_1620643; Annot_ID_47528
atttatagaggggagtgaataataaagagagtgtgccaacttgtgtttcttttttattcctttgtcctttcttttccattatttctaattaaaaaaccatgtgtattaattatttgaaatttattatggggaagacagaaactcaaaggagattgagataacattttgaaaagttaaaatacttatgtgaataaagaatgggtcatattgacacaaataaactagtttttcgatcattaattcaaacttgagttgatttataagttgctggtttcaattttattggtgtgtagaaaatgtaaaaagagagaaagtgaggacgaaaggacaggacagagttagggagggattccaaaggtattggcgttgggggaagagagagaaagagagcgtttccgtttctccgcgaacacttgtcgctgactcagactcctcttatattagtattactttcttcttttaagttaaagtattaaagatgtgtactcttctcttttttataagagtacgtactatataatgaaaacaaagctgaatttgggatttgataagttatagacaaatcttacgtcaggagacgatggggtgcacgtggattagaggaaattattggttcagagttgtttgtatttttatgggatgtttaggattttagtatagaaaaatgaaaactaggttattggtagttattgtgtgttacttgatgatgctaatcttcgggtggtgaatgaatcacatttttttagggtttaatcatttggagggaattattgatacaaaaagatactgaaatcaataagcaaatcataagaggacaatgtgttaaaagaaagtaaaaaaaagagaggaccaaatgttgtgcgtatcttgctacgtattcttcttctagtattctctagctagtagctagacacacaataagaccaccctaatacaaatttgaaatcactgttttatgtctcaactttaaacgtttgttattaaatgttaacgatgttcgtaaagaggggcatacatgagcaatatccacgattgcctaactgtgtaaaacttgcgtcaatgtacttcacattcctccaatcactttggaaatgtaaaatgattatcaataaataactagagaggaacgtggtgttcatgagtcatgtcctcgtcgtcttccacaaacgcatgtgtctccataggtataaatcagaattgatatagtacaaaaaagactcttaacttattatatattgagtgtttgactctacgtacctacgacacaacataagtatttgcaatctcttggaactacaaaagccgttattgacttattggcccttcgccatattcaaaggttcttctctatgcgtgcgcctttccctttctcgtacgtatatataggagtatagtttttaaaacattttttttctgtcgtcgtctattttttaaaacatttatttatctgcggcgtagagaaaatgtaaaagggaaagtgatttgcaaatttctcagtggcgaatttacaaaacttctgacctaataagagaaatttctagctcacatcatcttccacactttgtcggaataggtctcaaactactaaaagtattacaattattcatttataaatacgatatttctacctgcaaagcaaatgataatttaatggactagtgagtattgacactggttcagtatttggttgatattttggtttaatgtagaaaatacgaaagaagaagaagaaaacagaatagtgatgtaatggactgatcatttaacttagataacgatttcataaaataatagcaattccaaaatttgagaaaattatcaatcaactactacatgtatttcttttttctaatggtcaggattcaggaagaaaatctggaagtgtatcttcgctttctgctttacgattgattaaatatataacatttcgaagagttttctactaactgttggcaacagtctgttgctgtcggttccgacgttgcaaacttatccaaaacagcatttagttctgtgtaccgtacagttgaactcgctggattgtaacatgcaaagttacaatcatttttttttttaattcgcctgatatatgacctgattagattttagtttttcatagaaatttaaacactaatctcatcattttcaaactaattaataacactagcttacgagactccggaatccaaacttttctttctttcatattttcttactcccacaacaatatcaccaccatttctcctcgtactgttttgtattttatctcatttaactttatcatctttaaccctttatcaaccatgccaaattgcaaaatatttttttgttttgtttttgttgttatcccatttcagttgtcaattagaagcaatgatacaacacctttcattcaataaataaacaaaatttgatggtagccaccaaaataaaacttgatgacgccaagcgtgtaagccacaaccacgaaaaaaacccaacaaataaacataaatgaaattaagtcaaatgaagattcgattagattttttggacaaaatctgtcggatgcttattcatagcatctcctctgttacagcaagaatgaggaagtacggatcaaagagtgtttgaatggttgacctgaagaaggagaagcaattgagcttaagactctctgattcttttcataacataagtcaagaaaatgtcattttcaactttttggtcatgcatgcattgccacacacagagggagacacatgtcttttgatactatccacttggttcagaaaaaaacaaaaagtcacactttttgaaaaagtgaaaacgtctcaagatatggtgaaatctgcaatctttttttactgtctttttgttatgatagataaggaatctgcaagaaccaatgatcactcttttcactgtatcaaggacaaaagaaagagagaaaacaaaagagttatacagagagaaaacgtgaatagagagatcactgtacttattgggttttgatctttgatg

SEQ ID NO: 19085 - DNA, 3003 bp, Unknown; identical to SEQ ID NO: 19084
  misc_feature (1)..( 3003): 2750-1469P.txt file - cDNA_ID_1820598; gDNA_ID_2926213; Annot_ID_142095

SEQ ID NO: 19086 - DNA, 3003 bp, Unknown
  misc_feature (1)..( 3003): 2750-1469P.txt file - cDNA_ID_1820602; gDNA_ID_1620643; Annot_ID_47526
gccgtaacttctacgccggaagttgtcctaacgtcgaacaaatcgttagaaacgccgtacagaaaaaagtccaacaaactttcaccaccattcccgccactctacgcctctatttccatgattgtttcgtcaatgtaaaacatattttttattgatattattttcttgcgtaaaattatccattatttggtctaaataattgattaatattcataggggtgtgatgcatcagtgatgatagcgtcaacaaataataataaggcggagaaggatcatgaggaaaatttatcgttggccggagatggattcgacaccgtcattaaagctaaagaagctctcgatgccgtcccaaattgtcgtaacaaagtttcatgcgctgatattctcacgatggccactcgtgacgtcgttaatcttgttagtaactcaagcttatttattctattaaattaaaacattagtataagttattacattaaattcaatataggcgggtggaccacaatacgacgtggaattgggaaggctagatggactatcatcaacagcggctagcgtcggagggaagttgccgcatccgaccgacgatgtcaataaactcacttcactcttcgccaaaaacggccttagccttaacgacatgatcgctctctccggtaagatttgaactacttctcgatcataaatagtatcattcgaaccaaactaatagctatgtgatttaatattccggtttagctaactggatatcggacccgaatttgattagtatttaagttggtttatatatacccgaatttgattagtatttaagttggtttatatttccggtcctaatttagatttcgtttgatcttaaacatctcaggggcacacacattaggattcgcgcattgcacaaaagtgttcaatcggatatacactttcaacaagacaactaaagtggatcccacggttaacaaagattacgtgacagagctaaaagcgtcgtgtcctcgaaacatagatccaagagtggctattaacatggacccaacaacaccaagacaattcgacaacgtttactacaaaaacttgcaacaagggaaaggattgttcacgtcggatcaagtcttattcacggatcgtcggtcaaagccaaccgttgacttatgggctaataatggacagttgtttaatcaagcttttattaactcgatgatcaagcttggtcgtgttggtgttaaaactggtagtaatggtaatatccgtcgtgattgtggagcttttaattgatttaaatatatctgtattagattttgtttattgtatttgggtataggatgggtcatgggtctcataaagctggttcagctaaattgaaaattgtaataaatctctgtcttgggtttcagtttgcaaaacctaaactgtaattatagagtggaggaaataagaagtatcgtataatatttatcaagggataaatacaggccatccattatgggccgcgtaagagccaatgccaaattttaagaattttcttaaacaaattattatgaaaaaggaccaagaatgctggatgctcctacatacatataaagttttgataaaattaaaataattaacgtctatatccagaataaagtcaatgagcattatatatccaaaactgatctttccacaactatacaatatggatgtgttttttttttcttttggttgcattctgatatgttccttcctcttgtctgcagcgattacttgttattttgggttattcgtggaaatacaattcaaccatttgttttgaacgtgtaagataagtaatatatggttaaattatttaccatttttctcaatcgattagacaaaggacctggtgttattagaatataatataaatgacaaacaacagaaagaagcgtgattgcccttacttagatttttttggacaaacccatacttagattagatgcaagagtagccctttttgaatgactgtaatcttgtcaactaaagtttttgtttctttttaaaacgtcaactaaagtccatatcaatagctaatcgcctaatcatagataaaaactttaaaatctatattaaaccattagcttctgaaataaagtaaaacagccctaaataaaaccatgaccatgtcaactaattcggacgaccatgtgtccatgtgtagcttttcttttctagaactacgagatccaaaattaagcagtgtttcataacgaaataactaccgaatgtaatgaatttgatggatagatgatcatgttattttcttaagataaaggtgtccagaagaaattaataaatatcttaattgttcaaaaagtgttacatttttgccatcaaaatagaaaaatgatgatgaaatagcgctagacgcaaatcggaattttgtaaaaaaatggtatggtaagtaacaagaatatgagagagagagactatatgaagtccttctatcatctttagttgttacttgttaagattgaggttaccgtagttgattagactaattaatattagttgatccaaaaaagtatgatattcaggagtagtgtagagatttcggaaagattcaaggtgaccattacacaatacttaaatactattcgcaatgacaagtgaagcatcgttatcaacttctccctctcaatccccaccaccactctctattacctcatatagatagatcatcctagtgatcatacacacaacattgatagcgaacaccaatagtatgctatattcacaacaaaacaaaaatggactaattcatttgtttttttgaagtaaaggaattgaacaataattattttattttttttgggaaatactattcaagtatttgaaattagaaaagtatttagtctttttctctttaaaatatgaatgcaagctggccgctggccggcacacacagcacaaagcatgtatataagatctctcactccatttatgtaattatacatataaagagaaattgttttttttttttaaatg

SEQ ID NO: 19087 - DNA, 3003 bp, Unknown; identical to SEQ ID NO: 19086
  misc_feature (1)..( 3003): 2750-1469P.txt file - cDNA_ID_1820602; gDNA_ID_1620678; Annot_ID_164325

SEQ ID NO: 19088 - DNA, 3003 bp, Unknown; identical to SEQ ID NO: 19086
  misc_feature (1)..( 3003): 2750-1469P.txt file - cDNA_ID_1820602; gDNA_ID_1620643; Annot_ID_163097

SEQ ID NO: 19089 - DNA, 3003 bp, Unknown; identical to SEQ ID NO: 19086
  misc_feature (1)..( 3003): 2750-1469P.txt file - cDNA_ID_1820602; gDNA_ID_2926213; Annot_ID_142093

SEQ ID NO: 19090 - DNA, 3003 bp, Unknown; identical to SEQ ID NO: 19086
  misc_feature (1)..( 3003): 2750-1469P.txt file - cDNA_ID_1820602; gDNA_ID_2926213; Annot_ID_202777

SEQ ID NO: 19091 - DNA, 3003 bp, Unknown
  misc_feature (1)..( 3003): 2750-1469P.txt file - cDNA_ID_1820609; gDNA_ID_1620644; Annot_ID_47563
cctcaacttgtacctttggaccagtactatatagtagtgtttatgtagagacactcatgtgggtgagtgtatgtagaggttgatggggtataagtgtgggcaaaagggtaagaataatgtgttggctttatagataagcagcttaggtttcctttgtcttttttaactccttcctctcattttcttgatttgatagctactctctcctttgctttcaatgcccccaaattgacttgttttggttttggtttcacacccggtttgatctggtttagaattcagggaacttaaacaaaagcataccgggtatgtaagtcaattagtatacgttttaatcacaaattacattaaatttcggtttcatagaaggaggcagatattataattgataggaacttgacggtagtactagtatgattaagttagttaatttttgtttcatttaataacactgagaactattaattggtagttaagctcatttgtttctttagtttaaatgagtcttaaactcttaatgctttagaaaaatattatgtaatttatacgaatgtaaggaaaaacaaaaatgatgaatcagtttaattgtttcttttatattaccgaaataggtaaagaggcctagaagtgggaacttttaaggctcttatggaagaaaaagtgcaaaagtggaatttaatagtacaatctttttggtctaaaattcatctttttagtcagatgctagttaatctaattaatagaaacgacaaaaaaatcgaaataaaaactaattaaagaaatggaaaaggtgggggaactttgagaaatggccagctcttcatgccagcttttgtcttccatcatccatgtgtatatctacttccttttttttttttttttacctcaataaataaatatcgccgctctttttttttatatagattttatgtgtattagttgaacaaatagtataaattattgaatggcaaatccattttccaatcttcttcatacactcaacaaacactgccatgtatttgatattggtttcggtataaacctaaccaaccatagcttatttaaaaaccatagctttatgaacttcaatttattcttacagattttggttcagtttctattccggtggtttgtatcggttctgtctaacttgattgaaaatggtacaatatgctgtaatcgttataaagtggccttaatgaccgttgagaattgagatttagacatgatctaattgtattaacaggctagacatgatcatcgcttgttcatgtatctttttaatgaatgaaatttcttaaatgttctcgtagtaatcccaataaccaaacatactcgtattaatataagctttgcggtcatgtcggccatattgttcgaatttaaatgagtttttttttggtataataaacgctgaatacttttgatataaaataagtagagtggatctgatcttttgaagaataataattttagataatatataatttatgaggaagaagacgacaaaaaacacttttagaggaagaagatatggatgatctctctcgattctcgaatctttcccctcgttacttattttttttttgtcaacttcccttcttgcattaaaaatctatacattcattttgactgactctttgaagaaaatttttaagaatttttgagtttgggtttcaacgaagtaacttcgtcaggacttggtactaaaaaacgatattgttgatctcatttttttttttttttatccaagctgctgcgtggaatcatatcgtcttttggtttgcatttgatgtacataaagaaaaacaaacaaaccaggtaacaaatcgttttcaaagaaaaaaaagaaaaggttctttgcgtgattttaaaagagatcaaattttttatataatatttgtagatcttgagtcacatggatgtactactggactttttgaaaaggttcttcgtgcactttttagacattccttcttataaaatagtatgcatgggacctttaccaattaactactaccatcaattattcatcgatggactccaattaatttcaaatttgtttccatatttttgtgtaacctaacaaaatccaatcattcatcgatatatcactgtccttgttttgtgttaaataatgctaatttgctctgctaattgactattcttcgatttcgatatctattttcttgttaccaagtttaatctcgaattgtcacattaattttcatatttttgatcagtcggtgcgtcaatttttgtgagcggagtattaattatatcgtttgtctttgtctttgtcttaaatccaacaatgggttcgtggaccatttcctgacatgtttattgcttctttcaatcatgtccgtccaaatcccgtagatctcagtgtatattaatacgtacaatcccactttagcttttatttctgtcttcaaaggaaaataagaaaaagaaaaaatcgtatgagagcttttgtggtccaaattgtgactaatttttttgaaaatacgtttgtgtttacgttatatacacatttacgatttacatctccaattgttatatgctttcttgaaatttcgaccgggatattatatgccttgtccaagaaaaaagaaagagagacctgaatcttggaactaagttatttgggggtgtcactcatgggccaatattgggtccattttgaaaagcacatcactatttcaacccaattaatgagagtcccatactaacgctgatgttactattgtaccgaaccagttttgaagcccattaaaagcccaatacgaaagtacgtttgtaaatttgggagcccaagaggggtaaatatggaataaaaaatacgcgatgtggacaaaataatttacagctactatctctcctccgtcttggcttcgtggtggtctctctgacattatcgtcagacaaataatttctaaatatctctcctctcctctcgtttgattccaaaaaaaaaagctcatcgacgaacgaacgatg

SEQ ID NO: 19092 - DNA, 3003 bp, Unknown; identical to SEQ ID NO: 19091
  misc_feature (1)..( 3003): 2750-1469P.txt file - cDNA_ID_1820609; gDNA_ID_2926217; Annot_ID_142278

SEQ ID NO: 19093 - DNA, 3000 bp, Unknown; identical to SEQ ID NO: 3388
  misc_feature (1)..( 3000): 2750-1469P.txt file - cDNA_ID_1820613; gDNA_ID_1620644; Annot_ID_47562

SEQ ID NO: 19094 - DNA, 3000 bp, Unknown; identical to SEQ ID NO: 3388
  misc_feature (1)..( 3000): 2750-1469P.txt file - cDNA_ID_1820613; gDNA_ID_2926217; Annot_ID_142277

SEQ ID NO: 19095 - DNA, 3003 bp, Unknown
  misc_feature (1)..( 3003): 2750-1469P.txt file - cDNA_ID_1820619; gDNA_ID_1620644; Annot_ID_47560
ggtttgggatgtcggagaagattgtggataaggtgagtcgatgaacaagacgctgacgctgtcactctctccattgcaccaaacactctctaactttggtttctggtttctttttattataataaaccctttcaaatatgattatttcacaattaagaccctaaatgtttgattatttagaaagtaatctcacctaagtatctcacggttcagattgcgccgtggttgttttgggtcgttgtataatgggccaaattaggcccaattcgacccatttaaaaaatgatattctctccttcttttttgttggtgggtcactcaacaatgacattctctactgttttgcacacgctttcctgctaaaacaaattaaaattggtacggaccgacacaaatcggagattgatgacgaatttttataaaacataatttaatatttgatagattgtctttttctagccttattaatttccatttcaggtatgtttaagctagtaatttactaacaccaccttttttttttgcttttactaataccacgtattgttttattttctcttttatttcgacattagcaagcaagggaatttaaagatcacaccacatggcacgtgagaaaagaaaagcatacacgtgagccagctgtgcaacgatgctcaaaaaggtcctatgacaactacttagcttcgagaagcaggcactatatatttatcgcataacggtatttatttcattcaataatctttttgttgcataaatttacaaaaatttgagtgtgtgatgtgtacatatttctgacgaatactttttgttgcattatccaaatttttacatgttcccgagccgagagtctaagacgacgatttccaaattattgtcgttgctgttattataattgttaataatagtaagaattattattattatttaggacacgcaagattccacatgatactgcttaagcactacgtcgagctaaaatgaaatactcgatttaaatgaactaccccattagttacttgaagatgaaacgaaacaatttggttttggtcttttggatcatatagttaaacgttatgtatcttactcagtttattttaatgaagtttgttgtttggtatatcaattagccttagatgtcaaatcaaaacgaaacaaaaacatgaaaattcaatttggcgttaaatcaaaataataattaatattccatggataattaatatacacttagcaaattaccgaagtacccttgctatctcgttgtcgtcaataatcaaaattacagtattaacccaattaagagcgtttagcgtctacgtgtaaagcggtatcaggagaaaggagcagcgatcacatgggtggcttaaatctatatcctccggttcctcaccggccaattattctcgcgcgtgtctccgctcctctctgatgcgcgtcactcaaaaagtttgagtcaaactccagtaatatttttgatttattttgtattttcaagaatttcttaaaaattgctgttacgtaatttacaatgcaatgtctcgcggtaaaggtagagccggaactcaagtcagatcaatctccgtgtatgattgtgttcgcatccaatgttaataatttcaggatttgtattttccaagttaaaggatactattgttaactaacgtatatgctgacaaaaaaaataaaaaaataacgaatattataaatttatatcagtcgcataatgaaatgtgtaatttcacccagacaaaaatatctctacagaacaaaaaaaaaacgtttgttatatatgtttattctgtatatttaaaatgtagtctaacgtttgttctatatgtctacaatgtgtatttatatttaaaacatattccatccttaatttgctttatattattgttacaccattcatagtaatggaagaaatatctattggcattctatactttatgatatatatatatatatgaaccaaagtattgtatgtccaactgggacattttatatgacggcggacgaataaagcttagcagatatatatgtacgtgctggtaactccatattcattattttggatttaagttgtaactccatacacaatacacattgatggattagcattgcattttttttatggcattttatatcaaaagattctcaatcaaaacttagatagattcctaaagcttgtaattaaagcatcaaacatatttgttaaccagttattatttttgaaatcgagtagtgttttgttgatgctacatattattccatcataaaaagaaaattaatgtgtgtgtaagtgtgtttgaaataagtcaatatcttagtacagtaattaactaattatacgaagaagaactataagggtaaaaacggtaattacagtatttggtcagccatagttattcccgctcgtctcttgaaaaaaattcaaaccggtaaaccattttggtcatacacgttacagtaacacggtggtctggtcttcaataataaccacgtcagcagcatacagtaaaaactactttaaatgtttttttttattctcacccaagaaaataatttatttttgttttgtcgttctccttcctaaataatttttcaactaccacaattaatttaaaaattaaaaatagagtatatttggaaaggcacaaaaaaaagaaacaaaattcaaaatctgaaatttctcagcctcctcgtttcttcacccagaggagagagaaatctgaggaattcgatcttcgcttaaagaagacgaaacaatctctctctctttctctcttcaatggtctcaccatctctgtctaccatctcctagccaaagaagaagacgagaagaagaagagagggtcacaacaatgctttattcttcttatgtctccagccatgtgagctcccactgacacattctctgcatcttcggaagttttgttttggtttgattcttctcaccgattcctgcgaccgagtttgaccctcgagtttcgaggttagtggatg

SEQ ID NO: 19096 - DNA, 3003 bp, Unknown; identical to SEQ ID NO: 19095
  misc_feature (1)..( 3003): 2750-1469P.txt file - cDNA_ID_1820619; gDNA_ID_2926217; Annot_ID_142275

SEQ ID NO: 19097 - DNA, 3000 bp, Unknown; identical to SEQ ID NO: 3391
  misc_feature (1)..( 3000): 2750-1469P.txt file - cDNA_ID_1820647; gDNA_ID_1620644; Annot_ID_47552

SEQ ID NO: 19098 - DNA, 3000 bp, Unknown; identical to SEQ ID NO: 3391
  misc_feature (1)..( 3000): 2750-1469P.txt file - cDNA_ID_1820647; gDNA_ID_2926217; Annot_ID_142267

SEQ ID NO: 19099 - DNA, 3003 bp, Unknown
  misc_feature (1)..( 3003): 2750-1469P.txt file - cDNA_ID_1820651; gDNA_ID_1620644; Annot_ID_47551
ttagcatatttactgcagaaaatatattcaggacttgtgaaagaacttcaaaagcaggaaggacccttattttccaactaatcacaaccataaataaatggaaaaactcagaaatctgatctcaccaaactaaaactaagagactaaaacatgaaacatgcctggagaaggaaaagcttctgtgttgtgatgaaagagaacacttgaacattttatatgaaccacaaagacacaaataagagaagacttcttgtcattataatattaggattatacaagacagtttacttagaaggtgatcaaccacaactgaagaagaagaagaagaagaaaaacaaaacaaagattaccgactttatctgtaatggtcacccactatgcttgaggactaagtcacgttttaccaaatctaaacattgtttaatcgaataagagaggtaatgcatggtcccacagaccatgcttctccttataaaatgcatatacatctagtgtagagaacaaaaaaataagttatcatactctaaactttgaaaagtaacttggattataatatatgtacacgcaaaatcaaacataaaaataatagctttgtagtttttgaattcatcaatggagagggagacaaggtcagtcacaaatgcgtgtttaaaggttaaaaaaagtaacttggagtttacttagtcaaaactcaatgaaaccttatcaattgcaccaacagaacatttaatcattatcacaaaatgcatctcaatcttgaaccagaatactaagattttgcgtctataaagtgcgtgtcttgtctacatctctaacaagcaagataaagaaacatgcaaaggagctgtttttaccttgtgagtgagttgtcttcttcttcctcctctaaagggaataatgcggttccagaaagaatcctcttgtgtctcactcttcgcactccgaagctctaaactgcaagcaaacatccactacagaattcagcaatgacaacacagattcgaaattttgcaattgttttgtacttctccattagtgactttatcaatgaatgacacaaacccaaacaacaaaaccagattttgaaaaagtaactattatcttttggggcacatgaaaaaggaaagtagtcagaagtagtaatccaagatgtcacggttgagagaaacaacaatgtgaagttttcttctgaaagggaaccctaaagagtgccggaattggaaacacaacagtgctcaccggaaaaccaaaagaaaacaaaacggaaagatttgtaaaagaaaaagagagagaaatgacaatgttaatcccacccacttcctcctgctactgcctacaagtttggtagttgtttgttcttcgtcgtagtcgtcgtcgtcttcttcttcttaacttttgtctgaagggaccactccattgatttggtcccaaagattctctcttttcttctattcgccggtttctcagactctctctctctcggcttgggtagttaatgaccggtttacccctgaaacttaattaggaaccttaaacccgccacgtggacctcacactccacttcatcgtagcccattagtgagagaccttttctcccggcccagaaggtcataatgatattttgataacaaatataatggatatctagcccaacattacaagtaaagcccaacatttagcaatgatgcacatggcaggcaaactctcttctttggatgctctgttttttataaaaaccataatctatattttcaacagaagagaacattgtaattatgcaaatattgattctcgtgtttatgaatagggtgcgtcaaaacttttctttcaaattttacaaatgccaaagtgtcataaaacaagctacaaaagaatgtttatggaggagagaaagaataaactttgggatgaaaagaaaaaaaaactaagataattgtgaagatgttagttaaatgaaattgagaagatgggcaaggaaataaaaacaacattaaaccaaggccactagtagagttttgagagttgctttcaactacttctcgaccaccaattttttaaatggctggtgacatttggcccacccacctctttgtctttttttttaattccttttgtggctcttattttttcccccttttttatttattttagtttatatttttacttttaaaaatagtcacacgtcctaaatcttagcacattatgttgcctaaaactatttcagctgccgtcaaaaaaaggaagaaaaaaaatcagatataggatccaagaaatcatataaagattgtgacaaaaaaaactttttcaccaaaacaaaggaaacaagacaacgaatgtgtttcagggagacacatcaatgacctcccagatggcattgagtctttcgtcttcactttttagtcgatatcatttttctttttgtctgataatggtctctgatataatggactttaaacaatcttataactcaaaaccatatccactataaaagatttggtcttcccaatattttctcctaaatcatactacacacatttcttgttaggtactactttaatcataattttcgttagtcaaaacacacaattaaagaaaaaaagtaattgattggagaaatttactcaaagtagtaattaacagattttgccttgtcacagcaaagtatgcttatttgatactctcggcgcgtggatttggtcgtcgtctcttctggtctctcaagcttctcctccatcgtagaaaaagattttaaaggagcgatttttataatcttaaataatttcttccctttcttcttcttcttctagttccttgataccaacgcgtaatcctaacccttaatctacttcctccttaattaatcagaggtttctacttattatttccacttctcatctctttcaatcgcaatctgagttctggctaaagattttgtcttgaaggtgagattcattgttccgaatagagtgagaaaaagacttataagattgaaaaagcaagatg

SEQ ID NO: 19100 - DNA, 3003 bp, Unknown; identical to SEQ ID NO: 19099
  misc_feature (1)..( 3003): 2750-1469P.txt file - cDNA_ID_1820651; gDNA_ID_2926217; Annot_ID_142266

SEQ ID NO: 19101 - DNA, 3000 bp, Unknown; identical to SEQ ID NO: 3384
  misc_feature (1)..( 3000): 2750-1469P.txt file - cDNA_ID_1820655; gDNA_ID_1620644; Annot_ID_47550

SEQ ID NO: 19102 - DNA, 3000 bp, Unknown; identical to SEQ ID NO: 3384
  misc_feature (1)..( 3000): 2750-1469P.txt file - cDNA_ID_1820655; gDNA_ID_2926217; Annot_ID_142265

SEQ ID NO: 19103 - DNA, 3003 bp, Unknown
  misc_feature (1)..( 3003): 2750-1469P.txt file - cDNA_ID_1820677; gDNA_ID_1620645; Annot_ID_47585
ggtggttggagatgcgtttccagctaagtatatgtggattgatgattggttttcaaatcggttcatataaaatcagttatgttcataatgaagttagatcagtcaaatctatctcagctccaacatatttaacctacatggtcaaaggagtgagccactaccggacctagactatgaaatcaagactttttttaactaatcaatataaaaccaaagatgtcagtattggattactccattccgtgaaaacatgtttagttctcatacacaagtagatagaaccgagggttgtatattcaaattcaaaaacccggcaaataatttacttaagtgtttttagtttctctaatttcattctgaaagtttcatatatatggaagaaaattaaaagtaaaagattgagacgttcattttagaaaaataaagtagaaaaaatcaactggtctttggcttttctttttcactttaggcgagtaaagttgatgggggagggcctcctctttgttcttctcaaattttaggcatcttaataatctaaaaacaaagcaaaatcgaataaactaaaaagagcccataaaattgctaaagatggatagatttgtttcagattttctctgttaaataaatcaacttaaggtattccatatcacacttttccacgccaagtactttcgaagttcaaacccttcttgctatcatatgaaagagatatgtattcttgctaattaatttgtcgactataattttataacccacaacatgaatttcttcaccattatacaacctggaattactttatctattttagatgtttttcttacaaaaataataatttccctttagatcacataccacattgatctgcttccctagtttatctaataaatctgatgagtccttttcatagaaatacatattaaaaatagaaaaggagaaaaacaatcgtaaaggggagattacgaaataattcgataataattgtagattggcatgtacatatactactatctttttgcaggttcatggtgtgaaaacttcgaggagtataagctgatgaaacattgggtacagaaacagaatccttgacagagaagttattaatttctttcttctacgacaacaaaaaaacaaaagtagctgcatgcacaattaccaaagattctagttactttggagtttggtttgtacttatttagtggttggacaaagacaatgcatggcctcttaattaaacctgatggattagattttgattttttagttaatggagcataaaacgttagagtgacataaaggtacgatgtttaatgcagggtaattatatgatttatagctagtacataaattccacccgaaataaaacaaaaatcgattcatgcgttcgacaaaatgataagagtgagacagatggaaatttaatatattaaaataaagtatttcagcaacatgtgatattgtgtgtttcttaattttatattttacgatttctaaggttttcttaaaacccttccaatatttttttgttttttttctttcttaataatgttttaaaattattttgctttattattttatttttctaataatcgaatagaaaaaataaatttaatatggttgcctttaatggactgaatagacattaatcacgtaagaaaaagcattgatcttcaaacaataagcttaaatagtagttattttttgattcgataaggtaatttggttttactttatttgttgtttattaaactcacaaattcattcaaatttggattgcttaagaatgtgtttttcatcttagttcaatttattcaaatttggatcacctatgtagaggatttccatatttctacaaagtacaaatcaaaaggggaacacaacaaatttctatgaattaattatttattaaaaagttatcaacgaaaacgtctcccaagcgtatatacaaaattagcatatgccataggtaaatttaaagcttgaaagtatcattttatttgcaggaagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttacaatg

SEQ ID NO: 19104 - DNA, 3003 bp, Unknown; identical to SEQ ID NO: 19103
  misc_feature (1)..( 3003): 2750-1469P.txt file - cDNA_ID_1820677; gDNA_ID_2926175; Annot_ID_140305

SEQ ID NO: 19105 - DNA, 3000 bp, Unknown; identical to SEQ ID NO: 3410
  misc_feature (1)..( 3000): 2750-1469P.txt file - cDNA_ID_1820696; gDNA_ID_1620645; Annot_ID_47579

SEQ ID NO: 19106 - DNA, 3000 bp, Unknown; identical to SEQ ID NO: 3410
  misc_feature (1)..( 3000): 2750-1469P.txt file - cDNA_ID_1820696; gDNA_ID_1620645; Annot_ID_163193

SEQ ID NO: 19107 - DNA, 3000 bp, Unknown; identical to SEQ ID NO: 3410
  misc_feature (1)..( 3000): 2750-1469P.txt file - cDNA_ID_1820696; gDNA_ID_2926175; Annot_ID_140299

SEQ ID NO: 19108 - DNA, 3000 bp, Unknown; identical to SEQ ID NO: 3410
  misc_feature (1)..( 3000): 2750-1469P.txt file - cDNA_ID_1820696; gDNA_ID_2926175; Annot_ID_199795

SEQ ID NO: 19109 - DNA, 3003 bp, Unknown
  misc_feature (1)..( 3003): 2750-1469P.txt file - cDNA_ID_1820708; gDNA_ID_1620645; Annot_ID_47576
tctgattcggtcaacacttggcctgtaaaagtctttgtgcattctgtattagtctcctatgtcggtcacgatctttacttttattgaacatcacatgattttactgagaaatgttttcacatgattttagtgagaaatgttttcacatgattttagtgagaaatgttttaaagattctatcttttgtttgtatcttttttgtttaatcagaataacaattgaattgtgatgtagattagtttagtattgaacatctctaatggttcatcttaggagggaacatatcggttattgatttggtttagttcagggactgatctaaatggtatttggttttgtgtttcaggaaatggggaattgagaaactggcatatagagacgtcaagaaggttccaagacgggatcgaaaatacgctgtccagccggagaatgtattcgcgacaggcgtacacatgtctcagaatctacaagggaaaacataccacaaggctgaaagcaaaatccgttacttccactaccatggttcgatctctcagcgccgcgagccttgtcgtcaactttttaacgattctcgagtcgtgttcgagaacactccttatgtgctagacactacaatatgtgatgttggccttgctgtgagaacgttcgagttgagaacgatcggtgatcggctgctacggacaagacaatgaagagatggcaaaaatgaatagtgaatgtaatcaatctttagaaagaagaattagaaggtgttaagatgagttactttgtattattttcttttgggggtatattcttttattgtatcatataatttgggtaatgggttcattaatacagcttgaaaatactctttggtatatatattctgtatgatgtatgatttagaaaaaaggtctctgagtatataatctagtgatgataattgtggagatcaagtaatatcactgtttgtatttgattactgtactcttagttgacaaaaagaaaatgtcaatatccattggtgttactccagtaatccatatggaacgttgattatttgttatgtttgtggacgatttttataattgtttgtttgttgtattccctatgaattaattattaacgacaaaaaagatagcttttgctttttgtggagcgaaggaacgtgcgttgaggcttttcttgacgatcaccgaatgggcctaaacgtgtgggtccacttagaatgaaacatatgggacccacgtttcgtggttgttaatctcgcaagtcgcagaccagaggctagaaagctgtcgtttgttgcactagataacaagtgttttcataatcataacattacactatattatgcggtgttaaatcacccgagatttacgtttggacctacacacttcttttccccaacggttcattttaaaaatgattaacatcgtaattgttatgaataaaggtggatgcccattataaggcctatcatctaagcccattatttagatgtttctagggttttacccctttccttgtacttctatataaagaaccctttatctcaatggaataacacactcatttcttctatctctttctctgtttataacacgttatcagcacgctctaaaaggtagatatagagattcttacattttttttaagaaccatgtttacttatcgactcatggttcatagtacttattttctattattgaaacaaaacaatatgagccgatcgatgattatagtatagatcggtaaaagcaggttttcaatgattcaataaagaagagaatcatgcttatcatttgtttctataattactatcgcatgattcaatgattctacaaagaaaatcgttaaagaagagaatcatgcttgttaattgttaatttttgtgatgtactattacaatattgaatatataaattaccaattttataattatataactaattttgtaactattcatagtccggtggtgggtgatgcaagcatgtattaatgttttagcattctagttttgaatagttgcatctatattcaatatcattttataaatattatattgtctaaaattcatttatgattgatatgatatctcttatttaactcctttgattaaaacgttatacatatcttatcacttttagatattgacttttctatattaaatatttgatttccatatatttgattgtgttattattatttttactaaaaacgttgcaagataatttttttttttataagatttcatatatctaaatctttgtgttattattatctaaatctttttataagatttccatatatttgattgtgttattattatttttactaaaaacgttgcaagataatttttctttttataagatttttttctctaaatctttgtggtatctaaattataaaaaaaaaaaaaaaaaaaaattgttcatggttttgccctaattttgcacgaaatcattttacccaaatcttgcacgaattcatattaccctaaataaaagttttgtcaagatatatgtaaaatccagattttgcacaaaatagttttattctgattggttttacaatattgcattaaaattgtattagtatataatacttgattattttatgaaataaattgattgataaataacttaatttaaaggtataatcacttatagaaattttcatgaatgactagtttaatgtatcttaaaaagatatcatatttttgatggtcaaatttttttttaagaacttaaattatcactagaagttgagaaaataaatatggtaaaaaacaaaaaaaaacaaaaaaaaacaaaaaaaaaaaaaatttctaacgatgaaataatctaatatatcaagtagtataaaatcttattaaaagactctagaagagcatatacattgttttctatgggaatacaaaattaaaatcatcgatgcggtatagttctccaaatctcaaagttaatatgatgagatataaatacattatgattctagagtggaattcaatacgagatg

SEQ ID NO: 19110 - DNA, 3003 bp, Unknown; identical to SEQ ID NO: 19109
  misc_feature (1)..( 3003): 2750-1469P.txt file - cDNA_ID_1820708; gDNA_ID_2926175; Annot_ID_140296

SEQ ID NO: 19111 - DNA, 3003 bp, Unknown
  misc_feature (1)..( 3003): 2750-1469P.txt file - cDNA_ID_1820712; gDNA_ID_1620645; Annot_ID_47575
aagaaggtagaacgcgaagaaacgggagaaaacgtggaagaagcatcagtagagtttgtaaatgattgggatggaaacgaaatggaagaagaagaagaagaagaatatggagattattttaatggagatgatgattggattcacgatatatcgcggccacgaagttactgggaagatctaaggaaagaaaggtatcttgaggttctcaacactgaatcagagaagaaagatatttgcaatctcattgagaggtatatatttctatgatcattcatcaaatccctcaaaagcattaaacttgaaactttacttgacttttgatgtttagactaattttaattttgtataccgctgtgcagacgaacagtttccaactttttgactagtgatttgcgacaaaagattgataatttgatgatcactcgcgtgcaaagtcatataggcgtaccactcaatcaaatagaagaaggagacgaatatgaagaagagtgggaagttgagtgttcagcaagaaacgaggaagataatgaaacagaggaagaaccagagaagacaaatcttgaagctccaagcgatgtttgcagccaatcatcagcaaggagtagtaccatgatgtcgtggaatttcagagaccaggacattgacaaggataacgaaccgacaacgtctttgtctcttcctgaacctttagttcccacaaatcaatctgtgagttttgttcttgttttttttcgtcaagtttaggttacgtgttggtgaagtaacctgaaatcttaacttattagacacaggacatgcagacgataagtgatctcaaggaacaaatggagcaacttcaacgagaaatgctcgagctacgaaataccgttaaatcttgcatcgatatgcaacttcatttccagaaatctgtaactcaagatctgtctcgttctggtcagttttatcatcatcatcacattaaacacattttagatttattcgttacaaagaaatcaaactgattaataatcttttaggctcatcagcagaacaacgagtagacccgaagaaagatcctttgaaacgcaagtgttgcgtttgctctgagatgcctgttgattcgctcctgtataggtacttctgtttgatatatcgcaacttcaaatcggaaacgctgaaataataactggcggtcttggtcttccttttaacaggtgtggacatatgtgcacatgtctgaaatgtgctcatgaattgcaatggagcagtaagaaatgtccgatatgtatggctccaattgttgacgttgtgagggcttttcttgattcttaggacccaagaaaccacaaaacattgctagtttctccattgatttgaaaatgtgtcacatttgaatatacataataaacattttgtttgtcttcacgtgttatgccgacttctaaagactttattattctcctattcttctatgaagtgaaaccattactttgtagtaaattcaatttgttgagcaaaagctaaaagtacattaaagaggataataatgaatcttggtcttcttggtgatatggataaggataaacattgtagtatttggaggctatggatgtaagaaaatactttttcgaccgttttgagctttggaaaagttaaaaaaaaattataaagaatttgatttttatgttaaaatatataaaagaaattgaagaaaaggcaattgaaagtttgaaacgttagagagaagccaagcaaaaagacacgtctgcgccatgtgtcttacagattttggaagcttaaaacgaaactgcgtaattttaaaaaagtatacaaaacgatattaacaaacaaattatagaaaaccatattaaaaagccatgtaaatccattttctatacctgcaatgtcaccctcagaaaactcgaaattatacgccatcaaatttagaaacttacatggttaaagcaaactcattaaattgttacgacaatgccaaaaaaaaaaaaaagacacaatcatttgagaaattagctgtgtataccataagcttttcattatgtggttgatttttagtggctgctctgctaataattttctgttgttgattgatacatgacttggctttgagcacatgtcaactttgcgatacgaaatataatggttgttccatattattaaattatcatgaacaatttagattttgattctatgattatatactaaacataggaatcaatagttgttaatcatttttcataaagttgataatttggtcttcaataatagcttaaattgctctctctcttttattgtttacaaaatacactctccttttgacctgaccttcccttcactatacggtttcctctggtgacgtctgcaagtcaaaataatacagaaataaggaatgtgttattattcagccaaatgaagaaacataattattttacatgactagaatttttttttacttttcaataaaaaaagagacttaaatcaaaaatgaaaaaacagagattgaaattaagatttggcatagaattttttcatttaatcaaacacgaaagtcgaattaaaatagtacagaacaaaagaaaaatagaaataaagtaaacactcctagctaaaatctctcctttcataggaatgtctggtaattctacatatgaatggattcagtagttgtcttttgtaagtatcttttttcgttgtactcaaatagcatattaattctggaaatatcattgaacttacatattacagtaattaaaaaaaacataattaagttgtcaaaaaataacaaaacaaataaagaaacaggtgtgttcacactcaaaaaaatacagactagtagaagaattaaaaacgactcttctcgccgactcgttgaaaaagtgagagacacacaacttcggagcgaatctattcttcttcttcttcttcttcttcttcttcttcttcctccgtttttttcatcttcttctctgtttcgagagatccactagtgaaagagtcagcaccatg

SEQ ID NO: 19112 - DNA, 3003 bp, Unknown; identical to SEQ ID NO: 19111
  misc_feature (1)..( 3003): 2750-1469P.txt file - cDNA_ID_1820712; gDNA_ID_1620645; Annot_ID_163188

SEQ ID NO: 19113 - DNA, 3003 bp, Unknown; identical to SEQ ID NO: 19111
  misc_feature (1)..( 3003): 2750-1469P.txt file - cDNA_ID_1820712; gDNA_ID_2926175; Annot_ID_140295

SEQ ID NO: 19114 - DNA, 3003 bp, Unknown; identical to SEQ ID NO: 19111
  misc_feature (1)..( 3003): 2750-1469P.txt file - cDNA_ID_1820712; gDNA_ID_2926175; Annot_ID_199791

SEQ ID NO: 19115 - DNA, 3000 bp, Unknown
  misc_feature (1)..( 3000): 2750-1469P.txt file - cDNA_ID_1820720; gDNA_ID_1620645; Annot_ID_47573
tctttggaaataactttctccttcgtctctcgcttttcgcctttcccttctacagtttctttctggatagtttctcctgcaagtttctttaaaccattcctattctctgaaatttcacttaagacacctttcttcgcattctcaaccgcagaaaccacctccttaatctcctttactccactcttctctattgtctcctgcaaaaccttcttctctgtagctttgtgagggtctttatccataatccgaccccgagtagacgcatgactagttgaagctccagtctcaatgttctcagaatttgccttatatttctccctgcatttcatttcattgattcaaacctcattatatactaaaccagaacaaatcaacaaacattacctgagaagatgcatcacaccagaacctcgtgacgatcggtttgaatcagatcctgctgatgttgatttagaccgatgtctaccttgaatcgcaaggcacctttcgtaacatcgaattctaagcgtagactaaataccacaaaacacaaatcattagccctaactaaaaccctacaattttaacatcagtcttgatgagagatcaccaattacatacctgaatccttccacgattcgtgaactttgaaacacaatgacgttctcgtaaacaagccaagtctttttctcgatcacgcgtcatctgcaccaacaaatcagccaaagcttgacgacctctgattcttggggaacaagcaacctgaggaaaacttcttgcttctgttgtttgaacttctttactattgtcattgccgctgcttccattgtcattattagtaattgtctccgagtcgttgcttagtttccgaataatatccataactctcacaccttctctatctttctctccagattctaaaggtggaggtgcacattcaatctcttcttcttcctcctcattgttacattcttcaatcggttgaatcatttgagattctttcacggattcgagagactccgaattctctagagcgtttgatcccatagaacttgttctgctatcgattagggattggttcgagcttggtggttgctgcgttgtcctcgcctcccatatctgaacgagagaagaagctgcgtttcttgacgggttctcgggttgacctgaattcggatccgagtcggatcctaaagaagaagacgatgatgggacgtcttgccgagattcctctgttttcgagagccgatgatctgaaacagaggatttgttggaagaacattccggaacagctttgatggaatcatcaacaacatcatcaacggagacgctacagttttcgagatgatctcttacaaaaacattgagattcttctcgaaggcggcgacgtgtatgtttcggacattgttgttattgttgttcttcttcttgttgttgttggtgttgttgtctctttgggtgcatctctcgtgaggacgactcaagacgcaattaaaagtttggcatgaagacatttctacctcagaggacgccatttccatcaacaaccaaatcaaataaaagaaaaacacaaaccctatttaatcggatctttcttttatgtcttttttttttttgatattttaatgctctgttttcttattttttgaccccttctggggaagaagaacatgagcatcgaaacagattaaaccccatttgatgacagagttttttcaaacacaaacaatacaatgaaactttggataatagataagaggaattcgaagagacagaacaaaggaaaacgaagagacagagcaatggagaaaaaagtttgaagaaaaaataaaagtcttgctgtttttctctattcaatttttttttagatttgatgttattaatatcatccaccaatattaatttaggtaaataatattaccttttggagaaagaaataatccaaatatagattagtcgatgattcatgtaacactttaaaaacttgaaaaaaggttcataggggagaagagagacagtgtcaaacaaagagggagagcataattatggcattctctaaattaaagttgacttattaaattgatacatgaatacactctctatttttttttcacatttactgataagtgataacattagaagcacttttacattgttcttttctttgactcgaatggatttttttaaaattaattaaaaccattggatatgcttcattggtttgtattcaatcctttgggattttagtgttatgtcaaagattttgagttatctaactttttacaacaaattcattaattatatgtaacagaatctgtgcatatcccatgattatgaaatgaaatctacataagattaaccatgcatataatgctatttctagaaaaattactataaaaataccaaatgaagttccattgattcattgtactatatatggtaacttaaagtaataaatttacagtctttgactcatgtaattagttaaaatataatatggtagctatttttatagcctatcagaatcaaaataaatttagattctttgactaatctgacgggaaaggttaaaaaaaaacagatagagagttttggcgtaaattacaccggagtcaaactttgttccaatttaaaacgaacttaactaatttaattctatccaaaagatatgtgtatcttgcttaagtatagaagataattcacctaaattttagcatttggtagtttttaactttctgttaatgttaaaaaaaaaaaaaaaaaagtagtgcttctttttttactgtctaaacttactaacattttccaaaacaactaaacatagcagatagcgttccatatcatttatgtaacccaaggtctaggcccaagcccaagcccatatgagggcgatacactgaaatggcaatgtatgtggggaaaacattgtgaagctaagtccgagtagtcacttaaccggagatcggagactcatcgttgcaacaacaacaaatttcagaagatccgaagacgaaacgatg

SEQ ID NO: 19116 - DNA, 3000 bp, Unknown; identical to SEQ ID NO: 19115
  misc_feature (1)..( 3000): 2750-1469P.txt file - cDNA_ID_1820720; gDNA_ID_2926175; Annot_ID_140293

SEQ ID NO: 19117 - DNA, 3003 bp, Unknown
  misc_feature (1)..( 3003): 2750-1469P.txt file - cDNA_ID_1820724; gDNA_ID_1971811; Annot_ID_58119
ttctgtttcctctctattccttgacaaaagatggagaaatgagcaccaatgttacctaaatctgtggcaggcgagttatcgaggggcgatacttttgttgatggagcagttatcgctgcagcaagaacattacctacttggtcagacatagatcttcctccaataccgagtgcggaaagaaaagcagttaaagaattgcaagatgaatgtcgaaagatgcttgcggaatatcccacaacagcagagcaagaccagaagttgctaggtattacactaaagatatatacaccaatgtgttattatctattatcgctcatatactaaaacttaagctttccctcttgttgttgtgacagattcaatgtcagaagcaaggacaacatttgcaacagcggttaagtatagaatgcacagaaagatgttcatcggaaaaattatcaaggcacttgacatctatcaagaacggttactctattgattcaagcaaaaaataattatgagctgagtgagattcatacttggtgctcactcccttgagctacttagaaactgcaccatgtaattgaaaggttcctgtttttttttttgtttagtgtaaggttatgtatttgtatggaacagttagactaagtgtgttagtttgttttaatcgcaatcacaaacaaatcataacctcttcttttcttggctgctttaatgagtttgattagccaacaaacgctttggaatcatctgtgttttttttttctcttttgattaattcatgttcatgtttttagtccctaagcatgattagtgtctcaaatgttttagggtaattgtgtctcttacgccgaactataatgttgattagtctcaataattgattattacttatactatttattaaccttgtggttacactaatcaatcaaatcatattgcgtttcttctactctttgtctaacattactattttcaaaaaaagttacggtccaaaccaaacaaacctactctgagttatacagaaccataagcaatctatttcttacctttggctacttatttgatactttacattgactaacttgattcttaataattatcttcaatatgttgaatattttatttttgaagtaagaccactatgcgtttcataattcttgccatgcataatgaaattattcctttgaatttaagattaattaaagtataaatcaaccaaacaatagacaaaaaaaaataaaaaaaaataagcatcttgatctttttggtggatcgaagataattcctttgtctcattcttttggatttagaatctcgttcagtagaatattaacatttttaattatagattatcaattatcgaacaagttgttgtacgtaaacttgattcgatctagcgttattacagtcaaccaaaatttatataataataacaatttatgaaaatgacaatattattcgatgtattattccttttttcctataattagataggtgtgattaaattcaagctagattccgaatcgacaacaacatattatatctattattaacctcaatttttgaaggcaaaaaacacacgaaattattcaaaactcacgagttgattctttacttcgatgaacatataaattgggaaagtatcaccgaacttatttgggtaataaagaaaaagatggatgaaaaaattatgtttgcaaattttaataagaattatgtttgacttggtaataaaatatagggcataatcatatgatgccatgttaatgtacgatcataccacaactgctctccttgtcgtgaaaaggttgaagtgatgagaagctaacacactttgtgacataaccaaagccaaaaatatatacttcaaccaagtcattttctcaaccactcttttctccttgtccaaggtcaaagccatgcatcaccattttattttctattattcattattgttacttttcctttatataactaataaaaggtctattactaataaacaactaaacttttcttttctttttgataaaattaaacaactaaacttgtcgaaaagaaataggagaacaaagaactctaacttctcacgaaattgataaatcaaatgattgcgtatcacaaagacactaaaaagaaaaattaaggaatcgtgtagagttgacactctatacattcagagtagtaatcatgtgtttgatagataataaatagataatggaagtatgaaatgagaaaacttgttgggatcatttatcatttgtggaatcctctaaatcttttctaacttaactccaagtcgttagagtccaagagatatgaatcgatcggaacttcaatacagaatttaattagaatatagtggaacaacatccacgaatctaaatgtcataagttgttaattgatcaaacgaaatagaatgtacttattataagcttataattttacaagtttgatgtgaatgtaaagtgtactactccactatttatttatatattctgtggtttctaaagaagaccaaatgtttttttttttttctttcctaagaagaccaaatgttatgtcaaagtttaggcactgttttaattatataacatgtctccacggacgaataaatgtacacacgaacatcatagtacgaccgttgacctttgcccctccattgattgataaaaggctaaaagccgaaacattttcattctacgagccttcccattccatttccccacatctctcctctgacctctctttgacccctctctcctctctctctagatctctcaataaaacagtgaaatagcaaaaaagaaacacaaaaaagagagagagaaagaaactttgttctctctgcatttactcttctccaactcagagatagagtccctatgcaccgtttctaatgaccaatcatctttctccctcttcatcattctctacaacaagaatcacacaaatgccataaaacctccattcttcttcctcagtaaaccaaaccataagacgacgaagaagaaaacatg

SEQ ID NO: 19118 - DNA, 3003 bp, Unknown; identical to SEQ ID NO: 19117
  misc_feature (1)..( 3003): 2750-1469P.txt file - cDNA_ID_1820724; gDNA_ID_1620645; Annot_ID_47572

SEQ ID NO: 19119 - DNA, 3003 bp, Unknown; identical to SEQ ID NO: 19117
  misc_feature (1)..( 3003): 2750-1469P.txt file - cDNA_ID_1820724; gDNA_ID_1620645; Annot_ID_163185

SEQ ID NO: 19120 - DNA, 3003 bp, Unknown
  misc_feature (1)..( 3003): 2750-1469P.txt file - cDNA_ID_1820724; gDNA_ID_2926175; Annot_ID_140292
tctgtttcctctctattccttgacaaaagatggagaaatgagcaccaatgttacctaaatctgtggcaggcgagttatcgaggggcgatacttttgttgatggagcagttatcgctgcagcaagaacattacctacttggtcagacatagatcttcctccaataccgagtgcggaaagaaaagcagttaaagaattgcaagatgaatgtcgaaagatgcttgcggaatatcccacaacagcagagcaagaccagaagttgctaggtattacactaaagatatatacaccaatgtgttattatctattatcgctcatatactaaaaacttaagctttccctcttgttgttgtgacagattcaatgtcagaagcaaggacaacatttgcaacagcggttaagtatagaatgcacagaaagatgttcatcggaaaaattatcaaggcacttgacatctatcaagaacggttactctattgattcaagcaaaaaataattatgagctgagtgagattcatacttggtgctcactcccttgagctacttagaaactgcaccatgtaattgaaaggttcctgtttttttttttgtttagtgtaaggttatgtatttgtatggaacagttagactaagtgtgttagtttgttttaatcgcaatcacaaacaaatcataacctcttcttttcttggctgctttaatgagtttgattagccaacaaacgctttggaatcatctgtgttttttttttctcttttgattaattcatgttcatgtttttagtccctaagcatgattagtgtctcaaatgttttagggtaattgtgtctcttacgccgaactataatgttgattagtctcaataattgattattacttatactatttattaaccttgtggttacactaatcaatcaaatcatattgcgtttcttctactctttgtctaacattactattttcaaaaaaagttacggtccaaaccaaacaaacctactctgagttatacagaaccataagcaatctatttcttacctttggctacttatttgatactttacattgactaacttgattcttaataattatcttcaatatgttgaatattttatttttgaagtaagaccactatgcgtttcataattcttgccatgcataatgaaattattcctttgaatttaagattaattaaagtataaatcaaccaaacaatagacaaaaaaaaataaaaaaaaataagcatcttgatctttttggtggatcgaagataattcctttgtctcattcttttggatttagaatctcgttcagtagaatattaacatttttaattatagattatcaattatcgaacaagttgttgtacgtaaacttgattcgatctagcgttattacagtcaaccaaaatttatataataataacaatttatgaaaatgacaatattattcgatgtattattccttttttcctataattagataggtgtgattaaattcaagctagattccgaatcgacaacaacatattatatctattattaacctcaatttttgaaggcaaaaaacacacgaaattattcaaaactcacgagttgattctttacttcgatgaacatataaattgggaaagtatcaccgaacttatttgggtaataaagaaaaagatggatgaaaaaattatgtttgcaaattttaataagaattatgtttgacttggtaataaaatatagggcataatcatatgatgccatgttaatgtacgatcataccacaactgctctccttgtcgtgaaaaggttgaagtgatgagaagctaacacactttgtgacataaccaaagccaaaaatatatacttcaaccaagtcattttctcaaccactcttttctccttgtccaaggtcaaagccatgcatcaccattttattttctattattcattattgttacttttcctttatataactaataaaaggtctattactaataaacaactaaacttttcttttctttttgataaaattaaacaactaaacttgtcgaaaagaaataggagaacaaagaactctaacttctcacgaaattgataaatcaaatgattgcgtatcacaaagacactaaaaagaaaaattaaggaatcgtgtagagttgacactctatacattcagagtagtaatcatgtgtttgatagataataaatagataatggaagtatgaaatgagaaaacttgttgggatcatttatcatttgtggaatcctctaaatcttttctaacttaactccaagtcgttagagtccaagagatatgaatcgatcggaacttcaatacagaatttaattagaatatagtggaacaacatccacgaatctaaatgtcataagttgttaattgatcaaacgaaatagaatgtacttattataagcttataattttacaagtttgatgtgaatgtaaagtgtactactccactatttatttatatattctgtggtttctaaagaagaccaaatgtttttttttttttctttcctaagaagaccaaatgttatgtcaaagtttaggcactgttttaattatataacatgtctccacggacgaataaatgtacacacgaacatcatagtacgaccgttgacctttgcccctccattgattgataaaaggctaaaagccgaaacattttcattctacgagccttcccattccatttccccacatctctcctctgacctctctttgacccctctctcctctctctctagatctctcaataaaacagtgaaatagcaaaaaagaaacacaaaaaagagagagagaaagaaactttgttctctctgcatttactcttctccaactcagagatagagtccctatgcaccgtttctaatgaccaatcatctttctccctcttcatcattctctacaacaagaatcacacaaatgccataaaacctccattcttcttcctcagtaaaccaaaccataagacgacgaagaagaaaacatg

SEQ ID NO: 19121 - DNA, 3003 bp, Unknown; identical to SEQ ID NO: 19120
  misc_feature (1)..( 3003): 2750-1469P.txt file - cDNA_ID_1820724; gDNA_ID_2926175; Annot_ID_199788

SEQ ID NO: 19122 - DNA, 3003 bp, Unknown
  misc_feature (1)..( 3003): 2750-1469P.txt file - cDNA_ID_1820728; gDNA_ID_1971811; Annot_ID_58118
ttaactttctctgcttgctcagtttagtgattctcttgtcataagccaaaccctcccttacaaagttcttgttttcagttcaatcatctctttgttatttatgaaaaattaggactctgtatctactggctgcaaatgtcctgaaggtttccaaggcgacggtttgacgtgtgaaggtacataactcttaacttatcgattaaaatctcgaaagaaaccacataatcatattaccaacaatgtaattatgttttctgatttggctctattgcagatattaacgaatgtaaagagcgttcggtatgtcaatgtagcggttgcagatgcaagaactcatggggtggatacaaatgcagctgttctggtgaccggctttacataaacgatcaagatacttgtataggtaaaattttatcaatcaagatttaagagtactcaaattccataacagtatctaattaatatacattgatgattgtttgttacagagagatatggatccaaaacggcatggtggctcacattcttgatactggctatcgttgcagtagccggtttagctggttatatattctacaaataccggttcagggtactactactctttctgattccacaaaagcatttttgtacttaataacggttttaggattaccaaactaacttttctttggtgttcctattaacagtcttacatggactcagagattatgacgatcatgtcacagtatatgccacttgagagccaaagagctcgtgaagttccatcagaagccgagccttttacactctaatagtatatgaccaaagtaaccaaaactgtcatacacaaagaaatgtttgagatcaattaatgtacatatgaattatactgtaaaaataaaagagtgagatagagttgtgtatattttcatggcaaaaaaataaataatttggatgtaaagagacttttgaagaaaataaaacaaatattgctttcattgagagttgaactcaagacctcccgcttactaaacgggtgctctaaccaactgagctatgaaagcttcttgcaacatattattccaaataaattatatcgtaaactaagagttaaaatcttgaaaacaaaggataacgatcttcgtctccctctgctaaacccattttcttctgttgaggaatggcttcttcagtctctcttcagttcctgaccaacacctttatctccaaacctcaggttcttaatcttatctctctgtatcacctaatgtttctatgtcatgtgtgtgtgtgtgtgtctgtctttgtctgaattttctgagtactcctcatgttttttccggtcggacaaagggtttctgcaacggaattgtgtcagcaccaagacccagaagcaatttattaagagacagacaaaatggtgtacgacccatcaaagttgcgtctattgagacacaacctttccctctgtttcaatctcctgcttccgaagaatcttcctcgtccgaggttaggattttcagttttgagtgttttagggtttatagagttctaaaaggcagtacctttgacaattctttgcattgcccctatctgggagattgatttagagtacaaatgagttctaaaggtagtacctttagacaattctgttcattgcccccatatgtgatattgatttagggtacatatgagttcttaaggcagtaactttagacaattctgtgcattgcctccatctgtgagattgatataggggacttcttaaggcagaaactttagacaatcttgtgcattgccctcatctgtgagattgatgtagggtacaaatgagttctaacggcagtaactttagacaattctgtgcatttccctcatatgtgagattgatttagggtttttgtcttttgtttcttcactagctggagacagcagatccggatttctacaaaattggctatgttcgaagtgtgagagcttatggagttgagtttaaagaaggtccagatggttttggtgtctatgcttctaaggatatcgaacctcgccgtcgagctagagtcagtcttcttagttaaaaagttgacaactttttgttttgttcttctctttagattattttgttttcttttctctctgcaggtgattatggagattcctcttgaactgatgataaccattagacagaagcacccttggatgtttttccctgatattgtaccaattggtcatcctattttcgatatcattaactcgactgatcctgaggtagtaacacatttgtgctatttcgatatcatcaactcgaaagttcttatctttctcaaagtcctttcacatttgtgcttacagattgattgggatatcagattagcgtgtcttctgttattctcttttgatcgagatgatcacttctggcggctctatggcgatttcctgccggctgctgatgagtgcagcagcttgcttttagctacagaggtggattgaattgatatgattgccatttgaaactggtcacatttacttgtgtctttaaactaatgcttgatgatatctaattctgtgtgtttttctataggaagaccttgcggagcttcaagatcctgatcttgtttcaactatcagacaacaacagaaacgaatcctagatttttgggaaaagaattgggtaatgaggccttatatatgtgtttccagtatatcttgacatttggttattgctttgtttttcattggcaaattgtattccgtctcagcattcaggtgttcctctcaaaatcaaaaggcttgccgaggatccagaaagattcatatgggcggttagtatggcacagacacgatgcatcagtatgcaaactagggtcggtgctttggttcaggaattaaatatgatgattccttatgctggtaaggaagagcatgttgtgtagttattgataaattaagatttagtatcaatgaactttttgttgaggaactaaataagaatctcacgattgatcattctctgcagacatg

SEQ ID NO: 19123 - DNA, 3003 bp, Unknown; identical to SEQ ID NO: 19122
  misc_feature (1)..( 3003): 2750-1469P.txt file - cDNA_ID_1820728; gDNA_ID_1620645; Annot_ID_47571

SEQ ID NO: 19124 - DNA, 3003 bp, Unknown; identical to SEQ ID NO: 19122
  misc_feature (1)..( 3003): 2750-1469P.txt file - cDNA_ID_1820728; gDNA_ID_2926175; Annot_ID_140291

SEQ ID NO: 19125 - DNA, 3000 bp, Unknown; identical to SEQ ID NO: 3441
  misc_feature (1)..( 3000): 2750-1469P.txt file - cDNA_ID_1820743; gDNA_ID_1620646; Annot_ID_47612

SEQ ID NO: 19126 - DNA, 3000 bp, Unknown; identical to SEQ ID NO: 3441
  misc_feature (1)..( 3000): 2750-1469P.txt file - cDNA_ID_1820743; gDNA_ID_2926179; Annot_ID_140483

SEQ ID NO: 19127 - DNA, 3000 bp, Unknown
  misc_feature (1)..( 3000): 2750-1469P.txt file - cDNA_ID_1820747; gDNA_ID_1620646; Annot_ID_47611
tggcgataccgatgaaagcaactttcttcatcacgtatataatggttgatggttgggcaggagttgcaggagagattctaatgctgaaaccattgattatgttccatctcaaaaacgccttcttggttaagactgataaagacagagaggaagcaatggacccgggaagcattggttttaacacgggtgagcctcggatacagctctactttcttctcggtcttgtctacgctcctgtgacaccgatgcttcttccttttatcttggtcttcttcgcccttgcttacattgtatatcgccaccaagtaagtttcttcttctttccttaatagggtcgaatttgttttaaagcagtttcttaaacaaatttttgtttctgtcagatcattaacgtatacaatcaagaatacgagagtgctgcagcgttttggccagacgttcatggacgagtcatagcagcattggtaatatcacagttgcttctgatgggtctattgggaacaaagcacgctgcattagctgcaccgtttctcattgctttgcctgtgcttaccattggtttccaccacttctgcaaaggtcgttatgagccagctttcatcagataccctttacaggtttgtcgtttcttctaacaaccatttaacattttagattccacaatcataccaaacacgaatcattcttgtatttgtttactcgtgttacaggaagctatgatgaaagatacattagaaaccgcaagagaaccaaacctgaaccttaaaggctacttgcaaaatgcttacgttcatccggttttcaaaggcgatgaagacgattatgacattgatgacaagctcgggaagtttgaggatgaagccattattgttcccaccaaacgtcagtcgaggagaaatactccggctcctagcataatcagtggggacgattcgccgtctttgccctttagtggtaaactagtctaagagaagcttcactcatggtcaaaagaaagtatatatacatatgctactttcaatgtatacagagagtaagagaagctaccaaagtgagaaaatttgactaagatttgttgatgttgatattttataaggtttctgggttgtgaatggtgaatcctaaatttcggggtcgttttataagaaattgattttattgtggttttaatcataattttagctcagttgtcctaactctatggttcaaatgtatgattcaaatttggtttagatttttggttcggttagttaatttggatttcatttggaaactgtgctcctaaggcacctatatcttttatcttttcagcaattaaatagcaaagcctaattaaggaaagggtatcatattctatcattgaataaaatgttaaatacaaatctgtaagtttctaaaatctcttagattttgattaactttatcaataaattttgtatagaactaatcaatcatagactagtggatcatatataatttgaccaaatcaatatacatttttcaaaattaaattaaagattaccttccaaaactaattaaagataccttgtttggaaaaaaagagattaaattatcttccataattaagtaatatgtagagaaaaagattcaagtaagtaatttatggctaccaaaactttttgttgaatatgtgtatatataagttgacaagaaaataatatgtatatcgtccattgaatcgaggaaggaggaacaagggtgaaagaagataaattttcagtagcacaaaagagtgaaatatacacaacaagaatcatgagatctgctactttattgttggtttcttgtgttcttttgtctttcattttgggcaatgttaaaggtaaaatcttaaaaaaaaaacctcaatttctatcaactgcgaaattgtatgttcttttcataaacaatggtttgtataccatggtctaattataatcttcttgcatgatcaatgactaagatctttaatatttaacaattcttttggttgatataaaataacagaagtggaagctgtgttgaagccaatggaccaatgcggccggaaggatatatttttgggaggatgcggcagcaacggaagcaaaacatgcataaacgactttgttaagaaaggaggtgtagccgctaagcctagtagttgcgagtgtgatgactttggggaagaacatttatgtagatgttatgttccttgctagtttttgttatagttctacaaataaaatttacaatgaattatataatataacgttaacgaaaccagtttattgtgatgtgaaattttgaatcttcttagatgttggcaatattgtaatgaataacagtcgcaaaacttataatacctcaataaaaagtttcgtttccgtaagactactctacttgactcttaggtttgaatctcttctcaaaacaaccatttccattatttcgttttttgatcttcatgagtatcttcacgtggttcttcttgaagcaaagatgttatttctttgtatccaatggtttaatttggtcttacttaccaggaaccatatgaatgtaagaatgttgccatctcaaaaaaaataaaaaataaagcgttagttagttggaatttaatcaaaattaaaatacaagatactgtatttattagttggctttgtcttaattcaccaaccacgatctcgagctgtgctttccattaatacaatatgtcaacagtttcatattcttaagattcagtagaaaaaattgaccacaagacaaaatataggtaggacgtttcaatctttacacctattttgataataaattagagacgagcttaattatataatcagtcaactagaaatgattattataaaattacagtgttgattaaaaaaattaaaaaactatgtaattgttaatttgcatgcagatacaactatacagaaagagaagataggatgaacaagtgagtctcttctctctctcaaatccactccgtaataagttcataatctatcatccaccatg

SEQ ID NO: 19128 - DNA, 3000 bp, Unknown; identical to SEQ ID NO: 19127
  misc_feature (1)..( 3000): 2750-1469P.txt file - cDNA_ID_1820747; gDNA_ID_2926179; Annot_ID_140482

SEQ ID NO: 19129 - DNA, 3003 bp, Unknown
  misc_feature (1)..( 3003): 2750-1469P.txt file - cDNA_ID_1820762; gDNA_ID_1620646; Annot_ID_47605
atctggagaaccatctagtggttgaggaatggttccatcaaggaaaccaaactttttcctagaccgcaacgccgtcttgaaaccacatgcccactcttcatagttatttgtcttcagtatcggatgggagatcacagctcccgaattgtcagctgccgttaagtcgtacggcaaaattgtgcgtcggacctcaattacagatggaggtggtggtggagcatcagccatagcttcagagaaaactcacttgaaatactcaattcgaaaaacccagattgcgctctgataccatgacaaacttaagacaagatgtagtttggtttatgttgtcttgtcttattaaagaggcgttaaaaccttacttatacaaagcaaaagatataacctaaagtattgcacaaaggaaatgactaaacaggacaaatatatattgttgactaagctaactaaaatattgacgagcaatagcttcaacacttttaatataccaaccaattaatactggaccctaccttcatttttactactatggttatgattgtttgcgagtaaatgatttgattaatatgtattatatgtatgtcgtatgtatctgtaggtacaagaaaaagttggagcttgactcgagatttctatctgatttttatgacgaaatcaaatgttgtgttcttatttaaagtgaaaaaatattttgttttactagccatcagtgtagagtttttctggatctatagttttcagtataacctgcaaatttgagattagctaactaaaaataaataacactttgaaaatggaagagaaattatgttaaatgtaaattgatgaactttaattaggaaattttgttgtatacaatttttttttggatgaagtatacaatttgttttcattcaactgtttacagatgaataatttgttatgtgatatgttatcataatgttgacgtgtaaattatctttttcttcttctttttgttgctgttgttgaagttgatgtataaattatctaataaactttataccttaaaccaaaattctactcccttaataaattagagcaataacatgttaccgtccgtttcttaggggtcgtcaagattggtccgccttggttttaggggtcaagattggtcgcgattataggccagatatatttagtaaatgaaaattttggaatgaccccaaaatgtaagaccaagaatacttggattgaaaatttgcataatgtttataatgtttgaacatctgcatcctcacaatttttataatgttttgtttaagggaagtttatcaaagtttttgggagtaatttcttttgagtttctaacctatttccacaaacgacctatcaataaataaaactataatataccgtagttatgattaagaaaaaatcaaacatactcatataagtataaataagtggagttgttatttttcttcaagaatatgatatttactggttattgacgagaggaatggattccatatgacttaatgaataattatgattagaagaagaaaagaacaggaaaaaagctaatcttagtttgtagagttcaacgttcagtttggaaaatggatcaataactacttcgaaaggtataaatgttacttgagattgtaagaaaatatatttcatttatttctcgtgaaatcgtacctctttcacttttatccctttgtttcaccttgagctaatttttcctcaaaaatccgattaatcatataacaatagatatttttcgagtacgtagaatataagttcaaaatccgaatcatcaatattataaaaacatagaatgtacatggtaactaaagtaaaatacagctgattttaacacattcccaacaaacttgactactccatatttttcttcgaagtctacacacttacgacaaatttgcattatatgcgtggcactaattttgtcttaaagactctattgcatgatctcatgcatgccaattaatatcgtatcccacttgcggtttgcacatgcaccggttaaatagttttaatatttgatttgtttatcaaagtatagatatcagaataatacacgttgtgactaaaaaatagaatatttcgacgatccttagatactttgtaaacataaaataaaaccttactagaagtttagatgcatgatttcatcaaaaaatgttaataatcattattgactcatggtttaacgctatgaattaaaacaaataagataaacttgacggctcgttttcatatttctttttttttgaagagaggaaagttaattatgtgagagagagaacgatagtcaaaatgctttttaataggattattactcaactttccagtttaagacaatggaaccatcaactgtgtcaatatcgccattacacagcctggtagaagaataattaggtatgacttctgcgtttcatcaagtaaaaggaggtggagcctaccttcttttttactagtagtatgttttggttgtttacaagtaaataatttgattcaagtataacataacaattaccatgttcaatgaacctagcatgttctgtaagataattttgatgagactttaaagttgaagttacaaattgagtagagcaaataggaaaaaaaaaattgaattgtcgaatttgattatacctactcttgttgtcatttcgtgatattgaagaatatttctaggtggtacatttattcaaataaaacaaattctaaaaattaatacttgaattcaacatcataaaaagtagaggtcagatattaaaatgaaaattcctaattgcaaaaccatcttaaaatagaaaacataagatagattcaaaaatatttctgtctttttgttgatgcgaaactttacaaacttcaacacataattacatcctttatacaagtaaaggctagattagtaattaattaatttctaatgtcccttatgtaatcactatatataacgtacattctcaacctgataatatcactgagcctcacatctcaacaatg

SEQ ID NO: 19130 - DNA, 3003 bp, Unknown; identical to SEQ ID NO: 19129
  misc_feature (1)..( 3003): 2750-1469P.txt file - cDNA_ID_1820762; gDNA_ID_2926179; Annot_ID_140476

SEQ ID NO: 19131 - DNA, 3003 bp, Unknown
  misc_feature (1)..( 3003): 2750-1469P.txt file - cDNA_ID_1820776; gDNA_ID_1620646; Annot_ID_47601
tgaatccaaagagagatcatagtgagagtgaacttgacacaacatttcttacaaatcaaacgcagattggttgaaatgttgttaaaagaagagtctttggagactaattcttgatttactacgcagaaatgtgatgcaaatggatctaaatcctctaaaattagggtttgataagctcaacgcaaggatttagtgactgggtttcgttaactaaacatcatcacaatcgatttcgattccaaatctaagcctctcgagtacgggagcaactaggttcatcaatctcttatagcttaatacgaatctacttagagatcgatacgaaacttggaatcggaatgagagaaagaacttacataaaattggagatcggagactgtgagagcaactttgagaacgcggcgctgatgaagaacgcagacaagggttgggttttttggcgttagtaaacccttttcctatttcttttttgttttctcacccaaattatttgtaattacttagtataaatattttaaaaatcatgtatatttccaaataaaattcagaagacaaaaaaagtataaatagtacaggttactctcacattctcactatacaattctaaactagtgtagtatttatatttaatttatacaattccatcttcaaaattttttttgcttaattttgattttgattttttaatatacaaatgcaatgtatttaccacgccttaaacttttactgaaataacttatatatactatgctagatatagcgtaaaatcattaaattacatatttgagtttttgaaaaaatgtaaatatatataaattaataagcttaattacaaataggaccgtccattgtgtatatagtattgtgattgcatagtctaaagtattatcttaaacgaaattgaaaaataaccaactttcttttttctagacgggtcacgataaatggttaatttttaatagatcactaatacagtaaatcactgtaaatctgataacttatttcatccataagtaagtttgtattgcatttgggctactacagaaccaaaggatacattattaggaataggtggagagagacaaaaaaagagtattactggccttcatggcctctttgtgaattgtggccttatatattaggtaatcaattggcccattccaaagaatgtttcgttcattcttatacattactactacattgctaagtgctaagccccccaaatagcaaattctagaataacttttacatgttttgccacttttttattccgacaaatcacgatttatccataggaaaagttgccaactcacccaaacaaacgctaacatccttagaaattaagcagttgatgatcattacatgtgtttttggtgtcatatgacggattcatcaaatcatgttagaatgatgatgttggaaaagaaacacgtaagtagatagcattgattgagatctaaaattgcatttagtaacgaagatcccgtcgattccgtcgtaataactaaagcggtgcatggcaatatgtatattattaatattcattgaggaatgaggaactttcctacacgtaacgaatatacaataatattcctagttagtccaaaatgttggataaatgttcattcatgagttgtgaaaaaaagaaactaaaataatttcaaaaattgttagtattattataattattttttaacaaaatgtttcggttggtgtcatattcttaaagaaaaaaccaataatcaccattacaactaattaagcttaaaacccataaatcacaaacttttcaaaggactgacttccttctaccgaaattatcggaactcattgatgacataaccagacttgcttttgtcgaatgtacctatgattacaaaacatgacacattatacattcacacatacatgagttttggttatttccattatgatatataatatcacacttcaaataacagactttttcttgtttgtctttttcttcaatctttgctaatggtgcagaatggtactcaagcacgtgaaaacgcagaaactcgtatcatccgcttcatttccacggtacaccctcaccttcataactccgatctgtgatctccaccgtccaatagcattgacttcagctcaatatttaatccggcggtccaactattcaattcaagatttaacagaagcatgtgattcttacctcctgacagctcacacgccgcgtttcaaaacaccttcacttgcggacaatacggagcaatggtcgatgtactcttgacccaaagaaggcccaaacatctttaaataaaattaattgtaaactttttgatgagtgagatctaaaaagagtaaaaagacagagaatcttatgataaatttaatatttgttttgctattgtatataaccaactattatgacatagtttgcaatccaaggtgttacaccgaatcggtaaataactaaatactagcttgctcaatctaatagctagagctaataagaaaaatgtatttcgttaggataaataaaaatatcattatgtttacttgaatatttgaaaaaaaatttggtacatgtaaacgaaatttcccaaacaatattctaaagtgtgaaaggatttaaaaatgacgttgactttaggaaaaagtctcttcagttttagttaaaacatattgttaataatgcaaatcaagctcgaaattcaaccaaaagtttataagtgtaaattacttgaaaataatataaccaaataaatttgatgattttgataacattcgaggatatatgttactacatttacgtattttcttaaaattatttcttcaatacaaaaaaaaaaacatattaattacgtcggtgccactgccactaatatttaagagggcatcattaatagattctccattccaaaatcctctgtatatggatctacacctctcctcagtctcatactcaaatcaataatccaaaccccaaaaaaaagaaaaccagagaagagagtttaaaaaatg

SEQ ID NO: 19132 - DNA, 3003 bp, Unknown; identical to SEQ ID NO: 19131
  misc_feature (1)..( 3003): 2750-1469P.txt file - cDNA_ID_1820776; gDNA_ID_1620646; Annot_ID_163235

SEQ ID NO: 19133 - DNA, 3003 bp, Unknown; identical to SEQ ID NO: 19131
  misc_feature (1)..( 3003): 2750-1469P.txt file - cDNA_ID_1820776; gDNA_ID_2926179; Annot_ID_140472

SEQ ID NO: 19134 - DNA, 3003 bp, Unknown; identical to SEQ ID NO: 19131
  misc_feature (1)..( 3003): 2750-1469P.txt file - cDNA_ID_1820776; gDNA_ID_2926179; Annot_ID_200080

SEQ ID NO: 19135 - DNA, 678 bp, Unknown; identical to SEQ ID NO: 3471
  misc_feature (1)..( 678): 2750-1469P.txt file - cDNA_ID_1820787; gDNA_ID_1620647; Annot_ID_47644

SEQ ID NO: 19136 - DNA, 3000 bp, Unknown
  misc_feature (1)..( 3000): 2750-1469P.txt file - cDNA_ID_1820787; gDNA_ID_2926188; Annot_ID_140904
aatttgaagaaaattagatcaattgtctcttaagacaattgatctaattttcttcaaatttaagagacttatctaatatttaaatcatataaaatatttattatttgtttagagttttactaagagtccactattgtggatgctcttaatccttacacattaaaatccctacattaaaataataattatttatttaattttgaagataataaaaaaattaaactaattaataaaaatatatagtaattggcagtatataactatatatatagaaaaacataacaaaaaacaaattaatacttgagaagataaagtaattcactggcagaaaacataacaaaaacaaattaatacttgagaagataaagtaacactggcagtggagaacttgtgttgcagagtacggcaacgtgttcgtacaaacacgtttgaaatattcttgcatgtcataacgcgttttgcaatattatactgtactactattgttttgggttctcattgaattcaagaattaagaaattaaaaatgccaatatataaatgcaaagtttgaaatacgtatttggtaactcgtttattggtatacgattaaatattatttagtatggtgattgatctgtatacacacacacgcacacggaaaactaatgattgtatactaaagtttgttctccattttgatatcaatatgaagagaaataaacttagagcagcaaatagtggtttgtgttcgtgttcttgatgtgtcattgctttgctacaattatgtatagtactgcatgtttgctaaccaaaacaattagagaagccaaatcattaatagttcccttcttagtatagggtttccaacataaaatttgatgttaacacttgcattatcagtccaaactgaagcaattgattagaattattatactcatcatatatatggtgttggaacttgtgaaaaatggatttgtatatacaattggggacttcattaatttttcgacagatatggctgtgtttttttatatgtataaatggctgtataataattgttgattagttgtaaatataatcaagaacacaaaagtgcctcgagaattaaaaacacacatggagtatggtcaagttgtaaattttgtaataatatcttataattaaggagtacactttattacaatcttcaatcattgctgaataatgcatgaatgggtcacatatatatgaagctttacatttgcacatatacaaaatgaattatcaaccaacatagctaatagcttccacttggacactgattctcatgcccaaaatataaataaaaaaatacgaacgaaagaaaaacaaacactttcgtgtaagaaggtaaaatacgacagtcagtctattctcacgtatgtatgtataatctactcactgattgagcaattaacttttattgaacgattaattagattgatataaagctttagaaatgagaagaatcaccaaaacgttacaattagctgtgtcaagtagtttaagaacaccaagccgttatgattagctccaatttgcccaattgtgttaaaatgtgcttattgtacaaatgcagataaagcatgtgatagatggaaattgttgctacgcgtgcaacttagtttttttctataaagttcaagttgctttacaggtttattggcagataatttcaaataccgagttatacaataaacccattgtgatacttaaagaaaacatgtgttttggttttggagcatttctatatagagataaggtatgttgctacctttcttttacagatttactgaagactcgaaagcaataatctatagacttgagaacacaacactgatcaaaatcttcaggggtctctcttttagtcaaatatacagtatgggttttattggtcaaagagatgcaaggagcttaaatccaaaactttgacggttacaaaaagataaaactagtactttgcagttcttaaatcattttttgcatgcttcgtttacaaaaaaaaaaaaaagtaccatttacttgtatgaattaaacgtgagtcacgaactttagtatgactttgaattttgatgatcaatatgatgagtaaatttcttgatttgatgaacagaatcaaaatagatatataaatgggccacatatatgggcctaattagttgggtttaaattaaaacatttcagttgtgattcacaaaccaaaaaacctggttatttggagtcatgcttgtaaacctgaatggttattgataatgttttggttttcaatataaaccggaagttttaacacaaacgaagattcagttaacccttgctatcgaattcgccgcgcctcttcgtctccttcacagagatactcttcgtcaatttgaaaacttccaggtaatctcatctttttcttcttcttcttctccttctatttgtattaagcgtagcctgagaaatctcctggtcggttttgagacagtgccctgtgctctaatttcggttgataccttgacatgtccgtctcttcttcgagggtgatttttgtttttcaaattcagatttaagatgtgacccagttactaaaacttctggttttaaggttgccatcatttatgtggaatatcctcagctcgattgaatctggcagtttttcgtttttctcttgttaatggtttttgttaagaagcgttttggtgttttagtgaataagaacactgccaatcatcatttcacgaacaatggtattagaaagtgcataattttctggatggctgcttctttggttggaattgtttgattcacatttaatacatagtctctattgctcagtttccaatcacttaagagctccgtgttgggttttctagagctaccgtttgatggatttatgtgaggcatcttaatttatccgttctttgtgaatcatcacttcacttgtgctaaacttgagaaaacgtttcccttgatagttttgaactgcagctgatttccgactaaattaaaggagtaaatg

SEQ ID NO: 19137 - DNA, 3000 bp, Unknown; identical to SEQ ID NO: 3470
  misc_feature (1)..( 3000): 2750-1469P.txt file - cDNA_ID_1820791; gDNA_ID_1620647; Annot_ID_47643

SEQ ID NO: 19138 - DNA, 3000 bp, Unknown; identical to SEQ ID NO: 3470
  misc_feature (1)..( 3000): 2750-1469P.txt file - cDNA_ID_1820791; gDNA_ID_2926188; Annot_ID_140903

SEQ ID NO: 19139 - DNA, 3003 bp, Unknown
  misc_feature (1)..( 3003): 2750-1469P.txt file - cDNA_ID_1820805; gDNA_ID_1620647; Annot_ID_47637
atcagcctttgtatgtcaaggtaattgttaatgagaaagttttacaaaccattttactaaactcaatgtagatctgtgtatactctttttgcttatgtttacttatctgcagcagtgttagttttctatgtgcatcttaatgaattctacttggtatcttgtaatggcacagcgttatgagattgtgaatggcactactgaagttgaactggctccagaggatgataccaaggtggaccaaggagaggagaaaactgcagaaggtaacttcatgagcactatgtcttctttgtttgttgttaatctttttggaaagacaaaaacaatttaacatttttctctgtttttcattgcagagaaaggagttccaagtttctggctgacagctctgaaaaataacgatgttatttccgaggaggtagcctatatgcagttttggtgttcgttttataaacactccaatcataaccatggaatatgagcataacttattgtcatttatgtcaggtcacagagcgtgatgaaggggctctcaaatatcttaaagatattaagtggtgcaagattgaagagcctaaaggattcaaacttgagtttttctttgacacgaatccgtattttaagaacactgtcttgacaaagtcttatcatatgattgatgaagatgagccactgcttgagaaggctatggggtaactacttatactctcttgcaattgttgtatacttttaagtatattctgcttattagctgattgcattgagctgcttattttttttcttcgcttatattgcaaatggattcttattctttcaccattcattttcaggacagaaattgattggtatcctggaaagtgtctaactcagaagattctcaagaagaagcctaagaaaggttcaaagaatactaaaccaatcaccaaactcgaagattgtgaaagcttcttcaacttctttagtcctccagaagttccggatgaagatgaagatatcgacgaggaaagagtaagataacgattgttagaaaaacctgtcatcatttagttaatgtatttagtaactctttctcgttctttgatgcaggctgaggatcttcaaaacctgatggaacaagattatgacatcgggttcgtctttttctaaacacactttctctgttgattttatgggtttgcttttgagtcatgggactactttatcactgcaatcaaggtggttaccctttcattattatctgatcacaagtactttttactttctgcagatctactattcgggaaaagattattcctcgtgctgtctcatggtttactggtgaggctatggaagcagaggattttgaaatagatgacgatgaggaagatgacattgatgaggatgaagatgaggaagacgaagaggatgaggaggacgatgatgatgaggatgaagaagaaagcaagaccaaaaagaaggtataaagtgccccaagtatagttgtttcttttttttttttttttcttcatgccacgttagttttttactaatcctttgaaatcgcttaatatttttttttgcagccatcaatcggcaacaaggtatgtaacctttcagaactaaagtttatttgattttggaactccaacattcaaataaccaaacacaagaagtttcaggctgagcattgtgatgaaaatagaaattaatatcggaaatgtaggctctagaggcccatgaatcatacagattgctgaaagtaactgagcaatcctaaaaagtatgaatcagtaaataggtagttacgtagaagactctgagaaggatacatgaatgacacagcagagactaaacaagctctttaatcatggcatgggcagtacgagatagaaccattctcatgaattcattttattactatagtagcaaactagcaatcagtgtctatgtttgtgataaatgtgagaatcatctgcttaatttttttttcctcttggactgcagaagggagggagatctcagatagttggtgaaggtaaacaagatgagaggccacccgaatgcaagcaacagtaatcttttactacgctctaccagacataaaaggattgcgtgaaaatataattcaggtcattctctgttcatcaagaatgaggattgagaaaaggttttgggatttttaaaagtgaaattcatcttgtaggagtttcgttcgtttttctattggtgtgtttattttctctaaagcactttaataatataccttggtatttaatttatgaatcaagcatcatcatccctagtctctgcattcactacttcatcccctacctaaactttgtcgacgaaagagattttaataaccatttagatagtaatgggtagtgggaatgatcattattcttttgttcaccgtcctttgattttcaatggtaaccattttgttgtgtaagactacaaaagatgaataattggactatgaccatattatattagtcaagtctaaatcggtcgaaatcagttcacctttaagatgagtaatttgactaaatgcctccgcttgttcaacactaattataatttaaattattgtagaaggaaaacacaaagaaagtgaggttccgaacatccacaatttggactaatcacatactacttaagaagtttaatgcatcattagagctaaatgaggggaaaaaaaagctagctaaataaacttgagacacttgtttgtgtttggtgttatgaaaaacaaactcaaaagtcgcaacactgtttggtaaattggagacatgcgaagaggggaccgcttcgttaccattcagagtatttgacgtaatatattccgttttaagaaacctatctagtttccaagaaatttactaataaaggtgcttgagaaagaccgttgttgatgatacgtttttttatttgctaatgaaacgattcggtcgttgtttcttgaaattccactgttattagactcttgactctgttttgtttcccgccgatctcgtgatgatg

SEQ ID NO: 19140 - DNA, 3003 bp, Unknown; identical to SEQ ID NO: 19139
  misc_feature (1)..( 3003): 2750-1469P.txt file - cDNA_ID_1820805; gDNA_ID_1620647; Annot_ID_163293

SEQ ID NO: 19141 - DNA, 3003 bp, Unknown; identical to SEQ ID NO: 19139
  misc_feature (1)..( 3003): 2750-1469P.txt file - cDNA_ID_1820805; gDNA_ID_2926188; Annot_ID_140898

SEQ ID NO: 19142 - DNA, 3003 bp, Unknown; identical to SEQ ID NO: 19139
  misc_feature (1)..( 3003): 2750-1469P.txt file - cDNA_ID_1820805; gDNA_ID_2926188; Annot_ID_200809

SEQ ID NO: 19143 - DNA, 3000 bp, Unknown; identical to SEQ ID NO: 3457
  misc_feature (1)..( 3000): 2750-1469P.txt file - cDNA_ID_1820809; gDNA_ID_1620647; Annot_ID_47635

SEQ ID NO: 19144 - DNA, 3000 bp, Unknown; identical to SEQ ID NO: 3457
  misc_feature (1)..( 3000): 2750-1469P.txt file - cDNA_ID_1820809; gDNA_ID_1620647; Annot_ID_163290

SEQ ID NO: 19145 - DNA, 3000 bp, Unknown; identical to SEQ ID NO: 3457
  misc_feature (1)..( 3000): 2750-1469P.txt file - cDNA_ID_1820809; gDNA_ID_2926188; Annot_ID_140896

SEQ ID NO: 19146 - DNA, 3000 bp, Unknown; identical to SEQ ID NO: 3457
  misc_feature (1)..( 3000): 2750-1469P.txt file - cDNA_ID_1820809; gDNA_ID_2926188; Annot_ID_200806

SEQ ID NO: 19147 - DNA, 3000 bp, Unknown; identical to SEQ ID NO: 3458
  misc_feature (1)..( 3000): 2750-1469P.txt file - cDNA_ID_1820817; gDNA_ID_1620647; Annot_ID_47633

SEQ ID NO: 19148 - DNA, 3000 bp, Unknown; identical to SEQ ID NO: 3458
  misc_feature (1)..( 3000): 2750-1469P.txt file - cDNA_ID_1820817; gDNA_ID_1620647; Annot_ID_163288

SEQ ID NO: 19149 - DNA, 3000 bp, Unknown; identical to SEQ ID NO: 3458
  misc_feature (1)..( 3000): 2750-1469P.txt file - cDNA_ID_1820817; gDNA_ID_2926188; Annot_ID_140894

SEQ ID NO: 19150 - DNA, 3000 bp, Unknown; identical to SEQ ID NO: 3458
  misc_feature (1)..( 3000): 2750-1469P.txt file - cDNA_ID_1820817; gDNA_ID_2926188; Annot_ID_200804

SEQ ID NO: 19151 - DNA, 3003 bp, Unknown
  misc_feature (1)..( 3003): 2750-1469P.txt file - cDNA_ID_1820835; gDNA_ID_1620647; Annot_ID_47626
tctccttctacgtgatttactgtgttcaaagctaattcgaatttggggatttttaatttctatttctagggtttcttaatcataagtaggaagattcttgagttgtgatcattaaagttgtgaacttttatcccctagttgtgcaatttgattactttatggttccaattatagtttgaagtgttcactaagttaattacttgctcaatgttatgttttaggtgttaatatctggtaaggaagaaccagaggcctacatgtcaccggcaatggacgcagtgttgagggtgtttagacgtgtttcagggttgcctgataatgatgatgatgatgttcaaaacgctggaagtgtcttctcttcagtgcgtttattagttgcttcaacgcaggcgattaatttgattggaaaacaaggatctttgattaagtctatagtagagaactctggtgcatcagttcgtattttatcagaaggtattatctatcatctgcagttttctgtttttacctaattgatctctttgtttgtgattgttaaagtttagtttttgctatttcaattcatgtctgtttttttttctaaaattggtgtctttgttgccagtttcttatttctctacttttttctgccagaggaaacaccgttttatgctgcacaggatgagaggatagtggatttgcaaggggaagctttaaagattcttaaagcattagaagccattgttggacaccttaggagatttttagttgaccatactgttgtccctctcttcgagaagcaagtaagcttgcttgtttcaatcgagattattcctttcccttttttttcttttctgaattattgttatcttttcttatcttcagtatctagctagggtctctcaaactcgccaggaagaaccgttagctgaaagcaagtcatctctgcatactatttcgtcaaatctaatggagcctgatttctccctcttagcacggagggaacctttgtttctggagcgcgattctcgggtggactcacgtgttcagccttcgggagtttctatctacagtcaggatcctgtactgtctgccagacactccccaggtcttgctcgggtttcttctgcttttgtgacacaggtagattcccttaaatacaacatcagctcctgaaaacgagtttagcgatatcatcttacttgttatgattagtcttccagcagtgattttgatcttaacacatctaacttgtttctctgaactagtagtgacgtttctataatggattctcttactaggtatctcaaacgatgcaaataccattctcctatgcagaggatattattggtgtagaaggagctaatatagcctatatccgtcgaagaagcggagctaccataaccattaaagagagtccgcatcctgatcaaatcacagtggaaatcaaaggcacaacttctcaagtacaaactgctgagcaactaattcaagtaagaacacattcgatctgtatatatatatatatactttctgcgacgtggcattgtataaacactaagattatgcttgctttgcatcctaccccgcctgcttcatcataaccgtattcttttgtttacgtgtgtgtaggagttcatcatcaatcacaaggaaccagtttcggtatcagggggatatgccagaatcgactctggatatgtacctgcatatcctcctcagctaagtaaccgtcaagagccgctcccgagcacctacatgggcacagagccggtgcagtacagaccaacagcatactctcagctggggggtccttctacctacacaccgaccctgactgggcaaacttatggttcggaatatagaccagcttctgatgttggtggctacagcagttataatctttgaattggttgctgtgtttaagtttatttgcagattaatttctctttagagaaaggctcatttataatataatagagagggaaaaggaacaagttctagagagccaatgtagttgttggaatgtgtaatgtaaatctaggtgccctttttttttttttttttcatacctcgatatatgtcacactacgtttctggtcaaataagaacatgttttttctttcttttttgtatgaatttgtttatcagaagtcagaatgattcagttttaagaaatttttagttaacgttttacaacaataacctgtaggagctttttcttaattgaataagtttaagctttctattttgatctgatgatgctaatatgaaagcattctccgaagaaccaaaccacatgagactttttgatttcaatgtccattcgtaactagtaacggaaaagatcagacagaaaaaatgtaccaatcattccatatttgtagttttacatgatatagtaatattctctaggtgtttaagttgtatatttcatgatttttacacattttaaaacctgattaaggcctgtttttaactttttatttcttcaaaccgtaagaaacaatccttgcaagaaacaatccttgcttcttcttctttttttcgtcaagaaacaatccttgctatattttcatttttacagcttcttgtttttaagagagcaaatataataaataaggacggctgaaaagaggtatatgtatcacaaaattaaacaaaagagaatccacctatcgacatagacgtggtatcctttcgatatcgacagaattatgttgaacgcagcaagttggccattaatcaaatctttgacgcgtggaatcattctattgtcaatgaaaacaaatattaaagaacaggtactacctatatacctaatagattcctctaacccgtcaaatgtcaatgtatcgaccgttacaattatgcacgtcttctaattgaaacattctctactttgccaatgtcttatccccaaaactacatataaatatgcatttacgggggcttagaatttcatcacaaaacttgcaagtatcattcacaggagagggaagggagagctcatcatacgaaatg

SEQ ID NO: 19152 - DNA, 3003 bp, Unknown; identical to SEQ ID NO: 19151
  misc_feature (1)..( 3003): 2750-1469P.txt file - cDNA_ID_1820835; gDNA_ID_2926188; Annot_ID_140887

SEQ ID NO: 19153 - DNA, 3000 bp, Unknown; identical to SEQ ID NO: 3462
  misc_feature (1)..( 3000): 2750-1469P.txt file - cDNA_ID_1820838; gDNA_ID_1620647; Annot_ID_47624

SEQ ID NO: 19154 - DNA, 3000 bp, Unknown; identical to SEQ ID NO: 3462
  misc_feature (1)..( 3000): 2750-1469P.txt file - cDNA_ID_1820838; gDNA_ID_2926188; Annot_ID_140885

SEQ ID NO: 19155 - DNA, 3003 bp, Unknown
  misc_feature (1)..( 3003): 2750-1469P.txt file - cDNA_ID_1820846; gDNA_ID_1620647; Annot_ID_47622
caaatgccccttttcgcgcttggcgtctcgcaagccttagtttcctattacagtggttgggatgagactcaaaaagagatcaagaagatcgctatcctcttctgctgcgcgtccgttatcactctaattgtctacaccattgagcatatctgctttggcactatgggcgagcgtctcactctccgtgtccgcgaaaatatgttcagaggttcgtctcaaactctcaatgcaagctttaaataaatgataaatttaaaattcttcagaaattagagatcccaatttttattatcatgtgatacttattctgtttttggtttaatagcaatcttgaagaatgaaatcgggtggtttgatgaggtggacaacacaagctcaatgttggcatcgcggcttgagagcgatgcaactttgcttaaaaccatagtggtcgataggtcaacgattctactgcagaacttaggtctagttgtgacctcttttatcatagcatttatactcaactggcgtctcactcttgtcgtcttggccacatacccattggttataagcggacatatcagcgaggtaattaacgcaccgttttgccacttttaaaaattttcctttatgtttatgtttacgtttgtgtttttgttgtatttgtagaaacttttcatgcaaggatatggaggagacttgaacaaagcatacttaaaggccaacatgttggccggtgagtctgttagcaacatccgcacggtcgctgccttctgtgctgaggaaaagattctagaactttattcaagagagcttttagaaccttccaaaagttctttcaggcgtggacaaattgcaggacttttctacggtgtctctcagttcttcattttctcttcctatggcctcgccctctggtatgtctctatgtatatagaagattgtaaattaataggcctagggttcagaccaataaagaataggcatagggattcaccggttttaaatattgaattgtcaattgtttgatttgataggtacggatcaactttgatggacaaaggattagcgggcttcaaatcagtgatgaaaacattcatggttttgattgtgacggcgttagcgatgggtgagacattggctctagctccggatctgctgaaaggaaaccagatggttgcgtccgtgtttgagatcttggaccggaaaactcagatcgttggagaaaccagcgaggagctgaacaatgtggaaggcacgattgagctcaaaggcgtccactttagctacccttcgagaccagatgttgtaattttccgggactttgatctgatagttcgtgccggaaagagcatggcgctcgttggacagagtggatctgggaaaagttctgttatttcactcattctccggttctatgacccgactgctggaaaagtcatgatagagggtgagtgcacttgacttagacctatgaacacaaaattcttgcgtttcaagaaataactaaggtttcttggatcaaaagacagtagttgtttagttgaaataaatttgtttttttccctcttacccaaattgcaggaaaagacatcaagaaactagatttgaaagcattgaggaaacacattggtcttgttcaacaagaaccagcacttttcgccacaacaatctacgagaacattttgtatggaaacgaaggagcatctcaatctgaagtcgtcgaatcagctatgctcgcaaatgctcacagcttcattacctctctcccagaaggttactctaccaaagtcggtgaacgtggagttcaaatgtcaggcgggcagagacagaggatcgctatcgctagagccattctcaagaatccagcaattctattacttgacgaagccacaagcgctttggacgttgaatctgagcgtgtggtaggtttctttaccattagactttgtaaaatttaatcacaatggactaatgagtatacaacgaatgaatattgttaggtacaacaagcattggatcggttaatggctaaccggacgactgtggtagttgctcacaggctatcgacgatcaagaacgctgacacgataagtgtattacacggaggtaagatcgtagagcaaggcagccaccgtaagctcgttctaaacaagagtggtccatattttaaacttatcagtcttcagcagcagcaacaaccttaaattaagtactatactttatttattgaaaaactctttttatttttatttttgtggaaaatattgatcatatactcatttgatgtgattatcttaatcttcttgatttaccgttggtaaaaaaaaagttacgaaatccaaaataggaaaatgttctgaaacgttggctatgtattttcacccaaatttggatttagttatttttgagcactgtctttatcgtcagcacgtttcactgcgacattctccaaaggaaatgatcaacaaaaggacaacttgattggtttcaggaatctccagagttcatcatgtcctactaaatgacaaaaccctttacaaaaagggagccatcaccacaaataattaaataaaaccaagtcaaattaaaactgtattaactatttcaccaacaccaagttgaagttttctaattactattttttttttttgtcaaacatcatctttaatatgttataaatcgtttgcataattttgttataatttgtttgtattatttggttataaaatctcccacctttttggttatttcacacatcttttacttatacaaaaatctttcctgattttaattaaataaagctaaaacactttagtaatacaagtaaaattaaaaacaaaacaaaaaaattcgggaaaagtatttggtgtgataaattccctctccagcttctcggtgacacagatattttgcttccaaataaaacgagtccggtcactggcgctcactgacttcgtcttcctccatctccgatccattggtttaacaagcgcgtgagggccagatagaccgagaatcatg

SEQ ID NO: 19156 - DNA, 3003 bp, Unknown; identical to SEQ ID NO: 19155
  misc_feature (1)..( 3003): 2750-1469P.txt file - cDNA_ID_1820846; gDNA_ID_2926188; Annot_ID_140883

SEQ ID NO: 19157 - DNA, 3003 bp, Unknown
  misc_feature (1)..( 3003): 2750-1469P.txt file - cDNA_ID_1820850; gDNA_ID_1620647; Annot_ID_47621
aaaatatatctcaaacatactatttatagaaaatcccaaccgattacaaagcagctgatcggtgtgtatttacaagtaatgtgtgatttttttttttgaaaaatcgtgaattaaaaggaatcccaacgtgtgaggtgtgactctaaagtctgaataaagttgacgatccataattttcttatgtttgccgtcgattgtgagaattgagaagcatatgtggtttctcttctaagagttaaaaataccgtgaaataaaagctatattaattcatatgttttatcatatatcttcgaatatcagcattagaccttattagccagctcaagtacgtcattttcactgatataaatgcaaattaataaccagatcgtgcccaaaacgaataaattattccatgcatgcagttgcatcattattttttggtatagtataaagttgcatcattatacttcgcattaattttccaccacgcattccctcctaaataaaaagaattaaaattgtcacatccatctatatcaacataagcaagaggttcgagttggaagataaaggagatttttttttcttttccatatttcatctatttggaatggtgctgtcaaaatatctatcaagataatttacaaaatatgatggtgaacaataggatgtggttgttttcggttatccttatagcgtcttgtcttcttagattcaaagcggtgataatagtcgcggccggagcggtggccataattgcgtttgatgcggcgatagtttggttaaaggtctcgttgatgtttgaatgccatactttgatgttattctttccttttagtttgttattttatgttcttgtacaaaaaagttattgaattgccaaagaaatcttttctatatctataagttcaatatcgaacttcagaatataaaaaagaaacaattgatatcaataacattcaaaataattgaaattaataaacagtgattctaatttagccatttacaagcaaacttaaaagataaaggtgatctagatatattttaaatagaaaatggaatcatataatgaattttttgaaagtttcaccatagataagttgttgaaaacacatggtgagttttttactcatcaatgtcgtatatatgacttaaaaaatactttcttatatccaaatataaagaaaaagcaattaggtatgtaacgatgaagcaagattaaattgaaattaaattgcaacaaataaaatttgatagaaaaaaaaaatagtttttaccaaaacgaaaaagcaagattaaaatatgtggaaaaaacgtcgaatcaggagaatatatgagatgactctcagacatcataacacatacatacgtagtaatatattaacaactgcgtcgaatcgtaagacttggtcacttcagtacatgactaagcatcattcgggaccagccaaaaaacatgtatgcttcaaaaccagaccccaccacattataagctcatctcagtcatcaccacaaccaacgcaaagaattcttcttcttcttcttcttgacttggcgttttttcttctaataattttaattttaattttattttcaacatattcaagtaattaataggatcgacttgttggaaattgtttaagttctacttgttgaatattgtcaatttatttggatcatgttatttaagttctacttgttccaaaaagatatgaaagctaattggaacagaaatttgtctagtttcttaaaaaaaattggaaaatattattttaacgtatattttttcagatatatttcaaaacataataaagaaatattttgatgatataaatttatttaggagatgtatacagtcttaagtttttcttacatgaatttgagataaatcttttcttcttgaactgattaaagagggtatcaatgtcttattgaatctcaatccagcggacatagatcaaaagtccaaagcaacaacatgtgaacgcgttttgatataaatacaatcattatccattaacacgaacttccttttttacatcatttttaacttcattgtaggggcgacgtgttgaagtcttgaataggggtggacattttttggtttatttttagagagtttggatttggtttcattttcccaaactagagtttaatagagttctgaccgaagttatttatttggtgcagatcagtttattagatcattcatcaatttcttattcattatttcatatttctaattttttttatgaaaattatcgatggaattggtttcccaaaattttgtattaactcgtattttcataattttctctttaacaggttatacaaatagtagttgtcaactttacgtaaattacatcaaattttaagtaataaattttaaaattctagatgttgttaacaatgacaaacaaatttatttagtgacagcatttttattcagttagtgtatacacttttgtttttgtcaaagactataaacttaaaacatttaaatatagataggagtagttgaatcatctttgtaagtttgactattacaaaactgagtcttaaaagacattttatattaaaagatacctcagataagcaaactcttttacacgaaaatagacacttgttcctttcaccatttattatccctcccttaccgtgagcaagctaacgagccgagaaaactacgcacgtaccaaattaatacttcaagtaactactaccatttaccaacataattcggtaaaaaaactaaacaaaaatccaaaatttgggagtgatcaaactttattaagagagttactaactagggtcacacacacatacatacatagagcttcacaccaaacaattctcgctgaaaccaataaacttggtcttatgtcttctttcatttaatgtatatctctctcatcttcttcctctctaaccactttcctcccttaatttctatccctatatttattttcctttcattttcctctccaactaattacacacacttgaagctgaaaaaaatg

SEQ ID NO: 19158 - DNA, 3003 bp, Unknown; identical to SEQ ID NO: 19157
  misc_feature (1)..( 3003): 2750-1469P.txt file - cDNA_ID_1820850; gDNA_ID_1620647; Annot_ID_163274

SEQ ID NO: 19159 - DNA, 3003 bp, Unknown; identical to SEQ ID NO: 19157
  misc_feature (1)..( 3003): 2750-1469P.txt file - cDNA_ID_1820850; gDNA_ID_1620628; Annot_ID_162582

SEQ ID NO: 19160 - DNA, 3003 bp, Unknown; identical to SEQ ID NO: 19157
  misc_feature (1)..( 3003): 2750-1469P.txt file - cDNA_ID_1820850; gDNA_ID_2926188; Annot_ID_140882

SEQ ID NO: 19161 - DNA, 3003 bp, Unknown; identical to SEQ ID NO: 19157
  misc_feature (1)..( 3003): 2750-1469P.txt file - cDNA_ID_1820850; gDNA_ID_2926188; Annot_ID_200791

SEQ ID NO: 19162 - DNA, 3000 bp, Unknown; identical to SEQ ID NO: 3147
  misc_feature (1)..( 3000): 2750-1469P.txt file - cDNA_ID_1820858; gDNA_ID_1620647; Annot_ID_47619

SEQ ID NO: 19163 - DNA, 3000 bp, Unknown; identical to SEQ ID NO: 3147
  misc_feature (1)..( 3000): 2750-1469P.txt file - cDNA_ID_1820858; gDNA_ID_2926188; Annot_ID_140880

SEQ ID NO: 19164 - DNA, 88 bp, Unknown
  misc_feature (1)..( 88): 2750-1469P.txt file - cDNA_ID_1820870; gDNA_ID_1620647; Annot_ID_47615
gaattccagtattgtttccgcaagtatgtgtttatagaaaaaaaaacttttctttgttgttgaagggtatagttttgttaatgaaatg

SEQ ID NO: 19165 - DNA, 3000 bp, Unknown; identical to SEQ ID NO: 3486
  misc_feature (1)..( 3000): 2750-1469P.txt file - cDNA_ID_1820873; gDNA_ID_1620648; Annot_ID_47680

SEQ ID NO: 19166 - DNA, 3000 bp, Unknown; identical to SEQ ID NO: 3486
  misc_feature (1)..( 3000): 2750-1469P.txt file - cDNA_ID_1820873; gDNA_ID_1620652; Annot_ID_47751

SEQ ID NO: 19167 - DNA, 3000 bp, Unknown
  misc_feature (1)..( 3000): 2750-1469P.txt file - cDNA_ID_1820873; gDNA_ID_2926215; Annot_ID_142164
catagcagtatttctgtggcaatcgcatccgctgtacccttttcttctatttctcaacagagatgaagatcacaacaggtgattcaatcccctctgtaatcgtttcctttgatgagattgtactaatcttttgtgtaaattgtcaagggcgacagaggcgctgcgttggtgggaagacggagagacggtgggaggaagagaccttgttggcggcgggacgtggctgggctgcacgaggcatggccgtctggctttcctcaccaatttcaaggaagcctcctccttccctgctgctaaatcccgtggagatctgcctcttcgttacttgcaggtctacaccaccacctaatatgctttagattgtctctcatgttagagactgagagtacttttaacgttttggtgagaacagagcgaaaagagtccggccgagtttgccgaggagatccaagacgaaatttcactctacaatggctttaacctggttgtcgctcatgtcttgtccaaatccatgatttacattaccaaccgaccaccccacggtgacaagctcgtgacgcaagtctctcccgggatccatgtcctttccaacgccaacctcgactccccttggcccaaggtaagtaaatgtgggccatttctccctttatttaccttttgcagactcccccaattgcgtgtttttgtctctgcagtgtctgaggctgagggagggtttccaacagcttctggctgagaacgggagcggtgaattcccggtgaagaccatggtggaggaggtgatgaccaatactgtcaaggacgaagaaaccgagctacctcacgttttcacaccagagacggaataccatctcagctccatcttcgtcgacatgcagagaccaactgtaaccttccttttttagagtacattgattgtttgtttaacactttccataaatattcagtctcactcatggagatacaggggcgttatgggaccagaagcatctctgcgatcatcgtcaagtcccatggagatggtggtggtgatggtgagatttgcttctacgagaggcatcttgaagaaggcgattcatggaaggaacacactcaacagtttgtaataatacaaaaccaaagcatttgattagctagccaggcttatttcgcgagcttcccttgcttgtaacattgagaaatcaaaactctcacatatgttgtacatgtaaacacaaaacagaagacagagctgatctcttttattccaaaccatcaaaatacaaatacaatcacagttactcttaaaaccacaaccaattccatatacataattgcacacaaggagagaaaaacctctccaatctctgacttcacggacgctcacactttgacagagaagatctcactcagggaactccaagttcccgacacagcaagaaccacacctagtaccacaatcgctgtgtctgaactccattgcagccaccccatctcttccttgaacaccaataaatgaaacaatgcaggtaacacaaagcctaacacacagcaagtgctgctgccaaccaatgacaaaaaatctgcaaagtttggcacaaaaagagccaccagagtcactgctaagacgagtacccatctgagccacgcagagtacatcccgcgtgagaaacgcctctccactatctcaaacactggattcatcatcaaggggaaggtgaagaagaggttgatgcacagtccaagctggacaacagtgctgacaagtcctgcccccaagttagcagtgataatgtccatggtgtcctcaccaaaagccaagtaacctaagataccaaatgcgatgtatatgagagagatgaatcccatgccgagagccaagactttgccaaacttgtccttgtccttcatctccgattcaagaggcaagaccattccaacgccttcgaaggaatagacagcgacgcccataccatacaagaagagggacataccaccaaaggcaaccacgtcaggcctttgcttgagtataatcatggaatcctcaacaatgaccacagccatagcgccaagatcaacaatatcggcgaagatgctgagaggagccaagtgagtgagcgtcttgatcgaattcaaaccgagctgaaagggaaagcatccccatatgtagagactcttagaagacacgcccaggaattcagaacccagccttgtaaactgatgcctcagactggtgggcgattcaggatcggatagattagctaaagtagtgccgatgaagataagatatccgacacaaaaaccagcttgagacagaatgataaataagtcaacgacgatcctccccaaggagccgcagacggcgaatccaaggtcaccaaaagagccgatcttggagatgccagcattgaaagagtcgagcttgcggcgggtatagacaagaagcatcatacagtgatgggtcaaaacagagacggagacgaggaggaggacacccatgagccatccggttcgcttgaaggcgtaaggaagaccaagaacaccagcgccgacgacagcgatgaagacgttggcgaaggtcttaaactggctggagaggggaggtcccttgccgagaagaggcgagtcctctctggccggtggaggtattttaagggtataagaggaggagctagcttcgttctgaaaacccatctgatgattttcgaccgaatctcagaaatcgaagaagatggggatggatattggcgaatggcgacagcaagataattggatgaattgcgtgtagagttggtggactctcttttttggtttgttgtcagagatttacagaggaagaagctcggctctatttatggatgaaatgaaatggtcatcttatcatttttactgggaaacggtaccgtttttgttataacgcacgacgccgtttcaaacaacttccttattagctagctccctcccggcggcaaacaccagaagatccaccggttttgatctggttgtttgtcgtcgataatg

SEQ ID NO: 19168 - DNA, 3003 bp, Unknown
  misc_feature (1)..( 3003): 2750-1469P.txt file - cDNA_ID_1820881; gDNA_ID_1620648; Annot_ID_47678
accaggcagcccaaaaactggattctacccatgggagcagcctcgaaggaagaagcagcagcgagatctcccctagtggttgcagtgctgaaggctctgagggaactgaaaagagattcattcaagaggtatgcaccgaatttcttcccattgttggtggagcttgtgcggagcgagcacagctcttcacaagtcccacaagtcttaagcacagtgttccatacatgtatgggtgcaatgatggatgaataatagggtggttataagtgggttttgacattcgagcacctgaaggatattgattaacaagcagacacaaatcactcttttcttcttttgttttttcttctcgacggagatgcgagatttacaggttttgtgctgttgattgatagtgctgatataaagtaattgattactgtttgtagaaactaagaaaagaatggtgagattaggagggtcattgcattttgtctgcaatgcctattttcttccttccagtcgtgatcaatgtgcataatatactctcacacagctaaatgcggtccaagtaaggattgtgaaggatatattatataaaaagaaaaaagaaaagagaagacaaagatgagccactcgtggaaagtcatttatacctccttgaaatgaagtgatgatatctaatgactccaaagtcataataaagtcaccgaaagtgaatcatgatttgaagaagataaaggagtcaggagtggaactgctttccttggtatgtcattccgaagcgccaatacggaggagccacatcataagaggcaatggttttgccgcctttgagagtaacctcgaaagagagagactgtccgatgagatcgagagaggagtgccagttctgtccccagtttctggccattgggatccaagccgttgtgtggcccttcactttcacaccaaccacttccccgtcgaggcccacattgcttatcaacacctggaaaaagtgggagctcccgctcaagctgaatctcaacccgcctctccgcccacacttgaccctcctatactgtataggtatcatctcagctctggtttctgcgatccctgtgaaggcggcatgagatagttccaagtgttcctttgggaagttgcaccaacctccgtaatcggaggagagtcccgaattgggaggacagaaatcggtggcggtgaccaccacggaggggctgccttgaagacaccaacggatgtggttcacgcaccgcacttctagacaagctccgcagctgcttcccctgttgaacagcttcccgctcaggcctgcgctgtagccggcaaagctgctctgcctcagatctccatacccacaagcgcctcctatcagaaccaattagtctagttagtcctgatgaaagaagaaagaaaaataggggggagagagagaaaagagaaccagtagcgacggaggaggagccgtctctgtctctagaaagcgtggctgtggctatcttccagtcatcttcggcagtggcttgaaagaggcggcagagaatgaagaagaggcacaatgcgagttgctgaagcccagaatccatgaacaagaagtgttgttgggatcctcacagtcagtcacaggtggcagacaaaagtgatgcgtttgagagagttttgggggttccttttgatcatcaggctccgcttttcaagacttgtggggatgcgacaaaagattgctctgacatgttttgactttgacagtccgtttcagaccaattataataaaaaaacaaaaaagggaacaactatacgttttccaggcccatctcattcggaggcccactttcaatacgacacagaatcaagacaagagacgcaagacgaacttcttgagcccttttgttaattcaatgggccctcactaagaagcccataataaaataaaataagttctattttcaaacattgtactattactttttgtaccggccgtgtttattcaattctcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgacatggaagagatcagagacatcaagaaagaaggtcagtgcgtcaataaaagcctggtaggtggtgatatggaggccgtcgatgtggggatagggcagcctgggcctggtggtggtggtggtgggagaagagaggaaaacgtactctttgaatcctcctcctgctccggtggcctgagcgacgaagcccatggtggacatgattggttcaagctcctcgtgcgtcataacaggcttgaaggttctcgtgtgccacaaggccagtttcctcatactgcactcctccatcatctctctcgagatccacaagtgagtgagtgtagggattatggttacaattagtttggtttttctttcttttgcccttgttatttcatttattcaccaaactgccattcctttctgccacgtggccttcttcatcccatttgtgagcaattcaatttagtaatccatttgctgctctgtagtggaagtagttgttgttgttgttgcagaagaatccgaatccaattcaatg

SEQ ID NO: 19169 - DNA, 3003 bp, Unknown; identical to SEQ ID NO: 19168
  misc_feature (1)..( 3003): 2750-1469P.txt file - cDNA_ID_1820881; gDNA_ID_2926215; Annot_ID_142162

SEQ ID NO: 19170 - DNA, 3003 bp, Unknown
  misc_feature (1)..( 3003): 2750-1469P.txt file - cDNA_ID_1820885; gDNA_ID_1620648; Annot_ID_47676
agatccgcaaagctagcagcttctgccatagcttcaaaggatagaagagctcctccatcatcagaaagatagcatgacaccttctccaccggataatcaacggccaatatggacagaatcgtgttggcggtgacaaggggcggctctttctctggatctgccgttgacacaaaaaggtcaatacctgggagatccgacctccctgttgggttggagggagaaggcatgtcaaatttgtcacgaagaacttccaggtcagtggaccggtttattggacacaacttagggatctggtctagaatccatgaaaatccaaaccaaagctcgcatattatagacatgagccataaccatattgcgtcttcgttaggatttcggatcctccaagttagaaaaaaacatagcacgacaaaacgaatgacgattagtaatctgtaaggactaatgatggcggctggaatagggattcgtcggctcagtggccgccatggcttgtcagctgtttccaccatgccgcctctcatcccttcatccatatcatcgccatacatttcgtcttgaggccaatacgcattaccgtacccatatgtgccttgcgtctcgaatagccatctgttgtgatcaaattcaccgttttggttcctcttcatcatagacatgttgttgttgttcccacgttgatctttccctggagctggtaaggggagagcaccactagaatagtcaggcgtatcgtcatctaggtccccgattttgtattgttccttgcatcctggacaaaggcctgtctctttctgggcgtccatgaagcaatccctacagatcttaaacctacaaagacaatcatcaccacgtttgttggttagttagaattaaacctcattttcttgtgcaacaagtaaaagatatcaattagtgtttattaatatataccggcattcacatggcatcacgtcctttcctctctcgtctttcatgacatttccgtcgcaagcaggcatggcacacgaagagcctttagcgccagccatctgagggtgtgtgacatctgaatcgatcactttgtccataagatgtgcacgtgttacactgttgaaaccaccagtaaataaagaatttgacacgtattgctcttcggctttggtggccatgggctgattgtccggcgtcggaggtatgtgcaccgtatagttagaataatccccggagagctcgcctgataattctatattatctcgagataaactcacatatcttccgctagatgttcgtcttgcaaatttgacggtttggccgctaccggaattgttacggacctttttagaagtttgaggaggcgtggacgccattgtgaagccaaacaaaggagcttggtttctgcaatgtgatcatgcagtataaagatgaaacgtgacttttttaccttcttgttgattttggcaaaacagagagaaagataaggaggagagaattatcaggacacaaaactgtttatgccatggattcctatttttgggcttctatgtatcatgcactaacctattttaggaagctcgagggttttgttgtttattctattttgggattttaacatattctttcttttaactcaaatgatttattctggaaccccattcttcgctcatacaagccgatggaaaatttcctacttttttagttaacgcacagtccatattttttttattattcaactactaactatagaaatgatccttatcgtttgattttttttttttttttttttggcaactattctcgttactaatttaaaatgtggattactgcataatttcatattgaataagattagatatccttaattcgtcttaacactacgcttgttttcaattttcaacttgtttgcttgttttttccaaatttagataattggacttagcttcaaaaccgatgatcttaatgtgaattaatcatctaccattacttaataaggaattgtgttaattagtattgtactatacttttactttggaatttgaagaacttaacccaattagactaatttcaaatacaatataaaggagctaacggttaaatggcagatttctaatactaatagttttggaaattgatatgtaagagctatattataaactaagaatgatgcatgatttactgatagctaaatggatggacttagtttttgtataaacacatacaaacattgtttagctacacaatattctactagcgtattactaattgacagtacaatagtgaaattgaagaagcatcaaaaatatacttgcaatacatagaaggttcagtgtaacaaaggggttatatttggggactagctagagagacggtgataaaattgttggacgtctgtttcagagtacacgggaatatcccaacgtccacaaacgcaaatatgttaagatctagctaggcttatgcatgtaaaactggcggtagaaaatcacgataacatatctcgtaggcttgaccagatcaagaagcaccatccaaaactcgtctgatgatcccatgctgtctagtgaggttgaacagacaatattgggaagtatacataagagaagctgactcgtgaggttgaatagataaagtgtaacgtactagtgtttttttgttgttgttgtaatagtactgttgatggattttgataacgttcgttaaattatgtttatggatttactagttggaaacgagttatttttatatggaatcaaagaacatcttgttaacgatgttaaaaaccacttaaatattttttgttaactttaaaacggtgaatttaaacgataacattatgttaaattgagatttaaatgattttttttcctatgggctattaaattataattaatcaaatacaaaacgctgaaaggtaagaattaagaatgaaagaaacgcagcgtttcgtttcgacaaagtccccgggttctgggttggccttttatcattttgaatcgccgtgagaagtcgaatatgcgttagatg

SEQ ID NO: 19171 - DNA, 3003 bp, Unknown; identical to SEQ ID NO: 19170
  misc_feature (1)..( 3003): 2750-1469P.txt file - cDNA_ID_1820885; gDNA_ID_1620648; Annot_ID_163353

SEQ ID NO: 19172 - DNA, 3003 bp, Unknown; identical to SEQ ID NO: 19170
  misc_feature (1)..( 3003): 2750-1469P.txt file - cDNA_ID_1820885; gDNA_ID_2926215; Annot_ID_142160

SEQ ID NO: 19173 - DNA, 3000 bp, Unknown; identical to SEQ ID NO: 3491
  misc_feature (1)..( 3000): 2750-1469P.txt file - cDNA_ID_1820889; gDNA_ID_1620648; Annot_ID_47675

SEQ ID NO: 19174 - DNA, 3000 bp, Unknown; identical to SEQ ID NO: 3491
  misc_feature (1)..( 3000): 2750-1469P.txt file - cDNA_ID_1820889; gDNA_ID_1620648; Annot_ID_163352

SEQ ID NO: 19175 - DNA, 3000 bp, Unknown; identical to SEQ ID NO: 3491
  misc_feature (1)..( 3000): 2750-1469P.txt file - cDNA_ID_1820889; gDNA_ID_2926215; Annot_ID_142159

SEQ ID NO: 19176 - DNA, 3000 bp, Unknown; identical to SEQ ID NO: 3491
  misc_feature (1)..( 3000): 2750-1469P.txt file - cDNA_ID_1820889; gDNA_ID_2926215; Annot_ID_202894

SEQ ID NO: 19177 - DNA, 3000 bp, Unknown; identical to SEQ ID NO: 3492
  misc_feature (1)..( 3000): 2750-1469P.txt file - cDNA_ID_1820909; gDNA_ID_1620648; Annot_ID_47669

SEQ ID NO: 19178 - DNA, 3000 bp, Unknown; identical to SEQ ID NO: 3492
  misc_feature (1)..( 3000): 2750-1469P.txt file - cDNA_ID_1820909; gDNA_ID_1620648; Annot_ID_163346

SEQ ID NO: 19179 - DNA, 3000 bp, Unknown; identical to SEQ ID NO: 3492
  misc_feature (1)..( 3000): 2750-1469P.txt file - cDNA_ID_1820909; gDNA_ID_2926215; Annot_ID_142153

SEQ ID NO: 19180 - DNA, 3000 bp, Unknown; identical to SEQ ID NO: 3492
  misc_feature (1)..( 3000): 2750-1469P.txt file - cDNA_ID_1820909; gDNA_ID_2926215; Annot_ID_202888

SEQ ID NO: 19181 - DNA, 3003 bp, Unknown
  misc_feature (1)..( 3003): 2750-1469P.txt file - cDNA_ID_1820933; gDNA_ID_1620648; Annot_ID_47660
tcgtacggccaggctttgacttctttttcggactgaaaattgatataactaaaattaatgacttatctttgtaaattactttaaattaataaagtaaaagacaattaaaaaaataacctgttgtttagcatcttcccataacaaatcttgaggcttattgttgctggtagaatcagagtttaagtaaataaaaacaggtcccaagacctttttccacgcttcaccaggtctgtaatgtgcctccatgtccgcaccaacataatgtccgcttataaaagtctgcatatgcaaatcagttaagtaacgaaaacattaatactactatatatagtaccaaaaatgtaatctatgcttaatagctttggacgatgtctttaccgtgatggccgtgggtccgacgtgagacgtgagctcttgtttgatcggtccaccggagcgatattcaccgcttggtgagatgatccaaaagccgacacgggacttggttgagatccaaccgtgcactttgttgtctttgatctcacatgtgtactggtacttatcatccacctaatatatatcattcaaattaacgatcaaaattcgagacttcggatgcaagaacaattaaatattgcatccaaaaccgtatgcaaaagactaggtacctggtttttgaacatggagttatgaggatgagtcaattgtacagcctctttataaccaagagccttggcatgaccacgtttgatgtcacggtcatcttccgttggcatttctctttgtcgattatccgccaccgccatgtaatgaaatctacaaacatattttgtgatagtttagataaactcttttttttttttttataaaaacaaataattaacaaaacattggaatcgtataagatacctctcagggttgagtttgaaagcgattcgaattaaacccatgtcgagttctggccattcgggaagtctctcgaagattccgtacatgtagattcctgaagtatttctacgtatgatatacctcttgtctacgtttaatggaatatgaccatcctcccatgttctagagaacgatatctccacttgttcttgggtttgagtgatgattctaaaatttgttccttcgattctgaaccgaaaaataaatatgagtttataaattagaaaagattcattaaaattataaaccctaagataagttagatacttgctctataaatgtgaacgtgtgtatgttttattaaataatttaaactgacaaatcagacgaagtattaagtaactaacctagtttaattaccgatctaagccgccttggcgaatgtttgttccttgccatgttatgtcccagtacctacataaaatcaaagtaataaatcaggacaattttatgtacttacattacataagctttttgagaaataataattgattactacaatattagtttactgaaaattactcaccctctatctcggagatgtggatgaagaacattatcaattcctttgtatttgatcccagttataagtccttgaggattcgagaaactgactctgattatcccattgtccactatcacctgaaaattattagttttatatgtacgttagaatgtataatcatccgattattgattaaaaaatactattgaattatcattaaccctatatacctctctagtcccatgatgtctgcttcttatctgctgcactgttggagctcttgcacttattccatctaagttcctgtacaattttaataattacgcataaataaagccaatgcattgaatactgaaaacgcacacttataattaaattaattgtaaggcaaagagagggagttgaagtttgtttctaaaaaacaagatcgattgttacaagttaattaatacacacgttatgatcctaaaaacaaacttcttaattttatatgcatcaagaagttttttttcccttgttgataatcaaaaattttatgtcaaaatctagaattacttcaaactcatacgagagtcatcacaattgctagctaaaaacaccaatgaaatatgtatgagaatcgagaaacatgtgaattttgtgcacatacaacgtatatgtggatatgtgtttcatcgcaacttgtgaagaaaaaaagaaaaaaaaaactgaccttgtcggcttggaaaaggagagtggaagaagaagcaacagaaggaaacaaataaataacgaagcgatcttcttctgcgataccatcttttcttccagaaactcgagatttgaaataattaatgtttaagaataagatctttgcttctatgcatatattttatatgcgtgtgtgttgttaaacaaagtccaagactaaacgggaatagtaggtgcaccaaaacctaactaggagttactttgacttgtgaatgctgacattattagaacattagacttctaatatgacttagattcatagaagataatacgtaaaagatttagtttctggtatttttccatttttttttttgtgtatttccttttttttgtttaatagaagtaataaagaatacggaggataataatgacaatattcctgatgagaaagttgataattttctaaaagtttcacaaatcttgagcatgtatatattgtgaagtgttgtgttcattgtaacgtcggattgattgcatgaattaaatgaatatgacaaactatttgagaatgtaaataatgttttcttgtcctacgtatgacattatatcatctatacatgaatgacgtccatggcggttatatttgaataattgaaaaatacatgattttgcttcaaaaatagattgacctaagtccatgattttgctttaattaagagttaagacaaacaaaaactacaatctaaataaataatgataaaaaataataatataaaaatatttttagtaaattaatcaaaaaaaaaagagagcatgtgagctcacacataagacagcaaaaagagctaaatgcagagagcttcagatccgaccaaacaatg

SEQ ID NO: 19182 - DNA, 3003 bp, Unknown; identical to SEQ ID NO: 19181
  misc_feature (1)..( 3003): 2750-1469P.txt file - cDNA_ID_1820933; gDNA_ID_1620648; Annot_ID_163336

SEQ ID NO: 19183 - DNA, 3003 bp, Unknown; identical to SEQ ID NO: 19181
  misc_feature (1)..( 3003): 2750-1469P.txt file - cDNA_ID_1820933; gDNA_ID_2926214; Annot_ID_142144

SEQ ID NO: 19184 - DNA, 3003 bp, Unknown; identical to SEQ ID NO: 19181
  misc_feature (1)..( 3003): 2750-1469P.txt file - cDNA_ID_1820933; gDNA_ID_2926214; Annot_ID_202861

SEQ ID NO: 19185 - DNA, 3003 bp, Unknown
  misc_feature (1)..( 3003): 2750-1469P.txt file - cDNA_ID_1820951; gDNA_ID_1620648; Annot_ID_47655
gtccctgggtaacacaaattttctttactcaacaaataacattatttcatattaaaataaactataaatgctagcaaacgtgattgttactatttcaaataatatcaacctatatctaagattttcttgcatattttaccggatgagacatgttaattcataccattgttattgtaaaatcaaacaatggattgcacaaaaaaaaaaaaaaaaggctctaatgatgacatttaatcggaattaaattgtttcaggcatgagattgtgggcgtggtgactgaagttggagccaaagtgaaaaaattcaacgctggagacaaagtcggagttggctatatggccggctcgtgcaggtcatgtgacagctgcaatgatggcgacgagaactactgtccaaagatgatcttaacgtccggagccaaaaactttgacgataccatgacccatggtggatactccgaccacatggtgtgtgctgaggatttcatcatccgtattcctgacaatctcccattagacggtgccgcaccactactctgcgccggggtcacggtctactcccccatgaagtatcacgggctcgacaagcccggtatgcacatcggtgtggtgggactaggcggtttgggccatgtagcagtgaaatttgctaaggctatgggtactaaagttacggttattagtacttcggagcgtaagagagacgaggccgttactcggcttggtgcggatgccttcttggtgagccgtgacccgaaacaaatgaaggatgcaatggggactatggatggtatcattgataccgtatctgcgacccatccacttcttccgctgcttggtttgcttaaaaataagggaaaacttgttatggttggtgcaccagcagaaccgctcgagcttcctgtttttcctctcatctttggtatgaacctatttgtcagtcatctttaaacattatcaacaatatagccaccaaatttgcggttatagtaacaaatccgtatacttttccattgataattaaatctagtgattattttgtcacaaatctaatcatatttgaagagtaaagccactaaacgttgagaatatggtcttcttctttttgtgtgtgtgtggttgtatacataaagggcggaagatggtggtgggtagtatggtaggaggtataaaggagacgcaagagatggtggatttggctggaaaacacaacatcacggcggatattgagctcatctctgcggattatgtcaacaccgccatggaacggcttgcaaaggctgacgttaagtaccgatttgtgattgatgttgccaacacgatgaagccaactccttaactagaaagcttaagaattgaatatccccaaagcttttttcatgtttttgcttgtttgtttgatgttgtttgctggcgactttgtgtgtagtattaccacactgcatgtactttatcagttgaataaacttgaatattgtatttaataagctatctacattagattttggggaagtttgattaaaatttattccgattgaagattttagttggcgatattgtaagattacaaacatattaaggttgaaatgtgatgggttcgaatgatagaaacagttttgtttgaccgacacgagaaagtaatgagaacacactgatttaaattgatgactagaaactaccaagatatttattggtcagatttcgtaggactaatcaaatcaaaaactacttcttttgagacaaagtgcatgtatcttagaaaattttcaatgattccgatctttaattagcaatgtaaacacatttttactatggaatatgttacgtggacggaactgaattgagtttccgaatggaaaaatatggaccacgtgaacagatacatatatggttgagttgagcaaagttcaaaatggtccgtacacactgactaattgtcagtattctaacaacgttaatttcgtggtgcacgaaaacaaaatgacgatgtggttgcacaaggtccacgttcttgtatattgttttttaatgtgctaattgtgcgctaaaataaatttaattgtataaaattagtatagtttatatttttttaatatgtatatgttcattcaaaacatttggataatatatgtttactatgtgatagactgatggtggaacattttatccatcttatatgcatatgaataaaaattattcaaaatgtttgttgttgttcagattattaattattaaagaattagaaaattttggaattacaggtatatatgtatgtgttgtatattgtatatttaaattattatgtatatttatatttaaatttttctattttcataaatcgttagtatataattgtgtcacatctaatattattagaagacaagttggacttttcataataaaataaaacatatcttttatcaaattaaccttttcctttaggtgcccaaatccgtagcaccatcaaatacctaagatatactttttatttccaaaaatcctttcgtttgatctaatattaataatataaacgatcaaacaaaacgatttttagaaatcaaacgttcaagtttgatcgttggtcgtcgctaatttaagtttgatcgactgctcatgttccgtgacaatgttaaaactgaatacatgaaacatgttttttttttgtgcatttgattttaataattttttaaaaactgataacacccgaaaaaaacagcaagaaactaaacaaggaagaaaagaacggtcggtgaggaactctcgtgaaagtcttcaaaagacttttaacggaaaaacaaaaaacaaaaaacaaaaactcttgtgaacgtaagtgcatggaccgaattgcacccgatcacgtcggttccacaatcctctcctatattaaggccttcactgctccttatcatctcaaacttctcatttattaataagtgtcattcaaaagaataaaatcaaatacttacttttgaatccgtttttttcattgtttgatcgattatg

SEQ ID NO: 19186 - DNA, 3003 bp, Unknown; identical to SEQ ID NO: 19185
  misc_feature (1)..( 3003): 2750-1469P.txt file - cDNA_ID_1820951; gDNA_ID_1620648; Annot_ID_163331

SEQ ID NO: 19187 - DNA, 3003 bp, Unknown; identical to SEQ ID NO: 19185
  misc_feature (1)..( 3003): 2750-1469P.txt file - cDNA_ID_1820951; gDNA_ID_2926214; Annot_ID_142139

SEQ ID NO: 19188 - DNA, 3003 bp, Unknown; identical to SEQ ID NO: 19185
  misc_feature (1)..( 3003): 2750-1469P.txt file - cDNA_ID_1820951; gDNA_ID_2926214; Annot_ID_202856

SEQ ID NO: 19189 - DNA, 3000 bp, Unknown; identical to SEQ ID NO: 3501
  misc_feature (1)..( 3000): 2750-1469P.txt file - cDNA_ID_1820967; gDNA_ID_1620648; Annot_ID_47650

SEQ ID NO: 19190 - DNA, 3000 bp, Unknown; identical to SEQ ID NO: 3478
  misc_feature (1)..( 3000): 2750-1469P.txt file - cDNA_ID_1820967; gDNA_ID_1620648; Annot_ID_163325

SEQ ID NO: 19191 - DNA, 3000 bp, Unknown; identical to SEQ ID NO: 3501
  misc_feature (1)..( 3000): 2750-1469P.txt file - cDNA_ID_1820967; gDNA_ID_2926214; Annot_ID_142134

SEQ ID NO: 19192 - DNA, 3000 bp, Unknown; identical to SEQ ID NO: 3478
  misc_feature (1)..( 3000): 2750-1469P.txt file - cDNA_ID_1820967; gDNA_ID_2926214; Annot_ID_202851

SEQ ID NO: 19193 - DNA, 3000 bp, Unknown; identical to SEQ ID NO: 3474
  misc_feature (1)..( 3000): 2750-1469P.txt file - cDNA_ID_1820971; gDNA_ID_1620648; Annot_ID_47647

SEQ ID NO: 19194 - DNA, 3000 bp, Unknown; identical to SEQ ID NO: 3474
  misc_feature (1)..( 3000): 2750-1469P.txt file - cDNA_ID_1820971; gDNA_ID_1620648; Annot_ID_163320

SEQ ID NO: 19195 - DNA, 3000 bp, Unknown; identical to SEQ ID NO: 3474
  misc_feature (1)..( 3000): 2750-1469P.txt file - cDNA_ID_1820971; gDNA_ID_2926214; Annot_ID_142131

SEQ ID NO: 19196 - DNA, 3000 bp, Unknown; identical to SEQ ID NO: 3474
  misc_feature (1)..( 3000): 2750-1469P.txt file - cDNA_ID_1820971; gDNA_ID_2926214; Annot_ID_202846

SEQ ID NO: 19197 - DNA, 3000 bp, Unknown; identical to SEQ ID NO: 3473
  misc_feature (1)..( 3000): 2750-1469P.txt file - cDNA_ID_1820975; gDNA_ID_1620648; Annot_ID_47646

SEQ ID NO: 19198 - DNA, 3000 bp, Unknown; identical to SEQ ID NO: 3473
  misc_feature (1)..( 3000): 2750-1469P.txt file - cDNA_ID_1820975; gDNA_ID_2926214; Annot_ID_142130

SEQ ID NO: 19199 - DNA, 3000 bp, Unknown; identical to SEQ ID NO: 3472
  misc_feature (1)..( 3000): 2750-1469P.txt file - cDNA_ID_1820979; gDNA_ID_1620648; Annot_ID_47645

SEQ ID NO: 19200 - DNA, 3000 bp, Unknown; identical to SEQ ID NO: 3472
  misc_feature (1)..( 3000): 2750-1469P.txt file - cDNA_ID_1820979; gDNA_ID_2926214; Annot_ID_142129

SEQ ID NO: 19201 - DNA, 2053 bp, Unknown; identical to SEQ ID NO: 3529
  misc_feature (1)..( 2053): 2750-1469P.txt file - cDNA_ID_1820987; gDNA_ID_1620649; Annot_ID_47707

SEQ ID NO: 19202 - DNA, 3000 bp, Unknown; identical to SEQ ID NO: 4827
  misc_feature (1)..( 3000): 2750-1469P.txt file - cDNA_ID_1820987; gDNA_ID_1620734; Annot_ID_166195

SEQ ID NO: 19203 - DNA, 2053 bp, Unknown; identical to SEQ ID NO: 3529
  misc_feature (1)..( 2053): 2750-1469P.txt file - cDNA_ID_1820987; gDNA_ID_1620649; Annot_ID_163413

SEQ ID NO: 19204 - DNA, 3000 bp, Unknown
  misc_feature (1)..( 3000): 2750-1469P.txt file - cDNA_ID_1820987; gDNA_ID_2926215; Annot_ID_142210
tgatgacataccaattaccaaatcaaataaatgtttcagagaagactgaatctcatatttatatgcagccagcagggacgcatatgcctttaattacgatttcagaataaaataattgtgagggaagccaatacgtgtgaaagccaaaaatgaaaatagtatagctgctgtgatttatttgcttgctaacacaaatttcattttttggaagatttcacgtttgtgtactcagttttcgtagaatataaaaaactcatcttacaactataaataaacaaggattaaagatttgattaacaacagaaatgaagaagcggacggatggctactggctaatataagaaggtggtccgcgaagcagcagatttatattatattttaatagtttccgacaaaagacgacgaaatctctcatgagctgtcgtctctggagaggaggaatgggggctttctctttctctctctctctctccccccatttgaattatttcaccacgactccaaaaatcctgcgattctcattccttcttcctgtttccgtagcggggattttgtgatcatcaatatcaaaaacaatcagatttcttctaccaaacgattaattgccttttgggatacgattcagggcttcttttggggcctctgtttgatttaacaccttgtttgctgcaaaccaagatagcaaaggaaacgatggtgtcggacaatgagatgggtctggtattagctgtgtcgtcgagcgtcttcataggttccagcttcattttgaagaagaaaggtctcaagcgcgctgctgctaatggcacccgcgctggttcgtttccccgcttgctttttttttagaatccaattccatgctcctaaatttactttctgctttaattattagatagatattgaacaacccatctgctcgatcagggtttagctgtctgaattggaagaattcattttctatagacattgaaatgaatccatgttgacacattttcttaatagcagatgatccatcagcaatagatttcttatccactatgttttgtttcaccttttggttctgtgcctttctgctatcatttgtttgagaatatttgcatgtcaagaaatgggagtatgacttgcttgatgaatggtgcaggtttcggaggttatacatatttgttagagccactttggtgggtaggcttggtaacaagtgagttcaaaaaaaccatcttttattttccatatgactcttcccatcttaaaaaccatcgttctaaatgtgagattttgtaactcagtgacttttggagaaattgctaactttgtggcttacgtttatgcacctgctgtactagtcactcctcttggcgcattaagtataatcatcaggtttgtactgtattggcatctttttgagtggtatttcaccttttctctgactaaccttttcatcttttgccctgattgctccctcctagtgctgttttggcacatttcttgttagacgaaaaacttaggaaaatgggagtttggggatgtgtttgttgcattgtgggctcagttatgatcgtcatacacgcacctcaggagcagactcccaattctgtagaagaaatctggaaactagcaatgcaaccaggttttgctttttctacctctctctctctctgtgtttatgttactgatatagacaataacgtatatcccttctcttttttgtgtgagacagcttttctaatttacgtagccatatcaatgtcgatagtccttgctttgattctctactgtgaacctctctgcggccaaaccaacattcttgtgtatatcggaatttgttcattgatgggttctctcacagtaagcatctcggaatttagtgctgagctctatatcttttcccattttttgttctctaaaggttttaatttcaaataggttatgagcatcaaggctgtagggattgccataaagttaacatttgaagggataaaccagatctggtatccagagacttggttttttgccatggttgcagcaatctgtgttgttatgcaaatgatttacctcaacaaggtaagaagaacctgtgcatgtgtctgtgtgatgtagtgttgagcacactttggccaatggttaatagtagtcatatgttttgttttgtcaggcgctggacacattcaacgcagcaattgtttctccaatctattatgtgatgttcacaacactcacaattgtcgctagtgcaatcatgttcaaggtagagagatttcaacaaacattaaagagtaatgatcctcgtgtttcaagattgtcaaatgaatcacctttttcttaacaggactggaatgggcaaaacacagacagcatagcctctgagatttgtggattcatcacagtgcttacaggaacggttatactccattccacgagagaagaggaacaagcttcgccacgacgaatgagatggcaggattcagggaagagctttgacgaagaacatttgacaagtttgtacagtcctgaatattaggaaggtaacaaagatttaaaccttgtgctgaacggaaggatgttgggatccgaatcagaagatcatctaattaatctcttagtggggaaaagaatgtaaactagctttctgtatatacttgatagttttgtaacagtcttttgtatacaaatttgtccactgtttgttcatattcatttctttttgagctcttaggacagatttgttaccatatatagatcatataacattgactattattattttgatccaacaacactgtttccttctccttgtaggtgaaggaatggaaaatatactaaataataaaaccctattgatatgatgaattcataaccgtccgatcaaaacccaaaaagatctaactataaaaaggaaatcgagattcggtgagccattcattgtttttgattcacacgaagagaagagaagaagaagaagaagaagcagaagaagagaagaagagaagaagaatccaatcaatg

SEQ ID NO: 19205 - DNA, 3000 bp, Unknown; identical to SEQ ID NO: 19204
  misc_feature (1)..( 3000): 2750-1469P.txt file - cDNA_ID_1820987; gDNA_ID_2926215; Annot_ID_202950

SEQ ID NO: 19206 - DNA, 3000 bp, Unknown; identical to SEQ ID NO: 3527
  misc_feature (1)..( 3000): 2750-1469P.txt file - cDNA_ID_1821006; gDNA_ID_1620649; Annot_ID_47697

SEQ ID NO: 19207 - DNA, 3000 bp, Unknown; identical to SEQ ID NO: 3527
  misc_feature (1)..( 3000): 2750-1469P.txt file - cDNA_ID_1821006; gDNA_ID_2926215; Annot_ID_142200

SEQ ID NO: 19208 - DNA, 3000 bp, Unknown; identical to SEQ ID NO: 3526
  misc_feature (1)..( 3000): 2750-1469P.txt file - cDNA_ID_1821010; gDNA_ID_1620649; Annot_ID_47696

SEQ ID NO: 19209 - DNA, 3000 bp, Unknown; identical to SEQ ID NO: 3526
  misc_feature (1)..( 3000): 2750-1469P.txt file - cDNA_ID_1821010; gDNA_ID_2926215; Annot_ID_142199

SEQ ID NO: 19210 - DNA, 3003 bp, Unknown
  misc_feature (1)..( 3003): 2750-1469P.txt file - cDNA_ID_1821022; gDNA_ID_1620649; Annot_ID_47691
tacgtttcgttgaatctcgttttctttccgaaataagccacacagtgtgtatctctgtttgcacgtttataaatttataatgtacaattatttgcgccctagctagaacgggataaagtgtgacaacatataaatactattaaagattcgatatttgatgactgtagccgcctgcctagaacggggtgccttgtttgacttgccaacttcaaccacatttctttttgtttacttgaaagttaaaaataaatactagagaggaagaaaaacagagctttctttctaagatcatcaacgcaccatggaagaagaaggcagcccagatatcatcatcgttggcgccggtatctccggcctttccaccgctgttggactacacaggtgtgtgtggcgtgccttttgagttgttattaagcagagtaagttaactaaagtggtgtgtgtcacaggcttgggatcagaagcatggtgctggaatcttcggagacactgagagcgacaggatttgcatttaccacttggttcaatgcttggaaggccatggaagctctcggcgtttctcagcatattcgcagtctccatgatcgccttgaagggtatcaaactaacactattattactattcatatataatcagctcagtaaaaaaggggactcatctttgattttgctgcagatgggtggttggaacaatttctgcaggaactcctcccacagagatgctgtttccagaatccgagtatgtttcttcttctctgcacagagcatatgaatgttaaaacaataaataagataacttcaataatattgttgaatgattttgtcagagaatatgagtctcgatgcgtacagaggaagctgttgttagaggctctagcaggtgagttgcctgaagagaccatcaggttttcgtctaaggttgttcatattgaattgtctggatgctacaagaaggttcatctctccgacgggaccattctcaaaaccaaggtaaataactacttgtcctctgtaaaccatgtgaggcctggtcttgctacggaattgtagggtttctaaacgaaatgcaggttttggtagggtgcgatggagtgtactcagtggttggtaagtggctaggcttcaaaaatcccgctacaactgcccggttagcaatccgagggctcacacattttccggaaggccatggatttgggaaaaggttcttccagttttatggagacggcgttcgttccggttttatcccatgtgaccacaacactgtctactggttcctaacccacacctccactgatataggtgaagatatgcaactttacctgatatctaatatctaactacaagcagcttcttgttcatatcatactactgtctttgactcttctccttgcgcttgttagatgaggagacaaattcggaaatcctcaaagagtttgtgctgaacaagatcaaagacttgcctgaaaacattaagaatgtggtggagaccactgatcttgatagcatggtgatgtctcaactgaagtaccgacctccatgggaactgctatggtcaaacatcacaaaagacaacgtgtgcgttgcaggagatgcacttcacccaatgactcctgatatcggacaaggaggttgctcagccatggaggatggagttatccttgctcgttgtctaggtgaagcgataaaggcaaagagtctgaaaggtgaaacagaagaaaatgaagaagagggttataagaggattgaagaaggtttgaagaagtatgcaggagaaaggaaatggagaagcattgatcttataacaacggcatatacagtaggattcatacagcagagcagagggaagtggatgaacatgttcagagacaggttcctgtcgtcttacctttctaggatgctgctgaaaaagtcccatttcgattgcggaagccttgtcccatgatgattctcaaacataagtcaaaagcttgtgattcttcttgtcatcaccaactgcagaacagttttcacctttggtttgcttcaaagactatctatctgtttagtgttatttcatataacaaactcagaattaataaagtaagtttgtgtagtgaacaagaagctcttttattttttacggcaatctaaagctctgatatcaacaagtgatgaatgagaaaagaaaatgactacttcaattgaaccatagcagaagttatgtttattacattataacgtatgcgagcctcgttcaaacaggaatggattcagaaagaaaaagaaaaggaacctgaaggctgaggagagatttgagtgttaggaaagagagaagaggcaaggtgacaaaagttcccactggatcgaatcgcatcagcggcaaccccggtggccggcgatggcgagcagcgatgaagacgcatgtgatcatctgggcggggctgggtttttaaggaatttctcctctatttgggcctttcttttttctattttaaggcccattttgtgactgcttatgggcccatttgaatacaggagaaaggtcgccactattgaccaagtcatggttgctgccacttgattgataaagaaaaacgaaaacaaacaattatgtgatttagatctgagtctgaccaatattgttatatctttaggaatttgtttgtttgtaataatttataagtcaatagtcaaatgaatggttatcgtagacttttccaattgccattttcttgtttataaaaatatccataatacacagacttaaaggggcctctgactccattatatctatcgaatcatatataccagtcgtagtatgacgcgttgaagaacagaaacgaaacgaaccaaaaagtcttctccggcaactttagatcctccagcagcaaggtactcactcttatgaattcctaacatatgtataattactatacaaccaaggtactaatttgcatgccttcttatgttccggtctaaccacagatcatttctcaatcccatcctttgcctcaacccaatatg

SEQ ID NO: 19211 - DNA, 3003 bp, Unknown; identical to SEQ ID NO: 19210
  misc_feature (1)..( 3003): 2750-1469P.txt file - cDNA_ID_1821022; gDNA_ID_2926215; Annot_ID_142194

SEQ ID NO: 19212 - DNA, 3003 bp, Unknown
  misc_feature (1)..( 3003): 2750-1469P.txt file - cDNA_ID_1821026; gDNA_ID_1620649; Annot_ID_47690
tgaacctatttcacatatgactcatgggaaagaccgacaaagggatcgtattacccaaatatggttacgataacatccactgaatatcactcaaaatgaattattgtctcttactagatatattacggctagttgatgatttgtttgaaaagtttaatcttacaaaattattaatagatttgatgctgctcaaagtggtctcttttatttgcaccgcaaaaagccagtatatatccccattagaaaagacgtgacaaagtgtttaatagatcctttatgttttcctcggacccatgcatatataagtgtatttaaatcttttataaggtttttatagccataaataaacaaatttagttcaaaataagaataattaagtaattggaatagcgagacacgttccttgagatgataacacgagcatatattcttcatcacttttgtttgcttcatatcatatacgctaacttatgtgtgtgtgtaatatatgatctcagaactaacaagtaagaagaagaagaatgtcggagagtttcaaagtgtgcttctgttgcagcagaagctttaaggagaaaacgaggcagccaccagtgagcatcaagagactcttcgaagcttactcaagaaacggcaagatgtctttcgatgagcttctaagatttgtgagtgaagtccaaggagaacggcacgcagggttggactacgtgcaagatatcttccacagcgttaaacaccacaacgtttttcatcaccatggacttgttcatctcaacgccttctatcgctacctcttcagcgataccaactctcctcttcccatgtctggccaggtatctaagtttggaaactttttatggatttatttcacaaatggttttgtaattgggtatattatatgttcttggttgggttaaggtgcatcatgacatgaaggcgccgttatcgcattactttgtgtacacgggacataactcttacttgactgggaaccaagtgaacagcagaagcagcgtagaaccgatcgtgcaggctctcagaaaaggcgtaaaagtgatcgagctcgacttatggcctaatccttcagggaacgctgctgaagttcgtcatggcaggttggtcccactaacgaagtcttataatcaacaaacagactccaaaaaatgtcacacactatatgtgttttggttctctcatcaggacgcttacttcgcatgaagatttgcagaaatgtctaaccgccattaaggataacgcgtttcatgtgtctgactatccagtcatcatcactctcgaagatcatttgccacccaagcttcaagcgcaagttgctaaggtaagttggttttgcagaaacagagtatatatttcgttctctgaaaaagagtgatttacaaatttgattgattctatgtttgtagatgttaactaaaacatacagagggatgctgtttcgtcgtgtctcagagagttttaagcattttccatcaccagaagaacttaaggggaagatcctgatctctacgaagcctccaaaggagtatcttgagagcaaaactgtacacaccacaagaactccaacggttaaagagacttcgtggaacagagtagcgaacaagattcttgaagaatataaagatatggagagtgaagctgtaggatatagagacttgatagcaatccacgctgcaaactgcaaagatccttcaaaggattgcttgagtgatgatccagagaagcctatacgggtcagcatggacgagcagtggctagacactatggttaggaccagaggaacggatcttgtcaggtaaaatatagagtgagaggagtcataatgttgaacctttttcgactcaagagttataagatgaacctgagtcagagtttgaaaaaaaacaaaaacaggtttacacagaggaatctggtgaggatatatccaaagggcacaagagtggactcgtcaaactacgatcctcatgttgggtggacacacggtgctcaaatggttgcttttaacatgcaagtaagtggaactggctcatcatcgtttgacttgttaaaaaatggttgaataatatttgtgttgaaaagggacatgggaagcaactatggataatgcaaggaatgttcagggggaatggtggatgtgggtacgttaaaaagcctcgcatcttgctagacgagcacacactcttcgacccttgcaaaaggtttcccattaagaccactcttaaggttaagatttacactggcgaaggatgggatttggatttccatcatacacactttgatcaatactctcctccagatttcttcgtcaaggtaaacaacaactactactcttcttttaaactagatttcttcgtaactgtgtgtgtgttgcatttgctgcatcagattggaatagcaggagtaccgagagacacggtctcatacagaacggaaacagctgtcgatcagtggtttcctatatggggcaacgacgagttcctgtttcagctgtctgttccagaactggcgcttctgtggttcaaagtccaagactacgacaatgacacccagaatgatttcgcaggacagacatgtcttcctctgccggaactgaagtccggagttagagccgtccggcttcacgatcgaacaggcaaggcctacaagaacacgaggcttctcgtcagcttcgccttggatcctccttatacgtttcgttgaatctcgttttctttccgaaataagccacacagtgtgtatctctgtttgcacgtttataaatttataatgtacaattatttgcgccctagctagaacgggataaagtgtgacaacatataaatactattaaagattcgatatttgatgactgtagccgcctgcctagaacggggtgccttgtttgacttgccaacttcaaccacatttctttttgtttacttgaaagttaaaaataaatactagagaggaagaaaaacagagctttctttctaagatcatcaacgcaccatg

SEQ ID NO: 19213 - DNA, 3003 bp, Unknown; identical to SEQ ID NO: 19212
  misc_feature (1)..( 3003): 2750-1469P.txt file - cDNA_ID_1821026; gDNA_ID_1620649; Annot_ID_163395

SEQ ID NO: 19214 - DNA, 3003 bp, Unknown; identical to SEQ ID NO: 19212
  misc_feature (1)..( 3003): 2750-1469P.txt file - cDNA_ID_1821026; gDNA_ID_1620652; Annot_ID_163513

SEQ ID NO: 19215 - DNA, 3003 bp, Unknown; identical to SEQ ID NO: 19212
  misc_feature (1)..( 3003): 2750-1469P.txt file - cDNA_ID_1821026; gDNA_ID_2926215; Annot_ID_142193

SEQ ID NO: 19216 - DNA, 3003 bp, Unknown; identical to SEQ ID NO: 19212
  misc_feature (1)..( 3003): 2750-1469P.txt file - cDNA_ID_1821026; gDNA_ID_2926215; Annot_ID_202933

SEQ ID NO: 19217 - DNA, 3000 bp, Unknown; identical to SEQ ID NO: 3520
  misc_feature (1)..( 3000): 2750-1469P.txt file - cDNA_ID_1821038; gDNA_ID_1620649; Annot_ID_47687

SEQ ID NO: 19218 - DNA, 3000 bp, Unknown; identical to SEQ ID NO: 3520
  misc_feature (1)..( 3000): 2750-1469P.txt file - cDNA_ID_1821038; gDNA_ID_1620649; Annot_ID_163391

SEQ ID NO: 19219 - DNA, 3000 bp, Unknown; identical to SEQ ID NO: 3520
  misc_feature (1)..( 3000): 2750-1469P.txt file - cDNA_ID_1821038; gDNA_ID_2926215; Annot_ID_142190

SEQ ID NO: 19220 - DNA, 3000 bp, Unknown; identical to SEQ ID NO: 3520
  misc_feature (1)..( 3000): 2750-1469P.txt file - cDNA_ID_1821038; gDNA_ID_2926215; Annot_ID_202929

SEQ ID NO: 19221 - DNA, 3003 bp, Unknown
  misc_feature (1)..( 3003): 2750-1469P.txt file - cDNA_ID_1821046; gDNA_ID_1620649; Annot_ID_47685
taaagcagcaaattaatttgcagatgaatgataatgagcctctgtatttgtttgtgtgttgctccccttattcaattgattttgatttcctttgtaagttgctgcaccacactatctctatctcaaaaaaaaaaaagcttttaatgaaagaaaaaactcttcatttagcatcaaagcaaatgcacccaaaaatagaaaaaaaaaaaaaaggctcacgccgaagcaataaaaccaccacaaaaagtcaaaagccaaagtcaaaagagaggcttcgtgggccctaaaagggatacactttggttctctgtttctgttcttcttctctaataagtttttctctagtcgttcaatattacttaacgataaatcagactttttaaactcgatctggtggggacgatgagtggaaggccggcgaaaaggccgaggaccgaccattccgtcgtgaatgtctgggaaagggagctgggtctcttacccaatcgcagtttctcaaaccgtttttcagcatccgaggtctattgattcactctttttctttctttctttagggtttcgttgaatatattgcgttactttgctcctttgtttatgtttaacagccacccaatgcgttacgaacaatatgctactcaatgaacgtttttagattcttcttctcaattgtctttaattttactctaattgctttcagaagaatgtgtttgcaaatgataaaatctttattgtccaaatgtctagtgataggaaaccaaacaactatcttaattagatattgatgattttacaaaagcaggatctattgcggcgtcttggacttgacaagaagcttgataagcataagggatgtgtaaacacagtgagtttcaatgctgatggagatatcttgctttctggttctgatgacagacaagttattctttgggattggcagactgcttctgtcaaactctccttcgattccggccacttcaataatattttccaagccaaatttatgcctttctctgacgatcgtaccattgtcacatctgctgctgataagcaggtaccactctgcctctcctcttcatacctcctaccgcgaaccacacctcttgatagctcctcatgttacaactagcttatgttgatttttgtaacaggtccgctattccaagattcttgaatctggacaggtagagacttctttgttgggtaagcatcaaggacccgtccacaaattggctgttgagcctggaagtcctttctcattctatacttgtggtgaggatggggctgtcaagcatgtgagttgtatttttcattttgttttcttatcgtctgtttttatacctaggccgcctaaaacaacacgtattttcagtttgatcttaggactcgggtggctacaaatcttttcacttgtaaagaagcaaagttcaatttagttgtctacttgcatgcaattgcagttgatcctaggaaccctggtcttcttgccgtggctggaatggatgagtatgctcgtgtctatgatattcgtagctatcgctccgagggttggtataattttacccaacccatagaccacttttgtcctggccatttgattggagatgaccatgtaggaataacaggtctggctttctcggatcaaagtgagctccttgcttcgtatagtgacgagttcatctatcttttcacccctgatatggggcttggcccaaccccatatccatcttcaactaagactgaggagaggatgacgcctcaggtttataaagagcacacgaaccgtgaaacagtcaaaggtgtcaacttttttggacccaagtgtgagtatgtggtaagtggttctgactgcggccgaatattcatctggaggaagaaagacggagagcttctccgtgccatggaagcagacagacatgttgtcaattgtatagagtctcatcctcacatgccactgatgtgtagcagtggaatagatactgatatcaaaatatggactcctggaggaaccgagaaacctctgtcgccaggaaatgcgaaacaggtaatgccacatctattgctaacctcgtttgcttcttttatttttggtgtttgaagactcggaggatatgctttagttaacaagaatgtaactttggatacaatacatgtgactggaggctgaatttggttttggaaggcaaactaaatgtttgtatgtttgcttcttggaaacaggcttcgggttttggtaacccacgatggttcgacggatattatgtggatgacgatgatgattctgacgatgaatctagtgaagagagttcagatgatgatgatagttcggaagaggaggagaatggtgaagttgatgttgagattacgaaggatgatgataatgatcatggggatgatgatgatgatgatgatgaggatgatgatggggatggggatggggatgagggatgagatttgtatagacatgtatttatctaaacacaaaataaaacagcatatggtaacagtaccaaagaaaggattagttatagtttagttagatgtcatcatcgtggatacaaaatactattcaatagacattttcattcttaaccaaatggatcacatacataatcagcttctgtaatgtcagattgtcagtttcttcaatgaactagaatttccaacaatccaaattccaaagtaatttaaaatgtaaaagatgtcattggtaaaatgggtttataatccaggaaactttgagcccaaaaaaggcccatagatcatcgaaggcctttgatatctgcgacggcgagatcagcttcgtcttcctccaacgctcgatttagggaggatggtggtttctccggggctgctctcaactgtttcaggtcactattcgctccggttgcttcttctatatactttcccactgctttttgatattgtccttagtaatcatctagcttcgattttggttcataggcgtaatccgattggctccgtcacaccggattctaagacgcgatg

SEQ ID NO: 19222 - DNA, 3003 bp, Unknown; identical to SEQ ID NO: 19221
  misc_feature (1)..( 3003): 2750-1469P.txt file - cDNA_ID_1821046; gDNA_ID_2926215; Annot_ID_142188

SEQ ID NO: 19223 - DNA, 3003 bp, Unknown
  misc_feature (1)..( 3003): 2750-1469P.txt file - cDNA_ID_1821054; gDNA_ID_1620649; Annot_ID_47683
ttatccaatatatctacatcatttgctatactatatacatatatccacgtttaatattttctttcaaacaagaaataaatatcttcagtctctttcattcggatttcggattataatcacacttaatttggctatcatacgaggattgaataatccgagtttgcgtacacaacatgtttattggactaaatgaattatatttgtgccaatccatatttgggttgcttactttttcatcatgatattatttctgaacttatctacctaatgtttgtataaactagctaatcccatattcccattctttatatcaacatgctgaataagtgaattatatcattgttttaagtgggactaatatatgcattatgcagagcacatctttgttactcttttgaacgaataagttgtttcaagtattttctgtacgtgttcaatcggatattttcgacaactaacatgttattttcgttcaccgcttcattaaatctaaagctttagttgaataagcagttgctagctgaattacatcaagtgatacctttatatgttttagaaattcaattaatgcagttgaaaatgtgtaggcttattacaactatattatcgggacaatatggacaccatcagaaattgatgtcccgattcaatgaattaacgtgtagacttacaactatatatcgggacaatggacaccatcgggaattgatgtcccgattcaatgaatctgttaaactcttttacacatttgtttaaattttcataatcaatcaatggatcgtgtaatcatactaattagtaaactacatatataattaagtctggctcatgcaagataatttataacaaacaaaaaacttatttaagtgtttctctaacattggccgtatccgttagcatgatccttgaccgacggtgtgtgtgtcattgggtcattagggtttatcatgtcaataataaaaccttgttaaaatatgggtattatttggtgataatattatcaaagtgatcatctgacattgcgtttagtggttgaatctttaatatatcttggtacttggaacggggaataaataaattaataaacacatgtaataacatagtatattgcttcatgatatgaatatgatacatataaataaacatggcacgcaaccatactatagaccagtacttgttaattgttgatgtaaataaactaggatgtattgaaatactgatttacgaaattagtgttttgtttttacgtggcattagtgatgtgaagaaatgaccgatgtgagaaagaagggagaaataaatataatgggagtgtcgatggatggattgcagcaaactttaacggcgacaactcgccgcttacctggccgtcccagtttgtgacctttggtgagagtaaaagggcaaaaatccacgtgggctaaaaaatggagccatgtgccgccacatcatcggtcaattgggaccaaatacctctctatactacttattagtaacttgactatatatcttatgtttttttttataatactaataaaattatgggcgaccgaatcaaagtggtttattcctttttctggctgccgcatctttactctccctctctggtcaactcctacccgagatctatatggagtaccattttattaaagaaagaaaaacaaaaacgaaagtcagttaatttatctctccaaaatatatatatatgaccaaattaaatcgcattgcattaggaatgactgcatgcttaacatatatcgtgatatgcatggggtgtgttaatcataaaaaaatgccatataatttacaatgtacgtgtatattgtgagattaatttacaatttgcgtgtatatctctagtttaagagtatgttacttggaatgattttaaatactaaggaatagagattgcgttagaacgcgcataagacatgtttattaataatatacacgagcagccatacctgcaccacgtgttaccccattatatatgttttaggtttatgataatctcttttctataattttggttgactagcgtgctataagtttagttaattatggtaatgtagtatacaaagttttgatatatatcacacacaacataagagtaaagaatcgtgaatcctccagagatgaggggagtgagatgcgagagagagagagagagacgtttctatagttgggccctaagtttgtttttccaatctttaatgtgtggggatactagtttttactaggtgccaagcaaagcagaacaaaattgaacaaaagggatagattagagggaaagtaagtagggggttggaaaaaggataagtaagaaaacaaagggaccagaatagtaaaacatacaggtggaacctgatccggataagtgagtggggtctttatgaaagggggccacttgtaagaaaacgttttaattttgatcaaaaagggcgtatctgttggagggacaaatggagaatgtgttggattttcttggggatttgatctctcttcattattactacggtttaatatttgattatagtaataataatcacgatttttaaagtggcattaattaaggattaatccagagaagcttcttttgtccacctgcaatgactttaatacccattttagacgttaaaggatcagtatcgccacggcggcatgactcatccgctccttccaatacgccgtcgttttatacccccacctcgaattgaaaaaaaaaaaaccccaacaacaaagataaaaacgtaaaacgaaaaaagcatatcaatctctgtgcctctctcaattctcaaattctgaattctgatcgtatcttcttctctttaagattatcatttgaatatcttcttcatcttcttctccaagcccctctctctctgtatcgatcaatcatcaataggaggagctagcgaggggattcaataaagagatcttcttcttcttcttcgattcactttcctttcttttccattttccctttcgtcgtcgtcgtcaatg

SEQ ID NO: 19224 - DNA, 3003 bp, Unknown; identical to SEQ ID NO: 19223
  misc_feature (1)..( 3003): 2750-1469P.txt file - cDNA_ID_1821054; gDNA_ID_2926215; Annot_ID_142186

SEQ ID NO: 19225 - DNA, 43 bp, Unknown; identical to SEQ ID NO: 3516
  misc_feature (1)..( 43): 2750-1469P.txt file - cDNA_ID_1821058; gDNA_ID_1620649; Annot_ID_47681

SEQ ID NO: 19226 - DNA, 3000 bp, Unknown; identical to SEQ ID NO: 3548
  misc_feature (1)..( 3000): 2750-1469P.txt file - cDNA_ID_1821103; gDNA_ID_1620650; Annot_ID_47716

SEQ ID NO: 19227 - DNA, 3000 bp, Unknown; identical to SEQ ID NO: 3548
  misc_feature (1)..( 3000): 2750-1469P.txt file - cDNA_ID_1821103; gDNA_ID_2926176; Annot_ID_140349

SEQ ID NO: 19228 - DNA, 3003 bp, Unknown
  misc_feature (1)..( 3003): 2750-1469P.txt file - cDNA_ID_1821107; gDNA_ID_1620650; Annot_ID_47715
agtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgaattagctggtcgcgctctttcggagatgaagaggcttcgagaacgtcgacttgaatatgctcaatttgtccggagatcggcccttgataagatggcgagctcgttcagaagcgattggatcgtattaaagctcatattgacgatacgaaggcggcagaaccaaagttttttgaattcaaccaagtatctgggaatatcaagactctcgaggcgttggtcgaaggtggcgaagtggagatgaagtcggatgacacgatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaactaggagagaaaggaagagctgatcgccttcttgaaatcgaggtcgtcatcttttgcttggtctacgaaagatatgacaggaatcgctccggaggtaacctgtcataagctccggaggtaacctgtcataagcatccgcacgacccacttcaggagcaaccctccttgcaccaaacgtgctccgggcgatctccggagccacacaaggcaaatacttccgcgactgactcagttgttgaaagtgtctttttcgcggtgatctcggtgttccagctaaccactgggtcgaggtcaaattcaacatgatcctcatgaagtaatcgcgcattaacttcagcctctgtatactgcggctgcttgttataagcatcctccaggtcgatgagtgggtcgaactgagctaataagtgagcgggcgatctccgtagccacacaaggcaaatacttccgcgactgactcagttgttgaaagggtctttttcgcggtgatctcggtgttccagctaaccactgggtcgaggtcaaattcaacatgatcctgatgaagtaatcgcgcattaacttcagcctgtatactgcggctgcgtgttataagcatcctccaggtcgatgagtgggtcgaactgagctaagaaatccaccggatcttcaggagctgcgagatgtccaccggaaccttcccgatagctcatcaagcaacgtcggaatctcgatccggttagatcgactagactgagcttcgttacttggattcccggttaaccgagagtttcggcgaactaatgacacttcgctcccggaggaagaagaggacggagagacaagaacaaccttacccattgccggaaaaatcgataaagaatcgagagtacaaaataattcgcagaggagagagcgagagctaccttagattcttcttgcaagcggcggaaaatgatttcccgagggtttaatctaatataaatagagtcgaatgggcggcaaacctacgaggtcatcattaaacccacgagacgcttcggttcctgagcttcacgcgcgcgtacagacgcggcgatttgacacgtgtcagatacgttcgaaatacgaatcgattcggaaatctaatgattaattcacgctttccaagatttaaatcgaaattcaatttctaagttcggaaatttcgaattaagcaactcggattctccgaactggggggggactaattgttggtgcaggaattagcacctccgacaataccaatttaaaccaaggaataacgtgaataaaatcgagaattcgattgaaccggggaatcccggctagcccgttaatgggcctaagtcatgagctcgccagaagatttgggtcgacaatcgagatcctcataggcggcttctcaggtcgtgtaaaggaaaacttccatttaagaaaggaggatctcatgaagaatggaagtaatgaagatttagacctaggataattagaatatcatattttgatacgttcaacccattgtataaatagggggggtcaaactccccaaggacccatcttgaaccaagaagagactacaattatagagcaaaccctagcttttatttcaagcaactttgttctttccctttgattatttgcgagctaagagaggagtgaatttgtctaaatcccttagtacaaattcattgtttgattacagaatcaacagtagagacgggctctataagcatgtgagatgtgctattttcccaaaatg

SEQ ID NO: 19229 - DNA, 3003 bp, Unknown; identical to SEQ ID NO: 19228
  misc_feature (1)..( 3003): 2750-1469P.txt file - cDNA_ID_1821107; gDNA_ID_1620650; Annot_ID_163435

SEQ ID NO: 19230 - DNA, 3003 bp, Unknown; identical to SEQ ID NO: 19228
  misc_feature (1)..( 3003): 2750-1469P.txt file - cDNA_ID_1821107; gDNA_ID_2926176; Annot_ID_140348

SEQ ID NO: 19231 - DNA, 3003 bp, Unknown; identical to SEQ ID NO: 19228
  misc_feature (1)..( 3003): 2750-1469P.txt file - cDNA_ID_1821107; gDNA_ID_2926176; Annot_ID_199882

SEQ ID NO: 19232 - DNA, 3000 bp, Unknown; identical to SEQ ID NO: 3195
  misc_feature (1)..( 3000): 2750-1469P.txt file - cDNA_ID_1821121; gDNA_ID_1620631; Annot_ID_47245

SEQ ID NO: 19233 - DNA, 1057 bp, Unknown; identical to SEQ ID NO: 3567
  misc_feature (1)..( 1057): 2750-1469P.txt file - cDNA_ID_1821121; gDNA_ID_1620651; Annot_ID_47750

SEQ ID NO: 19234 - DNA, 3000 bp, Unknown
  misc_feature (1)..( 3000): 2750-1469P.txt file - cDNA_ID_1821121; gDNA_ID_2926182; Annot_ID_140601
ctctgcattaagtttcctctgctttttcacttttatacatgttttcttaacattttcatttatgtttttttttaatctaaattacattaaaaaacaaaaatctcaaaagttgttaattttattgatatattaagaaaaataaatctggtggtaaagaggacgagatagagagagaatgagaaagaaaaaggagactccgtaatgaatctggcatgagttctggcaaagacagaagagaaattcaatgagaaagagttctggctaaagtttggtgacgaagaaggaaaaaagaaacacaaaaagaagaagtaagcaaaatggtaatatagaccaaaaagtcacagaagatctgtaacaaatggaaactattttggtcaaatgttattttgttaattatttgtcagtcaaggtcattagtccatattctttttatttgaatgaaagataataaatgatacaaaaatgcatgaactaattgtgtcaatgaatttagttttcatgtgattttctacattataaataaatcattttgattcatttcttgtttgtagaagaaagaataaagataagagcctctttcatagtatcaatggcttccttcaaccactttgtgttactgcttctgttaataatcactcttattctatccgctgaagcaactaaggaacgccgagcaataccatcaaaggcagaaaggaatgaaatgaagagacaactcaaagctatcaacaagcctgcaatcaagagtttcaaggttggtttagccttccttcttcttccatgcttatattgtttcatatctaacttttttttcttatgaacagactgaacatggtgatatattcgattgtatcgatattcacaaacaactagcatttgatcatcacctactaaaaaaccactctgttcaggtttgattttatacatatttaattctctctttatctactgtcttttcaattaaaagatgcctctccttagagaatgactgactttgtatatgcagctaaggccaacaacagtacctgaatatatcactggaaacaacatttcagagagttttagtcttttgcaagaaggtataagctgtccagatggcacagtaattgtaaaaaggactacaatgcaagatcttatgcatgcacaacgtttgaaatccatgggattcgagggcccgagaccttttctcacagagacaaacaacatgaattttaatggaaaattctacgtaagaacccttataagttgatagtatatatagcaaccaccatttttgttttccactttcattttctgagtttctttcttctttatggatattaggatgcaagagctgattatggaccgaacccttttgctggagttgcaggaaacattaacatatggaaaccaaaaatcttgcaagatcaagttagtattggatacatggcagttagtggggggcctattgaagaagatttcgccagcatttcagttggatggattgtaagttaattctggttccttagcaaaagtgaccatgttcgtcaactgtaagttgcatgaatttaaagttgacaaaagtttgaaatatgtatatacaacaggtgaatccatcgatgcaccatggtgatcatgttcgtttatacgcctactggactgtaagttttgaattatactagtaagagcttacaccaatagtttctttatcaacttgtctgtgtcttataagttctttatgtatatgtttccttataattgtgttaatagttacatggaagcagtactggcggctgctacggcatgtcatgtcctggatttgtgcaagttagcaagactataccagttggtgccgttcttcaaccattttccatctataatggtcgacaatatgaattgcgtttaggcttgtttcaggtaaagtctactcaactttttatcacttctcttaaagtcatttgaattcatatttcaaaattgggaacaggatagtggcacgggaaattggtggtttgtatttaaagaggagattattggatactggccagcatcattgttcaagtcctggatggaatctaacagcgcaaattatgcatcttggggagggcaagtgtatagccctatcagagagaagagtccacctatgggaagtggtcattggcctagtgagggctttcataaagctgcttttattagtggcctcaaactcttcgatggtcacgggaaagtttataatccaggacgcgggacagtgaaggtacatgagagcagaccaatctgttacaaagccagatatgttcatgatgttgataaaccttggttaaaatctgtttactttggaggtcctggagggtgcatagggtaattgatctacgagataaagagtaacaatatcataagattttaattttacacaggctataggaaaaatcaacagatttgaaatatatctaagcattacttgcgctctaataaataataataaagtattagaaattcacaactttcagcacaaatttctatagtttattgagcatagattgatagctaactcaccttaaagtacattaaaaataaaaatctcattctcaactgcaaaaaaatgttacaaagtcacatatgttcatgatgataaggatccttggttaagagctatttactgtggaggtcctgcaggatgcatttggacataatatatgatatgcagagttacaagataaatcttatatatgtttgtatgaataataaagtttccatgaatcctcccaacttttttgcaataagtttgatgtttatgcctaattgtaaaaatgtcacaatctaatcatcaatttacaatcctttctaatacagacataatgataaccaaaaatgtgggttctactgttactgcatttgtctgaaacatttctaaagcctcttttaatcatgtcttaaatatatatacccctatccatagcatagcttgcccctactcataacctctaaactctttagacaactaaatatataatataaatg

SEQ ID NO: 19235 - DNA, 3003 bp, Unknown
  misc_feature (1)..( 3003): 2750-1469P.txt file - cDNA_ID_1821133; gDNA_ID_1620651; Annot_ID_47746
aagatttttatgctgaagtcttgctacaagaagcacctcgttcttgaactctggctcaccttgatctgatggtttagatagtctcttggcagcaacttctgttccattcggaaacataccctgctcattcgcatgacctttactatcagaattagcatctgagtttataatacaatcaagtagttgagaaaatttaagaacatcatgccttgtaaactgcaccaaatccaccatgaccaagcttgttactcttatgaaaattacttgttgcagcttttattgctctaaaatcgaatcgaagcgaacctgaggacgctgtaagatcatccgtagctgcacaaatatactgttatgctgtagagtttccaagggacattaacatctctgaaccgtagacaagtatttttaccatcatctggtgatgcagtaccataaggcctcctaggtcttcttgaaacagagaaatacccatctgagaagaaacagagacataacaaaagtgttggaaataattttaccctaaaatgttgttctgagataatgtcgttctagcaaaccattgaaaactcactttcacttgcaaatgattggtaagcttttctcctcctagaaacagcgtatccaagagcaagcagtacagtgctcacgacgacggaaacaaccgcaattgccacaatagatcctgtagatatatttttgccatctgcgcgaaagctgtcactcagaatacaatccaaattggtttaagggcataaagtattttaaatgcgaatttttttagaaacttcttttaaattttttgaatatgaaacaatttttttttgtgaaacgaatatgaaacattattacacaaaaataacaggaggttgtgttttctttttgagtttgtattttcaagtaaacaaaaataaatgcaaacacatcagcaaaaatcgagatccaacacagcagaaaaagttcaaatgaagagttcatatctttatattatatacctttcttggttgtgttagagtgaccattatctaattcagaagggggagttggtaacatcccatttatgaatagtcccaagaatggctgtagatcccatcgcatgaaacagctggtccttgcaatatagcctacttgtatcccccggcagcatgacctattatctatcctaagatgttgtaaacatttctcgcagttcaacttggttaggtctttattgcattgcgcgatggcataaatgctcctgaacgggaacgacccgagctcttgtatgctgttggcgtacaatgaaccatcaactttgtttatcacacgatccatcaaagcctgccatgtagatttaaactccgtcaagttggtttggccgaacgatgtgttatatttgtactcaatatactctgcccatattatgtcttcgtcgagcgatccattaatcaagtggtttgagtagcgtaccaaacaaagcgagtctccagaactccagtctatagcttctgcctgattaggacatgtgtgtagcaaggtatgagatacactcgtgatacaatccgaacaatcctgtgttgtagtacctcggctacacatccccagaccatgtgctatgtttggaccgggcttgaacggagtcttgtagaagccttcattatccttgacacgagaaggaagagacgagagcatggctcggaggtttatgtcgtaaggaccattggctttgaaaaaatcagatctctgaatgcaggttggtgcagcgacagcacaagagcttatgaccacaaaccagaagattgctcgcaagtcgaccattttgttcttttgcatcgagtttgattttcttgtttaaaacctccagtcttgaaagatttaatattagaagaggattcgattttcaaaagcaatctctttcatatgtgatgtgactacgtgtaggactcattcctcccttctttttcatacgaatccactatgtatatttgtaaccctgtttcacaactcttttaaggtatttggcttttaaatttaccggttccgtggaaactgaaccccgcaaatgcaccattatattcaaatcgatatctttgaaagcttaagcgaaattctgtagttttgtttttcttatgatgtcttttaaatttacatatcttgcattataaatagtactgattcatatccccgctgtagggaaaaatgtatttttcacattttcaaaacaaaatgtggagattttaccattttccctagccaacccaactcacatgccaatctcgctcgatataggacccaatacaaaaacaaaacaaatatcgtttatttccgaaactaatgacactgacgcattagttgaaaataaaaacgacactgacgcattagttgaaaaatacaacacgacgaattagcctaatactcatctggtccccttccaagttccgataagctgagttctagtaaatttcgtggttctgatcgtttcattatcgctggagtcagcagtagatgacagcaacaagctataccagtgtgcaacgaacgaagagaatgaacaacacacttgattattcgttttttcaagctacaataaccacagagttacattttcgattatttatttatttatttttattttgaatgaactgttaattcacacaaaaaaaaacaacatgttttacaagtatggtcatagactaaaaacagagctttacaaggacatagcatttgctgcggaatataatttaattctcgaaatatgaaagttgctatggaactgtgtcgtagttctcacccattattacaagtaaacgaagggactcgtcattttcagggtattatctaaactttcaaacattattgacattttaccatcgactatgtaggtttagggaccacttattagtttgatggattcaacattagaaaaatcgcagagaaacttcacttatctgttcgaacgggttagaaacagatacatgcgtaattactaacacaaagatcacagctataatctcgtaaggcaaaatg

SEQ ID NO: 19236 - DNA, 3003 bp, Unknown; identical to SEQ ID NO: 19235
  misc_feature (1)..( 3003): 2750-1469P.txt file - cDNA_ID_1821133; gDNA_ID_1620651; Annot_ID_163472

SEQ ID NO: 19237 - DNA, 3003 bp, Unknown; identical to SEQ ID NO: 19235
  misc_feature (1)..( 3003): 2750-1469P.txt file - cDNA_ID_1821133; gDNA_ID_2926182; Annot_ID_140597

SEQ ID NO: 19238 - DNA, 3003 bp, Unknown; identical to SEQ ID NO: 19235
  misc_feature (1)..( 3003): 2750-1469P.txt file - cDNA_ID_1821133; gDNA_ID_2926182; Annot_ID_200316

SEQ ID NO: 19239 - DNA, 3000 bp, Unknown; identical to SEQ ID NO: 3555
  misc_feature (1)..( 3000): 2750-1469P.txt file - cDNA_ID_1821137; gDNA_ID_1620651; Annot_ID_47745

SEQ ID NO: 19240 - DNA, 3000 bp, Unknown; identical to SEQ ID NO: 3555
  misc_feature (1)..( 3000): 2750-1469P.txt file - cDNA_ID_1821137; gDNA_ID_2926182; Annot_ID_140596

SEQ ID NO: 19241 - DNA, 3000 bp, Unknown; identical to SEQ ID NO: 3554
  misc_feature (1)..( 3000): 2750-1469P.txt file - cDNA_ID_1821149; gDNA_ID_1620651; Annot_ID_47742

SEQ ID NO: 19242 - DNA, 3000 bp, Unknown; identical to SEQ ID NO: 3554
  misc_feature (1)..( 3000): 2750-1469P.txt file - cDNA_ID_1821149; gDNA_ID_2926182; Annot_ID_140593

SEQ ID NO: 19243 - DNA, 3000 bp, Unknown; identical to SEQ ID NO: 3553
  misc_feature (1)..( 3000): 2750-1469P.txt file - cDNA_ID_1821165; gDNA_ID_1620651; Annot_ID_47738

SEQ ID NO: 19244 - DNA, 3000 bp, Unknown; identical to SEQ ID NO: 3553
  misc_feature (1)..( 3000): 2750-1469P.txt file - cDNA_ID_1821165; gDNA_ID_2926182; Annot_ID_140589

SEQ ID NO: 19245 - DNA, 3003 bp, Unknown
  misc_feature (1)..( 3003): 2750-1469P.txt file - cDNA_ID_1821181; gDNA_ID_1620651; Annot_ID_47734
catgtcttctctgatctcttttatcttccttttccttttctcattcctcactagcttcaaagcttccgctcaagatcctttttacttaaatcattattgtccaaatacgacaacttactcaagattcagcacttactccaccaatctcagaacccttttgtcctcttttgcttcccgcaacgcctcttactccaccggattccagaacgtcacggtgggacaaacccccgacctggtcaccggacttttcctctgccgcggagacctctcgccggaagtttgcagtaactgcgttgccttctccgttgacgaagcgttaactaggtgtccaagtcagagagaagctgtgttctattacgaggagtgtatactcagatactctgacaagaatattctatcgacggccattacaaacgaaggagaatttatcttgagtaacaccaacactatttctcctaatcaaagtcaaataaaccagtttatagttttggtgcaatctaatatgaaccaagctgccatggaagcagccaacagttctagaaaattctctacgataaagaccgaattgaccgaactccagactttgtacgggcttgttcaatgcactcctgatcttacaagtcaagactgtttgagatgtctgacaagatccatcaatagaatgccactttctagaattggagcaagacagttttggccaagttgtaattcaaggtacgagctttactcgttctacaacgaaactaccattggaacaccatctccaccaccaccaccgtcgccaagcagagcaaattgatgtgctgctttttacgtcgaagttttggccaagttgtaattcgttttgctctgctttacaaattgacgtgttgctttttctctgcgtttaaaattggtatcatcgaaataaagtaactcagtttcttacaatcaaagagataaggattgtgaagcagctaatgagtcttcttattttgtctttacttcagtcttctcgtctttgatagtgaattgctcatctagctttcttaatcttagacttggtcaatgttttggcttttctcatactaaaccaattaatacataaaatatttaatttattttctattacaattatctagatatttttagctacacgtgattgaaacgtgtctcaagctacaccaacgctcttcctcacaaactgaattcgtcgtcgatagtggttgctcttgctatcttgatgtttacttcgtctgatcgttgaactggcccgctgcaacattctgagtgttccaagtgattattctagttgtgcgtaacaccgtaacagtaaaaatgagctaaggaaagcgagatgcaagggagaaccaacagaagcataagtttttcctctgttattactaatggaaaaaaactttctttttcattttctaattccttgtcagatttctcagcttctcttctttttgttttgtgtaagacttggtcggagtcttagattacgctgatgattaaaaactactaaaaaagaaaaaaaaaagaatattacgcaaatgttctcgatgcattgaccaagtcctcttctggttctggctccattttcacatgcaggcccataaccaattttaacgagatttgttgcatgaaaagccgattgtttttccttggcagtaacgaaaaaaaattagttactttttaaaaactagggttttgaataatatcattaaaatcaaatagaacgaactagggttttggcatcatacaccgcctcattcaattattaacaaagctgagtcttcttcacggagaaatcacggctgagctaggtctcatataccttgcatcaatatcttgggcctttactaggatcggagatacatcaaacataaaatacttctcggttttattttctctttccttatgtatatgtgaatgcctttaaaaattttgattgccttttttctcgttttggaatagtcatgagaagctgagaaccaaaaaggaaatatttctcacctttgcaactagctagatggagcttatggatgcaaaattcgttttaaaacacattgtattcggatgatgtcaaaatatttcacattcatatagcaaattcatgtttatatattccgatattaactttaaatattaaaacttatatgctgtagattcatatccgggtgaaaacacgaaaggacttatgatggaaccattatatggaacgacgtcatgtggaatatcaagttatttaacttctcgcgagtaagactataaaaagtaatagaataattagtaactaacaatatcagataacgataggcagatgatttggtaatactattttagtatcactacatcacaataaccatactagcatatacgatatacaaattaataaattatcgtgcttaaaacaaaaacctattatcaaccaataatttcttcgcatcagtggcgacaattttttcagccccagaatgattctttgaagaatagtcaacaaagattcctaatttcaacaattctgttcaaggaaaagtacgaaacaaattctactgctagctagtttctctcatgtatatctaaattctattactagtaattaagatctttgaaatcatgccaactgctacatttattttctcttgaaaatcccaactaccttttttttgatcaaaaaaaaaaaagactttagagttcaaagcttgaatttagagttattatgttttaaattttgacagttttgataattttcttcattttaaaatgattttatattttccgtaatttttttctatatttcatatattaaaaaaataagtaatggattagtagctaaacacaagaagttggacaagacccgacaatttaatacgagacgcgttgaccttgaccttgacttttcgtcagcacaaaacgttatctacggtagtcactgagagagaacaaacaatcaaatttgtttcatatatcactcaaagcttgatgagaagaaacacagatcaagaaagcccaattatg

SEQ ID NO: 19246 - DNA, 3003 bp, Unknown; identical to SEQ ID NO: 19245
  misc_feature (1)..( 3003): 2750-1469P.txt file - cDNA_ID_1821181; gDNA_ID_2926181; Annot_ID_140585

SEQ ID NO: 19247 - DNA, 3003 bp, Unknown
  misc_feature (1)..( 3003): 2750-1469P.txt file - cDNA_ID_1821185; gDNA_ID_1620651; Annot_ID_47732
caccaccaccgccgctgcctccgttggcatctccttcactatctggtgaacagtttcttctacctttgccctgtttacttgatctttgcagtattaccaatatggaacgcagagttttcaatttttgttttgttataagtctactattttcttactaaagcagatgatctgtttaaacgcagataaaagtgggaattcaaatgtggtcgtggtagccgttgttgtgcctatcatagtcgctgttctgattttcatagctggttattgtttctttgcaaagagggcaaagaagacttatggcacaacacctgctttagatggtaaagattcaagtccttaattggtttgattaatgtttttgactaatatattttgtctttctttttctgattactaagacatttattttgcaacagaagatgataaaacaaccatagagtcgctgcaacttgattatagagcaattcaagctgcaacaaatgatttttcagagaataataaaattggtcgaggaggttttggtgacgtttacaaggtataatattatatacttctacataatttatcgattgttttgttttctttttgctacaacacatttggataatgagattgataaaaatggatagggtacattttcaaatggaaccgaagttgcagtgaagagactgtcgaaaacatcagaacaaggtgacacagaattcaagaacgaggttgtagttgttgcaaatcttcggcacaaaaatcttgttaggattctcggattttctatagaacgagaagaaaggatattggtctacgagtatgtagaaaataaaagccttgataacttcctatttggttagttgcatttgatgatttgtttcattgattcgttaaccagtcctgaaacatggttagagctaactactattcatggatgttcacagatcctgcaaagaaaggtcagttgtactggacacagcgataccatatcattggtgggattgctagagggatcctatatcttcatcaagattcacgactcacaatcatacaccgtgaccttaaagcgagtaacattctcctggatgctgatatgaatcctaaaattgctgattttggaatggcaaggatctttggaatggatcaaacccagcagaacacaagcagaatagttggtacctagtaagtcttccacttgactactctctcacatgttgaacattttattttgataacatattaaagtttttgatgtggatatccagcggttacatgtctcctgaatatgcgatgcgtggccagttctcaatgaaatctgatgtctatagtttcggagtgttagttcttgagattataagcggtaggaagaacaacagctttatcgagacagatgacgcacaggacttggtgacacatgtaagtttaaaggaaaggagttatatatatgtacctctcctcatcctacaataagcaatagttgcaataactgtttgactgattgattctaggcttggaggctttggagaaacggaacagcgttagacctcgtggatccattcattgcagatagttgccggaagagtgaagtggttcgatgcacccatatcggtcttttatgtgttcaagaagatcctgtaaaacgtccagccatgtcaaccatttccgtgatgctcactagtaatacaatggctttaccagcgcctcagcaaccagggttttttgttaggagtagacctggaacaaaccggcttgattcagatcaatcaacgaccaacaagtctgttacagtatctattgacgataagtcaatgtctgatttagatcctcgttgaatatggtgttattaaaccttacgattgaaatcaagtttaattaagcctatatttacatatttctaaacttgatgaaccatgttgatcctttagttttgatttggtttgatatttgttttcaagaataatcaatttagtctcagctatcagcatcaccaccgattgaaaaattcattacctaaatgagagggagagaacacttaatgttggcattagagttttgtccattctaaaaatttgtgcattattttggagttcatttcaacaaaagaatcgctttagcaatacctctaatgattttgtgccatttgattttgaaaacagagggaaaacagagtacagtgggatggtgatttgcatgatttgtaaagtggtgaaataaatgaaatgtgaaccatctaacacgtcaaagtttttttctttctttcgttgtaaagtaaactagttgaatttctaagttttgacgcctatcaatctatttccgagaaagatataaaataaaaatattggagttgaatattatttaataggttgatgattattctgcttggcgccgagactttgggttaataagacagcacagttaaacttccttgacagacaagtaacaaacgaacagttattaagtaaaaacagtaattacacaaccctagtttgattcagaatcagaaccaatcaacacgctcagtggcaggttaacttgtaaagattatctttgaatttttcttttagggctcttccttgtttaactttacaactgtgtattagatttttaaagtcattttttgaaacaaggaactttacttagatcagtcccaatctctcttttcctcacaatttacgacatttaaaagaaaaaaaatcgcttacattgactactgacttagtcgtaacaaaccgtcgtatacttcacgttactcagtactagtcagagagagtatcatggaagctccacgatgagaaactcaaatcaaggaactcgaaaaaaacaaaaccatgtcttctctgatcttattatgtatatagtttcaatgtaaatattatggttttgtataggtttaattggagtctgtataggtttggtttagctggtttagaggctttggtttaggcctggtcaaatgtatataaacccacaattgtatcttttaccagattaatgagaatgagattgtttactaatatg

SEQ ID NO: 19248 - DNA, 3003 bp, Unknown; identical to SEQ ID NO: 19247
  misc_feature (1)..( 3003): 2750-1469P.txt file - cDNA_ID_1821185; gDNA_ID_2926181; Annot_ID_140583

SEQ ID NO: 19249 - DNA, 3003 bp, Unknown
  misc_feature (1)..( 3003): 2750-1469P.txt file - cDNA_ID_1821189; gDNA_ID_1620651; Annot_ID_47731
gtgaggtttacaaggtatactataatatcttcaagtacaccctaggttaagtacttcgtattgattctttgattggataacgagatgatgctgattaaaaagttaaacggatagggtacattttcaaatgggaaagaagttgcggtgaagagattgtcgaaaaattcaagacaaggcgaagcggagttcaagaccgaggttgttgtagttgccaagcttcaacacagaaatttggttaggcttcttggattttcattacaaggagaggaaagaattttggtctacgagtatatgcctaacaaaagccttgattgcttactatttggtctgttgcatttcaatgattctttgaccattaatcttgaaacttggggttgctaatctcaagatttaactgtaatccatggatttgcacagaccctacaaagcaaattcagctggactggatgcagcgatacaatatcattggaggaattgctcgggggattctatatcttcatcaagattcacggctcacaatcatacaccgtgaccttaaagcaagtaacattctcctagatgcggatataaatccgaaaattgcagattttggaatggctaggatctttggattggaccaaacccaagataacacaagcagaatagttggtacctagtaagtcttccacttaacatctcataacttataatatgttgaacattttacattgccaacatatacactaaagttttgttgtggattccagcggttacatggctcctgaatatgcgatgcatggccaattctcaatgaaatctgatgtctatagcttcggagtgttagttcttgagattataagtggtaggaagaatagcagcttcggcgagtcagacggtgcacaagacttgctcacacatgtaagttttaagacaatcaatatatacctctcttacattacattaagtaatgttagctagaactgattgcttgattggtattcaaggcttggaggctttggactaacaaaaaagcattagacctcgtggatccacttatagcagagaattgccagaatagtgaagtggttcgatgcatccatatcggtcttttatgtgttcaagaagatcctgcaaagcgtccggcaatatcaaccgttttcatgatgctcactagtaatactgtgaccttaccagtgcctcggcaaccagggtttttcattcaatgtagagccgtaaaggacccgcttgattcagatcagtctaccacgaccaagtcttttccagcgtctattgatgatgaatcgatcacagatttatatccgcgctaaatatgaccttaaacttcatgcttgtaatcaagcttacgcaaatgtttacatatttgtagaattgtggatgtgatcaaccctaataattttttagttttgatttggtttgttaaaaccatatgtattttgttttgattttttaataatgaataattagtctagtctcaacatcaccaccgattgaaaaaaatgagagagggagagaacacttggaatgttggcattacagtttggttcattttaaaaatttgggcaatccaaaagctataactttggagttcatttcagcgtctaagagccaagaggatatatacctgctttgaagtcacaatgtatggttatgatcttgaatcattctagaatcgctttagcaatacctccaatgatcttgtaccatttgatttggaaacagagactaaacagagtacagtgggaaggtgatttacatgatttgtaatgtggtgaagtaaatgaaatgtgaactatctatcacgtcaaaagttttttttttttttttcttgttgtaaagtaaactaataactaatacaatattttgaaagacaaagtcatctacacgaggaatttaaatgttagactaataaaacatgtggaagagataaccagagaaaatagaattacaaaattccaggttttgacgtctatcaatctatttccgagaaaaataaaaaatattgggtttgaatattatttaataagttgatgactattctgcttggcgccgaaactttgggtcaataagacagcaccgttagacttccttaccatacaagtaacaaacggaacagttattaagttaaaacagtcatttcgcaaccctagttgattcagtttgtagccttatttagaatcagcaccaatcaacgcgctcagtggaaggttcgcctacaaagaaataggctttgatttttagagtctttttttttggaaacaaggaactttacaaatatgcctagacttatatcactcacatctcttttcataccttctgcactttttcctataaattatttttcaattttttttatataaaatattttcatacatctagatggatccttcacaacttttgagattattttgttattgttttatggattttgatattcttcataaaatttaagttttattaattttcatgatttttaaactccattaaaaattgtgttattcaaaggcttaagtttcattaaaatatatattgtttgtaaaattttattcataaaacaaaaaaaaaaaactgtggatatcctttacaatattaaaattattctataactacaatactctctacaatcttaaaaatctctcatttcttgaaagttgaaaccaaactcccatattatttaagaggtggagaaacaatgattaagtttttgggttttgctcaacaaatgtttttttggatcaatgatccaaagattccaaacactaaactcaacgtcttcttccaataacttttacttttgttgttaataaaaatgacataaaaaagattaatcgtatacagtacattgagtttgattgacgactgactttaaagtcgtaacaaaccaccgtatatttcacgttaatcaaataatcagcactagtcagagagagaatataatttgtcagtttataaatggaagctgcataatgtgaaactcaaatcaaggaactcaaagaaaaaaccatg

SEQ ID NO: 19250 - DNA, 3003 bp, Unknown; identical to SEQ ID NO: 19249
  misc_feature (1)..( 3003): 2750-1469P.txt file - cDNA_ID_1821189; gDNA_ID_2926181; Annot_ID_140582

SEQ ID NO: 19251 - DNA, 3003 bp, Unknown
  misc_feature (1)..( 3003): 2750-1469P.txt file - cDNA_ID_1821193; gDNA_ID_1620652; Annot_ID_47771
aggccggtgtggtacgagagagtctgatgatccgacaaggaatacttctagtccacacaatgtcagcctttctttattttctcggtcgcttcgagattctcaattctgctctgtagaaaagatcctgatggttcacttttaatatccaacggttgatataacacaagcgcatgctcctcttatgagaacggccgtgggatataatttaatctcgccgttaaaaaatgtgacgaccgtgagttaacggtttatctgttaccaacctcatacctgtccctaacggcagaggataacgccgtgagtatggatggatgggagagaaaagaagagagagagtgtgagtgaggaaatgaaaggagtcttttttatttgttatctctcatctctctctctctttctctctgagctttgctttttatcaaacaagcatcatcatcacatccacttccttcttcttcctttctctgtctgtctcttaacccaaatgtggactctttgagccgttattagatctctgccgcttcaataatggggagcttatcttctgaggaagacgacgaagtctcttccgagagatgcggaagttacagtcccagcgccgacattagcgagtccgagagttccagcagcttctcctgccaccgcttcgacggcgagggtgcctctagctccatcccttcttcccctcgagttgtcgctggtagaggattttacttcccggccccagtcatgcttccggtgatcggcggcaaagatgtggtctgggatgacaaacaaccagacaacgatttatccggtataaaagtttccaaatttgacctcttttgtaaacattgatgaacactaggattcaatttcccttttgtttcctattgggtttcagaaattgagatgatgaaggagagatttgctaagctacttctcggggaagacatgtctggtggaggtaaaggggtttgtacggcgcttgctatctccaacgccatcaccaatctctctggtaccatctcaatcttcttccctttttgttagttggtatatatagtaggggtttctagttttttaataaggctagtgtccacacagcgactgtgtttggcgaactatggaggcttgagcctcttgctcctcagaagaaggccatgtggcgcagagaacttgagtggctgctctgtgttagcgattctatcgttgagctcattccttccattcagcagttccctggaggcggaacttatgagatcatggagacccgtccacgttctgatctctatgccaatctccctgctctcaagaagctcgatgctatgttgatcgatatgcttgacgctttctccgatactgagttctggtacactgatcgcggcatagttcttggtgattgtgacaaggattcttacaattctccagcttccgttaggcaggaggacaagtggtggctgccttgccctaaggttccgcctaacggtttgtcagaagaggccaggaagaaactgcagcagtgtcgggactttgctaaccagattctcaaggctgcattggcaattaacagtggcgtgcttgccgaaatggagattcccgacccttacttggagactttgcccaaggtatgcgccttctcgagctcaaggattagctttttcattgctgctggagcataaattcttttaccgttatatgtgattagctcattgagttatgattttaaacttaatgcagagcgggaaggaatgtcttggagagatcatctaccagtacttaactgcaaacaagttctctcccgaatgcctcctggactgtcttgatctctcatcggaacatcagactcttgaaatcgccaaccggattgaggcggctgtgcatgtttggagacaaaagaatgggaggaggcacaagaagcaggcgaaactaaagctgtcttcttggggtggcaaggttaaaggccttgttaatgacaacgaaagaaatgatttccttgtgcagagagccgagaccctcttgcagagtctcaggatccgtttcccgggacttccccagacaacgctggacatgaacaagattcagtacaacaaggtacattatagtttggagtgtgctttgctggttgcatcatgaaacgatgcttagataatttaagagtttgtgtgtgttcttgcaggatgtagggcaatcaattctggagagttactctagggtgatggagagcatggccttcaacatcacggccagaatagatgatgtgctttatgttgatgatgccatgagaagatccatctctgtcacagaatcgctatccctattcagcatcaatggactcaaccctcaaaaagcgttctctgtgcagagctctccgcacggttcaccatttgcaacgcctgccctaagtgtagcatcaagaagcccgaggagagcaccgccgctgtattcagtgaagaggaatgggacgagagagaagggaatagtgggagaaacagagaaagcatggtcgtatgcagggaatctgagttcaagaagagtaacgggagtgacgccggaaagagattaagattgaaaatagaagaatgtaaatcaatggttgtagagactgtagttgtttcttgtttgtctgactacgaagacgaatgtggtaatagcaacaagaatgttatcttatgtggagttttgaaatgttgttaacaaatcaattccttagctcatttaccaagtttacaaagattatggtccaagtcctaaaactgaatgaacatcacatacccgtctcttgagtgatttaatcatgttcttcattgcactaaagcgacaacttttggttcaaatatagactatgactatatggtttgttttgcacaggattaaagttgatgttccaattttataattaaaaagtcagaaaggggttttcttgttattttttacttgttcttataagctatcgggacgacacggagttttaaagagttttccgttttgctgagcggaggcgagagagggtttagagtgatg

SEQ ID NO: 19252 - DNA, 3003 bp, Unknown; identical to SEQ ID NO: 19251
  misc_feature (1)..( 3003): 2750-1469P.txt file - cDNA_ID_1821193; gDNA_ID_2926215; Annot_ID_142184

SEQ ID NO: 19253 - DNA, 3003 bp, Unknown
  misc_feature (1)..( 3003): 2750-1469P.txt file - cDNA_ID_1821197; gDNA_ID_1620652; Annot_ID_47769
tcacgtcatatatagaagcagctggcacaagggtaggcgtgttcattatttattgagttgagagttttgagtagtaggaatgtgtagtgtgtgtctagcctataaatcatcattccaagtaaaaaggaaaaaaggtagtgtgaaagctagagctaccaccacattacccaatagtctagggtgaatgacgtggcattgcaccgactctctgctctgcctcacagctgggcctggtactacatgttgatgtcggtcggtctcttgttttctcaagtgatttattaccacacactctatctagctaattgtgttcctattaatcattcatcggacatgttaaactgttgatttcagtcaatgatgagatcttcaatattcagcagattggtagctaagaaacatccatgtgagaacgactctgtcacatctacggcattcattactacatgtgatgatatcttcatacttctccctctcttgtttaagaccctatatcaactgctgatttctttcaagttctaatgatggataacagatttagagaaacacccatgtcttgttgggtttaggctcatgactagaacaggaagagtaaacctttggttcctcttctttttttagtggtggggctgtaaagaagtccaatgacgtgagcagcattaaccaaaaccatcaagtttaacccaatactggcccttttatgtttatgtaagcccatcttctgattcggcccaatcaagacacttcagttagcagtaagattttcaaacttatttttctaataatgtctaaacaatttaaacagtgcttttgctctctttattggataacgtggaccgtccacaccgacaatccattggtcgacgaaacgcagagtattcggacatgtactatgttttttattacactttccgaaaaaaacaaaccttgttccgatcaaagtcggtccttaaaatattgacttgttagtacaatttgccggcaacaccttggctaaacgcgaaccgagtgttaattactataaattaactgtaactaaaataaacaaactaaaagctagagctactataaatacagtgtcgcaggggtttgtgtaactcatcagtcctcacagctagcaaaggaaagtctcgttggtaaattaaaagtgagtcttgaataccttgtttgcgtttttcctaaaagatggcggatcatcctcgttctactgagcagcaagaagctgatgctgcagcttccaaaggctgtgggatgtttgactttctcaagaagaaacccgaagatgtacattcttccgagaatgcccgtgtaaccaaggagcccaaggaagaggagaagccttctctcgctgaaagattccacctttctgacagctctgtaagcttaattgtatactcttgttcttatgcatgagaaatgttaataacacttgttgatggaggatgtgatatatatgtatatgcagtcaagtgatgaggaagcgggtgaaaatggggaaaagaaggagaagaagaagaagaagaagaagaatgaagttgctgaagatcaatgtgaaacagaggagaagattcctgcgggtataggccatgaggatgggaaggagaaagggtttatggagaagataaaggataagcttcccggaggtcacaatggaaagcctgaagctgaacctcataatgacaaggccaaggagaaagggtttatggaaaagatcaaagagaagcttcctggtcataccaatgatgagaagaagaaggaaacctagttataagaagaccctttttttttttactttcgcttttaccacttgcgttttcatcttcttgtattgttgtccacctcgttatgtgtcagtgaaatgccaacttttcgaattgaacaactcttgaatcttaaataactcatactattataacattgaaatcctcaagtatttaaaacctgttgttttcatctgttagtgaaaaaaacctatgtatgtatgaaacgttaaaaccctaaattttaccacaaaaaaaaaacgttaaaaccctaaaaccggcatccaataacccattaaacatataagaagaaacccatgctttctgagcaagaaacggttctgcttagttaggtttgggctgactaaaaagggcccaaaaggcccatttgaaatcacggaaaataggaaaaagttcaaggggaaggagcagccagagacacggagagtctgtgtatgaaagtgaagggaaaaggagatcgacgtctcctctcagactctcacgggaagaagacagtctgtgactttttgtgtttccagctgttttcatatcatttctcaattctcactcgtatacctgacaatttgggttaccaagttgaccgttgaaatttgtgtttatataataagaattttgtggactattactaatttactagtattattttatacttccagcatatatacatacatacattgcttcttcatattctctacgcgttcaatcaatatttctcgtgtaggctggctatttgtgccaaaatacaactcaaattgtttcaccccaaaaaaaaaaaagcagatacaataaaataaaatttatataattatatgttaattctcatttgtgtaaaatattgaagcagcttaaaataaaataaacctcacagtaaaaatgaaataaaataccttgcaattaaatgagaatgcttatttttaacaaaataaaaaataaataaaaatcaatgcatcaccggattgggattttattttctttcaaaaaaataaaataacaatccccaacccaaaggacaaaataatgggtatttaattagtaggtggggtggccttataatatattacaggttgaaataaaaacacggaattagctgattggaaaagcttccccctccccattggactttaaatacgacaccagagtcatttgttccgttactacaaaacagagttgaagctttctcttccaactttatcttcttcttcttcttgtcaaagcgagtatg

SEQ ID NO: 19254 - DNA, 3003 bp, Unknown; identical to SEQ ID NO: 19253
  misc_feature (1)..( 3003): 2750-1469P.txt file - cDNA_ID_1821197; gDNA_ID_1620652; Annot_ID_163500

SEQ ID NO: 19255 - DNA, 3003 bp, Unknown; identical to SEQ ID NO: 19253
  misc_feature (1)..( 3003): 2750-1469P.txt file - cDNA_ID_1821197; gDNA_ID_2926215; Annot_ID_142182

SEQ ID NO: 19256 - DNA, 3003 bp, Unknown; identical to SEQ ID NO: 19253
  misc_feature (1)..( 3003): 2750-1469P.txt file - cDNA_ID_1821197; gDNA_ID_2926215; Annot_ID_202920

SEQ ID NO: 19257 - DNA, 3000 bp, Unknown
  misc_feature (1)..( 3000): 2750-1469P.txt file - cDNA_ID_1821213; gDNA_ID_1620652; Annot_ID_47764
ttctaaggactccccttctttccaatatgcaggatctgtagagttgggttcagctggcgtttccatggccattttcaataccatatcaaagctcttcaacattccgctcctcagcgttgccacttctttcgtcgctgaagatattgcaaagattgccgctcaagatttagcctcaggtatacgttgataatagcttttttctcttcccaatttttcccagccttatatctctttgaatggatttacagaagatagtcagagtgacataccttctcaaggtttaccagaaaggaaacagttatcttcagtgtcaacagcgctagtgttagccattggaattggcatcttcgaggcactggcattgtctttggcatctggaccctttctaaggttaatgggtatacaatctgtaagttcggtccagagagtgcttattgtcttctatgtcttacgaaatttcgtgagaaatctatgctgaggaatgcatgttttctgtctttttttttacctgaaacccagatgtcagaaatgttcatccctgcgcggcagtttcttgtccttagggcgcttggtgctcctgcttatgtggtttccttagcacttcaaggcatttttcgtggattcaaggatacaaaaactccagtctactgtttaggttagcattctttgagatcttgttacatatccaagaacattagattatctttattgttctcggtttacatcagttctttcgttccctaatttccataattcaggtattggtaattttctggctgtatttctattccctctgtttatatacaaattcaggatgggtgtagccggggcagcaatctctagtgtcatctcccagtatgtatccatagatcttttttcttttcctgttttcctcctttggtcaaccttgtaggatggtgctaaacccctttcctctgattcataggtacactgttgccattttgatgcttatactcttgaacaaaagagttatactgcttcctccaaagattgggtcactaaagttcggcgattacctaaaatcaggtatgtagacactggtttctcccttatgggacttatggatgtaagcactgtattgatatttctaggttttaaacttgacttgaattatagggggatttgttctgggaaggactctttctgtgctcgtgaccatgactgttgccacatcaatggcggctcgtcagggagttttcgcaatggcagcacatcagatatgcatgcaagtgtggttggcggtatctctgcttactgatgcactagcttcatctggacaggtattagattctcagcttggttttcatacctagagattttggctatagctttcttcatctctttggtattaaatagaatgtaattaagcctcgtgtgtcttgttgagcaggccttgatcgcgagctctgcatccaaaagagactttgaaggtgtgaaagaggttactacttttgttctgaaggtctgagcctacttcccttttcgcagttcatattcactttttggggatgctacttgatctcttgttatatatatatatatagagagagatgtaacgtgtttggtgttgtacagataggagtggtgactgggatcgcactggctattgtgttggggatgtctttcagttcaatagctggtttgttttccaaagaccctgaagttctgcggattgtgagaaagggtgtattggtgagtgatgtaattacatagagtgggccgagcttttcctgttatattcacgtaacatgcattcagtttgtagcggcgactcaaccaataacagcgctagcgtttatctttgatgggctgcactatgggatgtctgacttcccctacgcggcttgctcgatggtaaggaagagagagagagagagagaagtcctctttgttaaaagaaaagataagatatagggtgattgattgatttgtgtgtgtgtggcagatggtggtgggaggaatatcatcagcgttcatgctgtatgcaccggcagggttggggctaagtggagtgtgggtggggctgagcatgttcatgggattgcggatggtggctggattcagcaggtaaagaaagagctacctgtatctatctataaataaatacaaggtgaaccaaaagtgtaatttttgtggtaataataaagctctcaaatgtgtgtgtgtatggtagattaatgtggaggaagggtccatggtggttcatgcataccagtgacaaggtgagagagcctcttctacgcttcttcttatagtttttattctattttttggggacctgcaattgcaaagcttttcttgttaactctgtttcctgtggattatatggcagcgtcttgcttaaaactgtgaaagagagatagagaaggagagagtgacgtgcccagtcatcttcttcatcaccttttcacatatacaacaaccacagatccaaaaaactgtcttttataattcgatttgatagattttacttattagctagctttgtttgtcactcatttttcgatcatcaatatataaaatatgtcgacttgtgaatttacgacaaagaagaaaacttaatgtaggcaaaagccaaaaccgatgcttgattgcagtgctgtgtatcaaaaacacatatttgccgtatttagctacattttgacaattgtgtagtgcagcaatatccacgaagaatggtgaataaatattccttattacagtatttaaaaaaatatcggattagaaggaaattagtgactgtaaatgttaagctttgactaaaagataagggataaaagagataagaatgcagccagtcaaaaccttagaaattactgatatgagattttcgataaaaattaggaattagaagaaattagtgaatacgaccgtataaatatcaaacctcagatagatagagtaaatgaaatgtatagagaggtaaagtgggaattttgacattggtgggtttaggggaaaaacagagagaaagagatg

SEQ ID NO: 19258 - DNA, 3000 bp, Unknown; identical to SEQ ID NO: 19257
  misc_feature (1)..( 3000): 2750-1469P.txt file - cDNA_ID_1821213; gDNA_ID_2926215; Annot_ID_142177

SEQ ID NO: 19259 - DNA, 3003 bp, Unknown
  misc_feature (1)..( 3003): 2750-1469P.txt file - cDNA_ID_1821217; gDNA_ID_1620652; Annot_ID_47763
tgccacagaaggaaatcgtgaacaaagattatatatacggttaataataaactggaatatagacagacgaagcaaaacatagaaactacctgctcgattctgtagaatggcgaaaggtgggtatcaaagaactttttctcttctgctgctttgctttcaggaccaacccacaactacaacatgtagaaattcacatgaacaatcataccagtatttgcagttgcttttctgctgaatgatttgtacaattatggtcctggcaaagttaatacataccttttctggtcgtgtttccaccttgaaattatagagacctgaacagagtgcaagaacaatagctactgacatgaagagaacaagagatggatttctagcaatccatgacccatatgatctgaggcaaacaattggaaacaattacgaatttcatctcatctaattgtagagataacttgcgagtaagatacagacaacgaaacaaaatcctggagattcacctgtaaaattttgccatatatctctgaacaggagagagttgagcatgtctttgcacctaagaattagaagtcaattgatcaattagttctttcctccaaacagattaaatcttcaaggatagtccagcatttatgtgggtatataaatgtattttatgttatatatacatacacataagaactacaatttctagccaatacattgatataccttgacaccaagtatgttttccttcatttcactattaattccatcttcttccacaggatgcaatagtggctttgagctatcaagaggctgtgtcgtatttcttcttcgatttaaaccagcccatccgaagaagcaagacaccagcaagacgtatacaagtgccattgataactcaatgcatctaacctgaaaatacaaatcaatataatcaaatccaagatcataccaactcaataatgttttcaagcaacaatgggataattcataactcacaccttaagaggaccgattctaattgagcaagaatcttcatcatggggcggcaggggttcgggacttgagcaagctggtgaggaagggcaatcaccacaagagcatccaagggatgtgtcaccacatgaataaacagatacattcattggtaccatcgcagatgactcagggatgcttgatttgaagttgatcgcatatggtgaaccaggaaagccagatggtgctttctgaccaataaacgtaaaccattctggaaaagcagaagtaaagatgaaacatggaacttttgaaacaagataaagcgtgtatggaacgccttagaacaaaactgcagagcacctctgaagtttttagcaccaccgccaacaaagttaattgcacgtgtgttcattgttccaaatttcacctctttacaggactcgtaaaggccttctccaaacgtatcagttatgtgatagtctataccatccactgtcaaatttccactcacctagaataaatcccaactagctagtgttgttaaccatataaatgggtgtcaagtaaccaacaaaagctgaaaaaaatggaagctaacctcagcaacagaagtgacgttgatgaaaagagactgatttggagaacaggagagctcgcagaacaaatttaagaagttccgtaagcatgcaggacaacccacaagaaaagggacagcctaaaagagattgcattgacaacgaattagtaaaaatggcctgctctgataatagcaaaaacaagagaataagaaaaaggtcatacctgttgaacttgagacctcaaagtgtcaaactgagtctctgtacaacagacattgccacttatggttgggcaaaggctttggattttggcagaaaacagttcatcaggctgcagaaaggaatgtcagattgactcagacatgcagaagtaattggaaaagtaatggtcttactccatgatctgaaaagttgtctacctgaatggaaggggaggcataaggacagttaaggacttttccatcgctgcggtgtccgcaaatgtcatacatagcgcaatactcttttgaatgtctattattactgagcagcagtacagattaccgaaagagagatgaataagagattgagaaaaaaggaaggccatatgtctcggtcactaaaatgcaaattaccttggttctgagtgggtcaggtttgcggtgagtaaaagtgagaaagtaaagagctgcaacatgacaatcattcccaattatacgataatagcatcgatagaagtcagaggcggaaatcgttcaataaaagcaaaggcctaataagaagaagcacacaaagtatatgcaatttgcataacgaaaaaacccagaaagaaaacataacaagtttttttttaaaaaggaaaatttggcaagaaacgctaggacaagacagaaaatgaagaggattgcctgtaagaggagaagcttggtaggaatcgccatgttttgtctgaagagcaattaagcaagcagttggggtttatttaatcttggcgtagtagttagttgcagagagattggattgttgactaaaattgaattggagagtaaagtaaggagagtcgggagacacgaggcaagaggaggacggtgatgatgagtcagtaccagtaacatctgcttgccgttttaaatgctaacaattgcaatgcatgccgtttttacgttttcttttaccatcaaagttagatgaaaaaaaaggcatctcttttgtcttgtttgttttttctcatcatcctctcatgggtcgtccattgcagacgtgagctcgtctgatcaaatcctccttggcttctcttcgttttctccaatccatttctttgtttataccaaacttcatgtcattaggtcctccgatcattcttcgaatcggtttttgtgtggcggatccagtttaatcatcatcaattcatcatcatcatcatcactggtcgcagctgaattcgattctttgattgggcttgtgggatgggaacttgttcctgatg

SEQ ID NO: 19260 - DNA, 3003 bp, Unknown
  misc_feature (1)..( 3003): 2750-1469P.txt file - cDNA_ID_1821217; gDNA_ID_1620652; Annot_ID_163494
acgaagcaaaacatagaaactacctgctcgattctgtagaatggcgaaaggtgggtatcaaagaactttttctcttctgctgctttgctttcaggaccaacccacaactacaacatgtagaaattcacatgaacaatcataccagtatttgcagttgcttttctgctgaatgatttgtacaattatggtcctggcaaagttaatacataccttttctggtcgtgtttccaccttgaaattatagagacctgaacagagtgcaagaacaatagctactgacatgaagagaacaagagatggatttctagcaatccatgacccatatgatctgaggcaaacaattggaaacaattacgaatttcatctcatctaattgtagagataacttgcgagtaagatacagacaacgaaacaaaatcctggagattcacctgtaaaattttgccatatatctctgaacaggagagagttgagcatgtctttgcacctaagaattagaagtcaattgatcaattagttctttcctccaaacagattaaatcttcaaggatagtccagcatttatgtgggtatataaatgtattttatgttatatatacatacacataagaactacaatttctagccaatacattgatataccttgacaccaagtatgttttccttcatttcactattaattccatcttcttccacaggatgcaatagtggctttgagctatcaagaggctgtgtcgtatttcttcttcgatttaaaccagcccatccgaagaagcaagacaccagcaagacgtatacaagtgccattgataactcaatgcatctaacctgaaaatacaaatcaatataatcaaatccaagatcataccaactcaataatgttttcaagcaacaatgggataattcataactcacaccttaagaggaccgattctaattgagcaagaatcttcatcatggggcggcaggggttcgggacttgagcaagctggtgaggaagggcaatcaccacaagagcatccaagggatgtgtcaccacatgaataaacagatacattcattggtaccatcgcagatgactcagggatgcttgatttgaagttgatcgcatatggtgaaccaggaaagccagatggtgctttctgaccaataaacgtaaaccattctggaaaagcagaagtaaagatgaaacatggaacttttgaaacaagataaagcgtgtatggaacgccttagaacaaaactgcagagcacctctgaagtttttagcaccaccgccaacaaagttaattgcacgtgtgttcattgttccaaatttcacctctttacaggactcgtaaaggccttctccaaacgtatcagttatgtgatagtctataccatccactgtcaaatttccactcacctagaataaatcccaactagctagtgttgttaaccatataaatgggtgtcaagtaaccaacaaaagctgaaaaaaatggaagctaacctcagcaacagaagtgacgttgatgaaaagagactgatttggagaacaggagagctcgcagaacaaatttaagaagttccgtaagcatgcaggacaacccacaagaaaagggacagcctaaaagagattgcattgacaacgaattagtaaaaatggcctgctctgataatagcaaaaacaagagaataagaaaaaggtcatacctgttgaacttgagacctcaaagtgtcaaactgagtctctgtacaacagacattgccacttatggttgggcaaaggctttggattttggcagaaaacagttcatcaggctgcagaaaggaatgtcagattgactcagacatgcagaagtaattggaaaagtaatggtcttactccatgatctgaaaagttgtctacctgaatggaaggggaggcataaggacagttaaggacttttccatcgctgcggtgtccgcaaatgtcatacatagcgcaatactcttttgaatgtctattattactgagcagcagtacagattaccgaaagagagatgaataagagattgagaaaaaaggaaggccatatgtctcggtcactaaaatgcaaattaccttggttctgagtgggtcaggtttgcggtgagtaaaagtgagaaagtaaagagctgcaacatgacaatcattcccaattatacgataatagcatcgatagaagtcagaggcggaaatcgttcaataaaagcaaaggcctaataagaagaagcacacaaagtatatgcaatttgcataacgaaaaaacccagaaagaaaacataacaagtttttttttaaaaaggaaaatttggcaagaaacgctaggacaagacagaaaatgaagaggattgcctgtaagaggagaagcttggtaggaatcgccatgttttgtctgaagagcaattaagcaagcagttggggtttatttaatcttggcgtagtagttagttgcagagagattggattgttgactaaaattgaattggagagtaaagtaaggagagtcgggagacacgaggcaagaggaggacggtgatgatgagtcagtaccagtaacatctgcttgccgttttaaatgctaacaattgcaatgcatgccgtttttacgttttcttttaccatcaaagttagatgaaaaaaaaggcatctcttttgtcttgtttgttttttctcatcatcctctcatgggtcgtccattgcagacgtgagctcgtctgatcaaatcctccttggcttctcttcgttttctccaatccatttctttgtttataccaaacttcatgtcattaggtcctccgatcattcttcgaatcggtttttgtgtggcggatccagtttaatcatcatcaattcatcatcatcatcatcactggtcgcagctgaattcgattctttgattgggcttgtgggatgggaacttgttcctgatggatatattaaagtcttaccatctcctagctgctgcttactcggctcctgcgtgggcaagctttatg

SEQ ID NO: 19261 - DNA, 3003 bp, Unknown; identical to SEQ ID NO: 19259
  misc_feature (1)..( 3003): 2750-1469P.txt file - cDNA_ID_1821217; gDNA_ID_2926215; Annot_ID_142176

SEQ ID NO: 19262 - DNA, 3003 bp, Unknown; identical to SEQ ID NO: 19260
  misc_feature (1)..( 3003): 2750-1469P.txt file - cDNA_ID_1821217; gDNA_ID_2926215; Annot_ID_202914

SEQ ID NO: 19263 - DNA, 3000 bp, Unknown; identical to SEQ ID NO: 3591
  misc_feature (1)..( 3000): 2750-1469P.txt file - cDNA_ID_1821221; gDNA_ID_1620652; Annot_ID_47762

SEQ ID NO: 19264 - DNA, 3000 bp, Unknown; identical to SEQ ID NO: 3591
  misc_feature (1)..( 3000): 2750-1469P.txt file - cDNA_ID_1821221; gDNA_ID_2926215; Annot_ID_142175

SEQ ID NO: 19265 - DNA, 3003 bp, Unknown
  misc_feature (1)..( 3003): 2750-1469P.txt file - cDNA_ID_1821237; gDNA_ID_1620652; Annot_ID_47756
taatggcaaaagcatatgcaaatattgccaaatcaaaaaatgtaaccaatctgtacgttttcttgatgcagcagtgtggagaaaataaacgtgttataggtaaagcaacctctgatgctgaccttccttcaaggtacttttttacattcctcttgtcagcaatctttgtgggacaacaatctttgttgaaactttttccatcccattttctttgctagcgctcttgatcaagcaaaagccatgggccatgcactctctcttgcaaaagacgagttatatgactgccatgaacttgcaaaaaagttccgggccatccttcagtccactgaacgcaaagtagatggactgaagaaaaagggaaccttcttaattcagctagctgccaaaacatttcccaagccattgcattgcctgagtctgcagctagcggcagactattttattctaggtttcaatgaagaggatgcagtgaaagaggatgtcagtcaaaagaagcttgaagatccttcgctctatcactatgcgatcttttcggataacgttctggctacatcagtggtggtgaactccactgtcttgaatgcaaaggaaccgcagaggcatgtgttccatatagtaactgacaaactgaattttggtgcaatgaagatgtggtttcgcatcaatgctcctgctgatgcgacgattcaagttgaaaacataaatgatttcaagtggctgaactcctcttactgctctgttctacggcagcttgaatctgcaaggctgaaagaatactatttcaaagcaaatcatccttcatcaatctcagctggcgcagataatctaaagtaccgcaacccaaagtatctatcgatgctgaatcatctcagattctaccttcctgaggtttatccgaagctggagaagattctgtttctagacgatgacattgtggtgcagaaggacctggcaccactatgggaaatagacatgcaaggaaaagtgaatggtgcggtggagacgtgcaaggagagcttccacagatttgacaagtacctcaacttctcaaatccaaagatttcagagaattttgacgctggtgcttgtgggtgggcatttgggatgaatatgtttgacctgaaagagtggaggaaacggaacattacagggatatatcactattggcaagacttggtaaggcattggaaatttctcaaaagaaatacatataaatatttttggatgatgaatggatgtgtcaattaatatatgattgatgcagaatgaagacagaacactgtggaagctgggatcgttgccaccggggctgataacattttacaacctgacgtatgcaatggataggagctggcacgtactagggctgggatatgacccagcgctaaaccaaacagcaatagagaatgcagcggtagtgcattacaatgggaactacaagccatggctgggtttagcattcgccaagtacaaaccgtactggtccaagtacgttgagtacgacaacccttatctccgacggtgcgacatcaatgaatgaatgaagagatggtggaggtagtatacatgatgaagcactcaaaggaaactaaataagtaaaaattgttttcagtttaccataatactaggaatcagcagacaatcacacatgacgattaattaaatagaatctcttgtttttctcaaactcagaaaaactcaccaaaggaaactgaacaatcttttcactcggagtgttgttcttcacttgtttttttggtatcaacgtgactgaaaagcatatgggccttagaatgcgatgctttgtctatatacagtgtgtacagtgagtaaaactgccccgtgaatgcacataatgggccttacactggcccatcattgctttactctcctctctagctagcgacgagatgagtaaaacgccatctctcggagcggaacggctctgctctgctcttatcctctgtctgatccgtctccatcaccatctccgttctacaggtaaattgttttgcttcgcgctcctccgattgattattcactgatcagattctaataattataatcctgagtcctcgtttggttgatgttgaagcaccgcagatcctctttgaacttgttatttgtaagcttcttcttagtttctccttaatcgcagtgaaatggagattccggaggggacatcaaaagattcagaaaaggccaacgaacaagattcagtgtcatcaattggggcaaagaaacctccactggaatctccagccactactaatgctgcaagcggtcgacttgtttatgtccggagaagagtggaggttgacacatccaaagcagctgctagcactactaatccgaacccgcctcctactaaggcaccacttcaaataccttcatcacccgcacaggaaccaacccctaccagccataagttagactgggaagagcgttaccttcatcttcaaatgcttcttaacaagcttaatcaatctgatcggaccgatcatgttcagagtaagctcctcccagtatcactctaattcctaaccttgatgcttctgtttttttatatatatatatgtttccactgttattagtgctttggtcactttcctccgccgagcttagcaagcatgctgttgacttggaaaagaggtctattcagttctctctcgaggaaggtactctactcctttacttacactctctcacttcctaccattgctgaatcatatctgtttggcacagttctagttgaccatccataagtggattattcatgctgctgcttaagccattttttccatatctgctgacaactatagaggttttagtcacatgcttttaggtttgtagctaggaaccatctggaatcaagttcatgctagaaataatgttgttgatcctctgttgcagcgagagagatgcagcgcgtagcagctttaaacatgttaggaaggtctgtgaatagtctaaaatctacatcaaatgagtgaagggaaatg

SEQ ID NO: 19266 - DNA, 3003 bp, Unknown; identical to SEQ ID NO: 19265
  misc_feature (1)..( 3003): 2750-1469P.txt file - cDNA_ID_1821237; gDNA_ID_2926215; Annot_ID_142169

SEQ ID NO: 19267 - DNA, 3003 bp, Unknown
  misc_feature (1)..( 3003): 2750-1469P.txt file - cDNA_ID_1821240; gDNA_ID_1620652; Annot_ID_47755
ctcaggatgtgaacatagttgcgacatacagtgaccattacggcaatatacgccttggtagggtgaaaatgggggatctttcaccttcttgggttttggagaatcctgcctatcaagttagccgcaaaacaaaaggttcgcaggtaccaaacatttcatgttctggtttttagttttaatgagatttgatcatcagtttaagaatagaactgtatatcctatgggcatatggagttctatagtagaaaacttaaagtgtgtgaagtgattacttaccactcttctcaccgagcaaaaaatacctctcatgaacttcatttgttctaaccttgtgtttcttgaatttatccttaagcttgctcatattctttgttctctagttgctgacatttttttgtatggaattagctagttataccacgggattcatttcaaaatgatactggaatggaagataatgcaagccattctacaactaatcagactgatgaaagcgaaaatcagtttccaaacgtggattttgcaagcccagcaaaactgaagcggcaggtgatctgtcaaatagccttcttttctaatctctggatgccttaacactatatgactgagattgtaacaactgtagaccctttcagattttacgtcaggaaaggagaggtcaacgaactttagagctgatccgacaagaaaaggaaactgatgagcagatgcaagaagcagccattcagaagtcaatgagctttgaaaactcagtcatagggaaatacagtatatggaggagagactatgagagcccaaatgctgatgctatcttgaagcttatgagagaccagatcataatggcaaaagcatatgcaaatattgccaaatcaaaaaatgtaaccaatctgtacgttttcttgatgcagcagtgtggagaaaataaacgtgttataggtaaagcaacctctgatgctgaccttccttcaaggtacttttttacattcctcttgtcagcaatctttgtgggacaacaatctttgttgaaactttttccatcccattttctttgctagcgctcttgatcaagcaaaagccatgggccatgcactctctcttgcaaaagacgagttatatgactgccatgaacttgcaaaaaagttccgggccatccttcagtccactgaacgcaaagtagatggactgaagaaaaagggaaccttcttaattcagctagctgccaaaacatttcccaagccattgcattgcctgagtctgcagctagcggcagactattttattctaggtttcaatgaagaggatgcagtgaaagaggatgtcagtcaaaagaagcttgaagatccttcgctctatcactatgcgatcttttcggataacgttctggctacatcagtggtggtgaactccactgtcttgaatgcaaaggaaccgcagaggcatgtgttccatatagtaactgacaaactgaattttggtgcaatgaagatgtggtttcgcatcaatgctcctgctgatgcgacgattcaagttgaaaacataaatgatttcaagtggctgaactcctcttactgctctgttctacggcagcttgaatctgcaaggctgaaagaatactatttcaaagcaaatcatccttcatcaatctcagctggcgcagataatctaaagtaccgcaacccaaagtatctatcgatgctgaatcatctcagattctaccttcctgaggtttatccgaagctggagaagattctgtttctagacgatgacattgtggtgcagaaggacctggcaccactatgggaaatagacatgcaaggaaaagtgaatggtgcggtggagacgtgcaaggagagcttccacagatttgacaagtacctcaacttctcaaatccaaagatttcagagaattttgacgctggtgcttgtgggtgggcatttgggatgaatatgtttgacctgaaagagtggaggaaacggaacattacagggatatatcactattggcaagacttggtaaggcattggaaatttctcaaaagaaatacatataaatatttttggatgatgaatggatgtgtcaattaatatatgattgatgcagaatgaagacagaacactgtggaagctgggatcgttgccaccggggctgataacattttacaacctgacgtatgcaatggataggagctggcacgtactagggctgggatatgacccagcgctaaaccaaacagcaatagagaatgcagcggtagtgcattacaatgggaactacaagccatggctgggtttagcattcgccaagtacaaaccgtactggtccaagtacgttgagtacgacaacccttatctccgacggtgcgacatcaatgaatgaatgaagagatggtggaggtagtatacatgatgaagcactcaaaggaaactaaataagtaaaaattgttttcagtttaccataatactaggaatcagcagacaatcacacatgacgattaattaaatagaatctcttgtttttctcaaactcagaaaaactcaccaaaggaaactgaacaatcttttcactcggagtgttgttcttcacttgtttttttggtatcaacgtgactgaaaagcatatgggccttagaatgcgatgctttgtctatatacagtgtgtacagtgagtaaaactgccccgtgaatgcacataatgggccttacactggcccatcattgctttactctcctctctagctagcgacgagatgagtaaaacgccatctctcggagcggaacggctctgctctgctcttatcctctgtctgatccgtctccatcaccatctccgttctacaggtaaattgttttgcttcgcgctcctccgattgattattcactgatcagattctaataattataatcctgagtcctcgtttggttgatgttgaagcaccgcagatcctctttgaacttgttatttgtaagcttcttcttagtttctccttaatcgcagtgaaatg

SEQ ID NO: 19268 - DNA, 3003 bp, Unknown; identical to SEQ ID NO: 19267
  misc_feature (1)..( 3003): 2750-1469P.txt file - cDNA_ID_1821240; gDNA_ID_2926215; Annot_ID_142168

SEQ ID NO: 19269 - DNA, 3003 bp, Unknown
  misc_feature (1)..( 3003): 2750-1469P.txt file - cDNA_ID_1821243; gDNA_ID_1620652; Annot_ID_47754
gaggactcgcctcttctcggcaagggacctcccctctccagccagtttaagaccttcgccaacgtcttcatcgctgtcgtcggcgctggtgttcttggtcttccttacgccttcaagcgaaccggatggctcatgggtgtcctcctcctcgtctccgtctctgttttgacccatcactgtatgatgcttcttgtctatacccgccgcaagctcgactctttcaatgctggcatctccaagatcggctcttttggtgaccttggattcgccgtctgcggctccttggggaggatcgtcgttgacttatttatcattctgtctcaagctggtttttgtgtcggatatcttatcttcatcggcactactttagctaatctatccgatcctgaatcgcccaccagtctgaggcatcagtttacaaggctgggttctgaattcctgggcgtgtcttctaagagtctctacatatggggatgctttccctttcagctcggtttgaattcgatcaagacgctcactcacttggctcctctcagcatcttcgccgatattgttgatcttggcgctatggctgtggtcattgttgaggattccatgattatactcaagcaaaggcctgacgtggttgcctttggtggtatgtccctcttcttgtatggtatgggcgtcgctgtctattccttcgaaggcgttggaatggtcttgcctcttgaatcggagatgaaggacaaggacaagtttggcaaagtcttggctctcggcatgggattcatctctctcatatacatcgcatttggtatcttaggttacttggcttttggtgaggacaccatggacattatcactgctaacttgggggcaggacttgtcagcactgttgtccagcttggactgtgcatcaacctcttcttcaccttccccttgatgatgaatccagtgtttgagatagtggagaggcgtttctcacgcgggatgtactctgcgtggctcagatgggtactcgtcttagcagtgactctggtggctctttttgtgccaaactttgcagattttttgtcattggttggcagcagcacttgctgtgtgttaggctttgtgttacctgcattgtttcatttattggtgttcaaggaagagatggggtggctgcaatggagttcagacacagcgattgtggtactaggtgtggttcttgctgtgtcgggaacttggagttccctgagtgagatcttctctgtcaaagtgtgagcgtccgtgaagtcagagattggagaggtttttctctccttgtgtgcaattatgtatatggaattggttgtggttttaagagtaactgtgattgtatttgtattttgatggtttggaataaaagagatcagctctgtcttctgttttgtgtttacatgtacaacatatgtgagagttttgatttctcaatgttacaagcaagggaagctcgcgaaataagcctggctagctaatcaaatgctttggttttgtattattacaaactgttgagtgtgttccttccatgaatcgccttcttcaagatgcctctcgtagaagcaaatctcaccatcaccaccaccatctccatgggacttgacgatgatcgcagagatgcttctggtcccataacgcccctgtatctccatgagtgagactgaatatttatggaaagtgttaaacaaacaatcaatgtactctaaaaaaggaaggttacagttggtctctgcatgtcgacgaagatggagctgagatggtattccgtctctggtgtgaaaacgtgaggtagctcggtttcttcgtccttgacagtattggtcatcacctcctccaccatggtcttcaccgggaattcaccgctcccgttctcagccagaagctgttggaaaccctccctcagcctcagacactgcagagacaaaaacacgcaattgggggagtctgcaaaaggtaaataaagggagaaatggcccacatttacttaccttgggccaaggggagtcgaggttggcgttggaaaggacatggatcccgggagagacttgcgtcacgagcttgtcaccgtggggtggtcggttggtaatgtaaatcatggatttggacaagacatgagcgacaaccaggttaaagccattgtagagtgaaatttcgtcttggatctcctcggcaaactcggccggactcttttcgctctgttctcaccaaaacgttaaaagtactctcagtctctaacatgagagacaatctaaagcatattaggtggtggtgtagacctgcaagtaacgaagaggcagatctccacgggatttagcagcagggaaggaggaggcttccttgaaattggtgaggaaagccagacggccatgcctcgtgcagcccagccacgtcccgccgccaacaaggtctcttcctcccaccgtctctccgtcttcccaccaacgcagcgcctctgtcgcccttgacaatttacacaaaagattagtacaatctcatcaaaggaaacgattacagaggggattgaatcacctgttgtgatcttcatctctgttgagaaatagaagaaaagggtacagcggatgcgattgccacagaaatactgctatgcacattctcttctcctccgacgaaccaacgaaccaaccatctctctgctctaatcaaagtcgtcgtctcttttttttttttttttctccgtcttctacttaaagaaactgcgtgtagtttttcttaccacgaaacggcagcacgtgcaggttttaacaaacctctcgattgattgatttgctttaaagaaagctcgccggcgatgtggtaatatcagtcagatccagatgacgacgttctctacatgcgccgcctttttatcgctggtacctagcttgattgttctctctccgttcgatatgattatctatatttacttagctcgtcctggaattcgcactactctcttaaaatggatcatctgatcaaattgtgccttaattttttgacatg

SEQ ID NO: 19270 - DNA, 3003 bp, Unknown; identical to SEQ ID NO: 19269
  misc_feature (1)..( 3003): 2750-1469P.txt file - cDNA_ID_1821243; gDNA_ID_2926215; Annot_ID_142167

SEQ ID NO: 19271 - DNA, 3000 bp, Unknown; identical to SEQ ID NO: 3569
  misc_feature (1)..( 3000): 2750-1469P.txt file - cDNA_ID_1821247; gDNA_ID_1620652; Annot_ID_47753

SEQ ID NO: 19272 - DNA, 3000 bp, Unknown; identical to SEQ ID NO: 3569
  misc_feature (1)..( 3000): 2750-1469P.txt file - cDNA_ID_1821247; gDNA_ID_2926215; Annot_ID_142166

SEQ ID NO: 19273 - DNA, 3003 bp, Unknown
  misc_feature (1)..( 3003): 2750-1469P.txt file - cDNA_ID_1821250; gDNA_ID_1620653; Annot_ID_47802
tcttcacgtcggcgacagtgaagtcacgtgcacccttgaagaagtagacggctcggacgtagtggagcttcatggctaagtccatgggtgtgagctgtcgtggcttgttctcacctaccacagaagcaggcaccaccgaagagagcctgacactggtcactgggcttccctccattttatttttgtgagagagctgatatgtgtagcttataggcttaaatgggatgtgttatataaggattgagtttcgaaagagagttgagttcagaataggcatgggtatcactgatttaggacagttgggaaaactgtttccgtgacggcaacattaaatgtgggtgggatttgggtctttagcaacaacattagagttggacagttgagtcatcatattcagatccatccaacaacaagcacactttattacgtccaccttgtccttattggcttcaagcaataaacgcacatgtacgtgtcgtagccaactagtattatattacggtacctaacaagtcacattaatctataaaaaaccaagttcagtttcctggtaacattgtttccaccagcaaaaatgatcttaatacggatgcggttcatttccacctcaaacacaatcatgcaacaaatttcctgataatgattttacataattgtacgataactaaatcttgcgaaaaaacagtaaaatttttggtagagaacatccctattgccaaccaatctactcctaattgcgccctcagagatgttcatcattcgctgttgtgtcttgttaagaaaataaacacaagtcactgaacaatacctagttcgaaagagtcaacggtgatctttccaggtacctcagatgcttggacttggtgtattttcactaggccagttgtcctgattaattgcttgactcatcgcatgtagcaccatctagagaagcagcaaggtactcagcaaggctctgctgattactgctagttttgtgggtagcttctgaggtcacagatttttttggtgctatagacttgggaagccaggcttgacctgttgagctgctgctcgaagcatctgagcaattcttccataagactggcttaagatgcttccatggatcttcagccatagagttggagtaaaatcgttctgcccctggttccatgggtcttcttcctccatctctcccaaagcttgtgttcataccgcgtcctcgacttctgcctcttcctgagttaggatacgtgtttccaccccagtttgcattttgtcgtccataattggaaaactgtggaggagtattgttgtagctgcctcgaccaccaaatctattattccccatgttcggcatttcttgagagaatggaaaagggcgaggtacccattgaggtggacctgaatggttaactggtggaggcctaaagttgttattccaaccggcgggtggacctctgtgtgagggtgaaagatgtgccatccctcttggttcataatgagctgcatgaaagccaccatgattggtctgtgcctgatactcactacataatgatcctgttcaaagttataatgcaaggatcagaactggattactgttcattgcaaggcacaggacacaaacctaactgaattccataattgatgtgattttcatactgtcaattcctagaaagtgaaacttaaagagatatatcaaattaaagtagctaaagctaataagtttgaagcctgagactgagagacaaatttcttcctccattgatcttgatttgtagattataatcaagaacacatgactaaacccaaacaaagaacaaaaatttcatatagatttgtagaagagaatcatcacctaactctacgaaagcccaacaaccaaataccaaagtgaattcctgattctgttcaatcctatacctatactcaccaaggaccaactaacatactgtaagttaaactctcatgatattaggcaatcttctttatcagtggactactttctttggcctcacaagaatatagacaaaacaaaaattaagacagagtcattgactatcaaggcagaaacaagcacctggaggaactgatggtggaaactgaggtggtacaggagagcttccttgatgactaggagatgagatgtattgttgcttaggggtcttgtttttcttgaaactagaataagcagccatgggatcggtataataatcaaacctttgcgtttcaaatgaatcctgctggtgattggatgtctctgccaatggattggagaggtgacctgtgctcatagatgtttcagtacctgtagtagcatcatcatcattctgcgctgcagcttccattcgcattgcttttaacatctgttttcttttctctgaatcttccattgtgattcaactacaagatcaaaaggaaatttagaaatcaatccttcaaaatccaaaacacgagctactacaatgtaaaagcattagatacataatcaatctgaccttaaaaccccaaattcttacaattatcggatacccaaattggaaaaacgaaattgaaggtgaaacgaaccttcacaaaagtatggtttctccaaaaatcttcactttctcgtgaaaaccttcaactgtgaaacaacgatgatgacgaagcctttcactacataaacgaagacttccaaaaccgggttagtgttcgaccgtatttttcaattaaacccggtttactggtttaagcgattgaaatcattaaaccggcccattaaattttccgatagaaccttctctcagtcgctcaattgcccgaaaacaaaagtctctctctctcgatcgacgccgcaacgtgctcctttcaggtgatctgcttcttattctccatttcgtcatctctgttgtttctagatttggatcacgttttttctttcctcgatctagtgtttgttttaactgttttcgtaatttctgatcagatttaaccggaaaagttgaatcacactgtcgcatctctcacagtcgtcggagaagaatg

SEQ ID NO: 19274 - DNA, 3000 bp, Unknown; identical to SEQ ID NO: 3621
  misc_feature (1)..( 3000): 2750-1469P.txt file - cDNA_ID_1821254; gDNA_ID_1620653; Annot_ID_47801

SEQ ID NO: 19275 - DNA, 3000 bp, Unknown; identical to SEQ ID NO: 3621
  misc_feature (1)..( 3000): 2750-1469P.txt file - cDNA_ID_1821254; gDNA_ID_1620653; Annot_ID_163561

SEQ ID NO: 19276 - DNA, 3003 bp, Unknown
  misc_feature (1)..( 3003): 2750-1469P.txt file - cDNA_ID_1821254; gDNA_ID_2926185; Annot_ID_140759
atacaccatttagtcacatttaccacacagatgcaacatctgaaatcgagaaacttaccttcagtggaatgaagctcattgtgactaaggtctaacatttggacaaacagcaacttctcaacagaggctatccgagatagtgataagttatttagccgtagacatacaagattgttcatatccctatatcgcaaaaggtgtcttgacaaagattcactgcttgaagtcacctgcatgaacattctctttatgagtagtaggcatgatgaaacagaattaaggaaaaaatctagaatcgaacaatcaactttatactgtagacgagaatcggggaaaatcataactccgatgaaaattttaatagcaaaagtttaacataagattcacagcaacaaggaagactaagtaccttgtggagaaaagctttgctgtgctcatccttgtagtactggtagtgtgaagaatccagcgccatcaaatcgttatacagctgaaggatttcttcatagtgaacacccttgacagcatcatccgataccatagcttcacgagccatcaaaagccttgcaagagtgagctttccaattttgctataaaggaaaaaataacacaacgtttaagactacaatttctctttccaatcaaagagagaaagtatataggatatatacctgtcaggcagtataccgaaacattcaacctcagaatctatagcttcctgacgccatttaaaatccatctcagcatttaaccgatccaaggtgacaagagaattcaaatcctttgacttcgcatcccaaatatcaaatccatccgtccatgaaacaatgccttcttgagaatcttcgacggtatcatgaacatgggctgtaaagacaaactcataaggtgcgttgaagttatatcctctggaagaaacgattcctggagagttcccaactctgatcttcactttgtattcgcaaggatctgaactgacatatttcagacgagcaacccatacacaggacacctgagaatttttgttcggaattggttcccaaacaaggccctcgtttccttttagttcagaatcaattgtaacagtagatgagcttactccaccaacagcttggtcaaagtagagaatcagtggaaaagaacccgactcagaacaaaaagtagtgaacatagatgaagagccactcaagcacccagctccagacagaatgatacttgaaccatgtgaaggccatgaggaagtgagaagaggagtctccacattaagagtttggtcaagaagccaaagatgataaaaccagccactttggtcatctggttccgtaaaaatagccgaatgtacaaagtcatattcctcaggaatctttatatttggcataaacccatcagcattttgtgccaacaaacttgatagaagtacactgcagaatgtgaacaaaaatatatagtaaagaatatgcatacctacgattatgctaaaaaactatttctgaacatgtaaatcagtaaagtataatatatactaaagaatatgcatacctacgattatgccatgcagaatagttgctgaaattgttattgatcatatcatctgtatactgcaactcatcctgttctgatctgttggttagctctacaacaaacctggaaaggaacaacacattaatatgcaagcttgattaacatacacaatgctcctttcaaaaagtgttgacattccctaattttcacctgcgatagttccaagcatgaaaatttctggaatccagcttctggaatttttccaaaagtctcaattcattccctacggatgaatgccctttactcaaaacccactttcgatgatgccaagcaccataggacttgaaattctgcctcaaagcactttctacctgaatttagaaccgacttcacagtaactaataagcaactactttcataaagagcaaattcgtttcttttaattgacaggataactcaccactctgagttcttcatcaagaattgcgctgaccaagtttggatcaggctcaattctggcaaggcgatcctccacagcaagcttccggtagttccatgcggtgtacgcctccggattgatttctagaagcttcgtgcttaactcaatagcttcattggtataactagaaaccaaaaaagcaacaaatgattagtaaataaacaaaggatccttcaaatcgtactaaaaatctgggaagtacactgatccgatggaaatgaaggagaagattgtacattttatcgtgatgattcgtcataaactgagactggagagagcgaagctgaacagctttagcagctgaagctgcttcctcttctggcttagaagcattccttggacgaccgtgcattcttctccgacgactgtgagagatgcgacagtgtgattcaacttttccggttaaatctgatcagaaattacgaaaacagttaaaacaaacactagatcgaggaaagaaaaaacgtgatccaaatctagaaacaacagagatgacgaaatggagaataagaagcagatcacctgaaaggagcacgttgcggcgtcgatcgagagagagagacttttgttttcgggcaattgagcgactgagagaaggttctatcggaaaatttaatgggccggtttaatgatttcaatcgcttaaaccagtaaaccgggtttaattgaaaaatacggtcgaacactaacccggttttggaagtcttcgtttatgtagtgaaaggcttcgtcatcatcgttgtttcacagttgaaggttttcacgagaaagtgaagatttttggagaaaccatacttttgtgaaggttcgtttcaccttcaatttcgtttttccaatttgggtatccgataattgtaagaatttggggttttaaggtcagattgattatgtatctaatgcttttacattgtagtagctcgtgttttggattttgaaggattgatttctaaatttccttttgatcttgtagttgaatcacaatg

SEQ ID NO: 19277 - DNA, 3003 bp, Unknown; identical to SEQ ID NO: 19276
  misc_feature (1)..( 3003): 2750-1469P.txt file - cDNA_ID_1821254; gDNA_ID_2926185; Annot_ID_200564

SEQ ID NO: 19278 - DNA, 3003 bp, Unknown
  misc_feature (1)..( 3003): 2750-1469P.txt file - cDNA_ID_1821258; gDNA_ID_1620653; Annot_ID_47799
agaacctatgatctgtgaccatattacaagatttgaatctgaaaataaattttattcttcccaatatttgtttttgcgaaaaaaagagattatttggaattgctgacgtcacatctctctcaggagattcccacccggaagtatcaactgtcgtcgtgtatcggttgtttccgtagatctctgttaccactttccatccaatttcaacaaattggatttggcaaactttcggatcagaaacgtgctcgggatgaggaggtacaccgagaaagtttggtcttttattcgttcgtcgctgagtttagaataagggattgtcttcatcgtacgactctgtttttgttgaaaatcgaatgctccaaatgaagcagccattacagaaccttaatcagtcgcagaagacagctttagctggtgttttcgtgctccttttcccgattctctatccgaatctcttcagccctcttggtcgcgcctctccttctctcttctccgtcagtctctctctctctatctccgatgatttatttggaatttcacattttgggattgtgaagctgaagaattaagtttggcatttgcaggaatggaatgctccaaggcctagacatttgagcctactccaaggcgctcttgatcgacaaattgtaagtgggtttagctcagtttcttggatgtatctactacgttcctctaaatctttttcttcttcctcgaaccaatgtgtagtcgatcagacaacaagttgagttatggtctcccttggcagatcaaggttggaagccttgcactgaatcttatagaggcgcttgtaagtttccaaatataaagctttcttccttctttcatcgtttacattcatgtgccctgaaaagtttgtattttgattgatgggtttgtcactctttgcagccttgccagagaagtctgaagggtttcttcaggttttccttgacggcggactaaatcaacaaagaatgggagtgagtataagaatttcagtcaatttttatggtggtttcccttctgactcttcttgttccttttgcagatatgtgatgctgttgctgttgccaagataatgaacgttacactcgtgattccacgccttgaagtaaatactgtttggcaagattcaaggtaatctactttgaaacttgtaagttgtctggtgcctgatgaatttggtgatttatgatttggcatttctttacagttctttcacagatatatttgatttggatcactttataagtgtccttaaagacgaggtgcggattgttagggagcttccaatacagtatgcctggagcactcgtgattattacgctacaggtattcgagctactaggattaagactgcgcctgttcacgcttcagcagagtggtatttggaaaatgtcttacctattatccagaggtttgtgctttctaaacctggtgatctatcagatgaataactgcattttaaagtcctggaaaatacgatactacatatgatctggaatgctttatagacaatactaagggagtgttcaatgtagatgtttttctgtcaagtcacgttttttttttgtgtctatctgaggaactatatatgtctgtagttcaatgcattgttactcatatgaattatccacttcgttatgcagttatggcattgctgctgttgctccattctctcaccgtttggcatttgacaatttgcctgaaagtatacagcggttacgctgtaaagtaaattttgaagcattaaactttgttcctcatattcgtgagctaggggacgctcttgtgcatcgactcagaaatcctccttccagctctcaaacatcaggaactatggatccgacagacagaataaacaccattgtaaaagctggtgctggaaagtttgcagtgcttcatcttcgtttcgataaagtgtggtcttaattctcaacaaatgtgcccatttcctggcagtaacatctagttctgacattgcttcatctttttttttaggacatggctgctcattcaggctgtgactttgaaggtggcaaagcagaaaaactggcgctggcaaaatatcgccaggtgatctggcaaggaagggtcttaaattcacagttcacagatgaggagctaagaaacaaaggtcgctgcccgttgacaccagaagagattggtttactgctgtcagctttgggtttcagtaacaatacccgtctctatctagcgtcacaccaggtttacggaggagaagcaagaatctcaacgctgcgtaaactgttccccgggattgaaaacaagaaaagcctagcctctgctgaggaactagctgatgtacaagggaaagcttctctgatggctgcagtcgattactacgtgagtatgaagagcgacatcttcatctctgcatctcccgggaacatgcacaacgcattacaggcgcatagagcctacttgaatctcaaaaccataagacccaacatgatactgttaggacaagtctttgtgaacaagagcttagattggtcagagtttgaaggagcagtaatgaatgggcacaaaaacaggcaaggccagcttcgtctacgcaaacagaaacagtctatttacacttatccagctcctgattgcatgtgtaaagtagcttagcattccccttttactgtcccaatcttttgttgatttttttaaaattttaatatatggtttttatgtactcgatgattagtaaattaattgaggaactcatattatgtacactaaattcaagtttagtaaaaaattggattaatgtgatttacttattgacaaaggtaaaataaaagtcaaataagaaaaggagagaaggacccactcagattcaacgccccaccaccgataactcaattaactctcttctcttggcttctgcaacgctgagccaccatcgtcctcttctcttcctcttcgatctctcctgaatcctcaaaccctggagagagagagagagagtgacgggggaagaagatg

SEQ ID NO: 19279 - DNA, 3003 bp, Unknown; identical to SEQ ID NO: 19278
  misc_feature (1)..( 3003): 2750-1469P.txt file - cDNA_ID_1821258; gDNA_ID_1620653; Annot_ID_163559

SEQ ID NO: 19280 - DNA, 3000 bp, Unknown
  misc_feature (1)..( 3000): 2750-1469P.txt file - cDNA_ID_1821258; gDNA_ID_2926185; Annot_ID_140761
acctatgatctgtgaccatattacaagatttgaatctgaaaataaattttattcttcccaatatttgtttttgcgaaaaaaagagattatttggaattgctgacgtcacatctctctcaggagattcccacccggaagtatcaactgtcgtcgtgtatcggttgtttccgtagatctctgttaccactttccatccaatttcaacaaattggatttggcaaactttcggatcagaaacgtgctcgggatgaggaggtacaccgagaaagtttggtcttttattcgttcgtcgctgagtttagaataagggattgtcttcatcgtacgactctgtttttgttgaaaatcgaatgctccaaatgaagcagccattacagaaccttaatcagtcgcagaagacagctttagctggtgttttcgtgctccttttcccgattctctatccgaatctcttcagccctcttggtcgcgcctctccttctctcttctccgtcagtctctctctctctatctccgatgatttatttggaatttcacattttgggattgtgaagctgaagaattaagtttggcatttgcaggaatggaatgctccaaggcctagacatttgagcctactccaaggcgctcttgatcgacaaattgtaagtgggtttagctcagtttcttggatgtatctactacgttcctctaaatctttttcttcttcctcgaaccaatgtgtagtcgatcagacaacaagttgagttatggtctcccttggcagatcaaggttggaagccttgcactgaatcttatagaggcgcttgtaagtttccaaatataaagctttcttccttctttcatcgtttacattcatgtgccctgaaaagtttgtattttgattgatgggtttgtcactctttgcagccttgccagagaagtctgaagggtttcttcaggttttccttgacggcggactaaatcaacaaagaatgggagtgagtataagaatttcagtcaatttttatggtggtttcccttctgactcttcttgttccttttgcagatatgtgatgctgttgctgttgccaagataatgaacgttacactcgtgattccacgccttgaagtaaatactgtttggcaagattcaaggtaatctactttgaaacttgtaagttgtctggtgcctgatgaatttggtgatttatgatttggcatttctttacagttctttcacagatatatttgatttggatcactttataagtgtccttaaagacgaggtgcggattgttagggagcttccaatacagtatgcctggagcactcgtgattattacgctacaggtattcgagctactaggattaagactgcgcctgttcacgcttcagcagagtggtatttggaaaatgtcttacctattatccagaggtttgtgctttctaaacctggtgatctatcagatgaataactgcattttaaagtcctggaaaatacgatactacatatgatctggaatgctttatagacaatactaagggagtgttcaatgtagatgtttttctgtcaagtcacgttttttttttgtgtctatctgaggaactatatatgtctgtagttcaatgcattgttactcatatgaattatccacttcgttatgcagttatggcattgctgctgttgctccattctctcaccgtttggcatttgacaatttgcctgaaagtatacagcggttacgctgtaaagtaaattttgaagcattaaactttgttcctcatattcgtgagctaggggacgctcttgtgcatcgactcagaaatcctccttccagctctcaaacatcaggaactatggatccgacagacagaataaacaccattgtaaaagctggtgctggaaagtttgcagtgcttcatcttcgtttcgataaagtgtggtcttaattctcaacaaatgtgcccatttcctggcagtaacatctagttctgacattgcttcatctttttttttaggacatggctgctcattcaggctgtgactttgaaggtggcaaagcagaaaaactggcgctggcaaaatatcgccaggtgatctggcaaggaagggtcttaaattcacagttcacagatgaggagctaagaaacaaaggtcgctgcccgttgacaccagaagagattggtttactgctgtcagctttgggtttcagtaacaatacccgtctctatctagcgtcacaccaggtttacggaggagaagcaagaatctcaacgctgcgtaaactgttccccgggattgaaaacaagaaaagcctagcctctgctgaggaactagctgatgtacaagggaaagcttctctgatggctgcagtcgattactacgtgagtatgaagagcgacatcttcatctctgcatctcccgggaacatgcacaacgcattacaggcgcatagagcctacttgaatctcaaaaccataagacccaacatgatactgttaggacaagtctttgtgaacaagagcttagattggtcagagtttgaaggagcagtaatgaatgggcacaaaaacaggcaaggccagcttcgtctacgcaaacagaaacagtctatttacacttatccagctcctgattgcatgtgtaaagtagcttagcattccccttttactgtcccaatcttttgttgatttttttaaaattttaatatatggtttttatgtactcgatgattagtaaattaattgaggaactcatattatgtacactaaattcaagtttagtaaaaaattggattaatgtgatttacttattgacaaaggtaaaataaaagtcaaataagaaaaggagagaaggacccactcagattcaacgccccaccaccgataactcaattaactctcttctcttggcttctgcaacgctgagccaccatcgtcctcttctcttcctcttcgatctctcctgaatcctcaaaccctggagagagagagagagagtgacgggggaagaagatg

SEQ ID NO: 19281 - DNA, 3000 bp, Unknown; identical to SEQ ID NO: 19280
  misc_feature (1)..( 3000): 2750-1469P.txt file - cDNA_ID_1821258; gDNA_ID_2926185; Annot_ID_200566

SEQ ID NO: 19282 - DNA, 3003 bp, Unknown
  misc_feature (1)..( 3003): 2750-1469P.txt file - cDNA_ID_1821262; gDNA_ID_1620653; Annot_ID_47798
tatttcatttcacgtgtaagttcgtcaagttgtggcgtgtgtcttggaaattgatgttttgtttgtagattttaagagctacttctaaaatttacaagagttttgtaattttcaattatggcccattattctcattaattcattaaaaaaattatatacattactatctatatctagcataggtagttttttttttctttttctttggtagacctactgaacaaatatctgatatatcactgactggataaatatctatagagatatttttgatagaaatgagtgttaatttaacgtaaaacaggaaactgagaggagaggatcttgatggattgaacttagaagagttgcagcggctggagaaactacttgaatccggacttagccgtgtgtctgaaaagaaggtttactactatacataaactaatagcatgcatattttccttaacgtggcatataaataataagctgtacatatataaaagtttgactttgttgttgttattggtaaatagggcgagtgtgtgatgagccaaattttctcacttgagaaacgggttagtagttagtacatacaattcgtataactaatggatcataagcctatctatagctagtgactttcttaataagtgaaacagggatcggaattggtggatgagaataagagactgagggataaagtacggctctaaacccttatagatatcatggaataaccttaatctatttttttatgtataagaaaatatgatgagggaacgtatattatatatcggcagctagagacgttggaaagggcaaaactgacgacgcttaaagaggctttggagacagagtcggtgaccacaaatgtgtcaagctacgacagtggaactccccttgaggatgactccgacacttccctgaagcttgggtataatttgtttaactgaacatatttcaaactttttgttgacattttgtatgtggatgtttactaactgtttgttggttaggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattggtctttataactattttgcaccaaagggattcttcacatcacggacaaataataattttaacactaatgaaacaagtaaatatagtgaaacgataggttttctatagtgattctttacattaacaacaatgaaacaataaatataatattggagaggggtgtgaaagaacaaatatgttaattaatttctacaaatgttttcacctcctttctcgattcatataaaacaaaggtaagtctttgttccttaccttcactctctagaaaagatttttttggccaaaaatatgtattcacgcaatcagcagaacaaaaacctcggaagatcacgtccaacgaaggacctttaggcttaggggtaacgtcatgtcttccacttttgagcaaccttgcaaaccatcaacgaagtctttcatgtgcattttattcaacaatggagttttgtaagaaggaactattgaaaaaactaatggaactaaggtgatctagatagtgaacttagcttttcccaaacttttctttatgcactacaaaatttcaataaattaagtttttagaaaaggttctcaagtgaagttagaattttataactcaaacaatattcatgtacgtgtccaccggttttcatggttagattttgagaaagagtgagtccaaactttttaataacgtttttgattccgtgtaagaatgtgtgattctccctcctcctgaaaccctaacccaagacaggagatctttctaacacattctatactaattcacaaaaatcttccaagttccgtccgatgtgggacaaacaattctaatatcccctctctagttaccgctacgagcctacgaccatcattctttgagtcgaagttatacatatgaaatgggaggcgtgattcacgggtgaatcctacatttgagaaattagaacctatgatctgtgaccatattacaagatttgaatctgaaaataaattttattcttcccaatatttgtttttgcgaaaaaaagagattatttggaattgctgacgtcacatctctctcaggagattcccacccggaagtatcaactgtcgtcgtgtatcggttgtttccgtagatctctgttaccactttccatccaatttcaacaaattggatttggcaaactttcggatcagaaacgtgctcgggatgaggaggtacaccgagaaagtttggtcttttattcgttcgtcgctgagtttagaataagggattgtcttcatcgtacgactctgtttttgttgaaaatcgaatgctccaaatgaagcagccattacagaaccttaatcagtcgcagaagacagctttagctggtgttttcgtgctccttttcccgattctctatccgaatctcttcagccctcttggtcgcgcctctccttctctcttctccgtcagtctctctctctctatctccgatgatttatttggaatttcacattttgggattgtgaagctgaagaattaagtttggcatttgcaggaatggaatgctccaaggcctagacatttgagcctactccaaggcgctcttgatcgacaaattgtaagtgggtttagctcagtttcttggatgtatctactacgttcctctaaatctttttcttcttcctcgaaccaatgtgtagtcgatcagacaacaagttgagttatggtctcccttggcagatcaaggttggaagccttgcactgaatcttatagaggcgcttgtaagtttccaaatataaagctttcttccttctttcatcgtttacattcatgtgccctgaaaagtttgtattttgattgatg

SEQ ID NO: 19283 - DNA, 3000 bp, Unknown
  misc_feature (1)..( 3000): 2750-1469P.txt file - cDNA_ID_1821262; gDNA_ID_2926185; Annot_ID_140762
ttcatttcacgtgtaagttcgtcaagttgtggcgtgtgtcttggaaattgatgttttgtttgtagattttaagagctacttctaaaatttacaagagttttgtaattttcaattatggcccattattctcattaattcattaaaaaaattatatacattactatctatatctagcataggtagttttttttttctttttctttggtagacctactgaacaaatatctgatatatcactgactggataaatatctatagagatatttttgatagaaatgagtgttaatttaacgtaaaacaggaaactgagaggagaggatcttgatggattgaacttagaagagttgcagcggctggagaaactacttgaatccggacttagccgtgtgtctgaaaagaaggtttactactatacataaactaatagcatgcatattttccttaacgtggcatataaataataagctgtacatatataaaagtttgactttgttgttgttattggtaaatagggcgagtgtgtgatgagccaaattttctcacttgagaaacgggttagtagttagtacatacaattcgtataactaatggatcataagcctatctatagctagtgactttcttaataagtgaaacagggatcggaattggtggatgagaataagagactgagggataaagtacggctctaaacccttatagatatcatggaataaccttaatctatttttttatgtataagaaaatatgatgagggaacgtatattatatatcggcagctagagacgttggaaagggcaaaactgacgacgcttaaagaggctttggagacagagtcggtgaccacaaatgtgtcaagctacgacagtggaactccccttgaggatgactccgacacttccctgaagcttgggtataatttgtttaactgaacatatttcaaactttttgttgacattttgtatgtggatgtttactaactgtttgttggttaggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattggtctttataactattttgcaccaaagggattcttcacatcacggacaaataataattttaacactaatgaaacaagtaaatatagtgaaacgataggttttctatagtgattctttacattaacaacaatgaaacaataaatataatattggagaggggtgtgaaagaacaaatatgttaattaatttctacaaatgttttcacctcctttctcgattcatataaaacaaaggtaagtctttgttccttaccttcactctctagaaaagatttttttggccaaaaatatgtattcacgcaatcagcagaacaaaaacctcggaagatcacgtccaacgaaggacctttaggcttaggggtaacgtcatgtcttccacttttgagcaaccttgcaaaccatcaacgaagtctttcatgtgcattttattcaacaatggagttttgtaagaaggaactattgaaaaaactaatggaactaaggtgatctagatagtgaacttagcttttcccaaacttttctttatgcactacaaaatttcaataaattaagtttttagaaaaggttctcaagtgaagttagaattttataactcaaacaatattcatgtacgtgtccaccggttttcatggttagattttgagaaagagtgagtccaaactttttaataacgtttttgattccgtgtaagaatgtgtgattctccctcctcctgaaaccctaacccaagacaggagatctttctaacacattctatactaattcacaaaaatcttccaagttccgtccgatgtgggacaaacaattctaatatcccctctctagttaccgctacgagcctacgaccatcattctttgagtcgaagttatacatatgaaatgggaggcgtgattcacgggtgaatcctacatttgagaaattagaacctatgatctgtgaccatattacaagatttgaatctgaaaataaattttattcttcccaatatttgtttttgcgaaaaaaagagattatttggaattgctgacgtcacatctctctcaggagattcccacccggaagtatcaactgtcgtcgtgtatcggttgtttccgtagatctctgttaccactttccatccaatttcaacaaattggatttggcaaactttcggatcagaaacgtgctcgggatgaggaggtacaccgagaaagtttggtcttttattcgttcgtcgctgagtttagaataagggattgtcttcatcgtacgactctgtttttgttgaaaatcgaatgctccaaatgaagcagccattacagaaccttaatcagtcgcagaagacagctttagctggtgttttcgtgctccttttcccgattctctatccgaatctcttcagccctcttggtcgcgcctctccttctctcttctccgtcagtctctctctctctatctccgatgatttatttggaatttcacattttgggattgtgaagctgaagaattaagtttggcatttgcaggaatggaatgctccaaggcctagacatttgagcctactccaaggcgctcttgatcgacaaattgtaagtgggtttagctcagtttcttggatgtatctactacgttcctctaaatctttttcttcttcctcgaaccaatgtgtagtcgatcagacaacaagttgagttatggtctcccttggcagatcaaggttggaagccttgcactgaatcttatagaggcgcttgtaagtttccaaatataaagctttcttccttctttcatcgtttacattcatgtgccctgaaaagtttgtattttgattgatg

SEQ ID NO: 19284 - DNA, 3003 bp, Unknown
  misc_feature (1)..( 3003): 2750-1469P.txt file - cDNA_ID_1821270; gDNA_ID_1620653; Annot_ID_47795
tataaatagtcgccatcatcatcatcaataaaagaatggtatcaaaaatctcgaagcagcttcctaacttgctccaacgtaacgaagagaacaacagtgaaaggaccttgcctacaaactgtaggaacaaagcctttataaagagccatggctccttccgctttaaccgtcttcaccgcacaatcccacgcgccgtcgtacgctcccaccttcatattcatcactctcgtctttatcacatccaccggattagacgcaaccgaagcaacaaaccccgccgcaaaactcgctaccacgtgagtccctagcccatcattcatcacaccattctccaatatcccttccttgaactgatcgtaagacgctagctgagccgccgtcacaatcatcgctcggttaatcgtcaacgccgagcctcgccacaagctcgttacgccttctcccttaaccatgctcctgattgcgtctcctactccggcgtagttacgacgttgcgctaaaggtaacctcccgtcagcttgcatcctaaccatcgccacgtcagctggatttccaacggcggctccgattccaccagcgactagccctgcaccgatcttcctactcagattcaacttccctgactcaggatcagtccatttgttcttaagcacttcgtatagacccatcctggtggtggaatataacgtctgacggagaagtgtagcggagactcctgagaataacgcggcggcgccttccgatttgactatgttgattccgagtgagatcggtcctactttggggactgaagaagtcgtttccaggaaagctgcaggagaagaattggggaaagcgagagctggacggaggagagtgacggtggtggtggaaggtgcttcaccgtgaagctgaagacgaaccttgattagatcgagagggtgagtagagcaaccggcgattacagaggcaatcccaccttcaacgaaacttttgactcccattgttgtgaaattggagagagaagagagaatgaaattgagatgttgtgagtgaaggagaagaagagggaaacaaaggtatttatttgtagcgagttttgttttgtgacgcggttttgtctgtgttcaatgttgacgaaacgagtgagagagtgtctgattattaaagaaaaccctaattaagtcagacccgccggttataaaaatagtcaaaaagtaggaaaacgcgtgtgtgagtgagacagagacagcccattgtttgctttatgggcttataagcgagacgtgttaattgggctttttcctttatggccgaaaacaaaagaaacgtcgcctgagagattcgaactctcgcgggcagagcccatgtacttagcaggcacacgccttaaccactcggccaaagcgacttgttgctatgagttagacaaaatcattaaaattctctattatgatttctcatagtgtgtgtgtatattgtggatctactaaaaattctttgttattattactttattttgtgaattagtttgatataggtaagtacaaagttaactttattatttactcaaaatttatcagattaactgattttatattgtttcctttggtatatagacgtactatagtttttagaaaaaccataagattcctttatatttcatagagtgaagagatgagatgagatcttggctggagaagaaataagtttccacgaggaggactctttttttttggtgaagacgaggaggaggactcttggttgatccagtctttacgttagacatcgacccctacatttatttgcctttctctatcaacatggcaggtaaaaatcttcattcaaccgaaccaaccaaagtctcttcccaataatattcaagcaccatcctttgggaaactcatacatactacagtctacactctttcattttctttcaacgctcaacttaacaaatgatatagtctagttgtcaattatatgttttaattagtgttttcacatcaaattctggtttgatatttgatgactattttcggaaacatctcaatgtcccgcaaatacaatcgtctatcatatataatcccgtacgttgtattcttatagatagaataatatggcgtgatctttataatataacatatagaatcgtgtagatttattttattttatttttatatatcgcataaattgcaaaatacttatatatgtttgttatatatgatacccattttatagttacttaaaaaaagttaagcgataatatatatatatcaactttttataacaaaaaagtataacacatggtaaagaaaaataaaaatgaagacatggtgtgacacgaaaatggcactaaatatacatatataatagatagctacaatatcccatcatacacacttttttaattgactaatacataacttacacacttttttaattgactaattcataactttttatcattgtcaacatgcaaattcatatttccgttgaactattattcttattttgtttttaaaagaagggcttcctggtaataaaaatatgatttccaaatgacgttagagcaaaaaaaaaaaaaggttgtctggtctggtaaaatgaaaaagcaaagcgtcttggtatagaaaagtaatatactgcctcctaatttcttcgtccttctaccgaagaatctctccactcttgccctctttcgaaaccctaaaccagaagcaccagattttttcaactttttcccagagaacaatagaaaacccaacttgtgctctctagggttttctttattccttctcatctttggattttcttgggtcatcattttggaagcttacccaccagcgaaaaaattataacttccatcgattcctggcttctctctctcgctctctctgcatgtgctaaatcgccggactgatcctcactgtcacctctgttcccggcttattcgccggtgaaatctatggttggtgctcagatttatttccaattgtttgtgcatctggtggaggataaatg

SEQ ID NO: 19285 - DNA, 3003 bp, Unknown; identical to SEQ ID NO: 19284
  misc_feature (1)..( 3003): 2750-1469P.txt file - cDNA_ID_1821270; gDNA_ID_1620653; Annot_ID_163555

SEQ ID NO: 19286 - DNA, 3000 bp, Unknown
  misc_feature (1)..( 3000): 2750-1469P.txt file - cDNA_ID_1821270; gDNA_ID_2926185; Annot_ID_140765
aaatagtcgccatcatcatcatcaataaaagaatggtatcaaaaatctcgaagcagcttcctaacttgctccaacgtaacgaagagaacaacagtgaaaggaccttgcctacaaactgtaggaacaaagcctttataaagagccatggctccttccgctttaaccgtcttcaccgcacaatcccacgcgccgtcgtacgctcccaccttcatattcatcactctcgtctttatcacatccaccggattagacgcaaccgaagcaacaaaccccgccgcaaaactcgctaccacgtgagtccctagcccatcattcatcacaccattctccaatatcccttccttgaactgatcgtaagacgctagctgagccgccgtcacaatcatcgctcggttaatcgtcaacgccgagcctcgccacaagctcgttacgccttctcccttaaccatgctcctgattgcgtctcctactccggcgtagttacgacgttgcgctaaaggtaacctcccgtcagcttgcatcctaaccatcgccacgtcagctggatttccaacggcggctccgattccaccagcgactagccctgcaccgatcttcctactcagattcaacttccctgactcaggatcagtccatttgttcttaagcacttcgtatagacccatcctggtggtggaatataacgtctgacggagaagtgtagcggagactcctgagaataacgcggcggcgccttccgatttgactatgttgattccgagtgagatcggtcctactttggggactgaagaagtcgtttccaggaaagctgcaggagaagaattggggaaagcgagagctggacggaggagagtgacggtggtggtggaaggtgcttcaccgtgaagctgaagacgaaccttgattagatcgagagggtgagtagagcaaccggcgattacagaggcaatcccaccttcaacgaaacttttgactcccattgttgtgaaattggagagagaagagagaatgaaattgagatgttgtgagtgaaggagaagaagagggaaacaaaggtatttatttgtagcgagttttgttttgtgacgcggttttgtctgtgttcaatgttgacgaaacgagtgagagagtgtctgattattaaagaaaaccctaattaagtcagacccgccggttataaaaatagtcaaaaagtaggaaaacgcgtgtgtgagtgagacagagacagcccattgtttgctttatgggcttataagcgagacgtgttaattgggctttttcctttatggccgaaaacaaaagaaacgtcgcctgagagattcgaactctcgcgggcagagcccatgtacttagcaggcacacgccttaaccactcggccaaagcgacttgttgctatgagttagacaaaatcattaaaattctctattatgatttctcatagtgtgtgtgtatattgtggatctactaaaaattctttgttattattactttattttgtgaattagtttgatataggtaagtacaaagttaactttattatttactcaaaatttatcagattaactgattttatattgtttcctttggtatatagacgtactatagtttttagaaaaaccataagattcctttatatttcatagagtgaagagatgagatgagatcttggctggagaagaaataagtttccacgaggaggactctttttttttggtgaagacgaggaggaggactcttggttgatccagtctttacgttagacatcgacccctacatttatttgcctttctctatcaacatggcaggtaaaaatcttcattcaaccgaaccaaccaaagtctcttcccaataatattcaagcaccatcctttgggaaactcatacatactacagtctacactctttcattttctttcaacgctcaacttaacaaatgatatagtctagttgtcaattatatgttttaattagtgttttcacatcaaattctggtttgatatttgatgactattttcggaaacatctcaatgtcccgcaaatacaatcgtctatcatatataatcccgtacgttgtattcttatagatagaataatatggcgtgatctttataatataacatatagaatcgtgtagatttattttattttatttttatatatcgcataaattgcaaaatacttatatatgtttgttatatatgatacccattttatagttacttaaaaaaagttaagcgataatatatatatatcaactttttataacaaaaaagtataacacatggtaaagaaaaataaaaatgaagacatggtgtgacacgaaaatggcactaaatatacatatataatagatagctacaatatcccatcatacacacttttttaattgactaatacataacttacacacttttttaattgactaattcataactttttatcattgtcaacatgcaaattcatatttccgttgaactattattcttattttgtttttaaaagaagggcttcctggtaataaaaatatgatttccaaatgacgttagagcaaaaaaaaaaaaaggttgtctggtctggtaaaatgaaaaagcaaagcgtcttggtatagaaaagtaatatactgcctcctaatttcttcgtccttctaccgaagaatctctccactcttgccctctttcgaaaccctaaaccagaagcaccagattttttcaactttttcccagagaacaatagaaaacccaacttgtgctctctagggttttctttattccttctcatctttggattttcttgggtcatcattttggaagcttacccaccagcgaaaaaattataacttccatcgattcctggcttctctctctcgctctctctgcatgtgctaaatcgccggactgatcctcactgtcacctctgttcccggcttattcgccggtgaaatctatggttggtgctcagatttatttccaattgtttgtgcatctggtggaggataaatg

SEQ ID NO: 19287 - DNA, 3000 bp, Unknown; identical to SEQ ID NO: 19286
  misc_feature (1)..( 3000): 2750-1469P.txt file - cDNA_ID_1821270; gDNA_ID_2926185; Annot_ID_200570

SEQ ID NO: 19288 - DNA, 3003 bp, Unknown
  misc_feature (1)..( 3003): 2750-1469P.txt file - cDNA_ID_1821274; gDNA_ID_1620653; Annot_ID_47793
ttcactaactacatcccaagagctactatcttctgcaaattcaacagctagcttatatagttagttatctctacaaccaaattacacacacattggcaatcttattgagtagataaacaaagctgaaacatcttaccagcaagaacttggggaactgaaacttgagctaattctatcttttcacgaaagtcattacattcaactctagatttgatgagatcataaaactgcacataagaaaacagatcacagaatcatgaaattgagcttctatattctaagttgagctaacatcgatcaaaatcctacgaaacagagagattaaagtaataaaaaagcatactttatcagcttcaggatctcctggatcggaagcagacggttcttccctgtccgattcttcctcctcctcctcctccggtgattcactctgttcgccaccgttttcatcgccgggaagttctagaagctcaagagctctctggcaatccgcgagcagattctgtaacgtctttcgctttacacgaatactatccaaatcgatgcggtttcctttggtttcggcatcatgagtcgagcaagagacttcgatttccatggaatcggaaagttttaggctgaaatttgtgaaagagaagaagatgaatttgatggttctcctccacaattgcgacctacaatatttgtttgttttatttccaccggaaaaaggggaaaaggagagtcgtgactcgtaagacaacaagcaactaaatttgctgaaattagattctattcaatctttgggacaaatattgctttatatatatcttaaagaattttaattgattttaaatatttttattattttgtatataatttttagaaatgtattcttgatttttaaaattttgaaatcagcatacttaaccacaataaaaaccataatcatcaacacttaatcagaaagcaattgagtacttattaaaatctcgataagtgttatggaatacagatggcatatttggcatacataaaatattcccacggtgacgggagctgtaacagtgacggtgacaaacacaacgaagacgtcaaattttttacatacatcacaactttatgcaagaagtaacaacttgttactattttttatgacaacgatctcttgttgttttcaccttctttttttttttttccttttttttttttgtctctgatgtgaactatacaccatagagtcatagacaatagtttgtgtagtgtgtactattctccatttctccttgagtagatgattgatcagtagcagttgataaagtcctttaaaacttgttgaagacgatctctgaggaaaattaattatacttaaataataagatttattctcaccatcgttgtacttcttcggctaattagcataaacatgtcttgtacatgtgcattaactcatctcttatgtgaaattccttattttaagctttcttactacttcgccatttttccttacaaattggattttgttttcacattctatcattaattcccatgtatcgagatggttatgttatgtacttatgtttatcatcgtagtctttgaccattttagagatatgtcatagaaaccaatgtttgaactcttagcaaaaaaaaaaatgtttgaactcaatgtcgttgttaagtgtttccaataagaacaagtaaagagacttatcaaaacactttgtgccatataaatgctcaagttttagtggaatcaggtgaattcatactgtaagtgtcacccaatctgttttttgatcactacagattacattaatgtgattcggttttggtgcgtctacgcaaatcacacttgttaattacttgcaagggaacacgagtagggggtggtggatatgttggaaagcggtgactatactaatttaacttaacactagtaatttcatgatatgacagtcctatatacacttaggtcgctcgcttgtacacctaaaacgcattgccatttgaggcattagtgttgcgcttggacatccaacaaacaagatcgatgctatatccaaatctagattgcataagttatatgaattgcatagtaattgaaacgaagaagaagattgttggatgaatagtcaattaatattgaaacaaccatcaaacaaaaaaaaattaaaattaatcgaaaagcagacgaatgaacgaatccccatgcacgcagcagcattatccaaacaaagataaacaaatggatcacgtagatttattaaactattcaaaccaataacatatcataagcaaaacaaatcagacaaacaaaaacagagagagtggtggatggtcgtgcttagcacgattcagtatattactgaggtcagagggtcaaatcaatgcaaggtgtaataaggttgtcatctccattaccattttttattacaaagagaaagagagattcttatttactctaaattaatgtcttaaactttattttgccaagactctaagacatattaagtagcatataatccataaaactatagagtagagagtaattataagagtgttaatataaattcggtataagagaaataatggttgagagaagagggaagaggtcaaagggggagaaagagggaaaatttccctccaaggaaggggggaagatgatgacgtgtacaactgccaaaataaaagcaaaggttcctcttttttcggccatttttttcgcttcacctcttctcctctaacgccgttgaactcatcaatcaatccattcacaaccaaaatctctctcaccatttctctccctaaaacaccattttcgctatttttatttttaattgatactttttttttactatcattcccagatcaaggtttgtttctcgatcgaattcatgcttctctgatctgagatcagttagatacgactgcgttttcctcctcgaatttgatcatcggacattctctttttgtttcctgggtttatagtgccgcacgtcaatggcgtgaaccgcggtcatg

SEQ ID NO: 19289 - DNA, 3000 bp, Unknown
  misc_feature (1)..( 3000): 2750-1469P.txt file - cDNA_ID_1821274; gDNA_ID_2926185; Annot_ID_140767
actaactacatcccaagagctactatcttctgcaaattcaacagctagcttatatagttagttatctctacaaccaaattacacacacattggcaatcttattgagtagataaacaaagctgaaacatcttaccagcaagaacttggggaactgaaacttgagctaattctatcttttcacgaaagtcattacattcaactctagatttgatgagatcataaaactgcacataagaaaacagatcacagaatcatgaaattgagcttctatattctaagttgagctaacatcgatcaaaatcctacgaaacagagagattaaagtaataaaaaagcatactttatcagcttcaggatctcctggatcggaagcagacggttcttccctgtccgattcttcctcctcctcctcctccggtgattcactctgttcgccaccgttttcatcgccgggaagttctagaagctcaagagctctctggcaatccgcgagcagattctgtaacgtctttcgctttacacgaatactatccaaatcgatgcggtttcctttggtttcggcatcatgagtcgagcaagagacttcgatttccatggaatcggaaagttttaggctgaaatttgtgaaagagaagaagatgaatttgatggttctcctccacaattgcgacctacaatatttgtttgttttatttccaccggaaaaaggggaaaaggagagtcgtgactcgtaagacaacaagcaactaaatttgctgaaattagattctattcaatctttgggacaaatattgctttatatatatcttaaagaattttaattgattttaaatatttttattattttgtatataatttttagaaatgtattcttgatttttaaaattttgaaatcagcatacttaaccacaataaaaaccataatcatcaacacttaatcagaaagcaattgagtacttattaaaatctcgataagtgttatggaatacagatggcatatttggcatacataaaatattcccacggtgacgggagctgtaacagtgacggtgacaaacacaacgaagacgtcaaattttttacatacatcacaactttatgcaagaagtaacaacttgttactattttttatgacaacgatctcttgttgttttcaccttctttttttttttttccttttttttttttgtctctgatgtgaactatacaccatagagtcatagacaatagtttgtgtagtgtgtactattctccatttctccttgagtagatgattgatcagtagcagttgataaagtcctttaaaacttgttgaagacgatctctgaggaaaattaattatacttaaataataagatttattctcaccatcgttgtacttcttcggctaattagcataaacatgtcttgtacatgtgcattaactcatctcttatgtgaaattccttattttaagctttcttactacttcgccatttttccttacaaattggattttgttttcacattctatcattaattcccatgtatcgagatggttatgttatgtacttatgtttatcatcgtagtctttgaccattttagagatatgtcatagaaaccaatgtttgaactcttagcaaaaaaaaaaatgtttgaactcaatgtcgttgttaagtgtttccaataagaacaagtaaagagacttatcaaaacactttgtgccatataaatgctcaagttttagtggaatcaggtgaattcatactgtaagtgtcacccaatctgttttttgatcactacagattacattaatgtgattcggttttggtgcgtctacgcaaatcacacttgttaattacttgcaagggaacacgagtagggggtggtggatatgttggaaagcggtgactatactaatttaacttaacactagtaatttcatgatatgacagtcctatatacacttaggtcgctcgcttgtacacctaaaacgcattgccatttgaggcattagtgttgcgcttggacatccaacaaacaagatcgatgctatatccaaatctagattgcataagttatatgaattgcatagtaattgaaacgaagaagaagattgttggatgaatagtcaattaatattgaaacaaccatcaaacaaaaaaaaattaaaattaatcgaaaagcagacgaatgaacgaatccccatgcacgcagcagcattatccaaacaaagataaacaaatggatcacgtagatttattaaactattcaaaccaataacatatcataagcaaaacaaatcagacaaacaaaaacagagagagtggtggatggtcgtgcttagcacgattcagtatattactgaggtcagagggtcaaatcaatgcaaggtgtaataaggttgtcatctccattaccattttttattacaaagagaaagagagattcttatttactctaaattaatgtcttaaactttattttgccaagactctaagacatattaagtagcatataatccataaaactatagagtagagagtaattataagagtgttaatataaattcggtataagagaaataatggttgagagaagagggaagaggtcaaagggggagaaagagggaaaatttccctccaaggaaggggggaagatgatgacgtgtacaactgccaaaataaaagcaaaggttcctcttttttcggccatttttttcgcttcacctcttctcctctaacgccgttgaactcatcaatcaatccattcacaaccaaaatctctctcaccatttctctccctaaaacaccattttcgctatttttatttttaattgatactttttttttactatcattcccagatcaaggtttgtttctcgatcgaattcatgcttctctgatctgagatcagttagatacgactgcgttttcctcctcgaatttgatcatcggacattctctttttgtttcctgggtttatagtgccgcacgtcaatggcgtgaaccgcggtcatg

SEQ ID NO: 19290 - DNA, 3003 bp, Unknown
  misc_feature (1)..( 3003): 2750-1469P.txt file - cDNA_ID_1821282; gDNA_ID_1620653; Annot_ID_47790
tgcagttggtctgcttccagcagcactacaggtaatttgtacataagcgtaaactttctatgaccattctttgttatttacacgaaagcattgtcatcatataggggattaatgttagggagatgcttactggtgctgctttaatggatgaggctactaggacaacttcggtaagtagtacttattgcagcttgtgttgaagatgagtttacttaccaggttttagtagaatgtcatatcatacggttgggtttcctgactcatacactttagatagtctctaccatgactcactctagcctgtaaatttctttcttctttcagatcaagaataaccctgcagcgctcttagctatgtgttggtactgggcttccaatggcgttggttccaaggtgtttttcctcaacttttttgagagttctaaggctatcaaggagattgagttcttattgaccttattactctattcttgctttcttttacaggatatggttgtccttccttacaaggatagcttattgctatttagtcggtatctgcagcagctggtcatggaatcactaggaaaggagtttgatcttgacggtaacactgtaagcatactcttcaattttctctgcagtaccccaaatcaaagttcatgagcatttactgagaactgagaaggtgtaaattggtcttgcaattaatgcccactcttataaatcagaagaccttggttacttaattacttgtgcacatgattgagttcagtttgttaccactccttcatggaagaattgaaacttgtgtactgtttcctcgaccctgttattacgagtgtgatcccaaggaccggttctttgaatttgcaggttaatcaagggttaactgtgtatggaaataagggaagcacagatcagcacgcgtgagtttcatttattcatatagttttactattgagagagcatagcaaataaggagctttttaacagtatttaatttgtttatttcattagctacattcaacagctgagagatggtgtgcacaatttctttgcaaccttcatagaagtgttacgggacagaccccctggtcacgattgggagcttgagccaggtgtcacttgtggagactatctctttgggatgctacaggtctgatttatgaatctcgtttcgcacaaattagtcagagataatatacactctttagtaacactatatatggtgaatttgtccagggaactagatctgctttatatgcaaacggtagagaatccatcagtgttacaatccaggaagtgacaccaacatctgttggggctattatagctctttatgaaagagctgttggtttatatgcctcaattgtgaacataaatgcttaccaccaacccggtagagatattcctcccatatctagaaaccgatgttctgtaattgcctaattgatatttgtttactgaatctgaataaaaaacgatttcaggtgtggaagctgggaaaaaggcagcagcagaagttctcgccctgcaaaagcgggtattgtcagttcttaatgaagccacgtaagaatcagaccgagtccgcttctttgtcaaaaaatcttgtctcgactcatgagagaccacttatatacttctttctgtggctgcagttgtaaagatccggtagagccattgacactggaagagatagctgatcgttgtcatgctcctgaggaagtaacgtccaaatccttgaaacttgttttttcattggtaacttttcgaacgcacgtatcaagaagtttttatctttgaatatgcagatagaaatgatatacaagatcatagcgcacatgtctgcaaacgacagagttctgatagcagaaggaaactgtggatcgccacgaagtatcaaagtgtatttgggcgagtgcaatgtggatgacctgtacgcataacaaaacccaacactttctcaaactccaaactctcattctctccattccttatttctttctgccatgtctatgattttgaaaaagaaaaagattgcaataagagccaggaaacacttgtgtacttgttttgaaataaagataatttcagaatgttacaaatgttgattgtaatgataacattggagatagattcatcaatcaagcaggctcatgtgaaacaatgatctcaacactcttctgcttgttttttggttaggtgttcttttgttgcataaacaaacaaaagcttaagctaatcagcaggttagagatgctcaacaacttcctcccatgtggttagattgtatcaactatagtttcttcaattaaattcacttctgaattttcttagaaaaccccattcagatctaaccaagataactctaaatatttaattttccataataacttttcacttgccacttttgaaattcgaatggaatatgttgacaaaagaaaatggtagatccaccgtaagaaaacaagacataagtcgagtcgattgtccccaccaccacctatttagtagcctaccataacaacaaaaaaattataacgttacaatcccttttatcaattttcaaaaccaagatgttgaatcgctttcccatgtcatcactacccgttatgccatagctcctatcaagctggtgagcgtactaaacgacaccgctttggggaggtcttaccaactcgattgcttttcctctctaccctttcccaaatttgaattcccaattttttcaaaatcaaaagtaaatactaacaaaaagcaaaaatatcaaaaaaaacaaagaaaaatcattttgaagtgcacagatatcaatcgtctctctccctctctctctgtgagaaagctttctgattaagctttcgtcgtctcctccattgcaaaatctagctcgatctgtgaaggtttctctgagttcttcaaaaatctcttctagagaaagacttcattagctcaattttagcaacttcctccacctccttttactcacactgtgcttcgatttcaacttcgcatttcacaatg

SEQ ID NO: 19291 - DNA, 3000 bp, Unknown
  misc_feature (1)..( 3000): 2750-1469P.txt file - cDNA_ID_1821282; gDNA_ID_2926185; Annot_ID_140770
agttggtctgcttccagcagcactacaggtaatttgtacataagcgtaaactttctatgaccattctttgttatttacacgaaagcattgtcatcatataggggattaatgttagggagatgcttactggtgctgctttaatggatgaggctactaggacaacttcggtaagtagtacttattgcagcttgtgttgaagatgagtttacttaccaggttttagtagaatgtcatatcatacggttgggtttcctgactcatacactttagatagtctctaccatgactcactctagcctgtaaatttctttcttctttcagatcaagaataaccctgcagcgctcttagctatgtgttggtactgggcttccaatggcgttggttccaaggtgtttttcctcaacttttttgagagttctaaggctatcaaggagattgagttcttattgaccttattactctattcttgctttcttttacaggatatggttgtccttccttacaaggatagcttattgctatttagtcggtatctgcagcagctggtcatggaatcactaggaaaggagtttgatcttgacggtaacactgtaagcatactcttcaattttctctgcagtaccccaaatcaaagttcatgagcatttactgagaactgagaaggtgtaaattggtcttgcaattaatgcccactcttataaatcagaagaccttggttacttaattacttgtgcacatgattgagttcagtttgttaccactccttcatggaagaattgaaacttgtgtactgtttcctcgaccctgttattacgagtgtgatcccaaggaccggttctttgaatttgcaggttaatcaagggttaactgtgtatggaaataagggaagcacagatcagcacgcgtgagtttcatttattcatatagttttactattgagagagcatagcaaataaggagctttttaacagtatttaatttgtttatttcattagctacattcaacagctgagagatggtgtgcacaatttctttgcaaccttcatagaagtgttacgggacagaccccctggtcacgattgggagcttgagccaggtgtcacttgtggagactatctctttgggatgctacaggtctgatttatgaatctcgtttcgcacaaattagtcagagataatatacactctttagtaacactatatatggtgaatttgtccagggaactagatctgctttatatgcaaacggtagagaatccatcagtgttacaatccaggaagtgacaccaacatctgttggggctattatagctctttatgaaagagctgttggtttatatgcctcaattgtgaacataaatgcttaccaccaacccggtagagatattcctcccatatctagaaaccgatgttctgtaattgcctaattgatatttgtttactgaatctgaataaaaaacgatttcaggtgtggaagctgggaaaaaggcagcagcagaagttctcgccctgcaaaagcgggtattgtcagttcttaatgaagccacgtaagaatcagaccgagtccgcttctttgtcaaaaaatcttgtctcgactcatgagagaccacttatatacttctttctgtggctgcagttgtaaagatccggtagagccattgacactggaagagatagctgatcgttgtcatgctcctgaggaagtaacgtccaaatccttgaaacttgttttttcattggtaacttttcgaacgcacgtatcaagaagtttttatctttgaatatgcagatagaaatgatatacaagatcatagcgcacatgtctgcaaacgacagagttctgatagcagaaggaaactgtggatcgccacgaagtatcaaagtgtatttgggcgagtgcaatgtggatgacctgtacgcataacaaaacccaacactttctcaaactccaaactctcattctctccattccttatttctttctgccatgtctatgattttgaaaaagaaaaagattgcaataagagccaggaaacacttgtgtacttgttttgaaataaagataatttcagaatgttacaaatgttgattgtaatgataacattggagatagattcatcaatcaagcaggctcatgtgaaacaatgatctcaacactcttctgcttgttttttggttaggtgttcttttgttgcataaacaaacaaaagcttaagctaatcagcaggttagagatgctcaacaacttcctcccatgtggttagattgtatcaactatagtttcttcaattaaattcacttctgaattttcttagaaaaccccattcagatctaaccaagataactctaaatatttaattttccataataacttttcacttgccacttttgaaattcgaatggaatatgttgacaaaagaaaatggtagatccaccgtaagaaaacaagacataagtcgagtcgattgtccccaccaccacctatttagtagcctaccataacaacaaaaaaattataacgttacaatcccttttatcaattttcaaaaccaagatgttgaatcgctttcccatgtcatcactacccgttatgccatagctcctatcaagctggtgagcgtactaaacgacaccgctttggggaggtcttaccaactcgattgcttttcctctctaccctttcccaaatttgaattcccaattttttcaaaatcaaaagtaaatactaacaaaaagcaaaaatatcaaaaaaaacaaagaaaaatcattttgaagtgcacagatatcaatcgtctctctccctctctctctgtgagaaagctttctgattaagctttcgtcgtctcctccattgcaaaatctagctcgatctgtgaaggtttctctgagttcttcaaaaatctcttctagagaaagacttcattagctcaattttagcaacttcctccacctccttttactcacactgtgcttcgatttcaacttcgcatttcacaatg

SEQ ID NO: 19292 - DNA, 3003 bp, Unknown
  misc_feature (1)..( 3003): 2750-1469P.txt file - cDNA_ID_1821286; gDNA_ID_1620653; Annot_ID_47789
ataaaatcagaaatcaaatatttacaacaatgagatatataggactatcagattgggtatcggagaagacttacataaatagtgaaaagaattgctaccaccatgatagcatatcccgcattgtagggagagaactcatggcgaaggtgccttgctacaaatacacagaacaaaacaaccggaactatgatcaatagcaaggtaagaggcagtgacctagcatctggtccaaatatcaatctcccacccaggatgaatttctgcaaaagagagagggaccatttattggtatcaccatactgaatttaaaacatgtgaagagtcaagcattgaagatacttccaattgttaataaattacaaggaacattcaacttgatacaaggttatgcaaaaatgcatggtcatgctttgagagtgaatcaagagatacttcaacgattcagctcaacaacattagtttacacgtaccaaagtaaaccaattgcgtaactaagattatgctacacaggtgaaactcgagaaaaaacgaattccaaatcatattcataccagagaacagaattcagagaatattcatctcccaacaaagagaaaacacacaaaaaaccaataaaattccaggctcaatcattcgatgaaaaaaggacttacattgcttcctttccagacttggaatacccgttgtgtcatggagagaagaagattaaagcgacagaatcagaaagtcctaagctaaccagcgacggaattcgaaggatagctgtgtaattctcgccgtgttctccctccggcgaagaagagggtttttatcccgacgaagaaatcgacggaaacctaatagtaccagaaatcgcgagcaaaaccctaaggattacacaattataaggctcgcgtgcgacttctggtctgacctccttcaatgggcgacgaagacgaacgagcgaataacctgagttttttttttatttttatttttttatgtttaaacgtttttgtctgcctttctcttgttttaaattatgacgtaatcatgtttatctcctaaaccacaaattacaattagtgtcctcaatttttctgcgcattttgtgtcagatttcattcctcgtgcaaactatacaatttcagttggtgatttttttgtttttgggatacattatttttttgtaggaaaacaaccaaataccatttatttgagtcattgtccattttgtctttcaattgactatcaattacaattgattatgatcgcaaatcaactggttttgactaattctattgaattgtttgaacctgttccttctcaatgagccaagaatttgacatgtttgaatagacacttaataaaactttgaaagtttgtaatttaaaaataaattgtagagatgaggaaaattccatttaatgttaaaattttacaaacgaattctcgattatttaaagatgatgacatgtataccttgcaaacataaatccctttattattaaaagggaagtacaaattgaatttttttctaatttggcctcaattttgatttcaattttggattttattctttgctattcaaaattattaaggctaatttggtcttaacaatctcctaaactttatatgatccgattcaatctaaaccgtttaataaaattaatttctttcaatctaaaccgttcaacaaaaataaggaatctatgtcgtttttgaaatcaaaatataatcacatttcatctctaaaaacagtatattcaatcacgaaatcaataatcaataatatccaaaccatttattacgattcttcactaatcactagaaatttatatttataagtttaagatatcaaatttattcaaatatttagtataagaaccaaataaattgattgcccgcggtaaaccgcgagttaaaacctagtttatatgtaaatgggtggaaacaataaacaaaaagcagctgaattgtttttaattttagcgtaattatttacttatttttctaggttttgcacgtaaaatgaaaggaatataatctctatttttcatcatgattagtagaaactttaacaggatccgacgtaattacatttttatctttttgtttgcgttaactaagttatccagtcaaacccttaaaatgtctcggcgacataaaaatattcgaaaagctaccatcgtatcatttctatagatctccctaatctatatgatatatcacatttctttcaaaattctttttttttttttttttaacaatttattgagatctatcatgtagattagggagaactatagaaatgtcaataagcacaaaagttatctttatcatcaaaagctatgcgacaacgctcaacaatcgacatccacgcatctagcatatgttgaacacataaagcaacccgactaaatcagcatactccatggatattactctttagatcaccaagaatggtagtctcgtttgtcctttagatgtcgaatctttttttcgaaagcttgtaaactcgaagttctttgaagaacaaccctactcccaatcaacattttaacatacgcataatttcatccaaaacacatacaaattgtttaaaaccacattaccattcattttatagcatatacggttggaagtgctagtttatgttcttcagctcaaaagagtggtagttattctgaatagaaaacaaaacatctgaaaatggcgggccacgtgaaataaaatagaatatgatgccaattgagacaataatatatatacatagtcgtaataagagtgataaaagctttgtgaagcctacctaatctaagcagggccgctcgctcccaccaaaggacaaatctctctcccgcactcatctctgttcattggttcctcccaaaaaatatcaatcaaatcggaataaactatacgaatcctccaatataaagctccaccctttctctttctatctctctctctccattgttgactgtctctcttccctcgtaaacatcgctgtctctaaagatg

SEQ ID NO: 19293 - DNA, 3000 bp, Unknown
  misc_feature (1)..( 3000): 2750-1469P.txt file - cDNA_ID_1821286; gDNA_ID_2926185; Annot_ID_140771
aaatcagaaatcaaatatttacaacaatgagatatataggactatcagattgggtatcggagaagacttacataaatagtgaaaagaattgctaccaccatgatagcatatcccgcattgtagggagagaactcatggcgaaggtgccttgctacaaatacacagaacaaaacaaccggaactatgatcaatagcaaggtaagaggcagtgacctagcatctggtccaaatatcaatctcccacccaggatgaatttctgcaaaagagagagggaccatttattggtatcaccatactgaatttaaaacatgtgaagagtcaagcattgaagatacttccaattgttaataaattacaaggaacattcaacttgatacaaggttatgcaaaaatgcatggtcatgctttgagagtgaatcaagagatacttcaacgattcagctcaacaacattagtttacacgtaccaaagtaaaccaattgcgtaactaagattatgctacacaggtgaaactcgagaaaaaacgaattccaaatcatattcataccagagaacagaattcagagaatattcatctcccaacaaagagaaaacacacaaaaaaccaataaaattccaggctcaatcattcgatgaaaaaaggacttacattgcttcctttccagacttggaatacccgttgtgtcatggagagaagaagattaaagcgacagaatcagaaagtcctaagctaaccagcgacggaattcgaaggatagctgtgtaattctcgccgtgttctccctccggcgaagaagagggtttttatcccgacgaagaaatcgacggaaacctaatagtaccagaaatcgcgagcaaaaccctaaggattacacaattataaggctcgcgtgcgacttctggtctgacctccttcaatgggcgacgaagacgaacgagcgaataacctgagttttttttttatttttatttttttatgtttaaacgtttttgtctgcctttctcttgttttaaattatgacgtaatcatgtttatctcctaaaccacaaattacaattagtgtcctcaatttttctgcgcattttgtgtcagatttcattcctcgtgcaaactatacaatttcagttggtgatttttttgtttttgggatacattatttttttgtaggaaaacaaccaaataccatttatttgagtcattgtccattttgtctttcaattgactatcaattacaattgattatgatcgcaaatcaactggttttgactaattctattgaattgtttgaacctgttccttctcaatgagccaagaatttgacatgtttgaatagacacttaataaaactttgaaagtttgtaatttaaaaataaattgtagagatgaggaaaattccatttaatgttaaaattttacaaacgaattctcgattatttaaagatgatgacatgtataccttgcaaacataaatccctttattattaaaagggaagtacaaattgaatttttttctaatttggcctcaattttgatttcaattttggattttattctttgctattcaaaattattaaggctaatttggtcttaacaatctcctaaactttatatgatccgattcaatctaaaccgtttaataaaattaatttctttcaatctaaaccgttcaacaaaaataaggaatctatgtcgtttttgaaatcaaaatataatcacatttcatctctaaaaacagtatattcaatcacgaaatcaataatcaataatatccaaaccatttattacgattcttcactaatcactagaaatttatatttataagtttaagatatcaaatttattcaaatatttagtataagaaccaaataaattgattgcccgcggtaaaccgcgagttaaaacctagtttatatgtaaatgggtggaaacaataaacaaaaagcagctgaattgtttttaattttagcgtaattatttacttatttttctaggttttgcacgtaaaatgaaaggaatataatctctatttttcatcatgattagtagaaactttaacaggatccgacgtaattacatttttatctttttgtttgcgttaactaagttatccagtcaaacccttaaaatgtctcggcgacataaaaatattcgaaaagctaccatcgtatcatttctatagatctccctaatctatatgatatatcacatttctttcaaaattctttttttttttttttttaacaatttattgagatctatcatgtagattagggagaactatagaaatgtcaataagcacaaaagttatctttatcatcaaaagctatgcgacaacgctcaacaatcgacatccacgcatctagcatatgttgaacacataaagcaacccgactaaatcagcatactccatggatattactctttagatcaccaagaatggtagtctcgtttgtcctttagatgtcgaatctttttttcgaaagcttgtaaactcgaagttctttgaagaacaaccctactcccaatcaacattttaacatacgcataatttcatccaaaacacatacaaattgtttaaaaccacattaccattcattttatagcatatacggttggaagtgctagtttatgttcttcagctcaaaagagtggtagttattctgaatagaaaacaaaacatctgaaaatggcgggccacgtgaaataaaatagaatatgatgccaattgagacaataatatatatacatagtcgtaataagagtgataaaagctttgtgaagcctacctaatctaagcagggccgctcgctcccaccaaaggacaaatctctctcccgcactcatctctgttcattggttcctcccaaaaaatatcaatcaaatcggaataaactatacgaatcctccaatataaagctccaccctttctctttctatctctctctctccattgttgactgtctctcttccctcgtaaacatcgctgtctctaaagatg

SEQ ID NO: 19294 - DNA, 3000 bp, Unknown; identical to SEQ ID NO: 3604
  misc_feature (1)..( 3000): 2750-1469P.txt file - cDNA_ID_1821306; gDNA_ID_1620653; Annot_ID_47783

SEQ ID NO: 19295 - DNA, 3003 bp, Unknown
  misc_feature (1)..( 3003): 2750-1469P.txt file - cDNA_ID_1821306; gDNA_ID_2926186; Annot_ID_140777
aagagagtaagtagaaacttacaatttgagattgataattctatcatcgtcttcttcaatcttgctatagttgcaagatgctgaagacaacgaagaagattctgaagccgtggtggataccacgggccatatgctaacatacgctgttctgtcccatgaatctcctcgttctctatcacccttcaaaatctttagaatcaagctgaagttgatggccaacgagaggaccaacatattcctccaagaaagaaacctcggaatctgtcccattttctctcaaaactaaaacacaaaaccaagaaacaagaatgcaaaatgcttaaagaagaagagcagagtgggatagctggataaagacctcttttaaaaaaaacaaaggaaacaaacaagtggtgtccaacgagactgatcctttttttggctgatattcgaagttatgatttttgtaagagattaaaataacccttgaagaatctcaagagataaaggtatgtataacaatgtgtttatattggattacgaacctaactcatgtacttaactcataaatattaccaatcacgattttaagaaattgaatttttaatcctagtagacaaattctaaactgagactacctatcaaaatacctgtagaattgcaggcagaggatcaaaaggtcacagaacaaattggccacagtgaaaggatcgctagaaggctttttatatgtaaactgaaaaagaagaatgtgtaattaggtcgaagctctttgtttgtttctctccacgataaaagatatttcccattgggaaaaagttattgtattttggctttggcgtgaagagtttcagcttttcggtttgtcaatggcagaccttggaaacgacagtacatgaaccgagtgagacactgaatttattcaggatctctgtttactagtacaagactggtgaatgctttatgtgtaacaatattttctagatttacgtcacttctctgttttcacatctaattagattagcttaaggctcattatattgactatgtaatattttgccctatatatgtttagtgtaatttacacatttggacaaaacgatttagggtgaaattgttgtaataacatattttggggtgttgattgtgaaagtaacaaagagaagaaaataatctctgcaagggtaacattaaaatagataaatgatccatggaccaaaatctacatattgccacggcccaaattgttcaagagtttagcaaagatcatatgggctggatccaagaggtttattatatttggtcattgttcaagtatatttgtttttttgttttcttttcatacattactgtttattgaatatgattctatcaaaggtgaagttgtataaaatggggtgggatcatcatttgtaagcattcaagtgtctcgttctctaactttcttaagtttgttggctttctctctaactcttaagtatcaatttggagaaaagcacgaaaatttaaaatatgctaagactactcgtaataaattaataaaaatcaaactatgcattatctaaaatcttctgtatataaaatttacacaaaattttaaaatttgaaaaaaaataagctagcgttgagctcaaatccgctcaagatcatcctctagcaccatgtacacagtgcatgtacgaacacttccaaccctcgattacaaaacaccggattaatatatgatctttccttagaatgagtgtactccacaaagaaacatgagaggtttggaagataaacataagcattacccaaaaaaccttattcatttgatcatgcctgccatcgtcttacttccctaaacatgtccttaaaatgaagaagtgaacctaccacataattcaatttctcccccatttttaacattcgtaaaatgtaaaagaaaggaaactattttgttaagtattgtttttatggctatcctttttttttttttttttgtcaaactatggctatcttttaaaatgggtaggtaaatatataaatgatgttaatgaataatactactcttttaatttatatatatatttttgttttttggagataggtgatcctttattcgctctattttattttaatcggcattcattttacaattcacaggaaaaaaaaaaagagagagaggaaaagctgagtaaaaccgtgcagccctgaacttcgacgctttctcctctttcaaccaatccgttgaacgtcgtcgtaataagcttcatcttcatcaatcatcatcactttcttctttctcccacagatccttccttttctccttcatcttccccttcttccttttccctcatcgcccaggaacacatccgatctgcaccctcttcgttcgattctcacaattaatatctagggtttgcgaggaccccccctctctattcaaaaaaagagagcagattttctctataatcccctttggtcagtttcttctctacctttttttcccctttgtattccagaggaatcgagtgatgagtttatagaattatcgcattttgaagtaatttgggtccttttgtagagcttgattgacatttctggagacatttgtatgtttcagagctctttttttgttgctgttgttgttctagcaagttgattgcgaaattgtcaacattctgggaatacgtcaattgtttttttagtattgcggtcatttagtctggaacctcttttgattccgcagtttgacgatctttcatacttttaggtttctgtaccaatttgattgtcgaacattgtctttctgttatgatggtgaattttagaaagtatttcaattcatgttggagaatttgtataggcagtctgattctgcaacacatttcacggtagcagtgttatagcaatagttcttcagtgtcggtcttgtttgattctttgggatttgagcttcaaatttcatttgtgaatctgattctgtatgtgacttacaggtttcaagtggtgtaattggatcgtgtagctgcttttataatg

SEQ ID NO: 19296 - DNA, 3000 bp, Unknown; identical to SEQ ID NO: 3603
  misc_feature (1)..( 3000): 2750-1469P.txt file - cDNA_ID_1821310; gDNA_ID_1620653; Annot_ID_47782

SEQ ID NO: 19297 - DNA, 3000 bp, Unknown; identical to SEQ ID NO: 3615
  misc_feature (1)..( 3000): 2750-1469P.txt file - cDNA_ID_1821310; gDNA_ID_1620653; Annot_ID_163538

SEQ ID NO: 19298 - DNA, 3003 bp, Unknown
  misc_feature (1)..( 3003): 2750-1469P.txt file - cDNA_ID_1821310; gDNA_ID_2926186; Annot_ID_140778
ttgagttggggtctgtttcagttccaagcctggatatcaaagtgtctggtgattcgtctgaacaaatcagttccttcactaatgaagagtctcaaaacagagctaaaaacaactggaaatctcaacatgtgcgtaggactcaaagaaactcactggtaaataagcctgcagagaaattttctggcaacaatgctgttatttgggctccagtacatccacagcaaaaagctgatgtttccactggtggagggagtcagactactgtccctgagtttggcacctcttcaaaaagtcagcatcaaggacagactagttctaaaagcaaaagagtggaaattgaaagatatgtaccgaagcctatagtaaaggaaatggctgagcaaatcgtcagtaaaaatctagtaacctctgctccagatatgtcggagaatgtaaaccagaaagaaaatcgtggaggtgagggtacaggaattctccaaccttctggttcaactgcagggaaatctgggtctccttcaaagtcaagacatgggaatggtaggcagggaaagcatggtagagaacatgcatcatggcaccagagaggttctggagcacctactaaagctttggaggatggacaatttgtaacctcaaatcagcccatccgaggaacagtgaactatcactctagtaagcaaaccgaacaaattgctgccaaggatcaaaccacatgtaataaggatggatggaacgatggctggtatatgactcctgaaacgcattactctgctgccgaagaaatggaatccagtgctgttggaaaagatcaaggaatgagcatgcacggcaggcagcatgcttcaagaagcaacaaggatggaggaagcaactatggtgaccctaaaaaaggcaataagagggatttcaataaagctcatacgcagcactctggccatgggtttagccaaccagatttgcctgctgcttcaaaagaaggtcgtgtccctggagatcatgtgtggcatacagctaataggacaggtaagtatggtggtcgtgaaagtacaagggacaaaccttatggatctcaggaaaaaaatgttgttggatacgagcatcaagggtttactacagaacaaaaaacgacatcagctgatacacaagcccagttgcaaaaccgatctaccaataaggaggtccaggttgagcaaaatccgaatagtatgttccaaaagaacacagggcagggtcgacggtttggaagagggcaggagtcacaaggaggttggggtttaccggcgcaagagaatatgcaccatcaccatcagaggccaccttcaaacagagatagacagaagcaaaatctgcattatgaatacaaacctgttgggtctcatacttatgatggagaacgtagtcgagaacaatcgaaagagagttctcagacagaaggtccaagatacagagagaagggacaggggcagcaaaggcagggtggataccaacagcaaaggggtactagtgggagaaacggtggtcatggattcactggtgatagaaactaagattggcctcttattgttatttaggtagtaagagctgccatgctgaggatacttgcattttgagatatggcgattgaggaagctaattcgtaggcacatagcttgggagattgctgagaggagacctatccgaggaggtattggcagattaaaaaaaaaaagtctttgtcttgagagtttattattatatgtttcagtcacttgtttgaatatgattataactactgtagtagccttttgtatacactagatgaatactcatgagtatttttgtttttaaagttgcttaaaaaaatatgattatgttttttggttgattttgatgttcattttgataaattcctatctatttaatataatttttttattttatgattagatttatctataactcgaaatatcaattctagtataatatatatatttatatctattattctaatattttattgtcatgatcacatataaaaacaatatatgatatattgatacaatgtatgcgttttgaaacttgtctaaattaattgtacaaacaattatttattccatatattctcttgtcatcaactacacaatcacatcatgatatgctagtaattcaagtcacactttaattcttttcacttgcatatagccatatagaatctcatatttttttttttgtatgtcgaatgtcgaatgtctcaaatgactattatattataaaattgtatatcaatgttactaagttattagaacgcaccaaaatgtacagaaaaagttcatatgataaattatattcacaaaacgtaataataagaaaatatctaattaaatttactaaatttatatgaggttaggtagcaaacataagagttttaagagtttggattttggaattggtggtgtttgtttctcaaacttcataaattagagtttaaaatgtttttttattttttgtggtcggcataagagttgaagttttaataaaataaaatagtatctgatcattttattggagaaaacataaaagatgtagtattttataagaactcgaattggtcaattttcaaaatgttagtatgaaaaataaaatatctagttatatgtactcgtatctcttgatatttttggctttaacttagggatgttagtttgatttgtctttctggataagccagtagtaaccaaaaaagtcaaaatcttgttggctaagtcagaaattaattaaataaacaaaagggcccattaaattaattattttaataaatattctgtgtaatgatatatagtataaaacgcgaccgtctaaattcttggttgtttacgagaaaagcggattacgggtacgcttcttctaagataaatctctccccgattctctctttttctcgctagatactctttttcttcaattagggtttcttctcgcttgccttttaattctctccagctgatctgatctccgttaccgatg

SEQ ID NO: 19299 - DNA, 3003 bp, Unknown
  misc_feature (1)..( 3003): 2750-1469P.txt file - cDNA_ID_1821310; gDNA_ID_2926186; Annot_ID_200613
ccagtagtaaccaaaaaagtcaaaatcttgttggctaagtcagaaattaattaaataaacaaaagggcccattaaattaattattttaataaatattctgtgtaatgatatatagtataaaacgcgaccgtctaaattcttggttgtttacgagaaaagcggattacgggtacgcttcttctaagataaatctctccccgattctctctttttctcgctagatactctttttcttcaattagggtttcttctcgcttgccttttaattctctccagctgatctgatctccgttaccgatggagtctactgctaacgcactcgtcgtcaaggttagagatacaaccttcctttctttatttgcgaatcgtcagttttctcacagtaattgtcggtgattctgggttttcgtggcgatcgtctcgtttctgttgattttgttgcttgtaatcggtcctttccttttgaatttcgctatggatcgactctctctctctctgtctctgtattataatcttaagtgtaattcgaaaattttccagacatacttagcagtatctgcttgaatcttatacccgaacaatgattaaaactataagttatcgtaattagaatcgtaatctatttcttcgacaattttttttcatttttttcattgaagtgatactaattttgtttgtgattatgtaggtgagctatggaggtgtgcttaggcgtttcagggtgcctgttaaagctaatggacagcttgatcttgaaatggctggtcttaaggaaaagatcgctgctctctttaacctctctgcggatgctgaattgagtctgacttactctgatgaggatggggatgtggttgcccttgttgatgacaacgatctctttgatgttactaatcagcgtcttaagttcttaaagatcaatgtgaacgctggcgtgtccactaactctgctgctccagagagtagtgggagttccacacctgcgggtatgcctaacccggtttccaaaatccagaagggtataaatgatgttctgatggctgtacctaacccgatgcgtgataccatatcaaaggtgtacatggaccttgcatccaaggcctcaacttctagtcctgtagttggtgagatgcttgattgcatttccaagctagggcagctctcaattcctcaggaaagtagtccttgctcacctgttaccaagcctggttcttcaggtgcttccctgagcagggatgttccttccgctggtggaaagaaggatatctctgagaggacccagaccggaaggaaacctgttaatctgaatgaacccactggcgctcattcaaagacttctggtcatgtaccaaactcgtctggactgggtgctaatttcaacgagtgtccctttagtggcagtaccatgaattactcctgtccaaatccagttaacctcaacaagcatcctcgtcgtgtttgtcattccaaaaagagcaccaatggtgattactggacttcattgggtgtattccataagggcatccgttgtgacggatgtggagttcttccaattactgggcctagatttaagtcgaaagtgtaaggatgccttctacttactactttagaaactataaacatgctagaacttattgtgcttatatgtttcgcttgtgaatattgtgcagtaaagaagactatgatctgtgcaccatctgctattcggtgatgggtaacgagggggattacacaagaatggataagcctgtatccgttcaacatctgcatccttttagaggaccgtttacccaagtattgctcttcttctaagtttataattacttttcttcttgtttattctatgtgtcttctctgatagctatgaggaattcttacccttttttttttggtatagtttcctaatccttggttgagccaccctgtgccacgagcaaccaatggaggtgcacctctcaggtgtactcgccctaaactagacagtcggtttgtccttgatgtgaatgtaattgatggaaccgttgttgctccatccgccccatttactaagatttggaaaatgaggaacagtggttcgctggtgtggccacagggcacacagattgtctggatcggtggggacaggttctgcaactccttgtcagttgatttacaggttagaaacaatttccttagttttcactcttttagctcgattcttaccactaacagagcaattatgttgtttgaatttacactcgatggcttgagttaggttgttttcttcacgaagtgactatagctgcttgattatataatactaactgtttttttctctctttacacatggcagattccaaaggagggtgtgcctatctatagtgaacttgacgtcaaagttgattttgttgcaccagagttacctggtcgatacatttcttattggaggatggctacctctgacggtgctaagtttgggcaacgtgtttgggtgttgatacatgtacttactagatttgtgcagcttctgtcctttaattctttgtctctttctatcatatgtgtttgatacattttttctttttgcatggttaggttgatgcatctctgaagaattctgttgtgaatgagtttcatggactgaaccttaatgcctccccctcccttgatgagaattttccaagcgaatttctagggattatgaattatgagtcagctcaacctggcagctccagtgtcaatcctgggaccgtgaaaggtactgatctagagggcgaagttggtgaaacacaggccgtggaaaaagaaaaccttttggttggtgaagctcatcctgctatccctcacggtcattctccttcatcttcatcttcttcatttaacatggtcgacttcccaagcatgcctgctgttgaggtcttgtctggtggttcttcatctactacaaaagacgtgccagttcctcttcaggaggatatagaaaagaatgacgtggagataaccatgctcaaggagctcgaggaaatg

SEQ ID NO: 19300 - DNA, 3000 bp, Unknown; identical to SEQ ID NO: 3596
  misc_feature (1)..( 3000): 2750-1469P.txt file - cDNA_ID_1821326; gDNA_ID_1620653; Annot_ID_47772

SEQ ID NO: 19301 - DNA, 3003 bp, Unknown
  misc_feature (1)..( 3003): 2750-1469P.txt file - cDNA_ID_1821326; gDNA_ID_2926186; Annot_ID_140788
tttgtcaatatcttttgctttatcgataagaaacttcaaagcaaacaatcaagttcgacatagaactctgttcaaggaagataattactttactttgatctcggcggtcatatagtgtgttccatgaacggacaaattcttcctcttccccaaaattttccaaaggttatttttggctatttacgggttgtcacaaattaaaaaggaaatgtgcaaatatttattattattctttgacttgagggttaggatactcaatatttacaacaacccctattcaaaacacagataaataaatatgaaagtgaataacatttaattgatggagtagtaggaatcaatcaaggagagagctagggccgctcatatcaacaagtcttcaccttcactccactccaccaacaagatttgatctataagataaatgtgataacgacaacgaagatttgagtaattgtagcacatgcatcccaaaactgattattgttgatgatgaagggtaaagtaggcaactctatcatgcgacgtatcctttttcttttgtttattctttttcctgtccgtaaagttcgccgagaattcgaaaaataagtaatcttatgctatccaaccatatatcatacgtggcacatttcatgctatcctctctactcattgattgaatgaacgtaattttggtgacatggaacttagaaggattccaatgtcaataaaccctatatactctgaagcaaaacataaaaactttgtttacatctccttttgaaaggtgtttaaagatttcttgatgtcatttgaaatagaactttagttccaacagtttcgaaacggtgagaaaggggatgaattattagttctaatccgcgaaagaactttctaactagagaggaatcatccctaggcatccaataaacgtaactagtaattaacggggttgaatcttcttctcatgagtccaacacttttctgccatcttgatttatatacaagaatattgttttcatttaaggtattttgggtttaccagtgcgctttcgggttacattcaaatctttgtcaccacacggacacttctctctctaatagaagaataacctacacatggccgcatattatggtttagttaatagactcgaaaacgggtcagtaggttcagctcattataacacttggccctggtgctataaaagttctatttggacctaaaattagattattatttttttgtttgcgcaaaaatattactatagattttgttcatttgcaccttggacacttgtcaagaacaggatatgctagtaacaacctaaaactaaaacctactaatagttgataaattggacaaaacaattcatcaaaaaatttccttactccacccataaagtttgatttaagaattcttcagtgcaccagcccttaattggtgtagttggaatttatcaaaagcatccttaaaatcgtactccaactacaccaagcatccttaatattgacaaaggatcttcttccatgaatgaaaaccagccctttactatctctaaccacccaagccgcaccagctagattgtttctctttgaccacgaaaaccccacattacacttaagccactgataattggtgtagttggagtacgattttccataaatattatcgtaagactctttgaataggagttcaatttgcgttgcatactaatgtgattaaatgatcaaattggtattattgtcggttgtatactctcgtaagatttgatgcatgtagagccctggtttttgggtcgaaaataaattggctcacactctatcatgctttagttttattacttttttcttatgatttcctcatttctcttctcgtctcgatttgtatagtttcttaacaataaaaatgtatatttcaacaataaaataaaattagttttccttccaaaccaaaaccattagcgattcacacttctctaaatactttttgatgcttttgtaacgtccataccaatataacatggaaaaactaaaatttgactcgaaaaactaacatggttcaatagacacactagtctaatcacaatttgaaagaggatatcagacatgcaaattgaaggatttttttttgtgggggtctggtcaaggagatgagactcaataactcatgttgaattccaaacaacaaataattgttgcatctagaattccaaataagaaataattgagatagttgaatcagaatatgttggtagaatgaacgaacacgtgagtagagtccccaaacgtggcagagaagcggaccacacgaagtcctgtttttattatttgttgccataaagaaatccaaacttgaaactgaaaccgtcgaacgaatcttaaatgaagcgaagaaggaacaccaaatagtagtcttaactctttctctctctctctctctcttactggttgggctctctgtccaaagactccacctttctctgcaaaaatctctgccctcctactctaacatgtctccccttctcctctgtcccttatctctctctattcactcaaacaacaacgaccctttttctatttttacctctcaccataataacttcccttatttaccactttaccaactacttcttcttcttcttcttcttcttctttcgacaagggattttagggtttaggattctccgcattgtacgccactctgttcaatacaccttggtattccccaatctttgacgttttgtattttcagtttgtcgtttccttatcttaaaccttatttaaatcgttcccaagttttttttgttttgtccatagcttatctgggtctctgttttttgagctctgtgattgttaaatttaataacttttctctcatatgtctctgtgttaccacattttcattgtttatcactaattgcttacattcattattaggtaagtgatgatgagtgttgaatcttgaagttttaggagatagagagaaaggtttaggattgttttgatctgttttggaaaatg

SEQ ID NO: 19302 - DNA, 3003 bp, Unknown
  misc_feature (1)..( 3003): 2750-1469P.txt file - cDNA_ID_1821334; gDNA_ID_1620654; Annot_ID_47825
cccgtgattttcccgccaaaaacgtaaacccgagatttttccgccaaaaacataaacccgtggttttcccgccaaaaacgtaaactcgtaattttgacgctaaaaacgtaaactcgtaattttctcgccaaaaaacgtaaactcgtaatttttccaccaaaaacgtaaacccgtgattttcccaccaaaaacgtaaacccgtgattttcccaccaaaaacgtaaacccgtgattttcccaccaaaaacgtaaacccaagattttcccataaaaaacgtaaacccataaaaagtagaatccgtaaatatcctaagtttgatgataatgaattaataatgataattatttattattattttataatagtaattaagtaaattattaattaaatgggttaacccatttaacaactcaacccatcaaattaaatgagttatgagttgacccaacccatttaacaaaatgagttgagttaacacataactcatttaactctaaactcatttgattatgagttgggttgagttgggttacccattttgacacctctaaatatgtgtctctagcctctactatttttaaaaactaaattttatataataaatttttttatcttaataataaccaagttgaacatattttagttctaaaattaactactcggtttaatattaaactttagaccaggacatgccggataacatggtcttagtgttgtcgtacgtcaccattagagtttcaatttgcataatacaaggtggttgacccaataaaagaaatttgattcaatttcgatataaacaggtttgttttggttcagttttacctattactttttattttgtccaatcccaaaactattatttcaaagacaaattggagaagaaacaaaaaaaaactaatggttggacaaaagattattatatatcaatttcaccacaaaaaacttagcattaaaatattcgaaatggacagcgacgaattcaaaccttcgtgttaattgtctccggcgactatgaattctaaaatcttccactttgcctaaaatatcaatacatcacattcatcctagccttatccactctttcttggaaattctggtctggtttcccttcagcaattcaattaacttcatcaaaccgaccggttcaaacaatcatctagaaattctattttattgttagactagatcatgaaattttgaccgagtcagcacacataaaatctggtacttgacgtggtttagttaacccaacaaagttgttttggttaaacggatttattgacaaacgtgtttcggttcactcactaaaaaacccggttaggtagatactacttcattgacaacaaacgaagcatcctttaatttcaaaaccgcgttttaatcagacttttccttttttattttcagttctaatgtttaaaactttccttttctttttctccatatttgactcgtcaatataaatacaattgtaacaaacagattttgatcaaaagattttacttttctcaattcctttcaactttcaaaatcgaagatctcttaagccatgaacgatcttctctccggctcgtttaaaacctccgtcgcggacggttcatcgccgccgcactcacacaacatcgagatgtcaaaagcgaaagtctccggcggaagttgccacggtggtaacaacctagacacgttcttcctcgacgtggaggttgtaaacgaagaccttaaagagctagatcgtctctgtcacaacctccgatcgagcaacgaacagagcaagacgcttcataacgctaacgcggtgaaggagctgaagaagaagatggacgctgacgtcactgctgcgcttaagacggcgaggcgcttgaaaggaaacctcgaggctttagatcgggctaatgaagtcaaccgaagtttaccggaaagtggaccgggttcgtcgtcggaccggcaaagaacttcggtggttaacgggttgaggaagaagctgaaggatgagatggaaaaatttagtcgagtgagagaaacgatcacgaatgagtacaaagagacggttgggagaatgtgcttcaccgtcaccggcgaatatcccgacgaagctaccctcgagcgtctcatctccacaggtaataattttttccaattctttcttaacaatttttttggtcaatttcaaaattcaaattctaaacgttaaagagcaagaaaatagcgcaagttgttaaacctttttaagaaattgttagtttataatttggttaaatcatgatattgatataaattggaattatattgtaggtgaaagtgaaacatttttgcagaaagcgattcaagaacaaggtcgtggtaggattttggacactattaacgagatacaggagaggcacgacgcagtgaaagatattgagaagagtttgaatgagttgcaccaagtgtttcttgatatggctgtgttggttgagcatcagggtgcacagcttgatgacattgaaggcaacgtcaaacgagctaactcgcttgttcggtctggtgcggaccggcttgttaaggcacggttttatcagaagaacacacggaagtggacttgctttgccattttgctattgctcattattgtggttttaattgtggtgtttactgttaagccttgggagagtaatggtgggggaggtggaggtgcacctcgtcaagctactccggttcaagctcagccaccgccacctccggctgtgaatcggcggctactacgctaaataattttttttttgaggttccctctgtctatgcatgagcatatctatgttttgaagattgttttttattttacagtattttgtctttaatgtttttgtaatgttttggttggttaaactctgtgtatatataatgcgatcaccacatttctttgttttattatggaacgatttgcttattttttacaatcgacttaagttaatttgaccgtctatgatattattattcggagagatctatcaaaatcgatg

SEQ ID NO: 19303 - DNA, 3000 bp, Unknown; identical to SEQ ID NO: 3638
  misc_feature (1)..( 3000): 2750-1469P.txt file - cDNA_ID_1821346; gDNA_ID_1620654; Annot_ID_47821

SEQ ID NO: 19304 - DNA, 3000 bp, Unknown; identical to SEQ ID NO: 3638
  misc_feature (1)..( 3000): 2750-1469P.txt file - cDNA_ID_1821346; gDNA_ID_1620654; Annot_ID_163595

SEQ ID NO: 19305 - DNA, 3003 bp, Unknown
  misc_feature (1)..( 3003): 2750-1469P.txt file - cDNA_ID_1821355; gDNA_ID_1620654; Annot_ID_47815
gatgggttgatttcacattctgttcttctcgtaaacgcaagtgctttagaatcatctggggtctgacccttgttaaagcattcacattttgacgactgttctggtcatacactttctcgaaaggactggtttatgcaaatggatgttcttttgttagggcaaacaaagtttgctaatttttattaaaggagaaaagggttttagattgggtgagcctgaagtaaccatctatattcctttgctctcatcattcaaacacttttgcgttcaaatgatttttggtctccctttggatctcttttgggtctaagctaataaacaaagcccctttcctttctttttttctgtctcaaacgtagacagcgaggacgaaacagtttatgagtttgtgtttattctcataactttcttatttggtcccactagtcgtctgtaactaaggcattggtatgtattctgatatgaaaacgagtttaatacctagcattcatgataattaacttataaattcaagataattcggtgtccttttatacaccatatatacatacatatataatcatgtttcttttgaatcataactttggactgatctcacaaaattcatttgctttttcctcaataatgattgtaggatcatttctctttgttttatggtacattatttgtatgtttttccccattttgagttaatacataaatgcatgggtaaatgatactttagcttcttttgtagaagcattgggagagtgagtgagtgaaatagtacctgttgcagagaatagtggctttcaggtgaaggcttacataaaaacaagtaaaaagctgaaaaaagatgattggggaatgaaaggaagatttcttgtttcttgtgagaggatattgtaatttttattctctattcttcaaattcaccataagaaaagataacttctttacaaattttatttgtcttttaggacatacatatctctatagtgggaatctatagcttaatatgattctcttatcaaagtgtataaatcttattgaagattcctaggcaagttgaatggtggtgtatttttctcttctttctatgcagtggcatgcttcatgtgagagagagagatatgttttcatcaaagtagaagtataataggtaaagctccttgtaccaattactgcaatgatctcatgtttgaataatccatacgcggaatcatttctttttgttcattgattataatagcatattccttaatcactattcagattatggttttgtgtgtttttgtcaatggattcttcaaagatttaagtggcatctgcatctgtttagctttgtgtgtgtatatatatctactatctagtgttatcaggttaatatatataaacatggcttgatatgtttgttagtggtacgagaatcaaacttttcttatctcttacttatgttgcaattataaaataatccatatgcagttctgcttctatgataaaattaatacacagttctgtttcttgttcttgaattacttatttgcttttgttttggtttgtggtttcctgtcacttatctgaaactctgatttcattaggcacttgaaaatgattggtcgtgttgatagcaaatacaatcaaagactgtccccaccaagaaactgactgccttgttcgctttcttttattttttttcttgttcaaaacacattcgtttcttcttcttcttctctcgttttaaaattgaaattaatatatggtccaaaagctacacacttttatgaaagtatcaaagggaaagtgaatgatgcatatatatagtgtctgtgttgggtcagatggtttgatttgctttttagtgttttgatattttagggggttgagtttctaaataccatgcagaaattcaaaaacatacaaagaccaagctagtgatccttatatattctgtgtttcctgccccaaagagtttggttggcaaaaatgattatgaaactaattttaaggtcttattatcaatatcattactagttgtctgaggaaaactagtcgtcaacatttttgatttttgatgatcgatggaacctaattttgtatagagaatgggtcatacatttaatcataatcaaatacatgttaacacttatattaaactgttttcttgatcaaaaccaacaatattcttaggtttgctgagacatagtttggctataaatatacaccctttttccttccaaaatctgttcactcccatgtttttatggctactagattgttgcttacatgtggacttgagtttaagcttacttgactggatctagagtaaaagtctgttgtctgaaaaaagtgttgggagttggctagtagtatagcttcaaggtgctacaaagggagagtgattaaatccccaattttccataaaatgttcttggggctattatttatttatatattatataagtgaatgatgatttgcatctttaattaggttcttttctaaataagtgatacactttgcagaaaagagagagacccacttagctgcagtacccattacatcttaatttttgtgaaatttgagaaagaaaagaatatatgggcaaagctgagttacctttgccttttgatactgctttgtcatcacatgcattccactttgcactacaaaatccactttggaccctcaaaaaaccccccaaattttttgcctctctcacaagaaaagcatacacattttcctccttctccttcctcatatatttgaagaccaaagtccatttttctttctctctctctttctctctcgctctctctatatccttactcttttcttaggtttaagacttagccccaccttccatatagacgccgtgttattagacccttcttctttgggtgtttttgttgtccaagataaatggaatgaagccaagattcttgaagcttttaccatagagctctcacttctgagtattagtactatccccaccttgtgttattttagggtgttttgtcactatg

SEQ ID NO: 19306 - DNA, 3003 bp, Unknown
  misc_feature (1)..( 3003): 2750-1469P.txt file - cDNA_ID_1821387; gDNA_ID_1620655; Annot_ID_47848
tgtattatttctctgtccaaatatgctttgttcttgagcaaatggactgacttttagtgtggagtaaagttcggtttatattctaagacaaaacagaaaaaccaattcgaatcttattagatttggaaaatttcatactattcaaaagaatcgcaatcacaatggacaagttccaaaatacaatgtggcagaacaaggatcatccataagaatcttgttctcatcgattactttagtaaatccaaacgaacttacttttcttcccttgcctttgttgttcatttggatagtattgatacattccgcacaaaactgcaacatgagatttttacaattaactctgaaactccaaaaataaaactcacaaaacttctgttctttcacgtctcggagtgatcacatcacacgtctctttccaacttttcgtaaacgataattttgtaccattgcaaagtaaataaatcacatccatgattttcaaatcatactggtcgccttctgtttttactttttaccgaactatttgcagaaactatataacgtacgcagcattataaactaatctaattagttatcaaataaatactgatatttaacatgcgaagttttatgttttgcctcatcgttctcgtgttggctcttaaaaaaccatgttatgtagatcggagataaaagtagtgaacgatttacgtgaaagagatattcgttaaaagttagtgtttcatgatatccaattatgcatggccaacaagatactaggcttagctagataactatagtacgataaaatagagaagtactatttccaatcattagcctggccactgaccacttcaaacattaatgattctcgtgaaactataataatatttaaacccaatcgtctcaagagtaatctcgactatacctgcgccaatagttctcggttcttgaagctgccgtgcctaacatgattagcgaactatttccaatcattagcctggcctctggccagcttcaaacatcaatgattcgtgtgaaactataacaatatttaaacccagtggtctcaagagtaatctcgactagtccatgcgccaatagttctcgtcttgaagctgccgtgcctaacatgaatagcgtgaacttgacgtctcatgtgtcaatcttttttttttgtttctctttattagtaataataaaatgaaataaagttaataacatgcagagaataagtgccagaagttattattgcgatccaaccaaaggttaaataatcagtacttatttagtattaaaatataagtagagatagtgcttgagcatctaatcatataagaaaagccaattactctggagaatcatcggatcacttcactctttgccttttctacacaaagagacagctcttgtgttcttgaaagcttaaagctctgttttccccaaagctatatgtgatgggtattacaaatagcaagcatacttttcatttccatacatctaaattgagaatataccaattattgtccttttgggtggtcattggagtttattcattaagattttgcagttttttttttccaaacctttgatcattttttaaatgatactattatattattttctcaatcaaattattttaagataaatatcaacttatcgtttaatagtaatgtgtatataatgtaataattgattttaatgttgaaaaatagtatttctaggtttccaaactaaattaaaatgaaagtacaaatgtttgataattttacggtgtattttctgtaggattttggtgttatatccacataatctatctataattaataaaatatatacaagtaaaccgttgaaagtttggaagcttaatccatattttgaccatgttttgtagtactaggctagccgtctttattaaaaaaagtaccgcgtaactacatctagttcaaatttggtaatctctaatatgaggttctaaattagcaaaatcatattttaaagaatttataacatttagccatatttgtcttaggttccaaataatacatagttccaaaggcaaataaactgtcttttatggtttagaaagatttctgccttgagagtaaacttcttaaaataaggttaattccaagagatttgattccagtttatttctaggaataacacaaagaaataatcatttttggtaaacaagataatcagaactcaaacggaaagaaatatgtcagtctgtcaaatccattaagaaaattgatattcacttctactctatttagaaggcacgtcaataattcagaaaaataaaccaagtgcatgcgataatgcaaaagaacacataaatccaaaatatcacaaggttacaaagtcaacttctaaaacttcatattttcttcacacgcttctctttacatttatacacaaagtacgaattaccttttgaaataagttgctaggtacttaatatttataagaaaaacaaaacaaaaaactttgggttgaaatgggaatgttcgttgaataaataagaaaaaaatcgagaaagcaaaagtaggaatggttgatgataagtcactccattcacaaacaatttgagctgtcaataatgtgattttccaaaatctcttttggtaccacaatgttttaaatcattggacatcggaatcaatttattgtattatagtatcgtagtatacaaaagaagttggcttcttctgtttttttttggctctgcagttttcaaatccattgttttaaaataaaacataattcgacttcataattataatcaaagtgttaatctttgaattttaataatctaatattagtggtaccatattgacaagaaggagacaatgtcacagaaacttacctcaggagtcaaaacagaagaattgaaaagaaaaaagaagaaataaaaattggatttttatatttgtttcgaccactatcaactctttctctctcttacaaggagcgaaagagaaacactttccgacttgggtaaggaaaaagagtttgatg

SEQ ID NO: 19307 - DNA, 3000 bp, Unknown
  misc_feature (1)..( 3000): 2750-1469P.txt file - cDNA_ID_1821387; gDNA_ID_2926209; Annot_ID_141872
attatttctctgtccaaatatgctttgttcttgagcaaatggactgacttttagtgtggagtaaagttcggtttatattctaagacaaaacagaaaaaccaattcgaatcttattagatttggaaaatttcatactattcaaaagaatcgcaatcacaatggacaagttccaaaatacaatgtggcagaacaaggatcatccataagaatcttgttctcatcgattactttagtaaatccaaacgaacttacttttcttcccttgcctttgttgttcatttggatagtattgatacattccgcacaaaactgcaacatgagatttttacaattaactctgaaactccaaaaataaaactcacaaaacttctgttctttcacgtctcggagtgatcacatcacacgtctctttccaacttttcgtaaacgataattttgtaccattgcaaagtaaataaatcacatccatgattttcaaatcatactggtcgccttctgtttttactttttaccgaactatttgcagaaactatataacgtacgcagcattataaactaatctaattagttatcaaataaatactgatatttaacatgcgaagttttatgttttgcctcatcgttctcgtgttggctcttaaaaaaccatgttatgtagatcggagataaaagtagtgaacgatttacgtgaaagagatattcgttaaaagttagtgtttcatgatatccaattatgcatggccaacaagatactaggcttagctagataactatagtacgataaaatagagaagtactatttccaatcattagcctggccactgaccacttcaaacattaatgattctcgtgaaactataataatatttaaacccaatcgtctcaagagtaatctcgactatacctgcgccaatagttctcggttcttgaagctgccgtgcctaacatgattagcgaactatttccaatcattagcctggcctctggccagcttcaaacatcaatgattcgtgtgaaactataacaatatttaaacccagtggtctcaagagtaatctcgactagtccatgcgccaatagttctcgtcttgaagctgccgtgcctaacatgaatagcgtgaacttgacgtctcatgtgtcaatcttttttttttgtttctctttattagtaataataaaatgaaataaagttaataacatgcagagaataagtgccagaagttattattgcgatccaaccaaaggttaaataatcagtacttatttagtattaaaatataagtagagatagtgcttgagcatctaatcatataagaaaagccaattactctggagaatcatcggatcacttcactctttgccttttctacacaaagagacagctcttgtgttcttgaaagcttaaagctctgttttccccaaagctatatgtgatgggtattacaaatagcaagcatacttttcatttccatacatctaaattgagaatataccaattattgtccttttgggtggtcattggagtttattcattaagattttgcagttttttttttccaaacctttgatcattttttaaatgatactattatattattttctcaatcaaattattttaagataaatatcaacttatcgtttaatagtaatgtgtatataatgtaataattgattttaatgttgaaaaatagtatttctaggtttccaaactaaattaaaatgaaagtacaaatgtttgataattttacggtgtattttctgtaggattttggtgttatatccacataatctatctataattaataaaatatatacaagtaaaccgttgaaagtttggaagcttaatccatattttgaccatgttttgtagtactaggctagccgtctttattaaaaaaagtaccgcgtaactacatctagttcaaatttggtaatctctaatatgaggttctaaattagcaaaatcatattttaaagaatttataacatttagccatatttgtcttaggttccaaataatacatagttccaaaggcaaataaactgtcttttatggtttagaaagatttctgccttgagagtaaacttcttaaaataaggttaattccaagagatttgattccagtttatttctaggaataacacaaagaaataatcatttttggtaaacaagataatcagaactcaaacggaaagaaatatgtcagtctgtcaaatccattaagaaaattgatattcacttctactctatttagaaggcacgtcaataattcagaaaaataaaccaagtgcatgcgataatgcaaaagaacacataaatccaaaatatcacaaggttacaaagtcaacttctaaaacttcatattttcttcacacgcttctctttacatttatacacaaagtacgaattaccttttgaaataagttgctaggtacttaatatttataagaaaaacaaaacaaaaaactttgggttgaaatgggaatgttcgttgaataaataagaaaaaaatcgagaaagcaaaagtaggaatggttgatgataagtcactccattcacaaacaatttgagctgtcaataatgtgattttccaaaatctcttttggtaccacaatgttttaaatcattggacatcggaatcaatttattgtattatagtatcgtagtatacaaaagaagttggcttcttctgtttttttttggctctgcagttttcaaatccattgttttaaaataaaacataattcgacttcataattataatcaaagtgttaatctttgaattttaataatctaatattagtggtaccatattgacaagaaggagacaatgtcacagaaacttacctcaggagtcaaaacagaagaattgaaaagaaaaaagaagaaataaaaattggatttttatatttgtttcgaccactatcaactctttctctctcttacaaggagcgaaagagaaacactttccgacttgggtaaggaaaaagagtttgatg

SEQ ID NO: 19308 - DNA, 3000 bp, Unknown; identical to SEQ ID NO: 3669
  misc_feature (1)..( 3000): 2750-1469P.txt file - cDNA_ID_1821403; gDNA_ID_1620655; Annot_ID_47842

SEQ ID NO: 19309 - DNA, 3003 bp, Unknown
  misc_feature (1)..( 3003): 2750-1469P.txt file - cDNA_ID_1821403; gDNA_ID_2926209; Annot_ID_141878
caattgatttaatatttgtttaatagattcgagaagattaattgaaaactgtctcggattagggttcgtgcatgttgtaattagttccgcgtgtttacctataatgcatctgaatctttagactaataattttctttaagattcaatctttatttaagcattgtttatgttaaagctagctggtgaaaacaaggttatcttagatataagtaacactaagattctctagcggaataagatctaatctatatacgatagaatggtaagagttttaagaaaataattaaaaatagaatggttggagtcttggagatcgtggtgagtttgagatcaagtcaaacaacgaaatttggcaagaataatactaattaagcttccgtgaaattaaaatgttttcccttttcttagttggcttaaattttacaaaacggctcaatatctgcttatgaatttcatgttttaagagatcaattctgttctctagtatttggttggatatacgtttgaaactttcttttacattttggtacaacacaagttttgttttctttcttgattcaagtgtttttttcttttcttttctgatctgattcaaaattaattaatataccagaaaatcagtgcatttcgaaagcacaaaactaaatatttttctttattaagcatatatatagcagaatatcctacatacgttatacttatcatcaaatcacaacatgtacattgacctattaattagaaggaaacatccaatatacctacagacattatatatatatatagatactaattagagtcctaacctaagatctaaacaacaccctgatgtgtccgaagtagaaagatcctgtattgttggaggaacattcaaatccaaagcaccactgatcatcggctcctcctccttttcccaatgacatctcatgtgacctcctaaagcttgaccactcgagaacactctaaaacagatattacacttatgatgccctgaaaacgtaaggatttttccctgatgatcatgcccactagaagtagaaaccgtcataggatcatcggttacgtttgtgatagcgaaacagcctttaacgtttttatgactcgctctgtgtcctcctaaagcctgatgtgatccaaacactttcttacatcctccacactcgaaccgttcaatactcgatgatgatggtgtaccattagacagcattaagagacaagaagcgacttcatggtcttcctcggacataaatgagacccaatttggtaatatctggtttaactgttttgaagaagccgcggtgggcacacggtagttaggaggaggattaatgccacgccattgacgctcagggtgacatctcatgtgaccaaagagagccttccaagaccaaaactttctgccacattcagtacatggacgtgtgattttgggggcatttgggtctggttttttggtgtattttggttttgacgcggattttggtgaagaactagaggatgaagcaacggttttggtgcgtttcttcttaggactgtgatcgtagcttgaagataaagcaaactggagatttggattagggttgcttgtgttagaaggatgaagtggaatgtgaaaactgcgatcatcataggaatgattgttgttcattgtgagcacgtagaggaagtgatggaagaaaagtgggaaaaaaaagagtagaagttagagaaagggttgcttaagtagaagaagaaggagaggttacgtgggaaagaagttatggaggaacagggagacagttaacttcagttgaggaacagagcggtttactatgtaaggaagagacttatctctttgcagtttgaaaccaccacgttttttatgtatcagttttgctgcttattatttgttggcccaagtttatctttgatgggccttataatactagagttcattatttcttatgggccttataatactagagtccattatttctgataggccttataaatcttgcgtctattattaaattctaagcctatgcaagaatattgaagcaacaaaattccaaagccaacaaaattccaaagccaattggaagatttggaaaaagtaaagattttagtggagtttgagcttccattactcaatttcggtggaggttccacacttccacagaaataaaatcgccactctcccatcccatgattcacactattgaaattggacatttgattacgatttgtttcctagattattatttttgtttctatatccgttagattttctttatcgtgcgttttcttatcttcctgaaacatttaaataataacaagaattgtttttggtataagtaaacttgtctctcttttttggtaagaaggtttaaggttgcctatataggacaacaaaatcagaaaatgccataagcatctgtaatttttattggtttggggtaaaaaaaggttacaaataaaagaatggtccaacaacatacattcatttttggagttatgtcatatgtggaacatgggaagatgttttaaatacctgaaccaaataatattcgaaatatccagactttctcattgtcgcatgaaagaccacaaaatataatactattacttttcaaaaaagaaaatgaaacaataaaataaatttaaaacagtcattggatcaaggtataacggaatccaaatacaagtataatatataattataaaatactgattcaataatcaaaagtataatcatacaactccatgacgcaaacgattaatggtcccaaagatgatttggttaattatctctttttttgggttaatgatttcactagccaataaaagattatagactaccattatagattatagtaaggaataatatgtttctcatcatcatcttctttactttggctgggaaccaaaagggtcacttcgtcacttgcaaacaaaacaaaaagttttcatttttcactggaaacaaaacttacaagttaagaagttcacatttttcaatcgataatg

SEQ ID NO: 19310 - DNA, 3003 bp, Unknown
  misc_feature (1)..( 3003): 2750-1469P.txt file - cDNA_ID_1821407; gDNA_ID_1620655; Annot_ID_47841
gaaggaatctgacttaaaaggagaaactaaatttaggggagacaaaagagaaaagtcgaacaacaaaggaaagctacaatattttatgtttatttatttcagagattgaagtaagaataaaaatagattttttaagagctttggtttggtcggatagattagattcgttggatgagaatgtgatggtgttttattttacggcggcgattgagcgaagaaaggtcttttattagtgctcaccagctactacttctacacctctctgactctgtctctctccgctgtttcctctcaccttctttcttctgcttttgcattattaaatttaaaccagtttctcttttgtttatcgtttaaattgtaattgaaaaaaaaaactaaaattagaatgttggtttgtacaaaatcaaaatgcatttctggttttactagttaccgttaattgtaaaaaaatttaagtattaagcacgatggttttattctcgtcgtatgagaagactaatttaaatacatgtgatctacttgtaaaagaagcaaccgttcattcaatctcctatcagaaagaatagtaatctcttgagattttttcttaagataaagatatgccaaatatttaaacagtattatggcgtcactgactattatgacgtaagagattgacttttccatatattgcaactttctggagccccgcacataatccctaataagttttacttttgggccttgtttattcactgatccagcccaatgttcaaatacaaaattcagacaccccaaaggccgtattattgtattgttttagactttagaccttacaataaggcctaaaatgataacatattacacatttcaattccagataaaaaaaagaaccgaaaattttaattataaacgctatcaaattgacattttcacaagactgaatcaaatttgacacctccacgtacacaagcaaaattatattttgggttttgtatcaatgtgctggctgattttttttagcaaaactgtcctgtaacatctctccaacttggtttgaattcgttttaacattagtttggtgacaaacataacgttattgaatttttcatttttccgtaataatcattctgatttttttcttttcaaaatgttgttactagatgtttctttcccaagaataatatcttaaatcagtaatcactactaccagtaaacataaatggtacgtttctcctcattctacggaatttttaagaagcaatgatgatgattaattgaggatgtggacaagaatctttatatattcgcattcacatgccataactttcaaagtctatgaaaaaagattctattgcgtgtttatattctgtggtgtgtactgtagttccaaacataacgcttgtactacgttcatttccggaaaatatctaagaaatatggagtcataaatatttattaaccaattagatgtttttcctatgttctaaatacatttatggtaatctttgcggtcaaatatacgaactttaacaacgacgtttaacaatatatcttttgttttatacatatcaagttttgatatacggacgatagatatttattttcagaaaaccagtagttgtcgtagtcacatggtttgtttttcgttgatcaaaatttgttaatgttattcatttagaattagagactgtatatcgaatttggtactcggttctaaaaaaaaaaaaaactcaatatgattttttatacattctttttcttcccttttaatctgtaagaagaatagtaaagtgaagaagaaaaaactattcattatattgtaacatacgaatacgactcacaattaactaaagttaaagtgtctcattgtatttggactttggacattattctccattattgcattgtttctttctttcttgattaattatgtaaagttgaaatgatttgaagatgctttccggatgtaaacaaactaaactttactttaccaataactttgttttcagaaaactcagatatttatctctagtttctcgtataagtcccaatgaatctaagatttcaaaaaccaatcctatatttgtttcatatttacaaaaaaacaccaaatatttttccccaattatgccgacattaaactcatctttttacatacaaaatcccaaattaatatccgtttttacctttacttcatgaaagcgaagatggtaaaaagcagaaacatttcgagatattaatttgattgtataggcccgtgaataaactcgtggacccaaatcgaaaagataacaaaatttaaagatgtacttaattctctgaaaaaattctgtacgcaaacacgagaaagagaagagagacatacacacacaatacacatacgtggtttgagaggacaggagcaaaacggcaggtgtcactaatcccataggcttctctctctgttcactgtccttccgcacaaaaaaaaaaagtattcatttttatattctcacggttacttcgaaatctagctttcgttttctttttttttgatttaaaccaaaagggtaaacaatgctttatgattgcttagtgacgccattgaagcagcggctcactgatagtggcttcttctgcctccaattccaagttgctaaccctagttttcatctctctctctgtatatcatattctctcgtactttcttactttctcttctacttggtagagataaaaagtagtcaaattttattcaaagttttgattttgacatctgaggtttcacctctgttttttttttctagaactcctttgggtatgtgtcttttacgtcactaaagggtttgttatagtcttaggtcatgctttttggtgttatctctctctgttttatcttttagctcaccaagtgattgtgtctgattttcgaattttcaggtggattttgtttcactcactcatcgtcgttgatcagtgactctgtttttgcgaaattctcttcagatttcttgataaaagatagaagacggaattatg

SEQ ID NO: 19311 - DNA, 3000 bp, Unknown
  misc_feature (1)..( 3000): 2750-1469P.txt file - cDNA_ID_1821407; gDNA_ID_2926209; Annot_ID_141879
ggaatctgacttaaaaggagaaactaaatttaggggagacaaaagagaaaagtcgaacaacaaaggaaagctacaatattttatgtttatttatttcagagattgaagtaagaataaaaatagattttttaagagctttggtttggtcggatagattagattcgttggatgagaatgtgatggtgttttattttacggcggcgattgagcgaagaaaggtcttttattagtgctcaccagctactacttctacacctctctgactctgtctctctccgctgtttcctctcaccttctttcttctgcttttgcattattaaatttaaaccagtttctcttttgtttatcgtttaaattgtaattgaaaaaaaaaactaaaattagaatgttggtttgtacaaaatcaaaatgcatttctggttttactagttaccgttaattgtaaaaaaatttaagtattaagcacgatggttttattctcgtcgtatgagaagactaatttaaatacatgtgatctacttgtaaaagaagcaaccgttcattcaatctcctatcagaaagaatagtaatctcttgagattttttcttaagataaagatatgccaaatatttaaacagtattatggcgtcactgactattatgacgtaagagattgacttttccatatattgcaactttctggagccccgcacataatccctaataagttttacttttgggccttgtttattcactgatccagcccaatgttcaaatacaaaattcagacaccccaaaggccgtattattgtattgttttagactttagaccttacaataaggcctaaaatgataacatattacacatttcaattccagataaaaaaaagaaccgaaaattttaattataaacgctatcaaattgacattttcacaagactgaatcaaatttgacacctccacgtacacaagcaaaattatattttgggttttgtatcaatgtgctggctgattttttttagcaaaactgtcctgtaacatctctccaacttggtttgaattcgttttaacattagtttggtgacaaacataacgttattgaatttttcatttttccgtaataatcattctgatttttttcttttcaaaatgttgttactagatgtttctttcccaagaataatatcttaaatcagtaatcactactaccagtaaacataaatggtacgtttctcctcattctacggaatttttaagaagcaatgatgatgattaattgaggatgtggacaagaatctttatatattcgcattcacatgccataactttcaaagtctatgaaaaaagattctattgcgtgtttatattctgtggtgtgtactgtagttccaaacataacgcttgtactacgttcatttccggaaaatatctaagaaatatggagtcataaatatttattaaccaattagatgtttttcctatgttctaaatacatttatggtaatctttgcggtcaaatatacgaactttaacaacgacgtttaacaatatatcttttgttttatacatatcaagttttgatatacggacgatagatatttattttcagaaaaccagtagttgtcgtagtcacatggtttgtttttcgttgatcaaaatttgttaatgttattcatttagaattagagactgtatatcgaatttggtactcggttctaaaaaaaaaaaaaactcaatatgattttttatacattctttttcttcccttttaatctgtaagaagaatagtaaagtgaagaagaaaaaactattcattatattgtaacatacgaatacgactcacaattaactaaagttaaagtgtctcattgtatttggactttggacattattctccattattgcattgtttctttctttcttgattaattatgtaaagttgaaatgatttgaagatgctttccggatgtaaacaaactaaactttactttaccaataactttgttttcagaaaactcagatatttatctctagtttctcgtataagtcccaatgaatctaagatttcaaaaaccaatcctatatttgtttcatatttacaaaaaaacaccaaatatttttccccaattatgccgacattaaactcatctttttacatacaaaatcccaaattaatatccgtttttacctttacttcatgaaagcgaagatggtaaaaagcagaaacatttcgagatattaatttgattgtataggcccgtgaataaactcgtggacccaaatcgaaaagataacaaaatttaaagatgtacttaattctctgaaaaaattctgtacgcaaacacgagaaagagaagagagacatacacacacaatacacatacgtggtttgagaggacaggagcaaaacggcaggtgtcactaatcccataggcttctctctctgttcactgtccttccgcacaaaaaaaaaaagtattcatttttatattctcacggttacttcgaaatctagctttcgttttctttttttttgatttaaaccaaaagggtaaacaatgctttatgattgcttagtgacgccattgaagcagcggctcactgatagtggcttcttctgcctccaattccaagttgctaaccctagttttcatctctctctctgtatatcatattctctcgtactttcttactttctcttctacttggtagagataaaaagtagtcaaattttattcaaagttttgattttgacatctgaggtttcacctctgttttttttttctagaactcctttgggtatgtgtcttttacgtcactaaagggtttgttatagtcttaggtcatgctttttggtgttatctctctctgttttatcttttagctcaccaagtgattgtgtctgattttcgaattttcaggtggattttgtttcactcactcatcgtcgttgatcagtgactctgtttttgcgaaattctcttcagatttcttgataaaagatagaagacggaattatg

SEQ ID NO: 19312 - DNA, 3000 bp, Unknown; identical to SEQ ID NO: 3658
  misc_feature (1)..( 3000): 2750-1469P.txt file - cDNA_ID_1821411; gDNA_ID_1620655; Annot_ID_47840

SEQ ID NO: 19313 - DNA, 3000 bp, Unknown; identical to SEQ ID NO: 3658
  misc_feature (1)..( 3000): 2750-1469P.txt file - cDNA_ID_1821411; gDNA_ID_1620655; Annot_ID_163626

SEQ ID NO: 19314 - DNA, 3003 bp, Unknown
  misc_feature (1)..( 3003): 2750-1469P.txt file - cDNA_ID_1821411; gDNA_ID_2926209; Annot_ID_141880
tgaaaactagggttagcaacttggaattggaggcagaagaagccactatcagtgagccgctgcttcaatggcgtcactaagcaatcataaagcattgtttacccttttggtttaaatcaaaaaaaaagaaaacgaaagctagatttcgaagtaaccgtgagaatataaaaatgaatactttttttttttgtgcggaaggacagtgaacagagagagaagcctatgggattagtgacacctgccgttttgctcctgtcctctcaaaccacgtatgtgtattgtgtgtgtatgtctctcttctctttctcgtgtttgcgtacagaattttttcagagaattaagtacatctttaaattttgttatcttttcgatttgggtccacgagtttattcacgggcctatacaatcaaattaatatctcgaaatgtttctgctttttaccatcttcgctttcatgaagtaaaggtaaaaacggatattaatttgggattttgtatgtaaaaagatgagtttaatgtcggcataattggggaaaaatatttggtgtttttttgtaaatatgaaacaaatataggattggtttttgaaatcttagattcattgggacttatacgagaaactagagataaatatctgagttttctgaaaacaaagttattggtaaagtaaagtttagtttgtttacatccggaaagcatcttcaaatcatttcaactttacataattaatcaagaaagaaagaaacaatgcaataatggagaataatgtccaaagtccaaatacaatgagacactttaactttagttaattgtgagtcgtattcgtatgttacaatataatgaatagttttttcttcttcactttactattcttcttacagattaaaagggaagaaaaagaatgtataaaaaatcatattgagttttttttttttttagaaccgagtaccaaattcgatatacagtctctaattctaaatgaataacattaacaaattttgatcaacgaaaaacaaaccatgtgactacgacaactactggttttctgaaaataaatatctatcgtccgtatatcaaaacttgatatgtataaaacaaaagatatattgttaaacgtcgttgttaaagttcgtatatttgaccgcaaagattaccataaatgtatttagaacataggaaaaacatctaattggttaataaatatttatgactccatatttcttagatattttccggaaatgaacgtagtacaagcgttatgtttggaactacagtacacaccacagaatataaacacgcaatagaatcttttttcatagactttgaaagttatggcatgtgaatgcgaatatataaagattcttgtccacatcctcaattaatcatcatcattgcttcttaaaaattccgtagaatgaggagaaacgtaccatttatgtttactggtagtagtgattactgatttaagatattattcttgggaaagaaacatctagtaacaacattttgaaaagaaaaaaatcagaatgattattacggaaaaatgaaaaattcaataacgttatgtttgtcaccaaactaatgttaaaacgaattcaaaccaagttggagagatgttacaggacagttttgctaaaaaaaatcagccagcacattgatacaaaacccaaaatataattttgcttgtgtacgtggaggtgtcaaatttgattcagtcttgtgaaaatgtcaatttgatagcgtttataattaaaattttcggttcttttttttatctggaattgaaatgtgtaatatgttatcattttaggccttattgtaaggtctaaagtctaaaacaatacaataatacggcctttggggtgtctgaattttgtatttgaacattgggctggatcagtgaataaacaaggcccaaaagtaaaacttattagggattatgtgcggggctccagaaagttgcaatatatggaaaagtcaatctcttacgtcataatagtcagtgacgccataatactgtttaaatatttggcatatctttatcttaagaaaaaatctcaagagattactattctttctgataggagattgaatgaacggttgcttcttttacaagtagatcacatgtatttaaattagtcttctcatacgacgagaataaaaccatcgtgcttaatacttaaatttttttacaattaacggtaactagtaaaaccagaaatgcattttgattttgtacaaaccaacattctaattttagttttttttttcaattacaatttaaacgataaacaaaagagaaactggtttaaatttaataatgcaaaagcagaagaaagaaggtgagaggaaacagcggagagagacagagtcagagaggtgtagaagtagtagctggtgagcactaataaaagacctttcttcgctcaatcgccgccgtaaaataaaacaccatcacattctcatccaacgaatctaatctatccgaccaaaccaaagctcttaaaaaatctatttttattcttacttcaatctctgaaataaataaacataaaatattgtagctttcctttgttgttcgacttttctcttttgtctcccctaaatttagtttctccttttaagtcagattccttcctaatcccattctttcagtcttctctttcgcccttctgagttcaacaactggtaactagatcctctttttgctttacttcattctctgttttgttattcctttaaaagatccatcgaaacttcttagctctttgtcttttttttggttattttgactctttgatctgatgtgggttttgcgtctttctttacttgtggtattgttaaagttcgttactttgttctcgtttagcttcttgtatttggtctaatttaagtcttttgacttttgacagtgttatctctatgaacagttcctttgatgaagaacacaaagtgaaagttgctgtctttataaccaggatttggtaattcccattgtttcatg

SEQ ID NO: 19315 - DNA, 3003 bp, Unknown; identical to SEQ ID NO: 19314
  misc_feature (1)..( 3003): 2750-1469P.txt file - cDNA_ID_1821411; gDNA_ID_2926209; Annot_ID_202464

SEQ ID NO: 19316 - DNA, 3000 bp, Unknown
  misc_feature (1)..( 3000): 2750-1469P.txt file - cDNA_ID_1821415; gDNA_ID_1620655; Annot_ID_47838
tgcaaaagggaaatgctggtgttggaagaaggacgatgagaaatagtctaaacattagcatgagagacgcgtagaggttgttttccccggtgtttaatatgttagtgcgatcgtgactgcgaaaatgttcttattcatggaatcaacaacctcaatgctcaccacctagaaggcgatgaaagaagaccaaaccggattcatacctgtggatggttcgagttttgtttaacgactgtgtgattaatcgtcaagtagttttggaggttttttctttacctctttgttgtttgttcattatggccattgttgaagttagtgagctttgttcatcatctgccattgttaaactttgttcacttgtatttgaaaaaaacaaaaatgtctttgtatgttgtgtgatttctaagcatttttactttgaaaatctatttcttcttttctagacgatcacgacccttcatccatatcggactacacaactcgatattgaataaatttatatgagaatagtaccaatggcctatgatgtggaagatgatgagctagcaagtctcaatcatgtaaatgaaagtgctttttctaagtaatctgtatttaaactcaaataaaaccaaaactcaaagctgttccaagcaaattattcattggccacaatctgtaatttggaacattatgcaccaaaaccatttttaatgtattttacatatacaggttttttggtacttctcctatacacatggcatattcatattaacaaaaaatatttattttggtgtcacttttcatattttattagtgtaaaataacctcttcttaagagtaacgtatggcaatttggtcagctttgttatttaaaaattatatgttaattagctaaaatacgatcatttgtacccaaattctcttaatttaaaactagtccgacttgaaagtaaaagtttagtttaaactataatcagaacaataaatatcaatacgccaccgacgatttgctgccaccgacaaatgttttgtcggccacacgcgtctcagttttatggaaccgaactctcgttaatactttgcttttttacataccatttttgttgaaaaccccacaaaatgggaaaataattcggtgaaatattttagatttttagttctacttgtatcatgaaattaagagttcttcgacatagattgttgttatcatcaattatcattatgatcattgtgtatatgaaactatacaacgaaattcagaatcataattagatagaagaatctcatgttgtttttcacattaaaaccaaaaaaaaaaaagaatctcatgttggcgcgtaaaagattaaaacgaaaataacggatttttctatataatttgcatggttattaaaatacaaaaatacaactgcacagccacaaactcgtaaccacaaataaaataaataaattgattaataataatctaggcaaattaattatagcaaaatacaacatcaagtttaaaaaaaaaaagacgaattatacattcattatactccattgcacaaaagtaaaaaaagaacagacaaatcacaaaatctcaaccttatatgaatcattttatcgttgacgcttgtatttgcaagaaagaggaagagaatcttctgaagaaggtcccatgaaattacggatctgagatcggagtttgaagaaaacgtgcattatacttcctctgttttgtgaaccaatcgatttagcttcgtctttgttaagctcaagatctctgatgaatataggttttcttgaaaggatccatgaccaaccccattcccaccattctttcacagagcttcctgcttgttctcccatggcggaaacagatttggatctcgggaatctagctgcgatcgctgctggttggtttgagaggttgagtgatagagaagagagacgacggcggatgagaccaggctcatcgtcggcggtggctgctgcattagggcgttgagaaacggggagggaagtgggtttacgaatctggagagtctccatcattgagctcataacttctttgttcttctttgtgttgagagagattgaagaagaagatgaatgtgaatgtgagagattgattagtgaacacagctctaacacaggctggggttttattccactttatttttgtggggtccatttacttttatgcccccagccaattacattcattttgttgttgctgtttgtttttgtattaaataatttgtattgttatgtttatttgttgatttgtatagttagttgttttgtgtatgaatgaatgcacctataatattggaaatataacaattttatttttagtgaatatagataaacattgttttcaggtagggttccatcacaagtcacaatacaaatttaattaaaaaaattctttgtaattttattttaaaggttattttcccagtacagaaatctgttgaaattgcattggctttgatttttttataataaaaatcagaaaaatgtagcagaatctgtccaatgtccatagccaagcaaatttatgttgacagaaaaaagaacaatcacatacaaaaatccaaaaaagaaaaaagatatcccagacgggcctaatcaggtattagactaaggcccaataaatttcaagcccaaaatcgaaattaagcactttattctttctttttttaatagctatcgagtgtgtatgttcggagaagagatcacagagatctgagagcttgaaacaatggagtaccggaaaatcaaagatgaggttcgttacttccatttcactttgtctttctgctgcttttaatttaagatttggactctctttaatgctcaattttgttccgagcttcttcaggacgatcatgacgttgcttctgatatcgagagtgtgaaaggaaaatctcataccggtgagatattcttttctcaaattccacttctcgtgttctttaatgtgctcattggtgctttgatttgacagttgcttcgagtaacattgcaatg

SEQ ID NO: 19317 - DNA, 3003 bp, Unknown
  misc_feature (1)..( 3003): 2750-1469P.txt file - cDNA_ID_1821415; gDNA_ID_2926209; Annot_ID_141882
tgatgcaaaagggaaatgctggtgttggaagaaggacgatgagaaatagtctaaacattagcatgagagacgcgtagaggttgttttccccggtgtttaatatgttagtgcgatcgtgactgcgaaaatgttcttattcatggaatcaacaacctcaatgctcaccacctagaaggcgatgaaagaagaccaaaccggattcatacctgtggatggttcgagttttgtttaacgactgtgtgattaatcgtcaagtagttttggaggttttttctttacctctttgttgtttgttcattatggccattgttgaagttagtgagctttgttcatcatctgccattgttaaactttgttcacttgtatttgaaaaaaacaaaaatgtctttgtatgttgtgtgatttctaagcatttttactttgaaaatctatttcttcttttctagacgatcacgacccttcatccatatcggactacacaactcgatattgaataaatttatatgagaatagtaccaatggcctatgatgtggaagatgatgagctagcaagtctcaatcatgtaaatgaaagtgctttttctaagtaatctgtatttaaactcaaataaaaccaaaactcaaagctgttccaagcaaattattcattggccacaatctgtaatttggaacattatgcaccaaaaccatttttaatgtattttacatatacaggttttttggtacttctcctatacacatggcatattcatattaacaaaaaatatttattttggtgtcacttttcatattttattagtgtaaaataacctcttcttaagagtaacgtatggcaatttggtcagctttgttatttaaaaattatatgttaattagctaaaatacgatcatttgtacccaaattctcttaatttaaaactagtccgacttgaaagtaaaagtttagtttaaactataatcagaacaataaatatcaatacgccaccgacgatttgctgccaccgacaaatgttttgtcggccacacgcgtctcagttttatggaaccgaactctcgttaatactttgcttttttacataccatttttgttgaaaaccccacaaaatgggaaaataattcggtgaaatattttagatttttagttctacttgtatcatgaaattaagagttcttcgacatagattgttgttatcatcaattatcattatgatcattgtgtatatgaaactatacaacgaaattcagaatcataattagatagaagaatctcatgttgtttttcacattaaaaccaaaaaaaaaaaagaatctcatgttggcgcgtaaaagattaaaacgaaaataacggatttttctatataatttgcatggttattaaaatacaaaaatacaactgcacagccacaaactcgtaaccacaaataaaataaataaattgattaataataatctaggcaaattaattatagcaaaatacaacatcaagtttaaaaaaaaaaagacgaattatacattcattatactccattgcacaaaagtaaaaaaagaacagacaaatcacaaaatctcaaccttatatgaatcattttatcgttgacgcttgtatttgcaagaaagaggaagagaatcttctgaagaaggtcccatgaaattacggatctgagatcggagtttgaagaaaacgtgcattatacttcctctgttttgtgaaccaatcgatttagcttcgtctttgttaagctcaagatctctgatgaatataggttttcttgaaaggatccatgaccaaccccattcccaccattctttcacagagcttcctgcttgttctcccatggcggaaacagatttggatctcgggaatctagctgcgatcgctgctggttggtttgagaggttgagtgatagagaagagagacgacggcggatgagaccaggctcatcgtcggcggtggctgctgcattagggcgttgagaaacggggagggaagtgggtttacgaatctggagagtctccatcattgagctcataacttctttgttcttctttgtgttgagagagattgaagaagaagatgaatgtgaatgtgagagattgattagtgaacacagctctaacacaggctggggttttattccactttatttttgtggggtccatttacttttatgcccccagccaattacattcattttgttgttgctgtttgtttttgtattaaataatttgtattgttatgtttatttgttgatttgtatagttagttgttttgtgtatgaatgaatgcacctataatattggaaatataacaattttatttttagtgaatatagataaacattgttttcaggtagggttccatcacaagtcacaatacaaatttaattaaaaaaattctttgtaattttattttaaaggttattttcccagtacagaaatctgttgaaattgcattggctttgatttttttataataaaaatcagaaaaatgtagcagaatctgtccaatgtccatagccaagcaaatttatgttgacagaaaaaagaacaatcacatacaaaaatccaaaaaagaaaaaagatatcccagacgggcctaatcaggtattagactaaggcccaataaatttcaagcccaaaatcgaaattaagcactttattctttctttttttaatagctatcgagtgtgtatgttcggagaagagatcacagagatctgagagcttgaaacaatggagtaccggaaaatcaaagatgaggttcgttacttccatttcactttgtctttctgctgcttttaatttaagatttggactctctttaatgctcaattttgttccgagcttcttcaggacgatcatgacgttgcttctgatatcgagagtgtgaaaggaaaatctcataccggtgagatattcttttctcaaattccacttctcgtgttctttaatgtgctcattggtgctttgatttgacagttgcttcgagtaacattgcaatg

SEQ ID NO: 19318 - DNA, 3003 bp, Unknown
  misc_feature (1)..( 3003): 2750-1469P.txt file - cDNA_ID_1821417; gDNA_ID_1620655; Annot_ID_47835
aaaaaacacggatcatttcaaatgggagtcgaggatctgaaggaagtcgacataaacaagttcttaattatataaaaaagtgggcgtcagcttcaagaaacaaagtatcttcccatgtggttcatggtcggctgctaccatatcttcgggacacagcagtgtctgataaggtatcccacacctgcacaagcatgcgtatacatatacgttggttatctcaaaaacagaatttgttatttcttgtaccatcaaaatccctacttacatttagcccctctgagccaccaacagcgagtaagaaggggcagtccgctgagaatgagaccgagaaaacttctccctgtttgatatatcaaagtttggaatggtaaacaaagaaaccagaaacaaacatatggcagcaaaagttcttattcatggctcttacagcatttggcttgtttgtagcaatccatgatggttggttgtttgaaagatcccaaagtttcacactttcatccgcagatcccgtagccaaaagctgcacagctcggatattaaacgactacactatgaatatggtaggagacaagagagaaagagagatatatgtgtgtacattgggggcatgtatgttgtatgatatggaggagacttcactatcatgagcatggataatgaaacttggtgataaatcagaagcacgtgtatcaaagcccttcacagttccatctttgagactcacctaagatggaagaagaaaagttaacgattcacatcagatatctgaatcattcagatgtttgtgttagaagagcaaagaaagcgtaatgcaccacaaaggagtgttcgctgtgaggatcccaagccaatttttcgactttggcctcggtagaccatttcaaacccgagtttgaagggtcccttccatctttctcaaacatatatatatatatatatatatatatataaaagactgatcaacataatgataaaaaaatttcatgtacaagactcaacacataaatggaacaaaacagtcaccaatactacagtacgatcacgagacccactgaggagtacttctggagtataattgttccatgcaaccgcgtgaacctgttagccaaacaacacacaataaataaaccatgagcatgcacagatgctagcttgaaagagcatggaaacagtttcaccttcataccttcttttcgtgatgctccatagtaaccttgcatttccccgtagccacatcccaaaccttcacttttttgtcttcactaccactagcaactatattcctattttcccagttaaaagttaaaaaaaaaagagtctggtaagcaagttctggagattattttcaatcatgaaaccagcgagcttaaacatatgtaccgaaactccttgttccaagcaagatcaattactggaccagtgtgggaatctgatgtctagagtgagagaaagacaactaacatgttacatttggaaaaacagaggagctaaataattttcaaaagttggttgtcacacctgcccggctatccgtcccagttgtacacaaggtagcacctcattcacctgaagcattatataatcagcttacaaatcattatctcatgatggataaaacaaaaggtaaacatcatcaaaaaaacagttaacaagtacatacaaggtcaagatcccatatctctatagaggactccattgtcccgatagctacaaagttccctgcgaacacgaaagcaaaacttgaggaaaatgatcataatctcatccacagctattcttggatacacacaaaccttttccccctcctttgagaggacaatcaagccatgctgtgcacaatggaagctcggatataatcatgtcattgcgaagataaatgttttcggattcctcatatacataaacctcgagatagttgacttcatgtttaatagcagcacagatgatcagtgaatcggttggcctaattgtcaagtcatcgtgatcctctgagtcatagtcaccctaggggatatcaagatcagtatttactattgagtctccacaattagtaagagaaaaattaatggtgtttcttacgtcagtatcctttaggtatggatccatgtcattgcttggataataaaggtgtccctgcccagagctaaacagttcaatctctgagtccaaacgcaagaatgaaggaaactgtacattagcatatatgcaatgaaaatatgcaaatatgtaggaaaaacagaagaaagttatataccatcatcctcttcatcatagttatccatgtcgagttctttcaagaacttgacaacttcatcagcatctgttgaagaagaagaagcaaccttgcttttcccaaaagattttgctacagacttggcatgagtaacttgagcattctgaatttcatcgtccatcttttcttccatacaaggagattcagcagcaacaggcatagcctttgatgcctcttttgggatccatgaaagtgcaactatcgtcattctgcaaaaatcaaaagagatttttacttaataagcgcagctcggttaggaaagcagagaacgccatgaagcaactatgaatgaatcagcaaactagagatgacttttagggtctgtaaacttggcaactaaagagcttacgatccaaaaaggtttcaactttaagaaagagagactccaattcatctatacaagactattgtatatacaatgcactatacaaatgaactatatactatgatagcttactatcagaaacgaaaaccacacaacaacgtaggactcgtcgaagaggagaatccaagaagcttgctctgcttgggaacgcgcggcacaaggaggcaaggaggataaacgagaaacgcttgaaagcaattaaaataagggtttcctcttaacttgccatttttctgttttaaagaaaaatcacttttttattctacagtgtttcattttcatatctcacacgtacgaacgaagaatggagagcgactccgagatg

SEQ ID NO: 19319 - DNA, 3000 bp, Unknown
  misc_feature (1)..( 3000): 2750-1469P.txt file - cDNA_ID_1821417; gDNA_ID_2926209; Annot_ID_141885
aaacacggatcatttcaaatgggagtcgaggatctgaaggaagtcgacataaacaagttcttaattatataaaaaagtgggcgtcagcttcaagaaacaaagtatcttcccatgtggttcatggtcggctgctaccatatcttcgggacacagcagtgtctgataaggtatcccacacctgcacaagcatgcgtatacatatacgttggttatctcaaaaacagaatttgttatttcttgtaccatcaaaatccctacttacatttagcccctctgagccaccaacagcgagtaagaaggggcagtccgctgagaatgagaccgagaaaacttctccctgtttgatatatcaaagtttggaatggtaaacaaagaaaccagaaacaaacatatggcagcaaaagttcttattcatggctcttacagcatttggcttgtttgtagcaatccatgatggttggttgtttgaaagatcccaaagtttcacactttcatccgcagatcccgtagccaaaagctgcacagctcggatattaaacgactacactatgaatatggtaggagacaagagagaaagagagatatatgtgtgtacattgggggcatgtatgttgtatgatatggaggagacttcactatcatgagcatggataatgaaacttggtgataaatcagaagcacgtgtatcaaagcccttcacagttccatctttgagactcacctaagatggaagaagaaaagttaacgattcacatcagatatctgaatcattcagatgtttgtgttagaagagcaaagaaagcgtaatgcaccacaaaggagtgttcgctgtgaggatcccaagccaatttttcgactttggcctcggtagaccatttcaaacccgagtttgaagggtcccttccatctttctcaaacatatatatatatatatatatatatatataaaagactgatcaacataatgataaaaaaatttcatgtacaagactcaacacataaatggaacaaaacagtcaccaatactacagtacgatcacgagacccactgaggagtacttctggagtataattgttccatgcaaccgcgtgaacctgttagccaaacaacacacaataaataaaccatgagcatgcacagatgctagcttgaaagagcatggaaacagtttcaccttcataccttcttttcgtgatgctccatagtaaccttgcatttccccgtagccacatcccaaaccttcacttttttgtcttcactaccactagcaactatattcctattttcccagttaaaagttaaaaaaaaaagagtctggtaagcaagttctggagattattttcaatcatgaaaccagcgagcttaaacatatgtaccgaaactccttgttccaagcaagatcaattactggaccagtgtgggaatctgatgtctagagtgagagaaagacaactaacatgttacatttggaaaaacagaggagctaaataattttcaaaagttggttgtcacacctgcccggctatccgtcccagttgtacacaaggtagcacctcattcacctgaagcattatataatcagcttacaaatcattatctcatgatggataaaacaaaaggtaaacatcatcaaaaaaacagttaacaagtacatacaaggtcaagatcccatatctctatagaggactccattgtcccgatagctacaaagttccctgcgaacacgaaagcaaaacttgaggaaaatgatcataatctcatccacagctattcttggatacacacaaaccttttccccctcctttgagaggacaatcaagccatgctgtgcacaatggaagctcggatataatcatgtcattgcgaagataaatgttttcggattcctcatatacataaacctcgagatagttgacttcatgtttaatagcagcacagatgatcagtgaatcggttggcctaattgtcaagtcatcgtgatcctctgagtcatagtcaccctaggggatatcaagatcagtatttactattgagtctccacaattagtaagagaaaaattaatggtgtttcttacgtcagtatcctttaggtatggatccatgtcattgcttggataataaaggtgtccctgcccagagctaaacagttcaatctctgagtccaaacgcaagaatgaaggaaactgtacattagcatatatgcaatgaaaatatgcaaatatgtaggaaaaacagaagaaagttatataccatcatcctcttcatcatagttatccatgtcgagttctttcaagaacttgacaacttcatcagcatctgttgaagaagaagaagcaaccttgcttttcccaaaagattttgctacagacttggcatgagtaacttgagcattctgaatttcatcgtccatcttttcttccatacaaggagattcagcagcaacaggcatagcctttgatgcctcttttgggatccatgaaagtgcaactatcgtcattctgcaaaaatcaaaagagatttttacttaataagcgcagctcggttaggaaagcagagaacgccatgaagcaactatgaatgaatcagcaaactagagatgacttttagggtctgtaaacttggcaactaaagagcttacgatccaaaaaggtttcaactttaagaaagagagactccaattcatctatacaagactattgtatatacaatgcactatacaaatgaactatatactatgatagcttactatcagaaacgaaaaccacacaacaacgtaggactcgtcgaagaggagaatccaagaagcttgctctgcttgggaacgcgcggcacaaggaggcaaggaggataaacgagaaacgcttgaaagcaattaaaataagggtttcctcttaacttgccatttttctgttttaaagaaaaatcacttttttattctacagtgtttcattttcatatctcacacgtacgaacgaagaatggagagcgactccgagatg

SEQ ID NO: 19320 - DNA, 3000 bp, Unknown; identical to SEQ ID NO: 3661
  misc_feature (1)..( 3000): 2750-1469P.txt file - cDNA_ID_1821423; gDNA_ID_1620655; Annot_ID_47833

SEQ ID NO: 19321 - DNA, 3003 bp, Unknown
  misc_feature (1)..( 3003): 2750-1469P.txt file - cDNA_ID_1821423; gDNA_ID_2926209; Annot_ID_141887
gtgaatcgttaacttttcttcttccatcttaggtgagtctcaaagatggaactgtgaagggctttgatacacgtgcttctgatttatcaccaagtttcattatccatgctcatgatagtgaagtctcctccatatcatacaacatacatgcccccaatgtacacacatatatctctctttctctcttgtctcctaccatattcatagtgtagtcgtttaatatccgagctgtgcagcttttggctacgggatctgcggatgaaagtgtgaaactttgggatctttcaaacaaccaaccatcatggattgctacaaacaagccaaatgctgtaagagccatgaataagaacttttgctgccatatgtttgtttctggtttctttgtttaccattccaaactttgatatatcaaacagggagaagttttctcggtctcattctcagcggactgccccttcttactcgctgttggtggctcagaggggctaaatgtaagtagggattttgatggtacaagaaataacaaattctgtttttgagataaccaacgtatatgtatacgcatgcttgtgcaggtgtgggataccttatcagacactgctgtgtcccgaagatatggtagcagccgaccatgaaccacatgggaagatactttgtttcttgaagctgacgcccacttttttatataattaagaacttgtttatgtcgacttccttcagatcctcgactcccatttgaaatgatccgtgttttttttatatctaaacgttgttgattgttgcatacaataatctcaaacatattttcattcaaaaaaataaagtttcaaaaatattttcttatttatgtctcagtatctgtctagttttgctaatttctctagttaattctattgttttaataataaaacaaaacaaacccaaagccagtttattattcaatcgggttttgtttggtacattgctaatttcaaggcccgttctgatcaaaggtttggatgttggataaacattttttcagagagagccaaaccaatcgaagcgacaaaccctaattcccaattttctgagcaaaagacaccgtcagcaagagatgatgcgtgcttccgtgtatgccaaggtacgcgaatatgaacagaacctgcagctgaattctctttgtttgatccgctggtttcattgattatatatgattccaaatgcatttcagtattgtgtatccctgatctcgcaatttttcaaccagagtaggggtaagcaagaataatgtgtatttttttttctcttggatatgaatacaaatttcatggaaccctaagatataagaggttcaaatttggattgagagaatcagaacaaagtttaagattaagcgaaaggagtttggagaagacttataaaaggctagtggaaaaggaacaacaactttgtgaccggctaaatcaggtaattaataagcataaccaataacgggcatttttagtttggatatgatcataccaattttatttgatcaaaacaaatttagagatcgaagaaagtaaaacaacgtttgaaagaaaccgagttgagtttggatgagatttctgcaaagcttgaggaaagacatcgacgactctttgataggcttgaggtaactaagaacgagttttttttgtgtctttcttttataaacactaattatattgaccctatgttatgtttggtagaaatcagtacaaaaattggaactaagtgaaacgaatttggaagagtgcttgaaaagctacgactatgccattacaaagttgaggaagtgtggatgaaggaatcgatgaggaagagtagtactgagagaatcatgaatcaaaacctttggaataataattaattagtaaaatgtttctagaagtcttgttacggttttaggttcctttgatcctattaggactaggtcttatttggatgattgatacaaggtaaaacgttacatcttccttccatcaccatttggtttatccaagcaaattcaattgcttcctttgaaaatgtcaatttatgtataaacccactactgcaaaatgaatgcaaccaatcaaatataattatattaatgtatgcatataatatatacttttgtagaaatgacgatatattcctatttcttagacagcatattgcgatgtccttacggtcgagaatattgcaagacaatcaatgtatatcatcaaaatgtcgtcgtgtttggcgtttggacaccagtatagttggattaaacccacaataatctatggcctagaaaccaaaataatcatttgacttgttacacttgtacttatacaagtcggattaattttagtcgtagtgaattgattgataagtcatacccaaattttggaatcatcttttttctctctctttggtcgtctatctatagtttcttaatccctaaatcaacatttcataaactatcttttattttacccatatacgatactaaatgttcgaagaataaccaatgcattaatatgactaatgactacattatcgtgggaattgaagaaaatcatagtcattacttactttactttactactgttacgttcaaaaaaagtcatacaagaaagctagaaaatgtataagtgcaattatgtttctactttctagattactacggttacgttcccatcaaagtcaatttgattaagacgcattactatactttttaataacgtgaccattagtatacatttgtatggtatcaatatttaaaaacatttgattggatcatagttgccatatgggacgtgggagatgagtgggtaataagacagtcacacgcgcctctctataacacatgatctccacgcgctcttcctcttcagcaggaaagcttttaccaattcagcaaatcaagaagctatataaatgccgcacttaacgtattgaaacttacgatcaaatatcaatctctctctctttcgaccaatggactaaatcaaaacttttgattttccggcgatg

SEQ ID NO: 19322 - DNA, 3003 bp, Unknown
  misc_feature (1)..( 3003): 2750-1469P.txt file - cDNA_ID_1821429; gDNA_ID_1620655; Annot_ID_47829
aactcttgattgattcgttaagaggactttgttatatgttgttacagggttcaatgcagctgtggctggatgcttctttgcagttgaatccgttttgtggccttcttcatcaactgattcatcaacttcacttccaaacacaacttctatggttattcttagtgctgttactgcttctgtggtttccgaaatcggtctcggctctgaacctgcgtttaaggttcctgactatgacttccgctctcctggaggtaatatgcattgccattcttatgctttttacgcaagggaaccagaaaccaaacttatgagagctggtcactgattttcagaacttccactctatcttttattgggcgctctgtgtggcttggtctcgttggcattatctcgatgtacatcatccatgacatctgctgttgacagtcttaacaaggatgctgggataccaaaggctgtatttcctgtaatgggtggattaagtgttggtatcatagctttggtataccctgaagtattatactggggttttcagaatgtggatattttgttggagaaacgtccatttgtgaagggtctttcagctgatcttttgcttcagctggtagcggtcaagatagctgcaaccgcatggtgtcgggcttctggacttgtcggtggatactatgctccttctctctttattggcggggcagcaggaatggcctatggaaagtttattggacttgctttggctcagaaccctgatttcaatctctctatcttggaagtggcatctccacaagcttatggtctggtactgttcttatgtggtcaatgtttcaaaattgtcttaatttcagactttcttgattggttacctatcaatactttgaacagaatattttttcgggttaactgagaatggatgctagtttttttgtagcttcattgccaatgatcctgtttgtctcattgtttaacaggttggaatggctgctacacttgcgggggtttgtcaagttcctcttacagcagtactactgctatttgaacttacacaggattatcgtatagtgttacctctactgggagctgtaggcatgtcttcatggattacatctggacaatcaaagagacaagaaactagagaaacaaaagaaactaggaaaagaaagagccaagaagctgtacagtctctgacgtcatctgatgatgaatcatcaacgaataacctttgtgaagttgaaagttctctttgccttgatgattctctcaaccaatctgaggagctgccgaagagtatttttgtttcagaagccatgcgaacaagatttgcgacagttatgatgagcacttctttggaagaggcattaactcgtatgctgatagagaaacaatcctgcgccttgattgttgatcctgacaatatctttctcggtatacttacactttcagacattcaggaattcagcaaagcaagaaaagaaggaaataatagacccaaggtacgaaattgaatagtctgaaataactatttctttgatcattaattgaagcatttctttggcttaggatatttttgttaatgacatctgttcgaggagtggaggaaaatgtaaagtgccatggactgttacacctgatatggatcttctcgctgcccaaacaatcatgaacaagcatgaactttctcatgttgcagtcgtttcaggcagcattgatgctcccagaatacaccctgttggggtcctggatagagaatgtatcactctaacacgcaggtaaacctgcatctatttcccctcggtttaactgtttgtcccaagatcaccttttcatatggattgtttttaatgaacctaactgactaacctagtcttccatatgacaagagtgtgtagagagtctgtgtaactataacttgggctgccaggtttcccacattggatgtagtagaagttaaattagttaaaaaaaattacttgcaactttttgtttgctcatcagaggaaaggagtgagtcgcaaagtccagtttgctagatttttaattttagagctttcatctgtattagagttgataccgaaaatattgacccagcaaataaggttcctcaattcatttgaaacttttcggtgtagatgctgcattggagatgatactggtttttcttaaccttttctcttgcttgacctggcagggctctagcaaccagaatgtacctcctaaattcgctgtatctgtaaatggtcttgctttgtaactcttctgagctgaccagggtgatttcaatttgtttcttctgtgaggctccgggccaatttttgttctttgtattaagagatttggggagaatgagttggctggtgcagcgtggatgttttttgtctactccatctgttggtttaaatggtgaagcccccatttctcacttaaggtgctgagcaatccaaagggaatcgaaacatggagcgtggttctgagaaaatcttcagaaattttcctgaaaccaaagatatgtgctcaggtgattcgttaccatttacacttttttcttacagattgttactgtaccttacttagtattgtctattttgtaaagtgctttctgacttatatcatattgagaaagttttgactacttaaagactaacagtgtcaacaattgtaagggtttccttgtccactattttgtatattgaagaacattgaaatatattggaatgcccttatttctggtgtgtgtgtctctctcggtgagccgcaagggcatgttgacatctaattgtatggatatttttctctaagaaaattcctagagaaaacagtagtcaggccattgtgttggttaaacaaccctcctaaaaccttttaggtaaagaagaagcaaccccgcatgggttgaatgacctacctaacctatacttacctccatcatgatatagctagtaccctctgaacatgcatggatacacatgctatataatcattcgggtgtgattccatttataccggaaaatg

SEQ ID NO: 19323 - DNA, 3000 bp, Unknown
  misc_feature (1)..( 3000): 2750-1469P.txt file - cDNA_ID_1821429; gDNA_ID_2926209; Annot_ID_141891
cttgattgattcgttaagaggactttgttatatgttgttacagggttcaatgcagctgtggctggatgcttctttgcagttgaatccgttttgtggccttcttcatcaactgattcatcaacttcacttccaaacacaacttctatggttattcttagtgctgttactgcttctgtggtttccgaaatcggtctcggctctgaacctgcgtttaaggttcctgactatgacttccgctctcctggaggtaatatgcattgccattcttatgctttttacgcaagggaaccagaaaccaaacttatgagagctggtcactgattttcagaacttccactctatcttttattgggcgctctgtgtggcttggtctcgttggcattatctcgatgtacatcatccatgacatctgctgttgacagtcttaacaaggatgctgggataccaaaggctgtatttcctgtaatgggtggattaagtgttggtatcatagctttggtataccctgaagtattatactggggttttcagaatgtggatattttgttggagaaacgtccatttgtgaagggtctttcagctgatcttttgcttcagctggtagcggtcaagatagctgcaaccgcatggtgtcgggcttctggacttgtcggtggatactatgctccttctctctttattggcggggcagcaggaatggcctatggaaagtttattggacttgctttggctcagaaccctgatttcaatctctctatcttggaagtggcatctccacaagcttatggtctggtactgttcttatgtggtcaatgtttcaaaattgtcttaatttcagactttcttgattggttacctatcaatactttgaacagaatattttttcgggttaactgagaatggatgctagtttttttgtagcttcattgccaatgatcctgtttgtctcattgtttaacaggttggaatggctgctacacttgcgggggtttgtcaagttcctcttacagcagtactactgctatttgaacttacacaggattatcgtatagtgttacctctactgggagctgtaggcatgtcttcatggattacatctggacaatcaaagagacaagaaactagagaaacaaaagaaactaggaaaagaaagagccaagaagctgtacagtctctgacgtcatctgatgatgaatcatcaacgaataacctttgtgaagttgaaagttctctttgccttgatgattctctcaaccaatctgaggagctgccgaagagtatttttgtttcagaagccatgcgaacaagatttgcgacagttatgatgagcacttctttggaagaggcattaactcgtatgctgatagagaaacaatcctgcgccttgattgttgatcctgacaatatctttctcggtatacttacactttcagacattcaggaattcagcaaagcaagaaaagaaggaaataatagacccaaggtacgaaattgaatagtctgaaataactatttctttgatcattaattgaagcatttctttggcttaggatatttttgttaatgacatctgttcgaggagtggaggaaaatgtaaagtgccatggactgttacacctgatatggatcttctcgctgcccaaacaatcatgaacaagcatgaactttctcatgttgcagtcgtttcaggcagcattgatgctcccagaatacaccctgttggggtcctggatagagaatgtatcactctaacacgcaggtaaacctgcatctatttcccctcggtttaactgtttgtcccaagatcaccttttcatatggattgtttttaatgaacctaactgactaacctagtcttccatatgacaagagtgtgtagagagtctgtgtaactataacttgggctgccaggtttcccacattggatgtagtagaagttaaattagttaaaaaaaattacttgcaactttttgtttgctcatcagaggaaaggagtgagtcgcaaagtccagtttgctagatttttaattttagagctttcatctgtattagagttgataccgaaaatattgacccagcaaataaggttcctcaattcatttgaaacttttcggtgtagatgctgcattggagatgatactggtttttcttaaccttttctcttgcttgacctggcagggctctagcaaccagaatgtacctcctaaattcgctgtatctgtaaatggtcttgctttgtaactcttctgagctgaccagggtgatttcaatttgtttcttctgtgaggctccgggccaatttttgttctttgtattaagagatttggggagaatgagttggctggtgcagcgtggatgttttttgtctactccatctgttggtttaaatggtgaagcccccatttctcacttaaggtgctgagcaatccaaagggaatcgaaacatggagcgtggttctgagaaaatcttcagaaattttcctgaaaccaaagatatgtgctcaggtgattcgttaccatttacacttttttcttacagattgttactgtaccttacttagtattgtctattttgtaaagtgctttctgacttatatcatattgagaaagttttgactacttaaagactaacagtgtcaacaattgtaagggtttccttgtccactattttgtatattgaagaacattgaaatatattggaatgcccttatttctggtgtgtgtgtctctctcggtgagccgcaagggcatgttgacatctaattgtatggatatttttctctaagaaaattcctagagaaaacagtagtcaggccattgtgttggttaaacaaccctcctaaaaccttttaggtaaagaagaagcaaccccgcatgggttgaatgacctacctaacctatacttacctccatcatgatatagctagtaccctctgaacatgcatggatacacatgctatataatcattcgggtgtgattccatttataccggaaaaatg

SEQ ID NO: 19324 - DNA, 3000 bp, Unknown; identical to SEQ ID NO: 3697
  misc_feature (1)..( 3000): 2750-1469P.txt file - cDNA_ID_1821437; gDNA_ID_1620656; Annot_ID_47869

SEQ ID NO: 19325 - DNA, 3003 bp, Unknown
  misc_feature (1)..( 3003): 2750-1469P.txt file - cDNA_ID_1821441; gDNA_ID_1620618; Annot_ID_46967
gcaagagttttgtttaacaacgttcattataacttacctccttggtcaatcagtattcttccagactgtagaaatgcagtcttcaatactgcaaaggtaagtgtatatggttgaaactcagaattatggttcctcaaattctctgtgttttttctgattcttgtggatttctcttgtttaatttaaggttggagttcaaacatcccagatggaaatgttgcctacagacacaaagaatttccagtgggagagttatttggaagatctttcttctctagatgacagctccacattcaccactcacggactcttggagcagataaatgtcacgcgtgacacaagcgattatctttggtacatgacgaggtaaaagaaaaacccgtctgctaccttatacaatgtaaactttccctagcttcaaagtgattctcgacacgtgctaacaaacatgtggaattggtatgtagtgttgatatcggtgacagtgaatcattcttgcatggaggagagctaccaactctcattattcaatctacaggccatgccgtgcatatatttgtcaatggacagctttcaggtatgatacttccactagtttggcctgttaatttgttctattagagaatttctgatgcaaacttataatatatgaattgcaggttctgcctttggaacaaggcaaaacaggagatttacttatcagggaaagatcaatctgcattctggaactaacagaattgcgttgctgagtgttgctgttggattaccagttagtagtcttttctctcttccgtgtaaacgatgtttttcgtttttctcttatcctgacccctttcctctttttcgtttttgaagaatgtgggtggacactttgagtcatggaatactggaatcttgggtccggtggcattgcatgggttgagtcaagggaaaatggatttgtcatggcagaaatggacataccaggtgttttatctatcctattttctcgtgatttctctcttttgatcccttttttctgtattaagttgtttaactctgttttcatcaggtgggactgaaaggtgaagctatgaatcttgcatttccaaccaacactccctctattggatggatggatgcgtccttaactgtacaaaagcctcagcctttgacatggcacaaggtttgattgaatccaacacaactcaacaaagctttttttctaattaagaatctgaactaacgagtatattttgttttatttcagacttattttgatgcgcccgaaggaaatgagccgcttgctttggacatggaaggaatgggaaaaggtcagatttgggtgaacggtgagagcatcggaagatactggacagcatttgcgactggtgactgcagtcattgtagctacactggaacatataaaccgaacaaatgccaaaccggctgtggtcaacctacacaaaggtggtaccatgtgccgagagcttggttaaagccgagccaaaatctgttggtcatattcgaggagcttggtggaaacccatcaactgtctctttggtcaaaagatcagtatcaggagtttgtgctgaagtttctgaataccacccgaatatcaagaactggcaaatcgaaagctacggaaagggacagacatttcatagacccaaggttcatttgaaatgtagtccaggtcaagcaattgcatccatcaaatttgcaagctttggaactcctttaggaacctgcgggagttaccaacaaggagagtgtcacgcagctacctcatacgctatcttagagagggtaaaagatataatctttacacagctaaaactggaatcagactcttcttctttttttttctaaccacggtgtgttttgatatatgcagaagtgtgtagggaaagcgagatgcgcagtgacgatatccaacagcaatttcgggaaagacccgtgtccaaatgtgctgaaacggttgactgttgaagcagtttgtgccccagagacatctgtaagcacttggagaccttaaagacaaccattgagccctttgtctacaaaatgtataaccaaacaatacagagagagttgaagaaaagaaattgtaagctgtgtttaaaatatgtgtgtgtgtgtgttagtttgaacagagacatttgtgggttagagtagtttcagatagataagagagaagagtctgtagagttgtgatgagtctcgggcaattccgtggctcattaaaaacgttcaggccaccggtcaccaccgaccattttaaccggttatggagaccgggattggtgggtctgaatgaagtcagtttaaggtttggttttgatttgtctttgtaatcaactaaagagggttcaggtttaggagaaaggagatcctatggtgacccatttctttcaaacctattgtcgtttcactttctaatttagttctattttccctttttctttttatctaacaaaatatttatgtttcataaactattttttcttcgtaaattataaaagctttttctccgaagttaaattggagaaaatctttaatattaaaaaaatcgagagaaataccctagaatagctattttttttttgtcggcagaatagctatttttccaatatatattttacaataaagtaaaaaataactgaattattccccttaaactaaattatgaaacctttatgacttgaaaccaaattttgacttttaagaagcgataaaattatgctatacgaggttaattatgcaacattatcccaaaaagtttgtttcgaaaatacgaccatgataatctcaataaccgtttaatatctataactaggctataagaatcctatttctattcgaatattctttaaaatccaactttatctcttcttttgcaaaaaaaaaaaaaacttcaatttaagttctatataaaacgttgtcacccatacgtttaatcagaaaacagaaagaaacatactcaaaactttttaagcagcgacgatcatagatcaaatatg

SEQ ID NO: 19326 - DNA, 3000 bp, Unknown; identical to SEQ ID NO: 3680
  misc_feature (1)..( 3000): 2750-1469P.txt file - cDNA_ID_1821441; gDNA_ID_1620656; Annot_ID_47868

SEQ ID NO: 19327 - DNA, 3000 bp, Unknown; identical to SEQ ID NO: 3680
  misc_feature (1)..( 3000): 2750-1469P.txt file - cDNA_ID_1821441; gDNA_ID_1620656; Annot_ID_163679

SEQ ID NO: 19328 - DNA, 3003 bp, Unknown; identical to SEQ ID NO: 19325
  misc_feature (1)..( 3003): 2750-1469P.txt file - cDNA_ID_1821441; gDNA_ID_1620618; Annot_ID_162157

SEQ ID NO: 19329 - DNA, 3000 bp, Unknown; identical to SEQ ID NO: 3680
  misc_feature (1)..( 3000): 2750-1469P.txt file - cDNA_ID_1821441; gDNA_ID_2926211; Annot_ID_141976

SEQ ID NO: 19330 - DNA, 3000 bp, Unknown; identical to SEQ ID NO: 3680
  misc_feature (1)..( 3000): 2750-1469P.txt file - cDNA_ID_1821441; gDNA_ID_2926211; Annot_ID_202618

SEQ ID NO: 19331 - DNA, 3000 bp, Unknown; identical to SEQ ID NO: 3694
  misc_feature (1)..( 3000): 2750-1469P.txt file - cDNA_ID_1821457; gDNA_ID_1620656; Annot_ID_47864

SEQ ID NO: 19332 - DNA, 3000 bp, Unknown; identical to SEQ ID NO: 3694
  misc_feature (1)..( 3000): 2750-1469P.txt file - cDNA_ID_1821457; gDNA_ID_2926211; Annot_ID_141972

SEQ ID NO: 19333 - DNA, 3003 bp, Unknown
  misc_feature (1)..( 3003): 2750-1469P.txt file - cDNA_ID_1821461; gDNA_ID_1620656; Annot_ID_47863
agataagagatcctctggcggtgaaagacgggtactttggtcagaaaagctcttaaatttctcacgttcttgttcgtcttcttttctttgtgacgaagacgactctaaagaagtgtcggcgttagagaggtcgagaagatcgtcgacggaaaaatcaccgagaaatgcttctacacactccatttttgtctctagccgtatgaaagcactacaagtattttaaataaaggaggagcgaagcgaatccatatttgaaaaagtttgttcgtgttccaatatattttacacaaatttcattctttctttttcaaaattttaaattctttacgtgtctatcgagtgagagagacagtggagagtggacagcactgattggggtttgtaagcaagagtgggttttaggtttttgtgattttggaagacttgtttggtatttgtctcgttacaaatctcgtaacaaatcatgcattgccatgtcagcatttcacattgaaaaggaaaccaaaaatacgtttccttcgtaagtaaaatgttttttttttttttttttaaatgttatctgaacttatccgtagaattttatttaaagataaccgctctttgtagtcaattcaatttattagagttcttaatgccaaattttaagttcataatattaaaagacagcaaagatttcttcataatttagaactatcatttttgacttaaccatcggcgcagagtttgcaagtctttttaagttcttttactatcaaaataactgaataaagtcattcagaactagtggtattctaacgatctaatggctcaacctaattaatcatgaccgttgaaagtgttgttgggccaaaaatatcgtcggttaatacaactttccctctatataaagctagtttcttgcaaaatatggtttttttttgttaacataaaaaagaaactagtagcacatatatatatatatatatatatatatatttttttttttttttgttgtatcagtatttcgaaggttttacagaaaagaagaaaaaaattaacaataattcatacgtcgagagtaatgattggactatcaggcttctcgggcccactcgaccgtcggtggaaggcccaattttaccaaaacaaacaaaaacgttattagtaagggcctattatttatttcttctttaatttcaaggaaagagtgaccatcatatgttgagcgcgtgaaaatatcgctcatggttatatatttgttttttctttgagataataatttccattagaaaaagtcggtttcaaagttagaaaaaaaacatctaaacattcacgtaaagtttaccaggagcaatggagcataaacatattcaaattacacacatacctaaatagtaaataataataaaatacatagacttgtatttttattataaatataatgaactacattccaaacaattgggtgtttggtctagtggtatgattctcgcttcgggtgcgagaggtcccgagttcgattctcggaacacccctctttaaattctctactgctacatcaatttttttcccctcggattaaattaacgcaagaaagtcgtagactgatgacatacaatatggtggtggctcactaaactgactatatgcctaattagcccgatgggccacatgggctcaatgcaagtcggtaaaaggtggaatgttattgaatgcgatgtatgttggcagaggagtaaccgtacaaattagactattttatacccatgaaatcattatcgttcgataacataagatagtaaactttcatgatctcgttctctatgcatccatctctcatctgtgtagtgtagctttttttttcttttttccccacagtatttatctcgtaaactatactttcatatagtcatatatgtgatatgaacattgacactgtacgtaacttatatgatgattaagtttacatgaaaaccattcaagtttttttaaaagcgtaaatacaaaattacttcatgaaatttacgtttataatttaaaatgaacttcgatttaagttatttgcattcagagaaaatagaaattaattaaatgtagcaacgatgtaagtgatagccataaaaatatcacattctttgtatatcggaaatttggttgagcttttaagtcttgaaccctcggataaaaaaaaatgtacacttgaaaccaatatagcattgctccataaatatcaatatcttagacccaaaaaacgatattgttattccatatcggattttagtcatttcgactattttcccaactatttttcctactgaaagattaattacagatctactattggccccaacatttggttcactagacaacctgtaataatatagttcaagtagtactattcacgtttcaacacactaacttttattgagcttcccaactacatttacaatattaatcgtatcactccacataatatcatctatactctagtttattcgacataaaagcatatttaaaaattgtagatgtgaatttgatagttgacaaaccaaatattttactgtacatatgaatttgatattagttgcccggaagcatttaatgaccggtgccagtaaccagacgtttcggactatgttaggtgagacaatgaatagagacacatcaataaatgtcaccgatacatatacttcatataatctaaagtatttcttgaaaaaatctaacatgtgaactaatgaaaatctatcaattacaacattaaattcaacgatatggacttccatcttcttgataacgatcttcaaaagtaagtaagacagcaaacctatttaatatttttaccttattattccccaactagttccttttccacttttaaccatcaccctataagtggttataactagtaacttgaaatagaaacactctatctctaaaagaggcaaccaaacaaacaaggtctagctttttataaccaaactctgcttctgaacagagttagtcaaagagagagaagccatg

SEQ ID NO: 19334 - DNA, 3003 bp, Unknown; identical to SEQ ID NO: 19333
  misc_feature (1)..( 3003): 2750-1469P.txt file - cDNA_ID_1821461; gDNA_ID_2926211; Annot_ID_141971

SEQ ID NO: 19335 - DNA, 3000 bp, Unknown; identical to SEQ ID NO: 3684
  misc_feature (1)..( 3000): 2750-1469P.txt file - cDNA_ID_1821468; gDNA_ID_1620656; Annot_ID_47860

SEQ ID NO: 19336 - DNA, 3000 bp, Unknown; identical to SEQ ID NO: 3684
  misc_feature (1)..( 3000): 2750-1469P.txt file - cDNA_ID_1821468; gDNA_ID_1620656; Annot_ID_163666

SEQ ID NO: 19337 - DNA, 3000 bp, Unknown; identical to SEQ ID NO: 3684
  misc_feature (1)..( 3000): 2750-1469P.txt file - cDNA_ID_1821468; gDNA_ID_2926211; Annot_ID_141968

SEQ ID NO: 19338 - DNA, 3000 bp, Unknown; identical to SEQ ID NO: 3684
  misc_feature (1)..( 3000): 2750-1469P.txt file - cDNA_ID_1821468; gDNA_ID_2926211; Annot_ID_202608

SEQ ID NO: 19339 - DNA, 3003 bp, Unknown
  misc_feature (1)..( 3003): 2750-1469P.txt file - cDNA_ID_1821472; gDNA_ID_1620656; Annot_ID_47859
atgcaggactctttgaatgttaagtttaatagaagtggcgatgttgagaatccgtggtttttcttcggagcttcttattctggagctttaagtgcttggttccggcttaagttccctcatttgacctgtggaagccttgctagttctgcagttgttcgtgcagtctacgaattccctgaatttgatcaacaggtatttgtttcaagattaaactttaaatgaagacatggtgtgtttcttcatatagagtttagttgctgacagaatcgaaatttttgtgccttattgagtagataggtgagtcggctggaccggaatgtaaagctgcactacaagagactaataagctcttggaactagggcttaaagtgaataacagggctgtgaaagctctcttcaatgccaccgaggtctagctttgttgtttttctttctattcgttggatatttaaaaaattatggaagtcaaaagtctgtctctaatatgtatatgtttctgaaatctgcagcttgacgttgatgctgatttcttatacttgatagcagatgcagaagttatggcggtaagcttgttcatttcgtactcttatgattttcattttctttctagttttagatgtttatcttcaaaaattttggcagatccaatacggaaacccagataaactatgtgtaccactcgtggaagctcagaagaatcgtgatgatttagtggtaagttcttttctttttagatccctctttgcttatgcttggtgtatatatgatcaatgattgatcatatatgctagaagaactcgttttgcaaactaaatatttgtatttgctgatacattagatgtggtgtattaatgcaggaagcatatgctaaatatgttagagagttttgtgtgggggttttcgggctaagctctaaaacatatagccggaaacatctgctagacactgcggtcaccccagaaagtgcagataggctttggtggttccaagtttgcactgaagtggcatatttccaagtggcacctgcaaacgatagcatccggtctcatcaaatcaatacagagtacacacagtcccaagcttttatccataacttttttcatggtttatatttattgtcctgcttacgtttcttttaatttgataggtatcatttggatctatgcaagagtctgtttgggaaaggtgtttaccctgaagtcgatgcaacaaacctgtattatggaagtgacagaattgctggtatgtaataacggaaaacatctcgatgctactcatatattttcgcacattccaacagtttcttcttattcgtaatttgcagcgaccaagattatcttcacaaatgggtcacaggatccatggcgtcatgcatccaaacagacctcatctcctgaacgtaagtctccatttagtatgatcaaatccttataacattatctcaggcttagtctatgtcgtacagtagcactcagacaaatactttctatgcgacactaacaagttaatacttgacgacacagtgccttcttacattgtgacttgccacaactgtggccatggaagtgatctccgtggatgccctcaatctcccatggtcattggaggtatattactggcctcttctctctttccgatccctgaagtcaaagacagactagtattggaacaactgttaaaaaaatattatttttccctgcttttttcattctcatattcaggtgattccaagaattgcagttcacctgatgcagtgaacaaagtgaggcaacatatagtagatcatatggacttgtggctctctgagtgtcgtggagggattaggagttccatgtaaagagtcacacgaagtcagaaactgcggttatgcaaataaataaaacatcagatgtatgtttcaaacctgtatctgtgtaactgtaacctctgatgtatgtttcgaacttgtctctacggacctaatacagtagtttacacgatgagacgatagaattaccgtcaagccatgaattgagaaagctgtctaaaattattttagtaacatatcagtctctttcgtaattactgtctaaatatattataaattgttacctatcacaaatccgttgtagtctagctggtcaggatactcggctctcacccgagagacccgggttcgagtcccggcaacggagatttttttatttctcgggattgactttgtttgtgaaacgagtcaacagagtgaaggacagatgtctcctgctattggaccggaaggaaaatataacggatgactcatatagtcacggattcatctttctcgggatttcgaaatttgacggtgatctgatttccaacgattttttctcttccatggctttttttcgctgatcggtaaatcaaacgtttgtttcggtttcgatggtggaagctacgtcgaatttgacgccgactcagagatatgcggccggcgcattgtttgcgatcgctttgaaccaagcgcaaatcaaccagactcagccgctgggaaccccggcggcggaagacgacgacggaggcgatgaagagcgaagaagcaattgcagtagcggagattctgtctccgatgaccccagcctttgggtacacgagacgtctggccttcttcgccccgttttcaggtgctttcccaaaatctcttgtcgatctcatcgattttgaaattcctttcgagtcttggttgtctatgaccgttgaaatcatctggttgattagtagttcgctttagctctgtttgtaattcgtttctatccacagatgtcttgagattgattcaccggcttggcttggtctcgagcaaacagcttgctcttctccggctaagcaccacatcggggcggtatggctatttccggagttcaaattttgctgttatggatccgatactcactgttgagttattgttcattaacttctattttgtttttattgtagttcacgaggttactctcagaagaagcgaatgatgcttctgccgagatg

SEQ ID NO: 19340 - DNA, 3003 bp, Unknown; identical to SEQ ID NO: 19339
  misc_feature (1)..( 3003): 2750-1469P.txt file - cDNA_ID_1821472; gDNA_ID_2926211; Annot_ID_141967

SEQ ID NO: 19341 - DNA, 3000 bp, Unknown; identical to SEQ ID NO: 3677
  misc_feature (1)..( 3000): 2750-1469P.txt file - cDNA_ID_1821490; gDNA_ID_1620656; Annot_ID_47854

SEQ ID NO: 19342 - DNA, 3000 bp, Unknown; identical to SEQ ID NO: 3677
  misc_feature (1)..( 3000): 2750-1469P.txt file - cDNA_ID_1821490; gDNA_ID_1620656; Annot_ID_163660

SEQ ID NO: 19343 - DNA, 3000 bp, Unknown; identical to SEQ ID NO: 3677
  misc_feature (1)..( 3000): 2750-1469P.txt file - cDNA_ID_1821490; gDNA_ID_2926210; Annot_ID_141962

SEQ ID NO: 19344 - DNA, 3000 bp, Unknown; identical to SEQ ID NO: 3677
  misc_feature (1)..( 3000): 2750-1469P.txt file - cDNA_ID_1821490; gDNA_ID_2926210; Annot_ID_202579

SEQ ID NO: 19345 - DNA, 3003 bp, Unknown
  misc_feature (1)..( 3003): 2750-1469P.txt file - cDNA_ID_1821494; gDNA_ID_1620656; Annot_ID_47853
cactgagagaacagctgcagagcctcattctcattaaagctctgaacctcatacacatgattgatctgacaaaggcggaacacttgtttatctctggacgttatgatgattaggcttcccgggccgaaccaatgaaacccttcgagaaaagactcggcaaccaaaggattgtgcacatcatcaagaacaacaagagttctcttcttgcttaatttgtccctggggaggctaggtctcgtaatgctactgcatacacgaggcaattccttcaaaattttcccaaaatgttcctccagcaaacggtgaagccccttcccactaaaagccttgtcaaagtgtttgatgaaacaagaagcttcatagccaccagagatttggtcaaaaaatgctttagcaagtgtagttttgcctatgccgggcataccccaaattcctatgcgacggacaccccatggttgcttgcaaagcaaatgttccatctccagcagcctcgagttgattccgatttgttccgtgggaaagagtttctcatgcacatctttgacaatctcttccacaagttcgctctcactgcattcctccctgtttgcattgatttaaaaatcacagagtgaattgttgcggaaaacactaatgaatattgaagaacaaaaaatgttttggataaactgcctcacattttgtcaatctatcataataacattattagttccatataaaacctttgatttgtataatatttctttgtggtgttagatttgtataatatttctttgtggtgttagatttgataggtggaaaacattttgaagtagagacttttaatcttctcaaagtgcaaacgacatattaatcaatccacagttacctattgtggtggcctggtaattctctcagttcttggagtgcgctactccattctcttatccggtccactgacttgtgctcctgcaccaccacatctgatgaactaatgccataatacacaggaaccaccagctggccggttttcctccgacactgaaagaccctcacgagcatgtccaggcatgaggtggaggagacgcagctctttgagaaaaccagcacggaagcgctaactctctcaatcacatccagagtctcactgtaatttacaaatgcagaaattcctttccggcgaaaatccatggagaggtggctggcgaaggagtattgtagtgtatcttcgcagtatatgtagacagtgggaagtaatccattaggtggcggaaaatccacgttgtatatatattggatcccttgttcctctaaaagtctttgatcttgtgttgtgatgataatccgacttccaggaccaaaccaccgagcttcgtttgccaaggcatctaattgtcctatgctgtccacatcatcaagaacaagtaccactttcttgtctttcaacatttcatgtgcagcttccaattgaagaatctcaccagtaaacttgtgatttaatagttgagacagtaaatggctttgtaactgcagtttcctgtcgtcctcattgtagcaagttcttggatagcatcctttgatatcaataatgatagtactcaattcgaattgaggaaggagttgttggtataaacgtttagcgatggtggttttaccactcccaggaagaccacatatacctatcaatctgactttatttgagtccagacctagcagctctttcatcttttccatatgagcttccatcccaactaagccttgggaagcacttgattgagtggaattattcattatactagaaatatcattagctatttttttgaccatagccttttcatcatccctaaacatatagtaaataaatagtcatgaataacttaaaaacaaaaaattgtttgatgcattaagaagaggcaagtggtaatgaaaaactgaccagtcgcgtgaacggtaaccatcgattgtggccacttgctccaaagctttaatccatctatcaatgtcctctttgttttttctctcacattcttctctgtgcttgttcatagccgtatcatcaatctttatggacctaaacatagtcatcaaacacatattaaaaaactgtgaattactttcatgtgttaagaaagattaagaagactaacaagcggctggtaagtttatagactctaggcaattccgccaaagctctagtgcatttccaaatgtcttcatctgttttaccctttcgtgtttttctgaaattatccccaaaatctccagtctgcttcaatacatcaattggatccaaattatagaaaatagtcaccactctttgacccaactcttctttgcacttcattatctccaccaactcgtcgagacaccacggagagagagcgtagttccttgagagcacgacaatcacgattctcgagacactaatcgcgtttctgagctcaggtccgatcgacacgcacctctcggtttcattatcgattagtggctcgaaaccctttcttcttaactctttcctaatcctactgagaaaggatttgggtacatctacagagctgaagctcgagaacacattgtgttcccaattgcgagacgaagccgttatcttcttcttcttctgcggattggatctgatgaatttttcataaatcagaaatgaaaccgtacccaaaatcgtgattgcagccgcacagatcctaaggagggaagcagaggaataatccatttagagtacgattgcaaaagagaaaaaagaccttcgtctgcacaaagaagaagaccaccattattgactccattagcaccattggttacaaataaaatatatgtatttttcgtattgggaatttaatatatttttttattaggtaacggtcacgagaagtcattaaactatcaatccaagtcgctgtttgctttagtgttttagtcaatggtcttcttctctcttccacacttgcctcttgaaaaaccagagtcctagttccatgctttcgatttcaacgcgagacatcatcgatcatg

SEQ ID NO: 19346 - DNA, 3003 bp, Unknown; identical to SEQ ID NO: 19345
  misc_feature (1)..( 3003): 2750-1469P.txt file - cDNA_ID_1821494; gDNA_ID_1620656; Annot_ID_163659

SEQ ID NO: 19347 - DNA, 3003 bp, Unknown; identical to SEQ ID NO: 19345
  misc_feature (1)..( 3003): 2750-1469P.txt file - cDNA_ID_1821494; gDNA_ID_2926210; Annot_ID_141961

SEQ ID NO: 19348 - DNA, 3003 bp, Unknown; identical to SEQ ID NO: 19345
  misc_feature (1)..( 3003): 2750-1469P.txt file - cDNA_ID_1821494; gDNA_ID_2926210; Annot_ID_202578

SEQ ID NO: 19349 - DNA, 3003 bp, Unknown
  misc_feature (1)..( 3003): 2750-1469P.txt file - cDNA_ID_1821502; gDNA_ID_1971813; Annot_ID_58172
ttttttgtgtcaggccaaccaaaagatatagatctatggaatctaatagatacataatacatgtaccggattcggctcagaaaaccaacagttgaagtatgtataattcatctacaatgtgtttgagtcttgtcgtgtacgtttatgtttggatttgatcaaaaccagtatcgcttaacccaaatcgaaccgcattataattatagtaaacacatcaatctcattattttgatggcaaataaataaactgaaactgaaatcatcgtaacaacttaataaatgaaaatccatcaataagatcttttgctagaattaaaacaatattgagattaataaaagattgatttaaataagatcttgtctttcaaacgttagaaacaacaggtgactctctcgttaagatttttctctcgaagatagccttaaaacgcatcttcttcgtttgaccgtctctaagagtcttaccagacgagaacatggactattcttcaaaaagaatagataacgcatgcaaattaaaagagttggggacgactttttcttcgttagagaaaccttattgtatgactataaatacaccttctctccaaaagaaatcaaaaatcattttctaagacaaatacaaattgacatagaccaaaatatttggcttatgaacgatttatgcattgtaaaactcattatttaattaaaatcaaaatgtatcaccgcctggtttggttaattgctttgattgttctattgttcgttggatcatcaaacatagaacaagtaagtttctagttattgataaactttattcatttctcaaaccaaattaaagttatttattttattaatatattcattgtatatattcatgaaaatttcatttcaaaaagggtgcatgcatgttaactgtgaaaatgaattttatttttttctcattcatgaattcacatcttttctgcacggacgatcattagaaagcatccgtatgactctcaacatggtaattttaaatattcaaaaatattgatggttttcaatgtttactaattgtatgtgaagaaaaggaagaaagggtttgggataaaattgtgatcaaagaaatcaagattgatgttggtggaagtaattcaagacgtgcaggtcaaggaaatgcatcagatccaggcaccaagatctagcgacagtttaccaatgattattattactaactcggacaatttagaagagttccgtagattcaaattcattccattttttaaactaaaagatatatgtctataagttttgtcaattaaacctcctcctatccaatgtcatcacatacatttcctttcaggacgaagaagtgtgtatatacacacacttacaattcaatctttttataaagatcgagagattaacaacgaaagaacaacaaaaaattcttacaattatcctaaacaatagtatataacgtcgacgaccaccgccgtttccggtcatttacatacacgttacattaatttgaaccataacaaaataagtcaaactctcacaaagaaaaagctaagttcgggtccattattcccttcaggactcaacatataaaaagtctctgaatctttagacccaataactctctcaaaataagctctcatatacgccatttcgccgtcgggtccttccgactccgagtttcccggcaaaactccggcgcccatagacaccggacgtaacaactccatcacgttaagatcttcttcggtcgcttctcgtttcacaccgtaacccgttttctctcctttacaatacattgtccataacggttcttccaaaatatctgtcttcttctcggttttagaattgttattatcagctcgaggctgtttctcagtctcgagagctattctcaccattcccgtgcttagctctttttgaagcgttgtggtttgcatggcgagctccacgactaaagaaggtaaacatttagggttttcttgaatggaaagacttactcggcctttacggtatccgaataacgttccggtgattcttgacgtgttgtgatgtggatccggtaagcctaaaccgggatgtataaccgggattttgcatgctacggatggtgttgtaaagattgggaaagatcgaaacacggtgcgtaagactctgaaaacgtttgttctgtttttcttcttttttgaagatggtggctggaggagaggatgttgacgtggcggagtggttgtggacgtcggagagggtgttggagacgaaggaggaattgaggaggaggaggaagaagaacttgtagccattggatttgatgattctcccattagacgacgatcgtacggcgaagaaagaaggagaagatctttcttcgacgaccgacgacgactaaaagaaccaacgtccttgtagaaatgtagtcttttttctttttctttagctctctattcctcctccttattgaattgataattttctcctagtaccaatccttatccttgaatttgatttttttgtttttcttttctaaatttcgtttttgttaatttcttttttaagagaagttaattagggatttcaatggtggttaaaaccgaagctatatttgcaagcaacaaatcgcatttttatgttagtttttctaagcttggtcatattttataaatgtgtagtggttgctattgtttgcataatcacttgttatgaaacttttatccggttaagtatatataatgaagccaacagtacaacaggatccgtggcgcaatggtagcgcgtctgactccagatcagaaggttgcgtgttcgattcacgtcgggttcaaataccccgaaaattagatccttaacttttttattcctgtatttatagaaacggcccaattgttttgctgtatttacaaaacggcccaacttgtttgctgcttcactgaatgtaccctcaaaacttttttggttgcaactgtaaaaaccttatccgccattaaaggattaggaaaagaaaaaaacttttcgtcaatg

SEQ ID NO: 19350 - DNA, 3003 bp, Unknown; identical to SEQ ID NO: 19349
  misc_feature (1)..( 3003): 2750-1469P.txt file - cDNA_ID_1821502; gDNA_ID_2926218; Annot_ID_142332

SEQ ID NO: 19351 - DNA, 3003 bp, Unknown; identical to SEQ ID NO: 19349
  misc_feature (1)..( 3003): 2750-1469P.txt file - cDNA_ID_1821502; gDNA_ID_2926218; Annot_ID_203150

SEQ ID NO: 19352 - DNA, 3000 bp, Unknown; identical to SEQ ID NO: 8501
  misc_feature (1)..( 3000): 2750-1469P.txt file - cDNA_ID_1821517; gDNA_ID_1971813; Annot_ID_58166

SEQ ID NO: 19353 - DNA, 3000 bp, Unknown; identical to SEQ ID NO: 8501
  misc_feature (1)..( 3000): 2750-1469P.txt file - cDNA_ID_1821517; gDNA_ID_2926218; Annot_ID_142326

SEQ ID NO: 19354 - DNA, 3003 bp, Unknown
  misc_feature (1)..( 3003): 2750-1469P.txt file - cDNA_ID_1821525; gDNA_ID_1971813; Annot_ID_58164
gttggcaaacgtgaattcgtcaggtctttctcttgataactgtaattccagaaacaggttgagagcttcttcgttctctgattgttgaacataacctgcaaacatagaattccagataacaagatctttcactttcatttcatcaaacacaagcctggaatccttgaggcagtagcaatttgagtaaacatcaatcaaagcgcttccagcaaatatatctaagtttaacccatatttgaacatcaatccatggatttgtttactcagtcccaagcttgttaaagaagcagatgcacgtagaaggctaacaaaagtcaataggctaggtcgaatcaatctgaacctcatgtcacgaaagatgttcaatgcttcatgtagttcccattgtgtcccaagtctcgagtaaccttcaatcattgcattgaataaaaccacatcagcagcagcgaaaatatcaaaaacttttctggcatcggtcaaacagtcacatttcgcatacatgtcaatcaagctgttagtcacatagctatcattgccaagattggctttgatagtgtaagcatgaacttgtgttccaaatcccaaagcatgaagtgaggcacaagatgtgagtatgctagagcaagcatacatatccggctttaaaccaaactttgacatactggtaaacaattccatggcttctttatgaagagcgttctgcttataaccagagagcaaagtggtccacgaaatgatgtttttattcggcattccattgaatagcttatgagccgctataactctgccacacttcacataagaatctataagcacattcatcagtgaggcatccatctcaagtccatatcttaagatgtgcgcatgaatctgcttcccaccttcaagaaacggaagtattgaacatgcacttagaaccgtcgaaaggatgtagccatctggaacaacattgtcttccattagttggtagaacagctgtaatgaaacgtagcttcttcccatttttacacacccactgatcatggtcgtccaagtcacagtagatttctctggtaaagcatcaaacacaagcctcgcataatcgatattaccatccttcaaataaaaatcaatcaacaaggtaccaacataaacatccctatcaaacccactcttgacaagaaaactttgtagttgaaacaccatccaacgcccacgaccatctaagcctgagcaagcttgaataaaactcgacaaaatatattcattcggactgtcttttctagttctccagaactctaagaaaaccaccaaagattcctcataaatcccatgatggttgcaagctgaaaccatggtagaccaagaaactaagtttctctcaggcattttctcgaacaccttacgtgcataaaccataccaccagctctcgaatacaaattgatcaaaatgttgctaagatacgtatctaactcgaggccccaaacaataatctgaccatgaactacattttgataatgcaacagatcatctgacgcacgcagctgcaagagacgagcaaattcgcgccttcctcggattcctatcgtagaaggaaaatctgcgtttacaaattccaaaagacttgaagcagaagaagatgaagaggagtataaacgtatggtttcttggactttacgccaacagcgatagcttctcatcctcctgagtgagaagaacagagcgtgctgtgacgaataaacatgctgccgttttttgtcataagcgaagaaagggtgatggaactaataaataaaacggcaaccagttatactaccaaacatcaaaacgacaggtggctgatgatattggatgatttaagttttttggttaggtttggtcgaaaaacaagaacggtagattttgatggcccggcatgttacattgcgtgggccatcctttagcaacatatgttgaattttaattccacgtttcacctaccaatattcctatttggacgacattaaatattcctattttatacatcattctgctaataaatcttgaaatttgtaaaatatttacattcatttatggttagtaaatactccctccgttccactaagatgaattttttagaaatttcacattctttaagaaatattgtataaaaataattttaacctcttaatatactttaaaaataataataaatatttatctaattatttagtaaggataaaacgggaaaacagttttaaaatttgcattggaaatataaaacttctatttttgtaagacaaatatttttcctagaaaatttctctttatgggacagagggagtaattatgttttatatatatctagattttatgattaagtttaataagaagacagattttagaaatttcatccttagtttacagagaaattctatccattcaaatctgtaaacattggaaagaatacgaatcaagatcatttgagatactcacaatatgaacagttgtcacatatcataaggaagatttcttaattttaaaacacgttacactttttccactaacattttatttggacttttaattgtcttattatcttcaattaaatacttaattattgacttggcataaatttagtaattaacagatagttttggaaattttcaccaacccctacgttataaattcgttttattcagattataattctaaaactaattttggccaataagaaaagcgtaagttaagagagagagagaaagagtctctgcctctcaagctccgccgtcggggaaaaaaggtgaaacctttatacattctccgatttcatttgtctttgcattgattgtttatgcagaatttggatttgtttattccttaaaactctttcttttactattattactcacgaagtttcttcaaaagtgtcatctgcaattagtttaattctcagaaaggaaatggttccattgatgatatttggcgttgaagatgagtaatagattttgctgaattcatgtactgtgcatttgcagaatatg

SEQ ID NO: 19355 - DNA, 3003 bp, Unknown; identical to SEQ ID NO: 19354
  misc_feature (1)..( 3003): 2750-1469P.txt file - cDNA_ID_1821525; gDNA_ID_1971813; Annot_ID_175838

SEQ ID NO: 19356 - DNA, 3003 bp, Unknown; identical to SEQ ID NO: 19354
  misc_feature (1)..( 3003): 2750-1469P.txt file - cDNA_ID_1821525; gDNA_ID_2926218; Annot_ID_142324

SEQ ID NO: 19357 - DNA, 3003 bp, Unknown; identical to SEQ ID NO: 19354
  misc_feature (1)..( 3003): 2750-1469P.txt file - cDNA_ID_1821525; gDNA_ID_2926218; Annot_ID_203142

SEQ ID NO: 19358 - DNA, 3000 bp, Unknown
  misc_feature (1)..( 3000): 2750-1469P.txt file - cDNA_ID_1821545; gDNA_ID_1971813; Annot_ID_58156
ttaacattacagaaaaatgtaatatttgcatagttcgatgtgtcgatcgtcgtatcttacgtacttcattactctcatgtctaacgtatacgtatatatgattagttaaatagtttgacaagaaaattaggaaaacaatataatttattgcacatcaaaggcatttgttgttagggttaattatctgatttggttggtctcccagagaagaacaaacaaacaaaccctaatatcgatcgactagtcaaaactcaaaagctctttcgattttattcactgtgagtgtgagtgagctatccaagcatgaggcctctctacctacttttgaggctaatgggctattatacaggccctttttggcccaattacaaaaatgtcattttccgggaatattataaggccctcgctaaaggggtttaagacgcaagatgtgttcaatcggagtaactgctctctgttctccggctaaatttcatcatcgccgggaacaatcactgatttttactccgacccatttgcgtaatccaaatgggttccaatttcggtggagaaagtcccgacctttcgctcccagactcgcccaacccgacaatttcgctccgccgctccctctcatacgctcttcgacgtctcttctttcttccaaggatttcgttcagatgctggcgagaaaagccgccattttacttgttgggtcgtttgtctttctagggttctgctcttcgaaacctgctttagcgctacccactgcaactgtagtctcccaggcagagttagaggacgagaaaatgttcgagaagcttctggaaaatgagccagagaacatggaggctatgaaggctgttgtgtataagaagatgaggagagggaaaaatgaagatgctgtgaaatatgttgagaagctgatgaaattagagcctcatgaagttgagtggaagcttttagaagcgctttgctatgaaacaatgggggaattgagcaaagccaagagattgtataaggatattctcaaagaacaacctcttttgatcagagctttgcacgtatgtgtttctcaccttttggtgcttctttaggattagagtctttttatgaaactgtgaataagtggatgtttaggagaaatggtgtaggtaatagaatggtatcttgatttcaatattgcagtattcaattttaggtcttgtcttgtttcttgcagggtcttgctatggtaatgcataagactcatgacacctctgtctttgatatgctcattgaagctatggaagttgctcgacaaggaaaccgagtaaccgaggagagaaacatacaagtcttgattggtcaaatgcatattgtggaggtaaaactcatccttagtttccttcttgtgtgttttggtccttctgagctatctttaagtatatgcataggaataatggattgtagtatatacttatggccattggtttaaaacctcagggtcaatttgaagaaggtctaaagatatttcaacagatggtgaatgataatcctcgagattttcgaccttacctttgccaggtagagtttaattatgaaaagaatgatctttgattccctatagtcatatgtctcagttatcaagtaaaaggagtttagctttgtctttggctattccgcttgaaagaaattgctagtatttgtttcagggcatagtgtatagcttaatggataaaaaagaggaagcagcacaacagtttgagatctattggagtcttgtacctggagaattcccacaaaagggatttctcgacgatgttgccttggctgctcaagcaaaatcccgagaacggcttcaaaacacattcaaagctaaatttactcaggggagataattgaaagcttcatcagcagttcaaagttttcttcttgaggtttgcagtgcccactcatgtaatcacattttggtcatgttacagttacatgacatatgtttataaagaatatcaggtatgaaatgttaacatgtgtcggggttaaagaaaaaaaacgctttcgagcaggcagagtttgtggctgcatgtagaaccgagaagaagatggtgcttttttgttgttttgttttgtttttgcagtcatgctagtgatttctctcaggtgcataataatcagacgtgaaagattacgacttccttgtcattcgtagagatattatacaactgttttttctgctgtctatcggtcatacgattgttgatacatctcttccaccaacagtagcaattttttttgtcagaaaaaaaacctatcataatcattcttgaaaagaagcaggtaatttgacgatctcttcaagttagatattgacttatttcaatgattctgaatttctgatgctatttaattattctgatcacgtgtaatgtaaagtatattgtcttattactaaaagtatttaatagataattatcttccaaattaaaatatctaaattcttaccacgttttttatgcaaactaccaactaacattgacaactgtatgtatacacgagactccacaagtaaaaaatttaaataaaatttgtgacttcattaacaagaacaaatttcccatttttatacaaaacctttgtcttttaggttaactaacgtatagtacattacaagaaactgatacgggcttttaataggctagtgtgtcggtataggcccattagtaaacagaagaagcttttaatcaatcctcttgcggagaaactttgggaagagccgaagagaagtcgaggtctctctatctctctctttcgtacacttcgcgcttctcttcctgtaatctctaattccacactcactacatttatgtacttttttctgtatctatacgctttgtgtatgatgttttgtatattgttgcttctcttgctttacttgtttggtttgggatttcttctctgttttttcttggtgaattttgcgtttcgcttaaaaatgagtgaaattgatttggtgaaattaggtcagaggcgtttctcatg

SEQ ID NO: 19359 - DNA, 3000 bp, Unknown; identical to SEQ ID NO: 19358
  misc_feature (1)..( 3000): 2750-1469P.txt file - cDNA_ID_1821545; gDNA_ID_2926218; Annot_ID_142316

SEQ ID NO: 19360 - DNA, 3003 bp, Unknown
  misc_feature (1)..( 3003): 2750-1469P.txt file - cDNA_ID_1821549; gDNA_ID_1971813; Annot_ID_58155
ggagaggatatctcttatcgaggtataacatttcctaatcattacttgtcgtaagggtatcatggttctgtatgatgctaactttatttaacttcttcgttgcttgaccctgtgacaaaaaagaggctttatcctagcagccacttttgggaaacatatcttgctcgtcgaaaggaactccttaaagctgcactaccttttgactccagtgaaattagcttgcaccttggggggtcgtctttgtttcagcatctcaagattgagtgtggtgaggttgatggtgttgttctaggttcttggactaaaatcaatgagagtgcatctgagcatgcacctgatgaaaccgatgcagttgctggctactgggctgcagcagctgtgtggtcaaatgcttgggatcagagaacatttgatcatgtaagaagttttctatagtcattctttctcgttaccctctaaatgcctgaatatttatctaattgcaccatcccattatactaatacatccgtaccttggggacgttcgaattgatttcaacgtactctgcatgtattggaattggaccagttggattatctcttgatctgtatagcttaacagtgtttgtagtcttacactggttagaggattttgttcagttgttttcttgttttataaagaacgagacaaatacatacgataaggcatctgtgcttatttctcgagtagctaccctctgcttatcttttcctcttaatgaaagtgtagatgaaatgtagatctgtatttaatgattgtgctcttaactagattctatttaatgatggtccttaatcttgggttgcattttatatctttttacttgaattagcacattgtagagcattagagggctgctactgccatctgttagtcctataaacacccttaatttggaagtcgacattattagatttcagtggtgagagtaacagtgatacatttgattgaaggttaaagactatacatatcaacattttttttgttttgttttgtattattccatgaacttactcaggcgaaggttgttttgttcgtttcagataacgtctgcatttgttggtttttgagtaatgtttcttgttgaatattttgtgcagatagtcttggatcagcccttagtcatgggtgttcatgttccatgggattctcagctggagtattatatgtgtcacaatgactgggatgaagttcttaagctgttggatctcattcctgaggatgttttatatgatggaagtttgcaaattgctttggatggtccgaaacagtcttctggcgtaaattattcagtttcttcccgtagcgagtatatatgctccatcgaagaagtggatgctgtacttatggatgttccttatatcaagatatttagattgcctggagatatccggtgctccttgtggctaacaacactcatggagcaggaactagcaagaaaacttatatttttaaaagaatattgggaaaacgctctagatgtagtatatcttctggcccgggcaggtgtcatccttggtaattgtgaagtttcatttaaggaggaaacttgtacgccatcgttagatctttgtttgtccataaagaagggaggagcaaatgttgataccctgaatgctgtacacaagctattcatacattactgcacacagtataatctgccaaaccttctggatctgtaccttgatcatcacgaattggtcctagataatgattcactcagttcattgcaggaagctgtggtaagtgctttccacgtccgtaatatatttgtgtccataagtctgttctttgtacgcctatggtttgtcttttgaagacttaatttttactgagaatgccaagaatctgtccatgtattcagggtgattctcactgggcaaaatggttgctactctccaggatcaagggccgggagtatgatgcttcattttcaaacgcacgctcaattatgtcacgtaacggggcaccaaatagtgaacccagtgttccagagattgatgaaatggtttgtactgttgatgacattgccgatggggcaggagaaatggcagctttagcaactatgatgtgtgctccagtgccaattcaaaaatccttgagtactggcagtgtgaacaggcacactaactcttctgcgcagtgcactttggagaatttgagatcatttcttcagagattccctaccttatggagtaagcttgttagtgcttgtcttggggaagatatatccgggaaccttttgcggaccaagactaagaatggttaagcctggtccaccacactttttcttttattctgtgtatagtgaggacatactcgctctgactctatggtttatcagtcttgtcagagtatttgaattggcgtgacggtgtattcttctcaacggcacgtgatacctcactcctccagatgttgccttgttggtttcctaaggcggttcgtagattagttcagctttatattcaggtatctatttctgttttatctgttgtatgtgctcttctgagttgtacaacactccttcaactttctggaattgaggatctagttgaactcaatacttgcactgtaatcggcgatataacaagtttaagaatttctatgaaataatttgatggttgtgaagaggcagacataggcaaaccatttggggaatgactactaagatttagggagaaaggaaaaacacatcaaatttgttctacatcaatctttaccattttacaaaagaaatttgaggcactataccaaaagtggtagaatggaactgtaactctggtctactcaattattagtgttttttttaggtgctggcttctgtttcgtctatacaattagtaggtattctcctcatgcatcttcttccagattttccgagaatgcatagcttgcttgttgttggttctctttgacttggagaccttgaattaaccctctgatatggcctccttgtgttggttcatcatagcagaaaaatg

SEQ ID NO: 19361 - DNA, 3003 bp, Unknown; identical to SEQ ID NO: 19360
  misc_feature (1)..( 3003): 2750-1469P.txt file - cDNA_ID_1821549; gDNA_ID_2926218; Annot_ID_142315

SEQ ID NO: 19362 - DNA, 3003 bp, Unknown
  misc_feature (1)..( 3003): 2750-1469P.txt file - cDNA_ID_1821572; gDNA_ID_1971813; Annot_ID_58149
gtcattttcaaaaatcgtatccatagtcatggtttttgttttcatacgatctatatcattacatttacaacgatgatctctatcaaaaatgtaattttttttctttcccgtcgttaacttactattataaagtttgacaacattttagatcccaaaaattagctttatgtaatggtattgaaaaaatatcatcgtataaagtctgtcgaaaaaagcggttttgtatctggtttaatggtgttggtagatttgacaatgaattcggcattgatggatttgacgtttgaagtcgtatgaaatatgtcactgaaatagcgatgcacttggttgaagaatttggctttaatggatttggcgatgaatttggtgttggtggatttgccgtttgaagtcgtctgaagtatgaacaatgaacactttctttttcccaaatgattatcagatttttttattaaatttcaatttaaggttctttgtcgttacacttaaattgatgatttctatcaaaaatgcaaattcttttttaatttcaattttgttctgttttttgtttttatacgattaattcaataggggaatcaaatacacttggttgcaaaacatttcaagttttcaaagaacaatcatagtatttttttgcccaccaatcatagttatatatatatatatctcaaatttagttggaacataagtaagtaataagtaagtagataagcaagtagataactacaaaacctcaaaagcgtctgatcaatgataatcattttgacaatatttggtggaatcaattagcacttctaaacttttgatccaactattttcgttagtttcatcatctagtgatcatacggaatccaccactataatttttttctttcttataactgaaaaattaatgtgtcaaaactgtaaaattagatacaaaacatgtatcctggaacagtggtactatacgagtcagtagatgtgcaccacttaactagtatcatgaatctaagataatatcggctgatatctaagtgaaaacttaccctaaaaagagaaacagttcacatgaaaagcatcgaataacgacaataagaaatagatacttaacagagctagaaaacacaatacttatatataatttaaaataaaaagaattatatatacgtaaaaacagtataaagaaagaaagacacaagaaaagtagtctgttttggatctttaaccaaacggaacctctgtctgtgtccccgcattgtccttttgtcgattataaaaatcggtcacgccttttcacttccatactcctcattttccatctctatactctaccactttttctagattctctttttcttttcaaaaacaaacaatttaatttccgataaaatagtaaaacatatttttactgatctatattgttcagaatgcattttttgcgatctatccgatatatttaatttgtagaaaaaataattagtgaaaacgtcgaattggtgagtaggaacaagtggcttcttgacaactaacttagtggtatcgaggattgcgaccaggagacaataaacaggggtaaaacaaactttgaaagacgaatagagtttgtgctcgttgtatgattttagacaaccggttgcatactattttggtggctatgtgatatgacgttgatagtcttataggaatcagacaattcatgtgactttaatttgctctatctaccgagaaagcacgactaaaatgaaaaaaaaaaaaaatgtagtatgttgtaagataaaaatatatgtaaataagttggtttttcaacaaaaacgcatacattaaccaaaaaccatgcatttgtcttctcttttattgcgagaaagaaattgttaatatatgcttagatcttgtttgctattgcataaattgaaacttaacaacaagtcaacaacactgtatctcttaaatatttgcatttcatcgacgaaaggagcaaacctgttgagagtacgggtaagtatgagaacatcaccatgaaagtaaataagtaattaagtaaagttgagaaattcatacaaacaatgaagcaactcaagcaagtcaggtcatacataagttatcaaactcttttaaattcgtagaaatttgttttaagcattaaaaaaaaaaagatattaaaaaatcaaatatcctatatctatagtgtaacaaaagaaacactgtatattaacacaaattagatttaattgttttgcttgaagaagaaagtgagggaaaatgaataaataaaaaaggttttaaaaaaaagagaaaagattcttctccctgtcctcgcttcttaaatggcaagaaaggagactctgatgggaagttcataactgaaaaataaaaataagacagaaaacaaagttaaaaataaaataaaaacggaagagagaaaataaataaataaaatcactcaaaggatttccacagtttttctttccatgttgatttagcccattcgtagacttcctccgcgccgccgttagacgccgcctcggaagtatcagcaaccgccgtggtgttcgtcgccttcaaaggctcgtttctctcctctctctggtatttttttttttatttctgggtttacttgtgaagattcggttatacttcggagatcattgttataattcacttgttctgatttagtcctacttgtcaaatttctggattgtcgaaattggcaattcattgtctcagatcgtatgattattggatctgattttgaattttagagttagagagttcatgttggagttttgggattaaaatcgtttctatattcttctggatctaaagcatttttagatcgtggaattgtgaaacagctaatagttttttttttttttttttgcgttttgatgattttcaattgcgattgcataggtttgatcataagatctacacttgattctactcactttatttgttgtttcctctaatttgaaaaattgaaatctgcagagatctgaatttgagatgtttaaaaaaatg

SEQ ID NO: 19363 - DNA, 3003 bp, Unknown; identical to SEQ ID NO: 19362
  misc_feature (1)..( 3003): 2750-1469P.txt file - cDNA_ID_1821572; gDNA_ID_2926218; Annot_ID_142309

SEQ ID NO: 19364 - DNA, 3003 bp, Unknown
  misc_feature (1)..( 3003): 2750-1469P.txt file - cDNA_ID_1821583; gDNA_ID_1620658; Annot_ID_47912
gagattgaggtataacttaagtttgctcaaaatgttcatggtaagcgatgacaaaaagctttctctatccggcagaataatctgcagatctctagcagacctcgagtttcttggaagtaaaaatctccgtcaagaatgcagcagagaatccaaagcgtgaaactgtaccttctaagaatttggatcttccaaatgcccaaaagtctcattccaatggcttacagcttcttcctgtgttcgcataatccagatatgtttttccgcagcagctttctcttgctcttccagaattctctgcaattgtcaaagcttaaattttcttggacaaaacagacacattcatacacaaacagtagaaactgcaccaatgttatgtgcataaaggacatggtgcagaaggacattgtcccatgttcagaaacaaaatgtatgctaaacataaaagctgcaccaggtaacaccgaattcgaattataattggaaaaagtgtgattcacataactccaaatcatggttatatgagattaagctagtctatgtgatatccaatagatgatgctaaaagacaaaagtaatgaagaatgaatcatttgtaagaacaaagaagctacaaacctcggcttcagaagctctttttgtcttcaaggaaagacaatcaaagaggtcagagaacttcttagtacaatcatcaagttttccaacccggtaatactgctgcatttgataaaatggtgctgcaaaaagagattgtctgagttaaatctatgaaaatcatgtcaaaggaatcaaaaaggtcaatgaagccaagagaacattatagatgaagtgaatgcacataaatcttaaaaattcatttacaaagtgatacaacttgctaaatagtgtctaagaactatgtcattttatacccaaatcgtttcctgtgtcatcgccattgctggttatgttggaccatctagacatcccttcatcaaaacatacattgaggaaatggtttcagagatcctttaattggtgtaaagctaatccatttctaaactctcaccaaggctttttattagtctataacaagctcgttaacaattccaaaaggcaaatgacaaagcaaagattggtatatgactgattgatcaaatctcaatcaagttcaaattttgtgagctcaggatatataattttgcagtttagagatggtgagaggagatggaatagaagatgtagaatcagagaatgcgatcagatgaggagaaacgaagacttacaatagcagaaccagagagcgtcgaagcatttagtgcaggacacgcgccgtcgcacagatgaagagtcttcgttctccgagctcatcgtgtctgcttagtgccggaagaagaaacgggtcaggtgttgttgtattcgggtttagatttagggtttttgccaccaatcatgtttattttttcctttctctctttttttttttttcctttaacaccaaaataaaataaaataaatacatcaactataaaatcaaaataactcaaacaaagaaatatattcaaaggataatttttaacaaaaatataatttaaaagactttaattggtaagattgcataatagcataataacataatgatataagttgcataataaaaattcgtaaaatgaaaacttgcagaatgaaaaatcgtagaataaaattatttttaaaatatgttggttgattttatttggaagagaatattatacgagtttcatttcattttgcatatcaatttatttatttttacgattgtacaatttttatatgttaggacttttgacatctcatatatgtatgtaacatacatataaaatacaaaagtacttgtctactacagaaaatcaaagaataattttttggcagatacatgcgaatacaatttagatttcaagaacaaaactcttactagcaaaggattcttgacaaaatgtgatagctagtcccatggaacaacaatggaggatagaccggtttatatcatcaaaatcttatcataagtcaaacgtgtgagatgatgattcatggacaagtgaaaatgaactctgacacgtaaaagaaccagagtttgtgaaagtttgggaggaatatttcttcaaagggtacttcatctttagtcgtcaaccagattaccacactaaagtgatatattatgtctctatttttaataatgttaatattgtagacaacgaaaaaaaagaagcaaattggcatggctcaaacgttacgttagctccttctttacagcttttttttttcctattttaatatccccaaaaagatttacttactaatacagaaaaacattagttgaccaacaaaataagtacatatttatcccaattgtttggttcgtaaccaaattacaaaaactaatttcacctaacgctataatatcaaccaaaccggaacaaattttctcccttaaccaagtaattaattattcgaattaagtcaaaatttttcattttattttattcaaacctacagttacattttttcctttatttctctctctttctttttctacataacaaaaattataatatcccatctgttttattccatagttttatttttgttttctctttccatttcttgccaaaaccctaatttcaccttcacttaagaaatttctcccccaacttaaaccacccccttagaaaaaataaacaaaaaaaattagatctttcttgtttgcttataatatgtatgttttaggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatg

SEQ ID NO: 19365 - DNA, 3003 bp, Unknown; identical to SEQ ID NO: 19364
  misc_feature (1)..( 3003): 2750-1469P.txt file - cDNA_ID_1821583; gDNA_ID_1620723; Annot_ID_165855

SEQ ID NO: 19366 - DNA, 3003 bp, Unknown; identical to SEQ ID NO: 19364
  misc_feature (1)..( 3003): 2750-1469P.txt file - cDNA_ID_1821583; gDNA_ID_1620658; Annot_ID_163719

SEQ ID NO: 19367 - DNA, 3003 bp, Unknown; identical to SEQ ID NO: 19364
  misc_feature (1)..( 3003): 2750-1469P.txt file - cDNA_ID_1821583; gDNA_ID_2926187; Annot_ID_140838

SEQ ID NO: 19368 - DNA, 3003 bp, Unknown; identical to SEQ ID NO: 19364
  misc_feature (1)..( 3003): 2750-1469P.txt file - cDNA_ID_1821583; gDNA_ID_2926187; Annot_ID_200706

SEQ ID NO: 19369 - DNA, 3003 bp, Unknown
  misc_feature (1)..( 3003): 2750-1469P.txt file - cDNA_ID_1821587; gDNA_ID_1620658; Annot_ID_47911
gcaaatagccaacatctctctctctctctctttcactttttctcatctgtttttttgatagatcaagaaacctgactataatatgagtgataacagaaacctgaagaagagtgcccttccatctccaaatccctatagagggccttttattcataagtcctctctctatttagagccacgagagagattaccactgccaaaacaaatcaaacagcttcacatattttgagatatcatgtcaacggattagtagcttccatgaactggaagcagtgagactagagaagactcgttcaagtgttgtggtccgcagagaaacaccaacgacgtcgtacttcacttattgctccagtctttgagcaaaacgctaaaaccttttggtacaaaaggacttaccaattattatttttcatttcttagatccgactagtaaaagagaggaattcaaagcaaaagttgagaagaaaagaaaacaactcttagaggagaaattgtcaaacaaaattttttagtgagaaagttctcctatatatgtcgacagaggaattgggcaaatacattttagtgagaaagtttctccaatgagtcgacagaggaattgggcaaatacattctaatggctgtgggtattagagtaacttttttctggaaagtttaatattatttccagtcatcgaatcattgatgtaagcaactaagcattagagatgaatagtatacgagttgttctcattttcacgttttcagaacgtgattccgccaggagcggacccatatgggggagttgccactgtcaaatattttgaaactagtgttattttataaaagatttttattgtgcccctattaaatacactatttattgtccccattattttttatttttttacagccaccttttaatacaaaattggcgcaagttttgacttttgtattatattgtattaaaatttaaaaatttattttattatataaagtttcgttgaaaaagttactatgataccgacatatatcaagtcaactgatcagattttgatacgtataaaacaaatagtacaataaattataaatcctaaagtaaaaggattgcaatttttaaaggtatataaaaataaaataatattttataattgctaattctgaaaagaaaaaactacaattattattctttgaaaatatatattgaatagaaattatatatacaaaaaaataaaatcatataatcttattatataacaattgatgtttcaaagttattaaatgatttctatatgtgttgcttaattgatgagattttgatttgtaagaacatttctcccaattatattttgacacatgctattatgctaatataaaaataaaactcacatatctttaacataaaataaaataatataaatatatattaaagtatataacttaaaaggatatatttcaattaaaataatatttataaaaataaaaaaacttacgaaaaagggaaagtgtaaaaaagcttacaattacaaaaaaatatattaaaatgaaattatacggaacaaaaaaataagtaatatatcttataatataatgtttgatgtttcaagcttagtaattaatgattgtgtcatttttatttataactatgtgataggagtatgtaaactttttcttttttaggtaggagtatgtaagatcaatataagtttatttttatttttatctcagctttgaattatctaagcatcatatatcattgtgcttaaaaaaaaaaaaattaatgatgtcaaattatttttcttttaatttcgcaacatttattggtatgtaaacattcatcgtaattgagtagcttttctttattttagttttcttaaaaacatcattaattattgttgtgtgatatatttttcaattgattttttatgtcggaaattttaatgatttaaaaaactatacaagattgaaagtaagagatatattgttggacgtaaaaatagaagacgtgttgttggtttaatgtgtatataaacattttataagtagtggcaaagaacatatttcaacagtaaaatatgattgagatgtaaaagcactagtggtaaatgatataagaggacagttggatctgtggtttgcatgtaatacattttctaaaagaatttgtagaataatatacagtaaaacctctataaattaataatgttgggaccgcaaaattctattaatttatcgataaattaataaatattaatttatagagagatttttctaatttggtaagttttttaaaatttttttatgaaaatataaacttccattcattatttgaaatatctttctagaactaattacaaataaaaataattatcatgttttgaaaacaacacgaacagtttttaatatagtaaaaattattaaaattaaattaaaaataactaatgtgagtttaagcaaaaagaaacaactaaaattatatttcattaaagttgttatatataattataatatatatatatatatagttgatatttttatataattattaatttatgatattaataagaccatatgtttctataggattttcaaaaaaattattaatcttattaatttatcgagttgtgtcactttttacactggtcccaactcgagaccggaagaatttattaatttatagaggttattaatttatcgaatattaatttatagaggtttaactgtataaggggaggccggaaaattacgttttttgagatacggtaataatagtaaacaaaattttggcaaaagttgtggtgatcgataattttaaccttactatatattattataataaaatgttccaactagatataaaatatagaaacgtaaattagtatagtaaaacaaaaacgaattaataaaatactaactcttgtttctagactttgtcatccatcaaaagctctataaaaccaataatcttcattggatgtaaaattatctatttacatttttctctttcaagaagaagcagccatg

SEQ ID NO: 19370 - DNA, 3003 bp, Unknown; identical to SEQ ID NO: 19369
  misc_feature (1)..( 3003): 2750-1469P.txt file - cDNA_ID_1821587; gDNA_ID_1620658; Annot_ID_163717

SEQ ID NO: 19371 - DNA, 3003 bp, Unknown; identical to SEQ ID NO: 19369
  misc_feature (1)..( 3003): 2750-1469P.txt file - cDNA_ID_1821587; gDNA_ID_2926187; Annot_ID_140837

SEQ ID NO: 19372 - DNA, 3003 bp, Unknown; identical to SEQ ID NO: 19369
  misc_feature (1)..( 3003): 2750-1469P.txt file - cDNA_ID_1821587; gDNA_ID_2926187; Annot_ID_200704

SEQ ID NO: 19373 - DNA, 3000 bp, Unknown; identical to SEQ ID NO: 3707
  misc_feature (1)..( 3000): 2750-1469P.txt file - cDNA_ID_1821591; gDNA_ID_1620658; Annot_ID_47909

SEQ ID NO: 19374 - DNA, 3000 bp, Unknown; identical to SEQ ID NO: 3707
  misc_feature (1)..( 3000): 2750-1469P.txt file - cDNA_ID_1821591; gDNA_ID_2926187; Annot_ID_140835

SEQ ID NO: 19375 - DNA, 3000 bp, Unknown; identical to SEQ ID NO: 3704
  misc_feature (1)..( 3000): 2750-1469P.txt file - cDNA_ID_1821595; gDNA_ID_1620658; Annot_ID_47908

SEQ ID NO: 19376 - DNA, 3000 bp, Unknown; identical to SEQ ID NO: 3704
  misc_feature (1)..( 3000): 2750-1469P.txt file - cDNA_ID_1821595; gDNA_ID_2926187; Annot_ID_140834

SEQ ID NO: 19377 - DNA, 3003 bp, Unknown
  misc_feature (1)..( 3003): 2750-1469P.txt file - cDNA_ID_1821607; gDNA_ID_1620658; Annot_ID_47904
cgttggtagaactgaaaatgaggtgaaccctcgcacagtggaagtctcaagtgatgagcagttagcccgtcagcttgaaagacaaaacaatcctgtacatgcactagccactggattatttcctgctgaggtgccagattctgtcgaaaatgatacttcgaggttcagttcattcttcgttcttgattttcttattaactacaccaaagtaacaatttatttagaacttcatgattcttttcctgcgactcccttgatcttggtactgagatactaaatttgcactgccttaaagtaacgttattttaaaatgttttgaatagcaagttatatttggtttctgacgaccactatttgtgcatatttcttggatttattttactggattgtataagttctcatccctttctttcacaaaataggaatttaggattggatccaagttggctgcagacatggtcaagtcagggttctgatgtcgctggtccttctaccacttccaggacagttggacttgggcgggttcagatgatgatgaggcatcttgcatctgttggcgaaagctatgctcaaactgcacttgacgatgctgcttggagtctatggccgatgaacccttcacaagcatccacttcttctacaactgtacctcctggtaatggtggaaggacaggtggtctgcatctgagaactgtatcaaacacgacaaatgaaagcttaacaaatatactagctatggccgagacagtgagggaagtcatgccacacgtgcccgatgaaattattttccaggtaaattttaagtgcatattggattatctgtaagctttgatgggatgtgcatacatggttgagttgagttggtggctcatttagattgtcttctgcattgactggaaggaactattttttgcatatattcatacctgaagccgaattttatcagtttatgtatgtggtcaatttgcctgaactggtctctatattcactagactggtccttaagctatggatagttcagttttaagattcacgtgacttgatacttgaacctgttatgtttcaatttcttgcaggacctgcagagaacaaactctgttgctgttaccgtgaacaatcttctccagatgtgatgatagtttgtgtaaaatatactaagcacttccatttcaaccttaggtatagattaatgattggggacatatccttatccgtaagttttacacaccacccaacattccaagcttcacccgctgtagatataaggcactgtgtatcactttttgctatagagaagaagaggctctagtgtatagcttctgttcattgctctcttgcgaaaataagttcggatatttacataaggtgatgatgccctggtggtctggagatatcttgttgcagtctgaccttggctccaatctcgagggagagtaaccactctttgcagctgctcttttggctgctgccacctctcctgtataagaatgtgtaatttacaataaagaaaaaagaagtaaatgaaagagtctactgttattgatccaatagcctgtaatgtagtatcatcaaatgtgtgaactcaatttttttttcttctgaagaattatcttcctacattaactctatacccgttttgacgaacggataaacagtgaagagacaaattaacatataaaatataatttgtcataaccatttcgagtagatataatcaatagaaaagtatcatgttggtacttttaacgcaacttcaagccgaaaaagattgtgaagagattgtttctttcgaaggaagcaactttgattttgtccatgccgtgtgtaaattagcaatagcagaagagaaccacttaaacttattttaatacgcttctagatagctctacttggttcgataaatttttatgcacgttaagtaagtttaatctgtttctaataactaaaatatatgatgtagttggcataaaaaaaaccataaaatctattcccaacaaatgaggaatattcacatctaagatattctttttaaaaccaaaggaacaagattaacatgagaccttagacaaagggaatggccatgaaccattccataattccatttagagatagcaagtggcagatatatatgtgtaattcgaaaatatataagtatatttgatccattctagtcttcattaaaagatacacaatattatcatttatcaattaagtggagggactgactctacatcaaagatagaaatagggtaatttagttaagcaagactcaagtatcaggaagtgagatcactactttgcaacaatctcttgatagccatctgaaatcttcttcagatgctaatctcaactcatggaaacatccatggcacggtgtattgacataatgtagcaagttacaaacttacaatgcaacatatggggaaaatctgaggaaaaacataagaaacgatgaacaacataaacttaactaataagaataatgtggtattatatattatgaaaaaattcaataatctgtttttaatgtaagttaaatcccgaccaagaaatgataaaaaagatatttgttcccacattcttctggtacatgtttccaggtcttctcctcaatctttgcattttaacgctcttcctttaatacatttttttttacactgtattaattatgagataaaccccaaaaaaagtacattggtacacaagcataaatacaaaaatatgcatgcttttttcagaactgtttaaaggtaaagcctttttctgcaaattttcttttcgtgtatgaccaaaaaaaaaaaaaaaaaaaactttattctaaaaaataatagaaaagtagtgtgtcttcatattgcagtgtcttgtaagaagaaattcaaaaacccacactgacactttaacacattgcttcgtcttctctaccgtttcgatttcactcttaattatgtcaaatccgtaagcttttgtgatcatcaacaccaaaaaaaaaaacctaactttatg

SEQ ID NO: 19378 - DNA, 3003 bp, Unknown; identical to SEQ ID NO: 19377
  misc_feature (1)..( 3003): 2750-1469P.txt file - cDNA_ID_1821607; gDNA_ID_2926187; Annot_ID_140830

SEQ ID NO: 19379 - DNA, 3003 bp, Unknown
  misc_feature (1)..( 3003): 2750-1469P.txt file - cDNA_ID_1821611; gDNA_ID_1620658; Annot_ID_47903
gtctatgcggttgggatgtttgtggcaggtcacttgggcgatcgtttggatctcaggacgtttctgaccatcggtatgatcgggaccggccttttcacagctctcttcggggtcgcattctgggcgaatttccacagcttctactatttcttggcggttcaggttatggcggggttgtttcagtcgataggttggccttgtatcgtggctgtgctcgggaattggttcgacaagaagagaagaggaatgattatgggtgtttggagcgctcacacttccctcggtaacattgcagggtctctgatcgcgtctgggctgcttagatatgggtggggttggtcatttcttggcccggcttttctcatgacttttcttgggatcgttgtttaccttttcttgccggtgaatcctccaaccgttgaggcagagagagatggaactgaaattgactctaccatgaggctcggtgacaccattacagagagcttattggaatctagaatgagtactggattcgatagaaaggcagtcgggttcatggccgcttggaaaatccccggtgttgctcctttcgccttctgcctcttcttcacaaagttggtctcatacactttcctctactggcttcctttctacgtcagccacaacagtaatgtttctcatcatctctccttccttttacctctagtgttgtagcctgactatatatgcattgtctgaattatatgtgatgcagtgatcggaggagagtacctgtcagaggagacatcaggaaacttgtcgacaatcttcgatgttggaggcgttgttggtggagtcttagccggatacatatctgatcaactcaacggcagagccatcacagcagcaggattcatgtacttggccatcccagctcttttcctctacagagtctttggacacatctcattgaccatcaatgtcatcctcatgttcacatcaggagtcttcatcattggaccatttgctctcatcacaacagctgtctcagctgatctcggaacccacaaatctctcaaaggcaatgcaagggctttggctacagtctcagctatcatagacggcacaggatccgtcggtgctgcgattggaccagtcctcactggttacatctctgccataagctgggacgcagtgttttacatgttgatgactgcagcattgatctctggattgttgctcactaaactaatcatagcagaagtcaaagcgttattgtttggatcagaagatgaagtagctgcatcatcatcatcaccaccagcatccagacctcccattgatgtcctcgtttgagttttttccttcattatttatcagtttctttgacaatttcacactttttttatccttttaaagttcgttcctttttccccagttgtcttcatttcttaagtttgaatgagaataagattacctaatttggttgtcgaatgatatttaaaccaatcaaaacagctgaaaattgcagcaatcggaataaagaatcatcatttggttctatatgatcatcaaatttcactgaatttacacataaaccttaagaagtagcaaaattcatttttaaaaaaggtacaagagacggtgaattcaccggagaagctgctaagtggaatctgtcaaacgtcgtctctgcttttgggcttgcgatatttctcctcaacttgcttggccattgaaacggcgcagtgaccgagctttttgatgttagggacgttgtaggtctgagcgatgtagatcccgcacactgttcccatgatgaaagagaagctgctccttattatccccatcttcttctccgtagatcggatttttttttttgggtttattgaattggagatattttgatcggagagattgacggaattaaaagcgaaatccgccaagatcatgagaattctggaaattaaaagtcgaagaattgaagatccattactgggcctgtaaggcccaaatatattaaaaatttacatgggctttttgcgttaaatccatatgaatttagcttttgtttgtttttatatgggaaaattcaaactagtcaccaacttaagaaatctttaatgagttaaaggtgtttttggttaaaggggtcatattcaaatttgttggtgtgtcaaaatcaaactattgctcttaaagaaaaaaaatgtttactgagatgtatataacattttgttgttgttaaaaatggttagaaaatattataactagagtttttggtttcaccaaaaccatatataacaaatgaattaaataaattttttgatgttatatagattttttcagtaggcatacatatgttgaaaataaactcaacaaaaaaaacatgtgttgaccgtatcagtttattttctaattaataagaaaagtattctattgttttccaggaaggaagaagatatcgaattttgctctttctacttttcgattctctctcgatcgagaggagaaaaagacagagaggcacggtgacacgctgctttcacagaatttccccaaccgacagacaagcttcgcggattcaggtttttctatgattcgatccatttcttaagaactctgcattttattccttgtaaaatcttcctcctagctcctttcttcaattttcgatttttgatttatattgtttcaattttggatcatatctttttatttcttgtgaatcgggtctttgtacttggtacctctatgtagcatttttggcttctgtacaaatctgatttcacctgtatgcatacgactcaatctaaaagaacccaagttttggattttcctctgctttggagctcaattttctttacattctgaaaaaaaaatcatctttttatggaaatgttcaatttttgtagttgtttgtatcgtccgagtcttaatacttatgagagatcatgtctttgcagatggcgtcatgctaatatgactaaatgagattctggggattaagtttaagtgggaaggctgtaatagttcctaatg

SEQ ID NO: 19380 - DNA, 3003 bp, Unknown; identical to SEQ ID NO: 19379
  misc_feature (1)..( 3003): 2750-1469P.txt file - cDNA_ID_1821611; gDNA_ID_2926187; Annot_ID_140829

SEQ ID NO: 19381 - DNA, 3000 bp, Unknown; identical to SEQ ID NO: 3700
  misc_feature (1)..( 3000): 2750-1469P.txt file - cDNA_ID_1821626; gDNA_ID_1620658; Annot_ID_47898

SEQ ID NO: 19382 - DNA, 3000 bp, Unknown; identical to SEQ ID NO: 3700
  misc_feature (1)..( 3000): 2750-1469P.txt file - cDNA_ID_1821626; gDNA_ID_2926186; Annot_ID_140824

SEQ ID NO: 19383 - DNA, 3000 bp, Unknown
  misc_feature (1)..( 3000): 2750-1469P.txt file - cDNA_ID_1821629; gDNA_ID_2926149; Annot_ID_139223
tctttttactaggcttggctgttgtttctctatgctgggttggctatgcgtgagaatatattaagagctaacggaagcgatattcgtccatggtacttttatgcgttccctcctcgttcggttatgactgttatgatcacttaagtttctcattgctattactgttggttgctttgaatttgggagtgttcttgtgttgtggtagttttgatttaaggacctgttaactgagggcaggtgttgctagtgaaggccatatgacataaaatttaagtccggagtgatgtgtcattctggtcctatgctcaccaagcacatgtgaactttaatgagagtcatagggcataatttagtgtggaaactattgtgtttctaagagtgttgtgtcacgctacaacctacagtatgtggatcttaggttctatattcaactttgcccaaaaataaaagggttcttatgtggatatcatccatggtacttttcctcagtcgattataactgttatggtctcttaagtttctctttgctcttggtaaattgggaatgttctcagtgcatctgttacactatatatataaagttatagggcataattttccgagatagatatagatgcgccatgataatgttgttgttcctatatttaccaagcatgtgttgcttggtgaaagtcaggggacataacttagttttgacagtaatgttgttggtacctcttcagagtacacttagtatattggttaatcatttggtcaagtagaaattagatatctgaatatttcatgggtaaatatagggagctttagcatctgcggaatcctctttctgtgggggtttgaattcggagagaatctctttatctggattgacttaggtgttttgtttggctttttttgttcgaaatattctcataagttggggtgactttaacctctgaacctgatgtgggtcttcaggtggctatatcatcattattgtgccatggctatggcccttgtcagcctcacatgggaaatcaaaggtcaaccaaactgtgtccagaaacaggtaatgcttagacttatatctgtttatgaagactaaaaagttcacaaagtaaatattatatatgacttcaattctgcagagaggagtccatcttttcctacaatgggctatgatgcaaggtgtcgccatgcttttacaaaacagatatcaacgccaaagattatacactcgcattgcactaggaaaggtgccttcttatgtcatgtgcactttttctcttcagttcaaaattctatttgtttttgtaaagtttgcgttgtggtttatgttttaggctaagagaatggatgttgtttggggagaaacggctggagttgatggacaactatggctgttatgtcctatactgttcattttacaggtgagcttttttctgtacatagatgaatcaagtttatgctaaaacattttaacgcgtttcatttgctctaccgtggcaccatgctagagtggtttactgatattttaatcacttcgttctttttaactactgtgtttccatggctttggagaggcaaagaaactcattcaaaactatagattatgtattgtcgcaagtataaattcggaagtcaatatttcccattcaaaattctctagatggcctgtacagtagaacctctttgctctttccacaacaatcaaaaagaaactttgcacgtgttcatgctggtaatgttgaggttttctgtttgtaactttgctaaaactcaggtgtttgaagcatacgttggactgctgttgctaagaaaaacagtaactggagttgttaatgaatggcaggtatatttttctcactctcgtggcattgttttcaacgggtctattcccggtataggccgacaaatcctgattcaatagagaataaagactaaaaaaataggaagtagagtaagaggaatgttgtcgctttcaggtgatggtttgtgggattcttctggtagtgatggcagttgggaacttcataaatacagtagagacactgatggcaaagtcaagagttaaggcaaagatgaagagaagtaaaagcagagcagagcttaattagacttcacaggtctctcatctgttcaaaatcttgctttttttgcagttcataaatttttgtcctttttgtttttaggccacggataaaataaaactgtgaccatcctttttctgtgtaaatggaagtggcagttgatatttgataattgatgttgtatttgtacacttgactgggttttgtaggaattttttaagtgtcagatcttgaagatgatagtgttaaaataagtatccttaaacaagaagagctaggcccaatcccaggcccacttgggtatcaaacacttccaaaacccagtcaagtgttgtgtcactgtgtcagtgtgtcacaacgaagctctgatacctttcttcttcttcttcttctttctccctttctcgattcagaattgtagagtttttagaaatgcttccgcagttcttcgggcgcttttgatttatcttctgattccggttcagaggcggaaaaattgagactttactggatttcactggaaataacagtccagagctttgtagggttcctctgtgcggttgtgtttggttcgcttgagacaattcgtctttattgcgtgttttcttgtgtttcctttttcaggatcggtgacattttcttgattgttttaaagatatggatagaatcagtgggttacctgacgaagtactggttaagatactgtcgtttgctccgactaaagttgctgtctcaactagcattttgtcgaaacgatgggagtttctttggatgtggttgactaaacttgagtttggtggtaaactttattcagagtctgaattcaagtgttttctggataggaatctgtcattacatagagctccggttatagaaagcttctgtcataagctaagtaattcggttttgaaacctgaagatatcagaaatg

SEQ ID NO: 19384 - DNA, 85 bp, Unknown; identical to SEQ ID NO: 3724
  misc_feature (1)..( 85): 2750-1469P.txt file - cDNA_ID_1821629; gDNA_ID_1620659; Annot_ID_47935

SEQ ID NO: 19385 - DNA, 3003 bp, Unknown
  misc_feature (1)..( 3003): 2750-1469P.txt file - cDNA_ID_1821648; gDNA_ID_2926149; Annot_ID_139217
tagttatattataagaagagtacatttggaacattgtcaatcatttatttacttcaattacgtgtagaaagtgtttaattgcatttagaaatggtagttttggaattaaagtaattgaaatcaaaatcaattataatttaatttagaatttttttaaaattttgctttaattattttagaggtacttcgaagattttttttttttttttctaaactccccactcctcttatcaatgaaattgggtttagatttttttttttttttttatgtactatgtattaattcagatgtcttaaaaatatgatcaaacctttacatcattatcatggagccttttgaatcttcttagaacttcagctttaacactttccatgcatcttttgaagtcttggaatcggaaatgtgcgctagtactgaaaatttctccagaaacaaaacactgaacaacagttgaagagcaatttcatctttcatttctagttttccccactccaacaatattttctttgcatcatgtgcatgtatgactaacttgtgactcggtgatacctccttcaatcactactttgtgcaactccttacacttaagcagccttcatctttatgatccacatactataattttcccatcacacaccacatttctacttagcttcatgtatgatcttatgtttacctgtttgatttctttgtgtttgttattattgctcgatcactcgactcactttctgcctttgatttcttttcagtattgtaggtcaccgagaacaattagctttgataccaatgaaggattttgttcaccctcttagcttaaccttttttttcttaattttaccttgattcgttacattcatatttatactacttttacctttaaacctacttattcctcgattattgtacttaggattacatattaaactaaacaaaagattcccaattagacaattgggccttcaataacacaacatgactggccttttttttcctcttccttatctaattaatattggaaattttcaaatttttaatagtaatttttttttctaaaccggaaaccgtggttaaaattatataaattgtgctatcatcattttttcttagtatgagaaaaataaaataaaataaaatttgtatctattttgaacaaaacttgggttcaagggtgaacccttttattcacctccttttgcattaaccaataaaaacatgttatgtcaaatcctacttaaattacataataaattaaagctataattataaatccaaaccgatatataatctcgtttaattacaaaatctaaaccctaattcttctttgtaaacccaaacctcatttaaactcatttaatcgtaaaaaactaaaccctaatcgtattttctaaatccaagccgatatttaacctcgtttaattgtaaaatctaaatctgtttataaatctaaaccaatatttaatccgtttaattataaaatctaaaccgtaattgtactttataaacctaaaccgatatttaacctcatttaatcataaaatctaaaccctaaccttttataataaactcaaaccgatacctaatttcgttttagtggcaaattagattttataattaaattacatattattatttttattattatgtatcagattttaattgactaaaataaaggaggtgaatataagggttcacccctaaaaatgaacccaagtattttttatttatttttagtgaataccattcttactaataatcgtgatattgagcacatattgtcatatactaacttagtatatgcaagcatgcaatatatttcgtttatatagtttaactattcatttttaaacttagaatatatgatcatcatatattggatattatgttatatgtcatgtagttggctatcttcttcccttatgattatgcatccaaagataattttgaggtaaatgtcgtaaaccttttttttattttattagaaagtacttttttctaaaattcagtaggaaactaatgttatacttaagttaagaaaaatatttaaatatgattttatagagtttgagatattaatatatcggcgagcatataaatttaatatgtataaattctttttaattaaaggtagaatttgttcatatataattattttctcataaatgagaataacaaccaaaacgaacaatattaaaaccatcaacaaccaaaacgtgacactaaatcaacaaacttcagcttagttgtataaattgtttgtttaacttcaatttcattggttgacgaattttatacacaaatgtaacaagttgatttcatcaaacaaacatctacatctactcactctacctcacataattcataaacctacctacacacgcaaaacttcttcaaaggcaacaataaaaatttagagaatcttttgaatcagttggtcagtcaacatcaaacactatttccatttgtacattttcttacttttagaatggtcaatttttttttctcttaataaatagcacttatacatttatgtcccaaaaaaaaaaaaaaatctactttttatttatgtccaattcaaccaaaccaagtccttttagccacgtctgtatttaaccaaaacaatctacagtacttatttttggtacacaataaatgcttcttttcaaaaatcaacctttttttttaatttccatataagaaaacagagagagataataaaaaaaagcttgaaactttgacaaattaacaatctgagattgtaattgagcgggaccagtagtatcgaacgacccagaaaagagatttgattcctttcctcatctttgttcctcaggtttactcctttgaccccaattctaggttttcgaatttgggtaacgaaaaagttttcatctttccgattctttgtgactcatatataagtttctgattctgggttttgttctctgtttccaattagctctgtttgacccatttatcatatcaaaggaagaaactttaaaatg

SEQ ID NO: 19386 - DNA, 3003 bp, Unknown; identical to SEQ ID NO: 19385
  misc_feature (1)..( 3003): 2750-1469P.txt file - cDNA_ID_1821648; gDNA_ID_1620659; Annot_ID_47929

SEQ ID NO: 19387 - DNA, 3000 bp, Unknown; identical to SEQ ID NO: 3723
  misc_feature (1)..( 3000): 2750-1469P.txt file - cDNA_ID_1821656; gDNA_ID_2926149; Annot_ID_139213

SEQ ID NO: 19388 - DNA, 3000 bp, Unknown; identical to SEQ ID NO: 3723
  misc_feature (1)..( 3000): 2750-1469P.txt file - cDNA_ID_1821656; gDNA_ID_1620659; Annot_ID_47925

SEQ ID NO: 19389 - DNA, 3003 bp, Unknown
  misc_feature (1)..( 3003): 2750-1469P.txt file - cDNA_ID_1821667; gDNA_ID_1621195; Annot_ID_57550
tctctgcttctttgctttaatggcgcagatacagaactagggcttagggttttcctcaatggctttacttgttagtgttgatccaacctgaggatttgtatcatcaattttacagaatctcaccactgttagctcaggacatttcctgctgcaagaatctgtttacatatacttgtgtctgagactctgaaacagacaagttcacttgtgtctgaatcatgtaatttttgtgttagtctctctacaaatgattgattcttaaattagacgaataaaccagagaaaaatgttatacattgcatttatggactgagttgtgatgtacattgagtaggtgggaaggtgctccaagcaagtttccatgggagtttaagaagacagagacaatatatttcatggaagggaaagtgaaagtgaatgtagacggatacgacgaagaagaagaaacctttgagatagggaaaggagatgttgttgttttccctaaagatatgaaagttgtttgggagataactgaagctgtgaagaagcaatatagcttagaggagtagtgactttgtagagagaatttgagtcacattgatgtttgtttgttgtacttggttactactttgaactaataatatctatggaattgcaatgttgattaggattctgattatagaagtaagaaaactatatattatatacaatttaattaggaccccaacagctcaagtacatgactgttctaagagattcttcagccttcttagccttctcgctctcaccagaggaggtaacggctgcggagacagaagacgaagagaaccttttcccttgagaaacagatctaacgttgttccggagatgttgattaaccgaccggagtatgtagttccaccgacaaagacctagttggtcttttaatgcctctacggctccgatgctcactgccactgtccatgctttgcttgtagaactcatctttcttcagagaattaaacttctttgtgttttgtgttttgtgtattgagaattgtttttgttgatgatgtttagaaagtgaagtgaattggtgtgtttatgtaagagagaagaagccaacaatattgccgtgtagttggagttaaaactagaagctgtggccgttggttttggttgtttactactgtctggatagtaaaatgacgttgttagccttttaagaacgaattggataaggggtaatattgggattctggtagttcctggattaacgagtgccgctatcatgtgcacctggttttgagattgttcacttgtttgggtttcgtgttgtgtccaagttttgaaatatagtaaatgttttctttatctccttgtagaataatgcatgttggagatgaataataatataatatcaaaaatcatttgccgaccaaaaaagtaaaaaatatattaaacacaaaatgtaaataaataaataaaaattcaatcaaaagaaaaatggttttgcgatgacttactttttttttttttctttctttcatacagaagatgaataccatttaacatgagtattcaaaaaatcaaaagtaaaactagtatcatcaaatatttccgctaaattagtaaacatatttccgctcataacaattagaatgagaattttagaatgttggttctgtgacaaccacacaaatttccgagtttagtagatttggaattggtgtttttctttgcgatttactggtatgcgctcttgagcaatcgtatacaattagagtagtaatattattttacttttctgtaaattgctttaatccgttctcagttctctttataacttctgtcaaaaatttaaaatgatataaaatttaacattttactaaaaaaaagagattgtaaaaaagaatatagagatttgttttattttatcctttaatcagtcattttataaataataaatttcgtttcaagtagtacattaatttttaaaatttttatagatttaatatacagatcattctagtatacacaaaaattaggatctatattattatttaaaaaaaaaaaaagcagctcaagtcgatgaactaaacatgggcaaaatcgtcattgaactaaacattcatagtttcagcagaaaccaagaaaaccagcagctacaaaacccactttttgtctgcactttcaaactccaaaggcacggcactttttgtctgctttctcttcttttataaacaaaacccactttgattcacttctcattcatcatcaacaaacacaaaatcgaaaccaaatcacttaaacaagaaagaaacaaagagaaatgagctctgcaagcaaaacgtggatggttgctgcaagcatcggagccgttgaggcattgaaagaccaactaggcgtgtgtcgttggaactacgtgatccgatctgcgaatcagtatctacgcaacaacttaagatccgtgtcgcaagctaagaagctctcttcctcatcaatcgattataccaacaagaccaagcaagctgaagaatcgctgaggacagtcatgtacttgagctgttggggtcctagttaatggacaatggagggatttgaaaaccctaatcatagagttttgataatgtctcttttagggtttaaaacccttaaaaaggttaaaaatgtatagaatttgctctgtaaagtgactcttgagtcttgaactaatgattaatctcttttcataagatttgttcaaatcggatttttcagttactgcaactaagtaagaaagacttaaactttgaatataaatacagagaatttggtacgttgtgtgtgacaaagatttatttctgttgatataattaggaccctaaattggaggtttgttacagtcaaaagtttgtactgagtttttactacaagttagggattttgttaaatgcttatcccatttttcatgcagttctgttgctaattctccagcttaataaagagaggttaattttgtttggtttatgtgtgtgaacatttcttgtctgagtaaagatg

SEQ ID NO: 19390 - skipped

SEQ ID NO: 19391 - DNA, 3000 bp, Unknown; identical to SEQ ID NO: 3722
  misc_feature (1)..( 3000): 2750-1469P.txt file - cDNA_ID_1821667; gDNA_ID_1620659; Annot_ID_47919

SEQ ID NO: 19392 - DNA, 3003 bp, Unknown; identical to SEQ ID NO: 19389
  misc_feature (1)..( 3003): 2750-1469P.txt file - cDNA_ID_1821667; gDNA_ID_1621195; Annot_ID_174707

SEQ ID NO: 19393 - DNA, 3000 bp, Unknown; identical to SEQ ID NO: 3722
  misc_feature (1)..( 3000): 2750-1469P.txt file - cDNA_ID_1821667; gDNA_ID_1620659; Annot_ID_163740

SEQ ID NO: 19394 - DNA, 3003 bp, Unknown
  misc_feature (1)..( 3003): 2750-1469P.txt file - cDNA_ID_1821671; gDNA_ID_2926148; Annot_ID_139203
tagactcatatgtccgtttgatcacgacttgggacgaaaattatggtttggacatggttgtgaaaaacacagagagattttcaaacagttgttataaagtgaaagatgcacagagtcgttttggccagatgtaggtcatcttatcgtttatggaggccccaggtgtacataaactttgttagtgcgtagcattattccaaaattgtagtatctgaaaatgttcaaaataaatcaagagaattacgttcttactatgaataaaaatatataagaaaaacgtaaagaaatttaaagaacatctttatattctttttttgttatcttgtttgacttggttagaaaggagaagacaaaagaactatttatatgttccaaattttaaaaacatcttacttattacatcatatatcattagaaaattccactacattaccttaaagatatataatattttctatagagatatagttctagacaaactttacttggtgtgttaacactcttaagtttttctagaacttagacttagttaattttgagtttggtccaataattaaactcttgatcatgatcccgtgattaaacttaacccaaagtcaagtttgatctcactaccggattatttgaggtgaatcaaaatataacaatataccatgtaattggtaggcaaaataaccaaaatttgaaaaatcaatccgaaccgaaataaatggttttatttggttatggttttttcttaaaactcatttggttatcatttttcttaagtttttggtttaggtttggtttggttaaaaaccaaatgatttttttttgtttttgattaaaattaagaataaccatatatactaatatattgtccaatttatattatgattagagtatcattggattttttctttactagacttatatacagtgatctcttagtaatatctgattattcttatattatttttattctacgtttcattttatttatgcatcaaacttatactttttttttgtaaaatacatggaataaccttaaaacccgtacccaaaccaaaaccaaaccaaaccaagatacatatagttttttatatgatttcaatttttacaaaactgaaaacccgtcataaattgtaaaaccgaaccataaccaaacttaattacatacggtttctttatggtttcaagttttttgtaaaaccaaaaaaaacaaactgaaactaaactgaaaaactgcacgcccaccctaatactatatttaaaaataaatctcaattaaaatcaaaaattaaagaaattaaagaaacaaaatacttatgattttaaggaaaatctaagaataattatttttatttattattttcatttgtcattctgaataatcacacaattagttttatacaaacattgattatgtcacatcattttatttatagtacatttttcttattttaatttatttataaatataatttatacaataggattataaatgcaagagaaaaaaatactatcttcaatttacacatagaaatgtattacaaatacttaaaataaatttcttattttcagattttttttagaggaaaagttacaaatattatgccaagcttgtgttaagaagttagcattaaagatatgaataaatgtcatcaatatatcgatgtaaatttaagaagaaattatgtttgacttgtatggtccacaaataattatgtcatctttgacttgtgcatggtcaaaaataacaataaatctcttaaaagcattcatggaaattagtaattacttagtttaagaagaaattttgtttgacttctgtatggttcaaagatatatatactatatttaggtttgaaggaatttaaggaaacgtatatgtattaattattttttctaacccttagctaggtgtatattctactctagtgaatcattcagaaatattacatttcttgtgagaaggtgattatcccaaatgacttcttcaaatctttctcctattactatatctcaataataactgtatatatagaagaaaaactaattatcaaatttctctagttcacaggttaatgaaaatgaaattggggtgtgcacttccaatgacgtgcatgattttggcatgctatattatttgtgggagccttctaatgagtcattgccatggtgttataaaagaagcaaagacattaaaaagtaatgaagatcttgaaatagagcacaaacttaagcttatcaacaaacctgcatttaaaatcgtaaaggtttatcctctcaccatgttatagaataattgaatgtgtttatatatatataacattaaattacctatcctaagtattctaggatttgtataatagaaagacgatgaaatttatgaaatcatgcaaaaaataatatattttcttatatatgaattcacagactattaatggtgaacgatatgggtgtgtggatttctacaaacaaccaggacttgaccactcatccatgaagaaccacacatttcaccataaggtattgcattggtaatatattttttcttgatatttagaagatttcaactctatttagaatagatggtaattaagtattggcaatattgtgacaattaagataggattattttcttgttttattaattattaatagaaaagtaatttttttttgtgtccactggattggagattagaatttaagtttaggatttaattagtttggtttcccataattgttaaaaataaagataaaatccaaatgtatatatatatatatatatatatatatatattggataaacatataatgaccaaattttctttttatatttaatatgaagtatagataatcatatacactattttgattagaaagagccatattttttaaaaaaatcacttttgagttttaatttacctttttatagtttaatttaagaagagtactttaataaaatttaattttggaatggctaattaataatttatattggattttgatgtggagatg

SEQ ID NO: 19395 - DNA, 3003 bp, Unknown; identical to SEQ ID NO: 19394
  misc_feature (1)..( 3003): 2750-1469P.txt file - cDNA_ID_1821671; gDNA_ID_1620659; Annot_ID_47915

SEQ ID NO: 19396 - DNA, 3003 bp, Unknown
  misc_feature (1)..( 3003): 2750-1469P.txt file - cDNA_ID_1821688; gDNA_ID_1620660; Annot_ID_47951
atgttgcttggttaagaagtgggtctccatcaaaaactgggcttttacacttattggtaagatgattttgctttgcacaagaatcccaaaagtttcttccttctatgggttttgtgtagtgtcggaatcttcaaatctattttgtaattcgtacgattactttgttgctttatatacagtaacttgagaaatctagggcttgttcttttgacttggtgatttgcatgtatggttttgcctataattaagatgttacttactagtttacacgagattcttctttttatgaattgtttttatccattcttcgattgttgtttgtgaaattgtgattgattatgtgtaattatgtagtggctttggatagagtaacttcagattcagagatctgtggctaaggacttgtttttctaacttagtgattttcatttacggttttgcttctgtttttcatccttcttaatcctttttcttttggctcctccaattggttttccatagagacaaggtgcaaaatcgtttgaaggattctttgttcaacaaagatatggaatgcaacaaggaggaagctataagagcaatggatattgctaagaggaaagttgcagagaatgattacaacggggctaagctttttgctaacaaggctcaggatttgtatccgaaacttgatggtttaagacaagtgatgatgttgatcgatgtgtatatctcagcaggaaatacaattagtggaggagaatctgattggtatggaattcttggtgttgatcctttggctgatgaggaagtagtgaagaaacagtataagaggctagctcttttgcttcatcctgacaagaacaattgtgaaggcgcagagggtgcgtttaagcttgtgttagctgcttggtgtttgttatctgataaggttaagagaattgcttatgatcagaagaggaagttgaacgaagttaaaccgaaaaggagtcgaaagcagaaacaacctccaaagaaaccaccaaatcagccgaaacaacaaccaaatcagcagaaacaaccaccagatcagcagaagcagccaccaaatcagcctagacagccaccaaaccagcagaagcaaccacaaaacgagccgaaacaaccaccaaaccagcctaaacaaccaccaaatcaagcaagtactaatggtagagctagaagcaaaaagcccacttccaaagtttctatcttttggacaatgtgcaacaaatgcgagacacaatatgagtatgtgagggtttattatcttaacaagaccgtactttgccgaaattgccgtgggaattttaaggcaactgagatagagaaaacaccaactgagaaggaaaaaacaccaactgagaaagaggaaacaccacaagcaacaaacaagaacacaaatggtgcttcgtcttcttgtgatagagattcttcactaaatgttaattttgattctagttttcgacgggattcttctttatcaagaatgagttactttaacagtggaaatgtggcaaatcaagcagaagaaagagggaaaagagaggtaagggagtcagaagaagaagctggtagaggaattgcaaactctgatttgaaagtagaagagagagtttttaagaagctgaggacagataactatgcagagtcaagtagtgaaatcaaggtgtgaagtaagctgaggacagataattagaagtttaacagtgaagtaggaactatgacatttagaagtttaacaatcaatgattttatgattatgatatttgaatattttgcatctagactaggatcttgtacagtggaaccaggttagttcttcttcctgtcatcttcaatgttgaatctgaaatgtcaaagctttattttatttttgttaacaatgtgtgctttaacaacgtgagtcaaattaatcaaagtgggttcacttaaattgttggaagaaattttacttccactaactaaatatttccttcttcggtcccttcattctcaaaagtttttacttttgtccccaaatattttaacggagaagatttagtctcctacttcgggtcatcatatatcacttgaaaatcgggatattcgttaaaaatcccccttttttttttttcttttcttgcttcctccctttttttttttttttgttctttcctttctcgcgtttcttctcctagggttagggttcgacgaacgcagctgttccacgcgtttagtttcaattctccatcgaagaagccataatccggtgcgtaatcatcgtttttgttatatgtttccgattaggtgtattattttccgtttgttttctcgggtttggtagtttcacgaacttttgcatctctcagatctattgtacgttttttccttcgtttgtgacggatttttctgtgaaaagagtttaaatttccatggagaattactcgattatctctaatttaactctttggcaatcaaatttttcgattttattgtttttttctggatgcgtgagcttagttatgaacaaggagggtcaactcgtttacatgattctctattcacagtattttcgtgggaaaggagcaattatgtttttgttttcatgattcatgtctttatgttgcatattttggccccttttactctcatttagactatgtggtgtttgttttgatgccattgttttgattttccatcaattagtaattttttcagtccgaatttcaattcttcgtcattgaccttgttgatgattcctgtgctttcagattcctaaagagcttacatttgttactcaactttaaagttttgacgctagagattactatcctcttgctgggaactcaacgtgaccaggtataaatctcagctcatagataagcaaagtagtttttttctacatctcttagatttgtaccctttttagctcacagtatcagttcaataaccaagctgatccctcttatgaacttacattcattggttctgtttttgctagactgtgtttgaaagatagcaatg

SEQ ID NO: 19397 - DNA, 3003 bp, Unknown; identical to SEQ ID NO: 19396
  misc_feature (1)..( 3003): 2750-1469P.txt file - cDNA_ID_1821688; gDNA_ID_2926174; Annot_ID_140243

SEQ ID NO: 19398 - DNA, 3003 bp, Unknown
  misc_feature (1)..( 3003): 2750-1469P.txt file - cDNA_ID_1821712; gDNA_ID_1620660; Annot_ID_47944
aagttcaaaaaatttcacaacaagtgggggacaaaaacccaaaaaatgcagaaggacaaaaagcctagaattttgggtacaaaacgattatatcaaattagatgaggactaataagtaattatgatgaataaaactaagggacaaaatcgattgaaagttatatgtagagaatctgtacagattgtcagagaaactgagagagagacgaaaccgtttcgttttgttttcaagaaaataatgatgtgtggttaaagcgcacgaatgtcgagaaagaagagataaaatataaaagtgaaatggtacgaatattataaacaattcaaatagactatagtacgtatgagttgaaagaagttttcgattgttgtagattttttctttaaaaaactattaagaaattgcagggttttatttgcaataaattaatctacacttattttaactcccgaaccattttatgcccttcctcgtcttggtctcatctaataaatggaaaggccaaaaaaatatatatgcatatagataacgaaaacatattgctgtataaaacatggccacataaaaagtggtcctaatttgggaagatttttaaaacatttttcaatcaatttagtttaatttgtttttcgtcggcaactgaatttcactggaaacaaacacttgaatggccattgaatggctattgattacccataaatactagacaacgatccgcatgcacgcgggatgaaactattcagataaagccattataggtaacattattagatgggatccaagatctgtttgtataaaacaaataatttaataattgtttctattatatccaaatttaatttgcaaatattttatataattttttttctcacctataaaatatttcaacgtggtgaaaaacttccacgtagacaagaagatagagcaagtaactcctgaatttagggtggtacatatatttttgtttttttaataattagagataaagcaagtaatatgcttcaccagcctctgcttagggccggctctggttcagctaattcctatattatcaatattcgttcagatatttgtatgttgataactaaatttgatatttgtgatttttctaaaaaaataatactaaaactaagtgcctgcattggcaggggccataatgctagttatcttctatattagagcgtaagtcaacgatcctattctgtaaggtctaccatctagaattgtaacaatttcgcaatcatccagcttttgctgacccgcccgccactcatctactagtcgtttgtatcacaattccaggtcagctacaatttggccaagttacttctagataagaatcctctggtctaaagtcctctcatattgtacgtaacttacaaaattttattgcaaaaaagaaaaccctctcataattaaataacgacacatggatcattttcaactagcaatggcccattgctagttgtttttggtagtatggcccattaacagtttgatttaagacctgtttttaggaaatttttccaagaaaactcttcaattatctttttataaggaagtttaatacctaatatttctgggttggaagaataatacatatatttataaaaatatgtaatttaacactcaaacaattaaatgttttatacttacaatctcataacaaaaaataaaattctaattaccgttaccatctcaattaattattaatttttagatgatttgacattaatttataattttgaatataattttattttatgttatctcaaaaatataaaatttcatttttatcataattaatttattttaaaattcaacataaaaaattatgagaaaatctaaatactttaaaatagtcatttttacaatcttatttcatcgtctcaatatcaaaaagatgttttttcttgagattcaatcttcgattctagatttcctcaattaatcgctacgagaatcgctgataaacaatttttgtcgccctcttttgccaacatcaaattcgataaccgttcacaatctccttttaatcgccactaaaattaatttgatttcattcgtcgtaatgaatatgatatcaacgaccattgatatgaacttcttcttcgtcgtgagaaactctctattcgaatttaaatccttgacaaataaacaattttcgacaaaatctcaatttgaatctcattgtatttctcatgatttttcaattcataaaaatggctaattttatttttacctttttcaaagttttttttgcttttttcttgaatttaaaaaagataatatttttttataaaaacttttgggataatatagaaactaaatgttaataaaataacttttaaaaattaaataaaattaatgcttcatcacctaaacattagtagttaattgagctagaaatggtaaaattggaattgtatttttgttctgagattaaattgtttgagtattaaactttacagttttattagtactgtatgtgtatttttcttcgaaccggaaagtaatgggtagtaaacatccaaataaaaaaataattgagttttttttgagaattttcctttcttttattaacatattttactttttttgattaaatttttttaaaatatatttaaaatctttgtagaagcacactaatccatttgctaactaatttaaatatgtttctaacatgttcacatatattaaaaggcacgttttgagcatacatatattttggttctcagttcttgatcatctagtgcattatctctcaaaaaccctaatcatttggcctcttcttttccccctaggctaatttacatataatatccttagaacgaccaaaacaatgtgccacagggactaattaaattaaacagcttgtaaaaattgtaattatcttggaattgttggagttggttaaaacactttttagaggcctttttattcccatctccgaccattccaccaaaacccaaaccatttttgtttcgcaaaatcattctaccatg

SEQ ID NO: 19399 - DNA, 3003 bp, Unknown; identical to SEQ ID NO: 19398
  misc_feature (1)..( 3003): 2750-1469P.txt file - cDNA_ID_1821712; gDNA_ID_2926174; Annot_ID_140236

SEQ ID NO: 19400 - DNA, 3003 bp, Unknown
  misc_feature (1)..( 3003): 2750-1469P.txt file - cDNA_ID_1821724; gDNA_ID_1620660; Annot_ID_47941
gctgaagcttcatgtcgagctaatcctcaaatgcatccggtcgttaccatccgacaatgccaatcaatcagacatcccaaactggggacaactagatgaattctttgcagagcactttagagaagaagaagcaggcgaagctgagtgatgaagtcgtcattgtacagcaatttgtttcttctcacatcctttataaagtcaaaaattcagagtttgggtttgaggatggactattcgcctgtagatttaacttacaggtaacaaattcattccctctgcctccattaccaaaaaaccactctgctaccaaaagtgtttaacaaatcaaatagaaaatgtgatctgtaatatctcatcggtttacatcaagatttgtggaagtgaaccaaattagtatcctgaaaatcaggcctttcttttgttgagatactgcatagaaacttaaagagaactctgatgggttggacccttaaaatgcaggcatactacagttcttggctcggatgaatattataaagccaacagtatctctataaagtaacaatctctcttcttgtttgaattttctcatttgcctcaattgttgcttttttattatcctttttgtttttgagttgtatgagatacgactgattgaactgaagtttttgaaagaggtaagcagtagattcttagacgtatataatgtattttcagagcgaggaaatatttagtcatttggtgtgtccactgcataagcatttcaagtctttattatgaacttgcacctccagaaaactaatggaaagattggctaacaaatggttccaaaacctccgtatcaaaaaatcctggagtaattaactaaggaatttgtaatgctaatgagtagacacaatttttcaatttcttaaacatttataaatataaaaaaatattttcaacaaaacaaaataataaaaagatgtaacattttaaagataatgcggtcctcatattttttaaataacaaataacaaaaaaagtgatagttttagcaaaataataatataaataacaaaatatatacatgaatagtagatagcgaaagaatgaaactttatatacaaagtgcaaacaataagtaattattaatatatacatttttacaataattcaattaaatgattataatttcatttacatacattttagtaatttaaaatttaaaataaatatatgaaagttacactaagagacgctcttgtaaataattaaatgttataaagatttataaaataaagtaaaagttgtaattgttcgtgaaataaactaaatattgcaatagttcaactcatcgattaaaactatttatgaagagtgactacaaaaggatgcaacggtagaatactacatttattcgggttgcaattttctaaaaaacataaccataaaatatttatttttaacttttaaaataaataacaaaaagttgtgataaaattacacactgtttccaactgcaaaacacatttatgggtgttatctttcaaatagattatgttagttgaaggtgatacatgtaagtgagtgaatggtgattagtcgagttatgtgtttttggagacaactatcttcttcctttcatcaatatacatatgttgtaagtagttgaatatcataatatggctagatttataattattaattttgttgatgaattagtatttaagaaattaacaaaatttgatggttccgacattattaattcgtagagattttgctgtacaaactattcaactagtgggacatatccactttggatattcattaagagacaaagctagagttatttatttcatttctaacattatagtgctacaattctaaataaatgatcgaaactatatactctctcttccttttcaatttattttatagaaaaaacgcacatattaaaaaatatatattaaaactgattataaatgtattaataatgtgatttcaaattttctatagttctaaaccattgatatttaattatttgtcttgaagtttaaaattcatcaataataactactcattctgttcttttttaattaattttctagaaaaacacacatattaataaaacatataaaactgattataaatgtattaatttttgtgatttacaattttttataattttaaaccaatgatattcaattatttgtcttgaaatttaaaattcatcaataataactaataaatagtgcataaaaaacttaaaaaattaaacaatattgttttctaaaagatcaagtaataaggaaccgaaggagtactaaatagtgcatagaaacctaaaaaatcaacttttttgaaacaaatttttttcctaaaaaatcaaataataaggagcaaaaggagtataatctaatctctaaccgatatataatctcatttaactataaaatttaaatcttaatcttctttgattaacccaaaccgatatataatctcatttaattacaaaatctaaaccttaatcttctaattagaaactcaatccgatattaaacccgtttaattgtaaaatttaaattttaacaatactttttaaatttaaactgatatttagttttgtttaattgtaaaatttaaatccgtttataattcagatcgatatttaattataaatctaaaccgatatttaactttgtttaatcatataatctaatcctaaaaaattcttatataaactcaaccaatatatcatttcgttttgatagtggagtatattttataattaaatgaattttagttttattagctagctgattatgattggctaaaatagaaagagtaaagagtgaataagaaggttcatttttggttttcaaattatccatctttattttttgtcctggatactggataggcctttatctttcattcttggggtttcgcatctcttccactaatttatttgagatggaattccattgagaatattcgtctcttctttctttcgttctcaattcccatcccatattccccatg

SEQ ID NO: 19401 - DNA, 3003 bp, Unknown; identical to SEQ ID NO: 19400
  misc_feature (1)..( 3003): 2750-1469P.txt file - cDNA_ID_1821724; gDNA_ID_2926174; Annot_ID_140233

SEQ ID NO: 19402 - DNA, 3003 bp, Unknown
  misc_feature (1)..( 3003): 2750-1469P.txt file - cDNA_ID_1821724; gDNA_ID_2926174; Annot_ID_199704
tttaattaattttctagaaaaacacacatattaataaaacatataaaactgattataaatgtattaatttttgtgatttacaattttttataattttaaaccaatgatattcaattatttgtcttgaaatttaaaattcatcaataataactaataaatagtgcataaaaaacttaaaaaattaaacaatattgttttctaaaagatcaagtaataaggaaccgaaggagtactaaatagtgcatagaaacctaaaaaatcaacttttttgaaacaaatttttttcctaaaaaatcaaataataaggagcaaaaggagtataatctaatctctaaccgatatataatctcatttaactataaaatttaaatcttaatcttctttgattaacccaaaccgatatataatctcatttaattacaaaatctaaaccttaatcttctaattagaaactcaatccgatattaaacccgtttaattgtaaaatttaaattttaacaatactttttaaatttaaactgatatttagttttgtttaattgtaaaatttaaatccgtttataattcagatcgatatttaattataaatctaaaccgatatttaactttgtttaatcatataatctaatcctaaaaaattcttatataaactcaaccaatatatcatttcgttttgatagtggagtatattttataattaaatgaattttagttttattagctagctgattatgattggctaaaatagaaagagtaaagagtgaataagaaggttcatttttggttttcaaattatccatctttattttttgtcctggatactggataggcctttatctttcattcttggggtttcgcatctcttccactaatttatttgagatggaattccattgagaatattcgtctcttctttctttcgttctcaattcccatcccatattccccatggcagcttctttttgcggcagccggagatacgatgttttcccgagcttcagtaaggtagatgtccgcaggtcattcctcgcgcatcttctcaaggagctcgaccgcagattaatcaatacgttcacagatcatggtatggagagaaacctcccaatcgacgctgaacttttatcggcgatagcagaatcgaggatctcaatagtcatcttctctaaaaactatgcttcttccacgtggtgcttagatgaattggttgagatccacacgtgttataaggaattggctcaaatagtggttccggttttctttaacgtacatccttcgcaagttaaaaaacagaccggagaatttggtaaggtttttggaaagacatgcaaaggtaaaccagagaatcggaaactaagatggatgcaagctctagcagcggtagcaaatattgctggatatgatcttcagaactggtattttcttttccattccaaccctaatatatatatgtgcctgtgttcaattttggggtgcctctttaatgacaaaattgactattgttattaggcctgatgaagctgtcatgattgagatggtagctgacgatgtttcgaaaaaactttttaaatcatcgaatgatttcagtgatatcgtcgggattgaagctcatttagaggcaatgagttcaatattgcgcttgaaatctgagaaagctagaatggtcgggatttcggggccttcagggattggtaagactaccatcgcaaaagctcttttcagtaaactctctccccaattccaccttcgtgctttcgttacttataaaagaaccaaccaggacgactatgacatgaagttgtgttggatagaaaaatttctgtcagaaattcttggtcaaaaggacttgaaggttttggatttaggtgcggtggaacaaagtctaatgcacaagaaagttcttatcattcttgacgatgtagatgatcttgagctattaaagaccttggtgggacaaactggatggttcgggtttggaagcagaattgttgtgatcactcaggataggcagcttctcaaggctcatgatattaacctcatatatgaggtggccttcccatctgcccatcttgctcttgagattttctgccaatctgcttttgggaaaatatatccaccatctgattttagagaactctctgttgaatttgcatatcttgccggcaatcttcctttggatcttagggtcttggtttggccatgaaaggaaagcacagggaggagtggatagagatgctgcctaggctccgaaatgatttggacgggaaatttaagaaaacattgagaaattacctgcctgtgatacggaagcgcgtttccaatgaagaagggggccgtgagaaattgaaaaagggaaataaaaagttggatttggatgaggagtttcctggtggagaaatttacagtgatgagataccttcgccaacatctaactggaaagatacagatgactttgattcaggggacatcattccaatcattgcagacaaatctactactataattcccaacaggaggcactcgaacgatgactggtgttctttctgtgagttcctcagaaaccgtatacccccgttgaatccctttaaatgtagtgccaatgatgtcattgattttcttcgcacacggcaggttttaggcagcactgaggctctcgttgaccgcctcattttcagtagtgaggcatttggcataaaacctgaggaaaacccttttcgcagccaagctgtaacatcgtacttgaaggcggccagggatatgacacgagaaaaagaatgcatacttgtgttttcgtgccacgacaaccttgatgtagatgaaacatctttcattgaagccatctcaaaagaattgcacaagcaggggttcatccctttgacatataatcttttgggcagagagaacctcgatgaggagatgttatacggatctagagtcggtatcatgatactttcaagtagttatgtttcttctagacagtccctggatcacctggttgcagttatg

SEQ ID NO: 19403 - DNA, 3003 bp, Unknown
  misc_feature (1)..( 3003): 2750-1469P.txt file - cDNA_ID_1821744; gDNA_ID_1971822; Annot_ID_58356
tttttttttgtttcactgagaaaatagtcagtgagagtaaaacagatctacttgaatatatataaggaacatcggataccttacctttcgccgacaacttcccttctatttgcactagaatccgcaattctatagcagcagagcagatctgtaatcaaataaatattttaatcaatctctcagaaactttactttatacgaaatttgcagtttatatatactgtacaacaatcatttcgtttctcagtttattgaataaaacgattaagaattttgtgggtcaaaaaggaataaaaacaaaaagtaaaagatgatcactttcttttagatattggttttgctcttttattcacttttttttttctgtgactagtgaatctctcttttgaaagagtgggagaggaaagagttttagaacgtatatgagagaacctaatttttgatgttacgtatttacccttttattttaaacattgttaatcattcaagttgggaggtaggggtatattcggtaatcaacattattttttccgtctttatgaatctttggacaagtctttttcctcttacaaagggtatttcaaatgtactttgagtttatttactctgtaataacgtactttgaattttgtttagttatatgtacacttttgtcttatttatcgtatagttttttgtattatccagttccaactttggaatataaaatgttttaagaatatgaatgttcatagttaattaggtacatagtggttagagacgttaaaaaagcaaaatcaggggttaggtcgctgatcaaacctgaatatgaaatggttggagagcatttttaagctaattcactcatcattttttttttaaaaaacagattgatcttgaggtgttccaattttgaaaattgtacaataattcagttgaggattttaaattttatattcaaagtgtttgatgacctaacacattaatgaccataacaatactggtccacaaactttgtttgttgttatctccataatgataatgtgatgtaagagaaacggtcaagtttgttatgagttttttcatttctacttttccaaacggatttggttcaatataagaagattacacaaaaatttggaacaacaacacatcactaaaccagcaccatagaaaatcaaggctgatccagattatttttaaagcagataactcggaaacaaaagaaagaaagatcaacaacacattccattggaaataagacgtataacaaaatgttcataagccaacatcatatgccaagataagaatcacacttgaagacttaacacaactcttgaaaacttctcaccatgatatagaatttgacccacggaggatcaaccaattaataacatttacctacaatatctcaaaaacccctattgcatgatatcgtcttatttcttgattttacctccaacgcgaagggcatggtcatggttccctcctcccattgattgtcctgcctatctagctgccttctcttgcaatgccctcgcgtctctacaccacaagaaaaatgatacgagactatggttagattgattaggccacggttaggacgttttaattaattagttttggtgttatgggtttcttttaatcatgggttttggaagttttacttttagaattaggtttgaggtttctttttacacaatgtattgtggcctatataaggtctcttcttcttaatgaaagaaccaaactccaacagttagcctaattctctaagagagagttgggttaaaaggaaacttttgcttaaaaactttggtccataacaagaaaccaacaatcgtccaatctatctaccaacattaccaatttcacatccttaatcaacaatacgaaacaaaatataattagctcatctaaaactaacaaacacaaataaacctaaattatcaacaaaaatcaacaaatttaaagagcttccaaggcttatgtcgtggtttatccattcagtctaccaatacaaatatcgaaatgaatctaagatgaacgtgttttacaaaatatcgtgataagccgttttttgtattgataataataaactataatactcaacttcttttatatacaacatcaaaccaaggaaacgtatgtcaatctagatttaacatcacaaatcagcttaaaccaaggagatatccctccgaaaccatgttacaatgcttacgattcaaagatgaaggagaaactcagtggacaaaaggatcattgaaaaacatgttcccaaccaaccatgacacaatcttggtcacaaaggtttaagtatcaaacattttcaaagaaaatgttgattggcattcgatacggaaacatgagtggacacaaatttaatatcttgttgagcaaggaaaggagattattaagatatgcgaataaatatcgtgataggcaagtaaaaagtaaacaggaaacaaataaaaaaatatgggtagcggtgcaggaaagaaataccaaataacttactcgattaaaacctaataaactcagaaaatcataaaatttgtctcaaattaaaatctaagatctctgtaaatctaattcattcattcgaattagaagcttctttattcatctattcatcatactctcatcaaaatatgcgaatttgattttaatttctatgtgtttatcaatcgattttgagaaaaaatcacatagacttcttagtttgagagaaattttgaggattttatgagcttattaggttttaatcgagttgtttaacgtttttctatgaattagtaaacattgactaaattttgggtcaaatttgttgagtcaacggcaatttaaagattaaaattgtgcacgcgatagtgcttattttaccgcctttgtggccctgttaattcacgaggcccatatcttgaacagcccataacaatgacattatcacattaagatgaaataagctcaattaagggagttgaaccagcacactctttcgtagacatgtagaaaacgatg

SEQ ID NO: 19404 - DNA, 3003 bp, Unknown; identical to SEQ ID NO: 19403
  misc_feature (1)..( 3003): 2750-1469P.txt file - cDNA_ID_1821744; gDNA_ID_2926156; Annot_ID_139537

SEQ ID NO: 19405 - DNA, 3000 bp, Unknown; identical to SEQ ID NO: 8639
  misc_feature (1)..( 3000): 2750-1469P.txt file - cDNA_ID_1821748; gDNA_ID_1971822; Annot_ID_58355

SEQ ID NO: 19406 - DNA, 3000 bp, Unknown; identical to SEQ ID NO: 8639
  misc_feature (1)..( 3000): 2750-1469P.txt file - cDNA_ID_1821748; gDNA_ID_2926156; Annot_ID_139536

SEQ ID NO: 19407 - DNA, 3000 bp, Unknown; identical to SEQ ID NO: 8632
  misc_feature (1)..( 3000): 2750-1469P.txt file - cDNA_ID_1821756; gDNA_ID_1971822; Annot_ID_58353

SEQ ID NO: 19408 - DNA, 3000 bp, Unknown; identical to SEQ ID NO: 8632
  misc_feature (1)..( 3000): 2750-1469P.txt file - cDNA_ID_1821756; gDNA_ID_1971822; Annot_ID_176229

SEQ ID NO: 19409 - DNA, 3000 bp, Unknown; identical to SEQ ID NO: 8632
  misc_feature (1)..( 3000): 2750-1469P.txt file - cDNA_ID_1821756; gDNA_ID_2926156; Annot_ID_139534

SEQ ID NO: 19410 - DNA, 3000 bp, Unknown; identical to SEQ ID NO: 8632
  misc_feature (1)..( 3000): 2750-1469P.txt file - cDNA_ID_1821756; gDNA_ID_2926156; Annot_ID_198432

SEQ ID NO: 19411 - DNA, 3003 bp, Unknown
  misc_feature (1)..( 3003): 2750-1469P.txt file - cDNA_ID_1821770; gDNA_ID_1971822; Annot_ID_58348
cagttggtatgtttgcgaaatccttttgtgcctcatcacatttcattagtatcatgtgatcatgtcaaaagtctagctaaaccatggctaatacttcgtggctttgaatagtttaagacattttttctttctgttttgtcatctattggatcgctttgcaaatctttatagactaacatttaaaagaactgcagacatgtgggcagttggagcgatactagctgagctttacgctttaactccgttatttcctggtgaaaggtgaattcatttccctttcaaacgatactagctgagcttaatctgtgtgcacacttaagatagaccatttagtgaaaactgatataatgatttctttatgagtagtgagatagatcaattatacaaaatctgctgtgttcttggcaagccggactggaccacgttccctgaagcgaaaagcatatctcgaattatgagtattagtcacacagaggtaagagttcttaatgaaaagataagaggcttattatattaactgcacttcaatattgactttgttctttgaatatcttgtgacagtttccgcagacacgaattgctgatttacttcccaatgctgctcctgaagctattgatttgatcaatgtgagttcttgtgttcactctttttgcggatatttcttaccattcttaagaatgttgtgatctttcaatatctttatttcgtatatcatctgtttctttttttgaatcaacagcgactttgctcatgggatccattgaaacgaccaactgctgatgaggcactaaatcatccatttttcagtgtaatttgaatattcccttgcttcttttgattttatcacacactcctctctttgtaataatcgaaaatgtaatgatatattcggaacagatggctacgcaggcttcatatcctatccatgaccttgagctgaggcttgataatatgggtgaggctttatttttctttgttaatctgcttcgtatagtatgctttcatgaccataagattaagttcaattatatttgtggtattctgcagcggcgttgcctaatcttgagctaaatctctgggactttaacagagaacctgaagaatgttttcttggcttgacactagctgtgaaaccaagtgctcccaaactaggtaagtatcattccctcgtgtagagttggtcactagatctgacacaaattgacattgacattgagcatggtttcaaatattgtttgcagaaatgctccgcaatgtatctcaggacatgagcgaggtaagctcatacgcaatgaacgtcacttatatagcattgttaaacttttcatgagttgtaataaatctgttgtttacaaaagcagaattttctcttttgccccggggtcaacaatgatcgagaaccatcaggtgatgaaaacttgagcatatgttgataaaactgcagatttctgttatatttctctgtgaaaggttgttgaatatctctctttgaacatttacagttttctggtctctgctctctcctgatgaaaacggcctccacgcgccagttgaatcatctcctttatctttgtctttcaggtgagattacaagttgtctctatggatccattaatgtgtaaacagatttgcctaatgagaaacatttactgtgagcagtccaatgcagcaacacacagttggacctccacagtcgagtggcttcacaatgacatcatcaatgcaaccgaatatgttggaccgcccgtggatggccgtgtctgcgccgtttcaacaaagtcattacctctgatctaataaacccataccctagtaaaaaaagtaaataacacagaggtttgtcagaaagatttgagtttaaagaacaagatagcaaaacaaaacagaggaaaggtgttagaattttcattttttttgtcaccaatttgttcttaatttgtaaaaatttggtttggctgatgcattttcctctcagagcttgagctctatcaatatcgaacaaataatttccttattcttgtctctgtataatatatgataaaaaaagacattgaaatcttgatgtggcattaccataaagaattacgtttcattaatgttggttctgtcgtcttttaatataaaagtctttaacttgtgaatctgtcttatctacaagaaaatttaagactatatttattatgttaattacgatacttattttaatctatatttagtaaagcgaacaagtcctacaaacaaaccaaagatattgaaaaaaagtcactttggagatagaacagaatataaaaaagattctttaaatgatcttttatcaaaacaagattctaacaagtcttagaaatctcaaaacgaagaacaagtaagaagcttgtagccatgggtggtgatactttcaaagatggtaaattttttgatctttttctttgaactgtgtttgcatgtttgatttaacgaaaaataaattatttttaagatgttgtagatgaagaatcttcaagatcatcatcatcatctccttgttcttgttgtttcaggtatattattatttaatctttatcactaatttttgttgagtatgatcataatcataatcaagaaagtgatggtggttttttttttttttttttggtgtagcagtgatgatttagggtttaaggatgatgtttctgaagagaatttcaccaatttctctaatcatgttactgatttgagaaggagagaaaaagcttaccaagagattcttcaaagtcatgatcttttgcttagaaccagcaaacggaaacttagacaagccagaaatgagattttgaggtattttttatatatatttaaattcaattcatttagggaaaagttgtgtttgttctacttggtgatcatacaaactcaattatgtttttgactattattatggttgatatatgcatagctatactcctggatcatggtctgatgtcaagttgagtgattacaatattccaaaaacgacatcgatcatg

SEQ ID NO: 19412 - DNA, 3003 bp, Unknown; identical to SEQ ID NO: 19411
  misc_feature (1)..( 3003): 2750-1469P.txt file - cDNA_ID_1821770; gDNA_ID_2926156; Annot_ID_139529

SEQ ID NO: 19413 - DNA, 3003 bp, Unknown
  misc_feature (1)..( 3003): 2750-1469P.txt file - cDNA_ID_1821774; gDNA_ID_1971822; Annot_ID_58347
gtagtcactagcggtttctatatggatctcgttgctctgggaatctatggaaaatttgagtacagagaacacgccttttaagctagataatgtgattgagattatgtacgaaatgagagaatgaagaaaagagacgatggtggtgagagtagctcacaaaagaggaattattagtgatagttttaaattatttctctgtttttgtcgattggattggattgcagagtccactagattgcatgatgcatctcatatgtgaagtgtctctgattaagtgattattttgtgaagttagtgttctcatgtgtgtattttttttctgattaaaaggtaacattatctgtttttgtagtgtttttttcttttttttttcttttgtgatgcattcctgtatgtgtattctgtactcttttgatgataaatacgtggttatctgaatatgttctcagcatgttcaagttccggttccaacaccaaagagtaatgaggtttgcctgaaattagaagctactagtctaaaccctgttgattggaaaattcagaaaggaatgatccgcccatttctgccccgcaagttcccctgcattccaggtattctaatagctttgaagattttagtttctgtatagaagaaagaggttactttgcttagaggtcgttgagtttggaacctttgatatttgttttgaacagctactgatgttgctggagaggtcgttgaggttggatcaggagtaaaaaattttaaggctggtgacaaagttgtagcggttcttagccatctagtaagttttttcagacagacaagtagaaactttaattaccttgaaacatgttaagggaaactgattttgttctttcagggtggaggtggacttgctgagttcgctgttgcaaccgagaagctgactgtcaaaagacctcaagaagtgggagcagctgaagcagcagctttacctgtggcgggtctaaccgctctccaagctcttactaatcctgcggggttgaagctggatggtacaggcaagaaggcgaacatcctggtcacagcagcatctggtggggttggtcactatgcagtccagctggcaaaacttgcaaatgctcacgtaaccgctacatgtggtgcccggaacatagagtttgtcaaatcgttgggagcggatgaggttctcgactacaagactcccgagggagccgccctcaagagtccgtcgggtaaaaaatatgacgctgtggtccattgtgcaaacgggattccattttcggtattcgaaccaaatttgtcggaaaacgggaaggtgatagacatcacaccggggcctaatgcaatgtggacttatgcggttaagaaaataaccatgtcaaagaagcagttagtgccactcttgttgatcccaaaagctgagaatttggagtttatggtgaatctagtgaaagaagggaaagtgaagacagtgattgactcaaagcatcctttgagcaaagcggaggatgcttgggccaaaagtatcgatggtcatgctactgggaagatcattgtcgagccataagagcgttgtagccatctttgactgtctgtgaatgtgataatagatgttaaaagtttgcgtaccgtttacagaatgttttatgttgttttgtttaatatacccgagtatgtcgaaagttacatgaaaagaaaatttggatgaaataaataatacttgttaggtattttagttttaccataccgctgaagttgaaccgaaactgagcatggaatcgaataaaacagacccaacaacatcataaagcccaatagcccattaacgacttcgtcaattcccctatcttaaaaagactttctccagtagaatcttccggtaaataaaacaatagtcgaaggagatttccgtcatttcaaatggtaagaaaaccagaattatttaatatcactctcttaagggaccaccgttgccttccccaccacaaccaaccattttcctccatttttttctttttccttattaatattttaataataatacaaaaatcaataattatcttcttaaatatttaatttaattaattaattatgtatttcgttcttcttcttcttcttcaatttcttctttcttctcccatggcttcctaaacaatctgctattcctctctctcttcttcacctatagtttatctctttttttttgttttggcttctcttaaattcactttctctaaaacataaacgacattgatgtttcttcatcagatcctttaattcttctccaattctcattctccttacatcaatggtgagaatttttttttatagattatgtttttaattcttgtgttcatgtaagatttttttttttttttttttttgtgttttattgttttcttaattccgattggatttgttttttgtttatttttctcaattttatctcaatttcttggacaaattgatctttttttactctacaaataaataaagtttgagactttatagcagaatcttcatatgtagcaattgaagatttttttttcttttctaaaccgatctaaatagattaaatcatcattattgaaaacaaaagattttgtttttattttgattaaatcctttttttttttttttttttttgcagataaactttgtagttggagatttgttgtggatgaagattattgattgcagcttataggaagctgctctttttgttttgaacaatgttgctaacttttcagattcttataattaatcagtcttatgatgagaagttggttcttgattacatactacaatcaagaagtaaacagtttatgcaatcttgtgacggttcttgtgttcaaagagtagatacttgttcttcaaggtggaggttaacagaggacaattgacggggtttttaatcgttgttgtattgctcgaataaacggaatcatggaaaggtttgttcttgttctgttcttgttgttgtttgtatatatattggacatggtgagaaagtgatg

SEQ ID NO: 19414 - DNA, 3003 bp, Unknown; identical to SEQ ID NO: 19413
  misc_feature (1)..( 3003): 2750-1469P.txt file - cDNA_ID_1821774; gDNA_ID_2926156; Annot_ID_139528

SEQ ID NO: 19415 - DNA, 3003 bp, Unknown
  misc_feature (1)..( 3003): 2750-1469P.txt file - cDNA_ID_1821810; gDNA_ID_1620662; Annot_ID_47996
aacttatgagaagcaaggagatacaaaagagataaagcaaaccctagtttttgaagattgatctgattcaagaatcgatcaaacaaaaccctcaattaaattgactcgtgtgaagaatggaggagaagctttaagagatgaaatcgtttaccgattttagaaagtcgattgtctcactgagacaaaaaaagagaggctttttatttttaatccgataacgagttaaaccaaagtgaactgagtcaaaacgtttccgatcatgtatacgtggcacattttcattggaagagatgattggttgttttgcatttttttttttcttgttctctcccttgaagttgaagagtttaacttcgctaagaggaacagagatggacttgagtttaatatgttctctgtttctaacaaatgtttttttttttgagttttcacatacaataaaaaatattaaaagttaattataatttataaatgcattattatttgtaatttacgatttaccattttctataaccttaattaatatagtatacaattatttttcttgaaatttataattcatcaataataactaataactattgcattggaaccaatttttttcctaaatatattatttaggaatagaggagtagttgtttttggcaaaatggtagattattataaatctaaagtggtagcagttaaatttgaaaaagatggatggcatagtaactaaaaattatttaccacaataccttaaaaaactatgaagaattgattaattaactaacagactaattaaaacccatatttgtcctttgaaattataattttaaataattttacgaaacctatttaagattacataatattttttttataaacaataacaccttttaaaattattaaaacttattcactatccagtttcctagtttttatatattttgaagcaataatgttgtgcttaaaatatatgacatcatagtgacaaaagagtttatttgtgaaatctcaatcactcattttgaaatgccattaatccgtttagtttccatattattaccaaagcctttcatgtaattggaaacttttgtgtttaagacttaatcttgtgttgcaggagccaaaagaaaaagaaaaaaacaaaaacaaagaaattgtaaagaagtgtaactagaaaaatcgatcactcatcttcaaatgtcattatccatcaagttgtcatattattgctagacagaagtggtcgtctagacttagttgacctgaaaaaagaatagtcaaagtcttttatatgtggacctgaaattagactttgtagtttgtacgtaagtttgtgttgctagagcctatatgagaaaaaaaaaacagtggatattggtgattggtttaatctggttaactccggttatctagatactggtttaatatcatttatcttgtgtatatataaactaaactttagtttattttgttgatgaacgttgtaacaaacacttaattctgttaataaagattcagtttaatctccgatcttttctcttcttttccgttttaccggaacttcgccggtgttaatatggtatcagagcatatcatttgagcttccgcatatcatcggagatgagtctttcattgaatcatctttctcttatgagagtttttcgattcctacaatcgtttgttgcaatttgcaatttcttcgtcagctatctaattttggttctgattcttcttctttccttcgattgaccttttgtggtgacgaatctcactttcttttcatttcgtctcactttctttgatttttctttaacaatttgttaagaatgggttctatgaacaatccgttgaattcttcaagtcttcgtccacctccagctagtgttcctgaacaatcgcgatatcaagctgatcaatatgagaatccgcatcatttgcatacgagtgaccacgcaggtttggttctagtctcagaacgccttaatacagcttcagatttccattcttggcgaagatctatttggatggcattgaatgttaggaataagcttggattcatagatggaacgattgtgaaaccaccattagatcatcgtgattatggtgcttggtctcgttgtaatgatactgtgtctacttggttgatgaactctgtgtcaaagaaaataggccagagtctccttttcattccaactgctgaaggaatttggaagaatatgttgtctaggtttaagcaggatgatgctcctagagtgtatgatatagaacagagacttagcaagattgagcaaggttctatggatattagtgcttactatactgaattgcagacactttgggaagaacataagaattatgtggatcttccagtgtgcacttgtggtcgttgtgagtgtgatgctgcagttaaatgggaaagattacagcagcgaagtcatgttactaagttcttgatgggtttgaatgagagttatgaacaaactcgtaggcatattttgatgctaaaaccgatacgtacaattgaagaagctttcaatattgttactcaagatgagagacagaaagccatacgtcctactcctaaagttgataatgtggcgtttcagactgtttcttataacagtggtgatccttatatggagaatatggaaaatggattcattgcggcttataatacagcaagaccagctcaaattacctctgtgtactaactgtggaaaggttggtcatactgtgcagaagtgttacaaaatcattggctatcctcctggctataaggcagctacatcatacaggcaacctcaaatacaaactcagcctagaatgcagatgccacaacaatctcaaccaaggatgcaacaacctgtagcagcacaaatgcagacaaacatgccaaatacaggaccaatgcagatgatcccttatgcaaatcaaatgcagatggttccatactcgaattcaatgcagatggcgaatgctgcttatgctgaataaggttcttttgttccaatgatg

SEQ ID NO: 19416 - DNA, 3003 bp, Unknown; identical to SEQ ID NO: 19415
  misc_feature (1)..( 3003): 2750-1469P.txt file - cDNA_ID_1821810; gDNA_ID_2926151; Annot_ID_139330

SEQ ID NO: 19417 - DNA, 3003 bp, Unknown
  misc_feature (1)..( 3003): 2750-1469P.txt file - cDNA_ID_1821821; gDNA_ID_1621151; Annot_ID_56883
ggaactcaaacatagtcttctgagagtgatatatagagttttctgatcatcttcaagtgtgaaagtaacttgtcaagagtcttgttgaatcttagttgtgtgtgtattgtggtgtggacaggttttaatgagacgacagatgcgtgttgtgggctagggaggtacaaaggatggcttccatgcatctcgccggagatggcttgctctgacgcctccggtcacctctggtgggaccagtttcatcctacagacgccgttaacgccattctagccgacaatgtatggaatggtcgccacgtggacatgtgttaccctactaacctagaaactatgcttcattcttaaatcagctgagaggataaaaatgtacataaaaaacatagtaaattgtaaatgaactttgcaattttgatgtttggtccatggtacataaaggaaaactataggtcttttatgctaaagaaagaaagtacggggttagagaagaaaaaggataaatgttttacaaagttgggctcaatgtatttacgtaaatggcccacatgaaacagaaagttaagagattcgacccataaaaagcacgtgtggtttataaatggaaaatttcatcttcagggagacgaagacataatttcaattcttttctcatcaaagtttctaaaacaaaaatcttggcctaaagaggtgacgtcatctccaccctctcgtaatttttccaattttgcccttggaagctgcttcgccttttttttcaatttcatcaagggttctgagatttttttctctcagcttcttcgtaggtttttgatccgaggtaggtaggctttgggtttacaaaaatttcgcctcgattttttgttctcacgcgtcgttcttgttacaggaaatcgatttcatctctgatcatctttgtgacgaaggaaatggagctcgattttgacgctagtaacttggttgaagatgaagctgttgaagttgaacataatgttagtgtaaaattgtactttctgggctatttttcttttggttgaactaatcatgggtttacctttttcatttcgagcctggagctttaaaacttgtaatttccggtgaaaatggttgtttatgtagctttatagttagaatcatgaacataagttgctatgtcaaccatttcatttagtttgtgtcacgtttcctggaacatatgtggtttttaatctcaaggatgagattttaataaactgtgtttgtgcattattgcttctcagtgttgattttaatttctttgaacagggtatgactgaaattgaaggggaaagatgtggaatttgcatggatataattattgatagaggcgttcttgattgctgtcagcactggtaaaagcttgttttcgcttttcattgtctttaaatattgcaaagttgctatgggtgtttgttaaggagcagtctggtaatttgtgtctatgtctgttaaatttcaggttctgctttgaatgcattgataattggtctacgattatgaacctctgccctctatgtcagagagagtttcagttgattacatgtgtccctgtaagatgtctcatatttgttttttgttttgttttatctgaacatttgtcatgatttttgtaagtagaacttttgagtttaggaataatgagtttttgttttgattatgaaggtgtttgattcaggtgaaagcagcaaggtcgatgaggatttggtatcagggtactatttttttccttgtgtttgttgttgtgataaagtttgcttgcctgaactatctgagcggtctctttgtcctcaattatttgtggcctataatgataaatttatattaagtggcatagtataatcaagtgatttaaaatgtgatagatgtcatgtgtaccatatgtttctgtatttgctaaaaactgttgtgatctgctgacgttaaactaagcaatacatgcagagatgaagattgctgcattgaggaggagactgatgtcgtctcttctccgtcacactatattgacgatacacactatattgatgaaaatgtaagtatatcatatatgggttttcctagttactacaaagtacattaagctttcctaatcattttgtaggcagttgtctgtttagatggagatctttgcaagattcgtaacactttcagttacattgaaggggattcaaaccttgatacatcaattgcttgtgattcgtgtgatatgtggtaactattattacctgttgactttatctatggtttttttttttgtacattgtcgtgattgttgtttttacctcttttttctatcactaattcattgctggtgaacttctggagcttgccttgttgttacagtgccataatgtttgtgtctaccatgcttttagatggattttgtgtctaaagcttagttgtgctaccggtttctaaatgctatcactatcagtctatcacatgaaggaattttgtaatatgaaatgtaaatggcaaagatactagccttttcaatcttttatatgtacttgcttttgtgtacttcgtattgttttagattgttcatcattacagcattctttcaaattagcttctgactgttgctttcaactgtgctaacaggtatcatgctatttgtgtgggttttgacgtggaaaatgcatctgaggatacatgggtatgtccgaggtaggtttcgttggcgtattgactacctatgattgcttaatccatggtttgatcaacttcagcaccgttgtttcattatattgtttctttaattattagcctattaggcaaaaatatttttatattagagtttccataaaattattttaatctttatctagtaaagacactttgtaccaattctaagtgaaacctaatgcctatacatattattcttcctttctctatcttatttagccatcttgtcatagtttccctccttggttttgtgtccacagatgtctctctaatgaaaaaccacatgaacccgatacctcgccaatg

SEQ ID NO: 19418 - DNA, 3000 bp, Unknown; identical to SEQ ID NO: 3756
  misc_feature (1)..( 3000): 2750-1469P.txt file - cDNA_ID_1821821; gDNA_ID_1620662; Annot_ID_47990

SEQ ID NO: 19419 - DNA, 3000 bp, Unknown; identical to SEQ ID NO: 3756
  misc_feature (1)..( 3000): 2750-1469P.txt file - cDNA_ID_1821821; gDNA_ID_2926151; Annot_ID_139324

SEQ ID NO: 19420 - DNA, 3003 bp, Unknown
  misc_feature (1)..( 3003): 2750-1469P.txt file - cDNA_ID_1821837; gDNA_ID_1620662; Annot_ID_47982
tcagctactatgtgacttgtatgacaaatacagtcgaaacttaatatgatattcggtacccaaatgacaaaaacccacgtacatcaaaagcagagaggctttataagaaatctatgactatcaattttattttttcccataaattatatgcatggtagaaatattatgaaatgagtttccttaactatggttggcaactaaaaatgtctttagtgacaaaaatatgcaacttttctacaaactgcaaatattagtttagattaaatcaaacaaatcatgccttcaaaaatctgtaaaacaaatctttttatttttaacgccggtggcaccatagacgaaatcgacaattttgaaggttggagttggatttgtctgaattttttttttattggaatttggaaagcagctgaaagatgactaaatgcgcagcaaaactcttcattcaggcttggcgtaacttgaatttgttttctttcttctatttttttagtttcattctagtttccgatcaagtcttatggttaaaatactcaattatatactcatcatttaggcatcgaaaacggtcctaacaaaacaccaaacatatattcctaggctttcacgtgtttaattcttacccgcatgatacatttccctcaaatggattgacataatgctattgttgttaactttttgtttgacacaaaatctatctagcaaattttttatagttatagatttaatatacgcaatgttagcttgattttgtttctaacttaaggaaaagttgaaggatgttttaatttgcaaggttctctttcaaaaagatttcgtgtaaattcgacaacggcctcaaacctactctaatcctgactctaaataatattataggttgaaagctttgtaattattgtttactaaaataagagaagaaaacattattacttactctcctttagaaatatatgtttgcattatgctgtatatatagatgaataaatgccataaacgtttaaatgtgtgttggtagatgtcattttacttcattcttagaggtctcttctatcaaatttagttacgtatataaatatagatgtcttgtgctttcttgcaaggaaataaacagagataatatactatttcatacacatccacacacatatagatgtctttttgtttgttgcatggatgtagacatacatccattcacatttccaagtatatacactaacctaatgacctaatgttcttgagagagacttctttcacaacctcttctagaatgtgagtttcttatatttttgttggtataaagtatttgaacatctttatcaaaagttaaaatgtttgaccatattcttggtaattcaaccggtaagtaaatgttattcttctatgacagaacccttaattttgcctgttgtatactagaggtttggttgggtgaaaagtgggcatgataaaaagaacaacatttagttttcctccttgatttttctaaattagagtttcgtatcaaaatacctaaaaaagcttgttttgtggtgcttccaatttcgaaatcggctaaactttttccacatgatttcttcttttacgatagtaagatttagaagaaaataaaaactgaataacgtcagattttccttaataaaagaagaagaaaaatctcacaacattttaagttcctttatttttttgatatgtgccctaataaatgcagtgaaataagctcacaacaaaagatgcacaacgagataaagccaaatgaaatttagtactggtatacaaattttaatgacacgttaatactctttttcgttttggttttataatcgtacttaatattcataactagcttcgaatctggtatttgtatacttaaaaagcttacatcagccaatctactatcattgaaattgtagtgagaaaatctaatataattctttagtgactgtttgtcaaaaaaaaaaaaaactcatgtctaaagtacataacaaattcaaattttgatacaaaattagttatttgtatttgttgtgaccatttctattctacattttgtttgattattagttgaattattcttagttaaatagagcaaacaaattaaattaaatgatttcttaatctataattactgtaaatacttcaaacatcttttaaatagaaacaaataaaataattactaagacatttgtccttatataagtctaataaatgtgtgttttaattcaatacctccaaaaataatttcaaaaaactagagttactgaattggtgctttcacacggtgcatgcattgtattcacacctatatgcatgtcatatattcatggtctctatgatctcgctctatataaacaccacccaatcgaccaaccttcttctctgattattttctcaaattatttaattaatttcttcttcttcatcaccaccaattacactcaaaattatggtgtttgcacatttgaaccttcttcggaagattgtggggattataggttagtccagaattttgacatctacaagttattatatctatcatgatttttttgtcccttcttcttaactttggatgatcttgtttgcaggaaacttcatcgctctatgtctgttcttgtcaccaacgtaagtattttgctatatctatgatttaaataaaattccagaaacaatgaaagatacgtgaaaaagagattcataaaaacgaaaatcgtatttcttaaagaaaaccaaacttgtttcatgaatttaacacatgcatggttcatcctgactactgaaagatctgaaattttttgtttttcattctcactgcagctttcaaaattttctttgtgtagtataatcacaatgtgaaaattgatacttttttcctcataatataatgttttttcctattatactaattgataacaattaagaaagtttatttatgtaatagagtttcttccaaaacaagagaaaaactaaaagtatgtatcatcaataaatgactaatacttttaataaatg

SEQ ID NO: 19421 - DNA, 3003 bp, Unknown; identical to SEQ ID NO: 19420
  misc_feature (1)..( 3003): 2750-1469P.txt file - cDNA_ID_1821837; gDNA_ID_2926151; Annot_ID_139316

SEQ ID NO: 19422 - DNA, 3003 bp, Unknown
  misc_feature (1)..( 3003): 2750-1469P.txt file - cDNA_ID_1821868; gDNA_ID_1971821; Annot_ID_58327
aattcatatattataagtcaaagctttgtttatacataaatctatcttatttacacaaatcagcttcgtttgatccaactaacatgtattaagtattaacattagtagaattctctgaacataacttaaaatcaaaacttgtatctactaattatgggaaaatagtctcaaattgaatctgaaaaagaattgcaaatttttaagaaaaataaagaaactaaacatcaaagtgttggtgtgttgtgttaatttgacttcttttttctctgttagcaaaccattgagcagtttttctagcgatcggcagccacaaacgccgtcttctctcctccgtctcattcccaccgttttgtaacgcagacgcagtctctgcggctgaaccgctgcaatctccatgaatcgatatactgagtctaggaaccgcagtgatgtcagacaccgatcttcgtcctggttcgatcataacgcttcttgatttcgaaccagagtctccgttttccgaggaaaacatagttgtcatcgaagttaacttgttctccaacattctcttcgcttccatctcttccttgattcgcaagatacctatctgatcctcttcatctcctctcttcacatgatccaatgaagaaaatctctcgctagaaatcgaattaaccatctcggaattcaaaaacatcaaatctgatgaactcacgttgctccaacgattcttgaaaacaacatccgacacaacgatcctatgattgaacttgtgcataagcttcttctcatctttatcgttcacgtgttcatcaagtaacgttttttctttattacctaatttcagaatcttccggaaactctctccgatgctgaatctcgacgacccactaagttcttctctgtgtattctttcttcttcttcttctctctcgatgtaaagctccaagctcgaatcttctctaatctcagactgattcaagaacctgaaactgtttccgttagtgagaacagaggaatcttcttccattgagactctatctctgcaaagaggacaagttgcgtgttgctcaagccactgatcgatacatccgatgtggaaagcgtgtctacacttaggcaacaatctaagaatctcaacactttcgaatttagacaaacagacagaacaatcaagaccttgttttgatcctttcaaagcagagaatctaaacagaggaagagactcgattgctgttttgtctaaaccagagaatcgatccgatgatgccgttgaccggttaaagaatattccttgtctgagccggcgatcgtgccttcttctgtcgccggaacctgatcggagatcgatgtggcagcacttagcgtagacgaggaggacgaaagtgagtgcgaacatgatggcgagaactccggtgacgacggctaaactcggctcaaaatttgcgacgaggtcaccgtttctgaacggaggaggagtctgggcagaggcataactgtggaggagaggaagaaagaaaaagaagatttgatacatcggagcgttcgagagaaactttgtttcttgatattcttgggtttgaaatagttttattggagatgaaaatgagattatgttagagaaagtgatatttttcggtgtatgctataaactaatacaattacgtcatatacgtgacaacaatttgtatgctattgctttttatctatgctctatttgtcttctactattctctccatttaattaaatacaattttatctttcggtgggctgttattctccgacctcatttttgatgatacttaggactacaatatatatggaacttatttatcattttataaagttacaacttgcgtcacacatttggagtgatatttttgtttagtttttggtctgcgaactattaaaaaaaactacatatataaccaaatctcttttcaattcggttccatatattttttgtcatatggtttaggttatgctatttaacaaaattattttgacgttacttgacttatttatgtctgctcttccttttttatccatacacagtgaatcacatacaaattttgaatacacaatgaatcacaaatatacatatcttgatcgttctctcgagtcattttggtttgattgatgttaaaacaagtatttatataaccgcatgataagctaaagtcgaaattaattactttccaaaacatgtgaacgtccaaccataactaaatctcaataggaggattcgtaccatggttttctaacttcacggtaagtgttttcaagttttcaaccatgaacaaacttgattttttttttttttttttttgtatgaggttatgagaagtcgtttactctccaattatggtttcataatgaatattttcgtttaataaaaactaaaaaggaatgccatggttgtacctagaactactagtttattatttgtgacaaagctactaagtatacttgctagtaataaccatgacaatgttatattataaatgttaatgaatcgtgacagattaactaagaaaaagtcaacgaccagctgcacaaaattccggtgcggcaaaataaagtcaaagttgcattactcatgattggcttcgatgctttactatttgtgaatcagagagaacctcctctacaatcagaaactttgctttctgcgaatggacctgcaacactcaacaatactttgggcctcagtcaaagtgtcaagcccatcaacctcaagtcttctctaccttgcaacggtaacaagattcctcaatttccagcgcatcaacgtacgggattcacagctaatcatttgtcccttcataacaaatttgatcctctttgttcctctgtcgtgatgtgcagctaatgacgtgtgacctagtgtctcaccattttggggttcatatataaactcttctctgtcattgtaaaccttaagctgaaatattcaataaagagatttctcttcatcatcgttttatcaatactttcatggtatcagagctcagtcgaaaatg

SEQ ID NO: 19423 - DNA, 3003 bp, Unknown; identical to SEQ ID NO: 19422
  misc_feature (1)..( 3003): 2750-1469P.txt file - cDNA_ID_1821868; gDNA_ID_2926193; Annot_ID_141165

SEQ ID NO: 19424 - DNA, 3000 bp, Unknown; identical to SEQ ID NO: 3772
  misc_feature (1)..( 3000): 2750-1469P.txt file - cDNA_ID_1821876; gDNA_ID_1620664; Annot_ID_48028

SEQ ID NO: 19425 - DNA, 3000 bp, Unknown; identical to SEQ ID NO: 3772
  misc_feature (1)..( 3000): 2750-1469P.txt file - cDNA_ID_1821876; gDNA_ID_1620677; Annot_ID_164271

SEQ ID NO: 19426 - DNA, 3000 bp, Unknown; identical to SEQ ID NO: 3772
  misc_feature (1)..( 3000): 2750-1469P.txt file - cDNA_ID_1821876; gDNA_ID_1620664; Annot_ID_163883

SEQ ID NO: 19427 - DNA, 3000 bp, Unknown
  misc_feature (1)..( 3000): 2750-1469P.txt file - cDNA_ID_1821876; gDNA_ID_2926203; Annot_ID_141615
tttattagcaaagagccattgacgacaccagcggtgaagtatgaaacatcaattttaatagcaaggcatgccatccttttctatcacatattttatcataaaaaatcgtgggaattgaaccgttacatatagacatagatttgacagcccaatcacatatcacagacacgaatacatataactagctaggttccctcaactattcatttgacttctgaaaaatggtcatctctcgagttctagttaatacaagcctatgatcataattagggcatatggactataatccatcagttgtattctgtctatggtagtcaaattgtaaggcctgatctttgggttttgcaaactatttactagaattgtctagcattttttcctatgatgtaggataaatcacccttataaagggattaaaacgtttcagaaacgtttggaaactaaactacaaagggattcagtaatttattcaatgcttatttcgaacaatgatgatagcattaagatcttacagccgattaaatttgcccaaacaatgatgatagcattaagtttttaatcgatatgtcttcgatttacattgtctattgtatacttacaaacttttatgccatatgaactgttttcttatattaaagattgaaaatgttttatggggaagaagattacatgattggataggaatcttgaatatctctacaaaaacggccttgtttctaatcaatctatgccaaagtcaatccgttttttataacccaaattagctataaaacctactgctatataaactggatgcaacgggacaaccaaatgcattatgtagttttccacttatcgaagaaatgaaattgataatgtgagacttctgtagcagaaagctcatcatgatcaagccttataaaacatttcaaaatctaattcataatgaaaatttgcctagccatttaactagctagggccattaggcccaatgtccaaatagcctgaacgctgggaaaaagtggggctttcggaacagaacaaataaaatttgacgcactttattgtgttgcaagctacttcttgaagtatatattttgattctcgaaacgtcttcagttctgtacaaatttaaatattctattgaaaaagaaatcttggtcgtcgtcgtcgaatcggatacgttaacgttacgacatacgagtcaccattagggccgtagacgaaatactaggagacgcatgaaggtcacgtgtatcaccgttgcagcacataagttttcacctctcagtattgaacatgcgccgtatttcaatttcaagcttataagaatattattttctgttttgtctcgtcacgtagaagaacactcaacacaacgggtcatataaaaacaatcaattgaccaattgaaacacttaccattagctttactaaaacaaaaagtgctacagctcaattatttcgacgtactttttttttttttttttttggtcttttgtggcctatttcgacgttctttaaaaccacgatcatagtggtttgggatatagtaattaatttcatgtgtttaaccaaaaggtaggaaaagtaattaattattagttgttgagaaatcaagttgcaaaggagattaccggcgactccgttggtttatgaaacaaacaatgagacggtttagaatgacggtggccccaatattttaggtctgctcatattattttgaatgatttaattttttttatttaaataaggtacccttatatacataaatgatttaatttagtaaaagcttttgtttatattgcttttatacaagtttttgggtatgactattttaacctcaatcctcaaaactataaaatctattattgcacgcttggattttatatatatatattcaatctataagaactaaaaaataaaagtgatcatagtcaaataatttttgcataaatacttaatattgctacccaaaaaaaagaaaattgcataaatttatgtataattacattatgaaaaattattgatatgttgatatacagttttctaggaaatatcaatatgaaaagaaaaaaagaaaaaaaaacattgtaagctatttcccttgaattacactatatgtatgtgtgacagtatatatgtgtgagcttaatcatataattaccgtaacatcactattgatcttgaaagttacgacgacaaaaacaagattccatcatagatctacgtgtatcttttgtgtgattagtatataaccaaagcgattaagtgaatttaaaatttgtagatatttcttacttaactgattatactataagaagcaaaccccaaaaccatctgcatctcaacgacgataatcgtccgaatatgtttttctaatagagtttgctgaccaaatgcaaatggcatcacgtctcttgccgtttgacgctagcaattacacttcttcattgaaactttaaaagtgaacccaaagaattaactcaataataactgatgagtatacaaattattgtttccggctaaaaacctgaaattaactcaaatttggaatggggatattataactttgttcccacgtataacaaattagttcataattaagaggagaatcacaaaaataactgatgtattgatgttcaattttggaaaattaagatatttccaatggtaataatctgttacagccttactgggagtagtatgatactaaaacagtaaatgcattttagaccgacataaacaataattaagaagaagaatgtttgggtcaaatctcaaagttagatattatttttttgctttttgcacaagaaaacagaaaccaaaaaccactagtcaaaaaaccacccatgtattcctcctagtctctaatccaacaactatataaaaacctctcccattctcattttgttactcatcccaaaaataaaaagagtatatctctcacacacatacacaaacttgacagttttttaatttctctgttagtgaactcaaaccttcccatttccaatg

SEQ ID NO: 19428 - DNA, 3000 bp, Unknown; identical to SEQ ID NO: 19427
  misc_feature (1)..( 3000): 2750-1469P.txt file - cDNA_ID_1821876; gDNA_ID_2926203; Annot_ID_202007

SEQ ID NO: 19429 - DNA, 3000 bp, Unknown; identical to SEQ ID NO: 3774
  misc_feature (1)..( 3000): 2750-1469P.txt file - cDNA_ID_1821880; gDNA_ID_1620664; Annot_ID_48026

SEQ ID NO: 19430 - DNA, 3000 bp, Unknown; identical to SEQ ID NO: 3774
  misc_feature (1)..( 3000): 2750-1469P.txt file - cDNA_ID_1821880; gDNA_ID_1620677; Annot_ID_164269

SEQ ID NO: 19431 - DNA, 3000 bp, Unknown; identical to SEQ ID NO: 3774
  misc_feature (1)..( 3000): 2750-1469P.txt file - cDNA_ID_1821880; gDNA_ID_1620664; Annot_ID_163881

SEQ ID NO: 19432 - DNA, 3000 bp, Unknown; identical to SEQ ID NO: 3774
  misc_feature (1)..( 3000): 2750-1469P.txt file - cDNA_ID_1821880; gDNA_ID_2926203; Annot_ID_141613

SEQ ID NO: 19433 - DNA, 3000 bp, Unknown; identical to SEQ ID NO: 3774
  misc_feature (1)..( 3000): 2750-1469P.txt file - cDNA_ID_1821880; gDNA_ID_2926203; Annot_ID_202005

SEQ ID NO: 19434 - DNA, 3003 bp, Unknown
  misc_feature (1)..( 3003): 2750-1469P.txt file - cDNA_ID_1821883; gDNA_ID_1620664; Annot_ID_48024
tcaagtatctgaatacaaaaatataagggtatcatcaattgattttgtgcatcgacactatacaaggaaattatataaacggattggtttgactaagtcacataacgtcaaaatatattaacacacacacacacaccaaaaaaaaaaaatgtttccacaatgcgtttaagtcgtcatttgtatctttggaagaaaacttaaataatagtatgatattttagaattatcttattttttcgttttcatattaataatgttttggtagaatgaacatgaagtagtactatatataatagttacgaagataacattaaataattacttaaacaagcaataaaataaattttattatttttttcaataacaaaatctatatagtgattagcaactaactaaacttggcattgtaaaactttatagttgattactataacaactctaaaacagcttatgcaagtcatgtacagttattagaattcatccaattgacttggctacattgtatatgaatgaagtcaactgcatttgaaataaataaatcttattagcattaaagaactcaaaacttaaaagtcagagcttacgaaaaacaaagtcaaagtcaaaaaacatatgaagaaaagaaaaaggtcgtttacctgagaaacaacaacgtgcctcacaccactgtccaagcctacgtccccgtggccgtggctgtggccgtgtccatgaccggaaacaccacttctcttagagagagcctcaaaaccttcggcacccatggagaggctatgacggtgatgctccgcgtgagcccgcatccccacgatatgcaacgcccctccatcttcttgatctctcagaaaacccgattcaagacctgggtcagacataaccgaaacttgcgtaccaagcgactcgacggactggttcatcatcttctcctgtttcctctcgtagtatcccgtgatcatgaaatccgcgagcagagtaagaagcgccgcgaccatggcgaagaattctggaaaagggaacattttccatggaaactccggcagacatgggtcggacaaagctttggatccgcccgagagcatgtgaacgaaccctgttgcgaggataactcctgctgcgaacgctttggctcccctcattaagccaccgtttaacggaagtagggttccaactagaggaatcgagactccggcagctccggagataaggatcgacgccatagctgcgaacttgagggtaagagcagctgcgtcatctcggcacgggtctgagtcgcccgagtcacagctagttgtgaacgactctgttttgttacatgcaaaaataaattgagttaactttgctaagaaaatctcaaaatttgcatttaagtgtgtttaagagcgaaatgaagtaattgctttgagatttgaagtgacaatacctgtcaaaccagatgataatggtcgaagaaactgccaaaaatcctgaaaacattatgaggcaaaattatgtgaggaaacaggattgaagaagcaaaataacattaaatagatgaagtggaagaagtttcagacctgtaagagagacatttactaaatccgattaggcgattaaacttgtagaattatataaattattgccaaggaaaccagcaagctaagtatatatgggttattaatattatggagttgtctgtgtgttttataaagaaagattgggagaatgtcaatcagtgcgagggtttgtgtgtgcgtgcacgtacgttaacaaggtcacatgaggttcacgggaatcaaatgaccatagaatgtcgtcattttcatctagtaccctcattgacaagaatattaaagtttggaagataataactacgagaaaacaaatatagaattagagatgagatgtatgagaatgttttgttataattgaagtctttgttcgtatcttgcatcagaagtatgactcttgtttggtcaacttgcagaaaaatgactattacaatgcgaaatactagtaatgttttgcgtcttaataaaatttcattcaaaagattatgtaagttaggtttgcattttacagttgattttgtttttctcctatctcatgattctctgttttaataattaaaagttaaaatttagaaaatagccacaaacatattcaaaaagtatatatttgggccaaccggcccagtaagggaagaatgttccttaagttgcctaaatgagcgactgagaaactggcccacaaaggccggacctgtatcattcacaaccggaaaactttaaaactaataaaccaacgttcttaaaaaagcgacactttgggccataatttgttgggaagggaataagtaagaatatgctttgggcatatctgatgatttatatctgtctcatctcatctctcatcgttccgggagaagagaagagagacccatccctcacttcaaagttcaaagtctcgaaggatcttctccaactctctctaaacaagattccaaattttcaaaggtaagcaatcgtttcttctaatgaatttcatttctccggttttgtaagttgagtgatttcgttttgaagaaactctgaatatgataggaaatcaaaattcacagagttttcattcagttgggttttctctgaatttcatcaatgtacttctttcttacatttactttagttgatcaaataaatatccagtctttgacaatagctgattttcagattcgataaaagacttcaaatttcgtgtgttttgattcttctcttgttatggacgtagctgatttaggggggggggtgtgaagataaagtttcgatttctattcatgtctttttggattttgatttgaatttgaagttaaactagagaaaatcagctgaatccttacttgttatatggtatgaaacatctacttgatatgtcttgttctgctgaaccaaattatgtcttgaaatcttagctgcttttgtttttgcaggtgaatttgtttgatagaatcaagaacaaacctttaaaatg

SEQ ID NO: 19435 - DNA, 3003 bp, Unknown; identical to SEQ ID NO: 19434
  misc_feature (1)..( 3003): 2750-1469P.txt file - cDNA_ID_1821883; gDNA_ID_1620677; Annot_ID_164266

SEQ ID NO: 19436 - DNA, 3003 bp, Unknown; identical to SEQ ID NO: 19434
  misc_feature (1)..( 3003): 2750-1469P.txt file - cDNA_ID_1821883; gDNA_ID_1620664; Annot_ID_163878

SEQ ID NO: 19437 - DNA, 3003 bp, Unknown; identical to SEQ ID NO: 19434
  misc_feature (1)..( 3003): 2750-1469P.txt file - cDNA_ID_1821883; gDNA_ID_2926203; Annot_ID_141611

SEQ ID NO: 19438 - DNA, 3003 bp, Unknown; identical to SEQ ID NO: 19434
  misc_feature (1)..( 3003): 2750-1469P.txt file - cDNA_ID_1821883; gDNA_ID_2926203; Annot_ID_202002

SEQ ID NO: 19439 - DNA, 3000 bp, Unknown; identical to SEQ ID NO: 3779
  misc_feature (1)..( 3000): 2750-1469P.txt file - cDNA_ID_1821891; gDNA_ID_1620664; Annot_ID_48022

SEQ ID NO: 19440 - DNA, 3000 bp, Unknown; identical to SEQ ID NO: 3765
  misc_feature (1)..( 3000): 2750-1469P.txt file - cDNA_ID_1821891; gDNA_ID_1620664; Annot_ID_163875

SEQ ID NO: 19441 - DNA, 3000 bp, Unknown; identical to SEQ ID NO: 3779
  misc_feature (1)..( 3000): 2750-1469P.txt file - cDNA_ID_1821891; gDNA_ID_2926203; Annot_ID_141609

SEQ ID NO: 19442 - DNA, 3000 bp, Unknown; identical to SEQ ID NO: 3765
  misc_feature (1)..( 3000): 2750-1469P.txt file - cDNA_ID_1821891; gDNA_ID_2926203; Annot_ID_201999

SEQ ID NO: 19443 - DNA, 3000 bp, Unknown; identical to SEQ ID NO: 3768
  misc_feature (1)..( 3000): 2750-1469P.txt file - cDNA_ID_1821909; gDNA_ID_1620664; Annot_ID_48017

SEQ ID NO: 19444 - DNA, 3000 bp, Unknown; identical to SEQ ID NO: 3768
  misc_feature (1)..( 3000): 2750-1469P.txt file - cDNA_ID_1821909; gDNA_ID_1620664; Annot_ID_163871

SEQ ID NO: 19445 - DNA, 3000 bp, Unknown; identical to SEQ ID NO: 3768
  misc_feature (1)..( 3000): 2750-1469P.txt file - cDNA_ID_1821909; gDNA_ID_2926203; Annot_ID_141605

SEQ ID NO: 19446 - DNA, 3000 bp, Unknown; identical to SEQ ID NO: 3768
  misc_feature (1)..( 3000): 2750-1469P.txt file - cDNA_ID_1821909; gDNA_ID_2926203; Annot_ID_201995

SEQ ID NO: 19447 - DNA, 3000 bp, Unknown; identical to SEQ ID NO: 3762
  misc_feature (1)..( 3000): 2750-1469P.txt file - cDNA_ID_1821917; gDNA_ID_1620664; Annot_ID_48015

SEQ ID NO: 19448 - DNA, 3000 bp, Unknown; identical to SEQ ID NO: 3762
  misc_feature (1)..( 3000): 2750-1469P.txt file - cDNA_ID_1821917; gDNA_ID_1620664; Annot_ID_163869

SEQ ID NO: 19449 - DNA, 3000 bp, Unknown; identical to SEQ ID NO: 3762
  misc_feature (1)..( 3000): 2750-1469P.txt file - cDNA_ID_1821917; gDNA_ID_2926203; Annot_ID_141603

SEQ ID NO: 19450 - DNA, 3000 bp, Unknown; identical to SEQ ID NO: 3762
  misc_feature (1)..( 3000): 2750-1469P.txt file - cDNA_ID_1821917; gDNA_ID_2926203; Annot_ID_201993

SEQ ID NO: 19451 - DNA, 3003 bp, Unknown
  misc_feature (1)..( 3003): 2750-1469P.txt file - cDNA_ID_1821921; gDNA_ID_1620664; Annot_ID_48014
aggtgacagtggttcgaatctaatcgcagtctcatcccacgaattgattaatttcggatttgcagatacgaggatgacgaacgcgaaacagagacagaatctcaccattggaatcgaaatcgaaatcatctagagatgagaatccatggttacacaaaacaacgaagacattggattcgaagaacaaagaggctaaacaacaatataaccgttgcgtctgtacgagaattcaaaattagaagaaaaaaaacagattgaagaaacagagattacacgaagaaacagaacagagctttgaaaacagagctctgtgtgtaaaaagacagagagaagagaaaaaaaaagataagtttggtcttgtagagagagagagatgagcaaagaagaggttgaaggaaggaagcgagaggcgcgctttagtttggtaaatgctgaagaaatttttttagaaaggctttcgcgttacacgtgagactttttttttttgtctaccaattagtttttgacacgtgctagtttaataccaccaaactgatatttatttaggctttgtttttagtctttaaactttactttaattgttgtgattaagagatcttctctttaattttgttgaaaccttcacttgaacgaaaaacaaaaggggaaatgctaataaaatatcttctatccaatttttaccaaatgaatctctatttttgtaagaactgtcatcacaactctttctttaattaaaaattagctatattttaattaactcattttgacaaattaatttagggattcaaaaaggatatttagggttttggaactagaggaagagatcaggttttggaaatgtaggacttatcttatgaaattctattttattatgatttttttttttagttcaatcttggttaacatgtttcaattctaaattggtttttgtttatgagtttaagtttttggtaatttacagagacattaacttttgtttttatagttacttatcatctagattgtcttttatggattttttttttttgtcctttccttatcaattttgttttctttagaggtcctaagtggtctcttagagaaggatggtttgatcttgatgtatctggccattttccataaatccatattcacttaacggtttcgatatatttttatagcatctcctcaacttcattgtggtgaaactaatttgagattaatcttctcgacatgtgattttttgctaacgtgagcatctctccaatatgtgagacagatccaaaacagaagagtttttcattattatttttctgttaaagatgagtttatcaagaatacttatacgagcttcacgtccccaattaactcaatcgcgattttgaagatcctaaacctttgtcccacattcagtttccaatcatcacatctcccaaatgtaaacctctcacggactttaagagtttctccaatatttccaacgttcgagctcgttttcgtgttgcccacattatgattgcaaaacgacatgcaactttcagtagtttcgtttttaagttcacccaaaatcatgcaggattacattatcagttatcacagtaaaacaatgttaacgttggaatgtaattgtatgttttgtaacttcatatatgtatcaaaataaatcttgcaaaatttggaaatctgatatatataccactaaaaccttcacgagacaacgaaaattcttcactttaatttgttaaacaaaaatatttaaaagtatccacatgctgttgaccgtaaaaaatactgggcgacagtttcacttaaattcatattcacaactcacaagtcaaagattttgattggagtcacgtatcatatacttcgtaggagttatttatcttttaagttatatgcgaacataagacgaagaaaaaaaactattttagtacatataaatatcaaagtaatcacatgaagttttttgcgaaagtgatagtttaacggctaatcatacaggggccaaagagtactcaattttatgattatttattgagttctgactattttatgtgttggagaatgaagacagtacttgtcacgtttaatgataaaatactgattacaaaacaaaaaaggataatggcgacaataatgcagaagaaatgacggaattcaaaagaaataaattggggattgattggggatgaagctacgtagatgtacgtgtggctttctctcagtgtcgcgaaaccgacatgaagccaaatggcaagacactagattgacttttgtacaacgtgtttggctgttgatgaggattcctctaatccagaggttgcgtgttggtgcgttcccactacacccacacgagcttttacattttttctttatgttctttttttggttttgtgccattttgtgtcaacaatagcgaacaaagcgtagcattggagaaacctttttctataaataatagttttctttaacatgtgttttcttctatcgttaaagaagttgatctttttccgttggtttttgcatttttttgcctatcttggtagttggacttaagagcaaatattggttaatcatggtttgaattcttgattgtgacttactaggcttgtagtttgctaatggtgttttttttaaaaaaaaatgttgagtctagtgctatgattttgctttgagaaattaagtttaaatcctaaggtgttttattttaaccactcaaaatccttaagattattaaaaaacctaagaaatatcaaatgataccaaatagaaaacttacaggacataaaacaactagatgtaaataacttgggctcaattgctttcaaattgggctttttcatatgtgtgcttttggactaaaagactcataggtcaaaaaaattaaacgggctgagaccaaatatttggtttataacgaaatatgagttttttggggggccattctgataaataataagaagaagaagaatcgcgtctgcaaagctttagtgcttcatagagcaaaggagaaaaaaaatg

SEQ ID NO: 19452 - DNA, 3003 bp, Unknown; identical to SEQ ID NO: 19451
  misc_feature (1)..( 3003): 2750-1469P.txt file - cDNA_ID_1821921; gDNA_ID_2926203; Annot_ID_141602

SEQ ID NO: 19453 - DNA, 3000 bp, Unknown; identical to SEQ ID NO: 3760
  misc_feature (1)..( 3000): 2750-1469P.txt file - cDNA_ID_1821923; gDNA_ID_1620664; Annot_ID_48013

SEQ ID NO: 19454 - DNA, 3000 bp, Unknown; identical to SEQ ID NO: 3760
  misc_feature (1)..( 3000): 2750-1469P.txt file - cDNA_ID_1821923; gDNA_ID_2926203; Annot_ID_141601

SEQ ID NO: 19455 - DNA, 3003 bp, Unknown
  misc_feature (1)..( 3003): 2750-1469P.txt file - cDNA_ID_1821927; gDNA_ID_1620664; Annot_ID_48012
gaaagaaatttgcctattacaaatagagtagaaaataaatgatatgacgatttatttaagcttttttaaagattaatattaacgaccaaaataatatatataccacgattatgatttttattaaccttttattttgtaaaaaaaatacactgttaaaattttaacttattcaagtttttgtggaagtctactattgactgccgagggatcaatatagcccagtgctatcggttagaccgatcaatcttggcactcatgtatatgagaatgtttcctttattagttaaaatattgttattttaactatgaaattctggttgttactttggttttggaagccaataccctatactacagcggtaaaaacttgaaagtgtcagaatgtaatcgaaatttacatgaattcaactccaaaaaaccggtggaagaactactacaagcaaattaaccaacaacaaatctaacatgtaccttgaataatcattacacaacaacattgccttgcctgaattaaccttaatcctggagaaatcaaaatcccagaggaactacgccaagaaaaagctcctgaatcagagtaaagccagcctaccagttatggaatcaaccaactcctttggtcctgcacaagaaaagtaatgaacatgttgaggaacaacatcttagctaaaaccgaatttcaaaaaattattgtctctaccaggtccaactgcaagaactgttcttgatccagccgcaacctgttaaaggaagagttttagtttccagagaaacttgttagcgtactactaccacagaaaattcacaaataattttcattcaagagcagtcttttcgtgtttcaataggtcggatggtgtttatgtcttctatagttctaactatttgattagtagaaacttttagattttcttttgaataggaggagctctgattatactttcagcctcaataattgatcaagcacgacaaacctcagttcttccagcatcagctacaacaaaagtcgggaggccaacgctctcagcagcctctgtgatcttattcctgtgagcagaaaagataaatgtagctttcaaatttattgaagacaacttattaacatttgtagtaaagtaataatatgtcttgaagtgcgttttgtttgtatcccccaagattttcacctgcttacatttcttgctgtttttgcaagtgacgactatctttggctgcccattttcctcccatcgccgcagaaggtatcggtcactgaaagaattaagatgaaaacaaaaaaaaacataaaccccggactgatgcatcatacaaagcaaacaactcatttcagacgaaattacctctgcatcaactctgcatacatgccggtggcagcatctgcgaatattaaaaagaaagtcattttacttccagtgttcaaatttcaaacacatttcataagacacttacgtgcacactgtgacgcaattttgcccgttctcatcttcaagtcttgcctaactaccagtacctgtgatcagaacaagctcaaattagttacacaaatgttctgattttaacttgtaatctaaaaatctgacatcattgaaaactcatcaccatccttgtatagattatgcaagtctcttttatgaagctaaaatttcaatcatttgatgggtttggaacataaatcagcttgcattatcactaggttttgttataaggatttaagttataatattttactccaaaccaataaaatctaggggcagagacaagagactatcgttacactagatgatagacaaaccattttaagctcttggtccttgccattgcctggtacagaactctgcttctggaccttgctggataaaagtctgctccttttcactggggaggtcacttgctgtgataaatccaatatcatacctatgatgaatcctatcacaacccctggtatgagattctctgctctaaaactcacagatatcgacttcttttcttgtctctgatcatattcaccggaaaaaaaaaaacaatgatacatttttaactgtccaacaagaatgctggtttagtaagctacaagaaaatttcagaacatgaccgaaacaaccgagtaaataagctcgtttgttgcagtctcagtaagattttagagacaaaaacatgataaattctcgtttgggtggtgagaactgagaggcaaacattcaaatttacaccacaaatctctcaattttatttgccaaatcaaccatagacatacatataagaaacttgtgcactataaagccaaacacttacacttaaagcaaagtacactattaagaaagaatcagactttgactctttgagcttaactgatcttacatcaataaccaaaagaagaaagagctcagaatttgtaatttgtttagtttcaagttttccaattcactagccaactgatgccattcggaagttttgatcaaactagactcaattcctcagcccgagataaattttgacaaaaaagaagcaacaaaactaagaacaaattatcaacagaaaagacggaaaataagtcgaaatcaataccatagcttgaggctgcgaagagtttcgagacgaaggccacatgatacgcttctggagattctccaaggcgacagaggaacaaagctaagcctttaaaatcgaatgcccatgagtatgatgaagaagggagataagagcagccttagtaaccgtaaacgtcagggtgttcatatctctgattacaaaacgacgcgttgtttggggcttaatgtacattctggaaaaatacatggtccaattagaaaagttttaacagtatatagctactaatgtaattactatagaatatctctcgaacacacggtgcgttttactgtcgtcgctcctttttgttggtctgtttccacttcagttcttctccctccggaaaagctacaaccccaatctaaaaccctaacggccatttctaccatcggagctccgaaaatgccgggtatg

SEQ ID NO: 19456 - DNA, 3003 bp, Unknown; identical to SEQ ID NO: 19455
  misc_feature (1)..( 3003): 2750-1469P.txt file - cDNA_ID_1821927; gDNA_ID_2926203; Annot_ID_141600

SEQ ID NO: 19457 - DNA, 3000 bp, Unknown
  misc_feature (1)..( 3000): 2750-1469P.txt file - cDNA_ID_1821931; gDNA_ID_1620664; Annot_ID_48011
taataagcctaatccctgtttctcgcacgatgctagataaataggagctatctgcaaatttcaaacacaatatggaagagtttgatataacaagaagcgcaataagaaaggtgccgatttgattacagggaaggtacttgataagtcataaaagaaaggtacctgccaagtcaaagcatgagaagaaagaacttgagcataaacaagtctatggagctcttccatgttaattccacccaacttacgctgttcctcatgtacaagaacttctccttcttcgcttccagctgtcaataattccatggcatgtgcaaccatcctaacaaaaacatgaaaagtctcgtcctgattcatatagataagagtatagcgtactcaataaacttagtaaccagaaacaaacatcgcctgcctaccaggagccaaattctttggaacactctgccagaacaacctgcatcatttaattacaccatgctggattagaaagtggcgaagagctgaaacagttgcacctctgactaggtataagatgtactactgacctcagtattttctccaagaattccaataagcagtcttagaagcttatgggaagtgttaactggctttgactgaacacacttctgggctaggctatgcatgccatctaatccctgcaatgcaaaatggtattaatttgattttcaagtttaatattagaatgatagcaagactcgaatttaaatagacaaacagcaggtaaagcaatccaccttcgtaaatggcctgagataaagaagatgtgaaacaaaaagctccatccagttacatgtcgcagctctgaggcaatcagcatttcctatcatgatcttcaacatatttctcaagccctcacgggtctgatggtgagcacattgaacccagaaggcactgcactctagtttagttatctgagactgccatctttctcgtgtctggcaaaaacggcaagatgagtctagacacataatcagatacaataaaaagagttagaatgatacatgtttctaaaataccttcataaagtcaggctttgctgcagagcattcaccaaatttcccatcttctagttgtggccgcattcgtggcatttttgaaatgagaacagcaaccgcttctaccaaaccattttctgtctatttcattaaatttgtattacattatgaataatcagaaatctgtgcatatacaaaagtactagcacgtagctagtcacttcatatgacataaatcccaaaggacctaaacatgaacaacttcattctaacctcacgatgtcccagctggtctagttgataagaaccatgtaggtgtaacaacttcacctgaaaataaaaagtatgggcagaacatttctcaaattgtaacattcaagatcaaattacaaagaacccccaatcccaaaaaaaaagtactaaccactatttctagccaaccaactgataaagcagaagccatcacttcccagtatcttggatcatcctcgatggcctgcaatggcacataaccccgttaagaaagtcaggttcttcaatcacttattttctgagaactatcgacttcttagagatgagcaaacctgcaggccaacaagttccttttggaaatcctggagctttgagtagattgttggatgtgagctagaaaggagtatatcgtattcctgccatgttataaatggtaggtaagaaaacactagaagtttaaaaaaataagatagctcaagtgtcgaaggtaaaaactaattacagataaccaatcaacgagccgttctggcaaccaagacagacatgtcttatctgcataaaataattccatcaactcccacgcagcctttaaagaagttggttcctcagcattctgcatatgtatgttaacaggaacatccattaacaaagctccacactcaaacctatacctcactcgcggaggagttaaatttacaagtaaagttaaccaattgtagaaccagaaagaccaacgtacctttataactgatctcgggtcttcaatcaaaggagcgggcaaagatattgtattactaaggagagatttaatatctctgctgtattccattacgtactcccacctgattaaaattacgacaatccagaattgctcaaacacgctttagaagtctaatcataagataatccaaaacagtatttcagtattgaatgggcaaaatctgggaatttacaaagaagatactcaccacgcagtctgatacagagaggaactcatatccatcttagacaaactggaaattgagtttcttctgctctgcaaaagcgcgaacggagataccgatccataagcgatccttcgccactgtgggtcactgatttcgccatcctcgccgctaagcctaacgtttacgaccttaccaccaacttctccgtcgtcatcatcgcgtaactctggattccttaaaaccgtgacgcgtaggttgtttccgcaaccccaggagatggagagcctgtgaaccggagacttgaggccatagcttagaggatacaacaccggagttttttccttggtcgaaaacagaaccaattctccaccgccagattccgaagacatacccggcattttcggagctccgatggtagaaatggccgttagggttttagattggggttgtagcttttccggagggagaagaactgaagtggaaacagaccaacaaaaaggagcgacgacagtaaaacgcaccgtgtgttcgagagatattctatagtaattacattagtagctatatactgttaaaacttttctaattggaccatgtatttttccagaatgtacattaagccccaaacaacgcgtcgttttgtaatcagagatatgaacaccctgacgtttacggttactaaggctgctcttatctcccttcttcatcatactcatgggcattcgattttaaaggcttagctttgttcctctgtcgccttggagaatctccagaagcgtatcatg

SEQ ID NO: 19458 - DNA, 3000 bp, Unknown; identical to SEQ ID NO: 19457
  misc_feature (1)..( 3000): 2750-1469P.txt file - cDNA_ID_1821931; gDNA_ID_2926203; Annot_ID_141599

SEQ ID NO: 19459 - DNA, 3003 bp, Unknown
  misc_feature (1)..( 3003): 2750-1469P.txt file - cDNA_ID_1821947; gDNA_ID_1620665; Annot_ID_48046
cacttttatatttgtcttttgttgggtactgttgaacgaatgtttctttacttccatcacaagacaaataaataactcaatacgtcgcaagtgattctttatattcctaactgtcgactagaaagaaaataaatatcatagttctttgacaaaaaaaaaagaaaatatcatagttactttactccaaaattatagcctatgactagacttgattggccatagaaaatacttacatattatgttatgatggaatttcttcagtagctattcaattcttgttaggatacgacgctatattatgatggagtttcttcattatttacatgttatattatgatagatagaacaagaaacaaaaataaaaagcttctatgtaattaattatggaaactttctttggtaatttttgtttggacgttgtaaattactttgctgttttttattttatttttttttgtatatgttgcgttttcgtttattgttgatttatatattcatctaaacgtgcttccagttttaaataaatttattttgtatttgtaaacttaaaaggccacatggaaaattttcaaaactttacataaatgactgaaattacaatttacaccatttttcttcacacacttaagaagagtcaagactaaattttggaacattcaaacgggctaaaccattaagcatctttgtctgggccgaactcaaaatatatctctgttcaatccgtgccttcagcccaacatgtgttttttcagcccaataagtttcttgcatgttttgaaataaataatgaattttagtcgaattactttctctcatatcggcatattttgttcattttgtttgatgaatgggtttaagtcgtcgaagttggttaaccgatatcgtaacgtaagattgaaccggagtttcaatactcgttacattttttcgtattctagctaacgtgaacggatgttgtttatacagctttctactacaaaagtagatttcaaaattgaactgcgattttcttcttactcttctagaaacacttcctcatatttaataagaaacgaaagaattagactccgacaatattgggaatgtttagttgtcatttggacccaatataatcaattccatacatttgcaattgcaaggtgggtgagtcatcaaaatttatgaatcttccaaagattatagatagaacagcttttaattagcctaataaacaaaaggaaatacgattatgcatacaaaataaattaaatattaagacttttaatgaattcttaaccaaaaccatatcaagtcatatcatacactatcctccatacacgtggtagcatacataagtacgttaaataattttatttagcaaataattttattataatcatctttgatcaccaagatcatgttgggccatccaagccacgactttagtaatgtgaaaacaatatcataaggaacgaaacactgttcatttcatacaattaaaatacaactttttcctacacattttctcaagagtttagtaagtgagagacgaatgatttgagaaaacagtttttacttttttcgatttgtttctcaaactcagtattttcggatttctaatccagattaaaagttctgaataaaatcacggggtatggagcaaagccgatataagtaaaaacctttccatattgatagacactagatttttttttagttcataagatagatactagatttagtttgagtataatggattaatgtggaactagttgtattgtttagtatgtgtatgttgtatgatttagtgaccgtcttcagttttcttgatgtctttccacgttttacaaattcttgaaagaactgagaactcaaatgtatgatacataaccattgaaaaaaatatttccaccatcataaatagagttttacgaatcgtttcacaacttttaattcagttgacaccattaaataatcaatatttctttagttacaattcagtagaataaaattgcatatgctatattatctaattctatgaatattttctgtctatgatatttgatttttatatactttagattttggatcacccccacattatttcgcttttcagtcacattttgtgtttaatattgctagataagtccgtggttatagcttactttgttaaaatcatatatctcaacttatttcataacagtatctaaagaagatggaattttataaatatatagacactcaaaaatcagaagaaaatatatatccacaaataatagaagaaaacatagatttactgcattcaaatcaagggacatgaaagaatatcctggacccaagtgggttatattttcaataaaatttagcaaaaaaagttgacaatcaactaatcatcaccattattggccataatcattacgtacgcatacacatagccacgatgtctacctatgtttaaatctttgaattctgaaactacgtatcttttatttttgtttaaaaaaaacctagtacgtatcttctttccttacttagacatcatcttctaactttaaggatcgaaattagaagaaaaacaaatgattaatatctacaagaacagaattttgcatttatactcagatactcttctagtacctcacaaaaataaaatgaaattggaattgaacacgccctaaattcaagtactatacggtctatacccatttgagtatatgaataatgcatattgtgagtgaaagagatagatacgatacactcttttctttgtttttcaattggacaaaaggaaacagattttgatctctgaattgaacggtcaagatcgtatataattatttcaggagattaagatcccacgtgcttaaaaactctctgtcagactctttatgtataaaatcctcggcccactcttgttttgatagtacactcaatagaaagacacaaagaaagaaagaaaggacaaacagaaataacaaaaccttccatttcaagaaagcatcatctttgtgtgtccgaaaaatg

SEQ ID NO: 19460 - DNA, 3003 bp, Unknown; identical to SEQ ID NO: 19459
  misc_feature (1)..( 3003): 2750-1469P.txt file - cDNA_ID_1821947; gDNA_ID_2926196; Annot_ID_141307

SEQ ID NO: 19461 - DNA, 3000 bp, Unknown; identical to SEQ ID NO: 3790
  misc_feature (1)..( 3000): 2750-1469P.txt file - cDNA_ID_1821959; gDNA_ID_1620665; Annot_ID_48043

SEQ ID NO: 19462 - DNA, 3003 bp, Unknown
  misc_feature (1)..( 3003): 2750-1469P.txt file - cDNA_ID_1821963; gDNA_ID_1620665; Annot_ID_48042
taacttttttctaaaacggcacaatgtgcaaatgtattcatatagcggataacaatatccaagtttccaaacaaaccaactctgaaactgtttcactcacataataagagaacgaagagctaattgctgaagaatccgacgaaaatggctccgagatcagattcacaaaccctagccaccggctccgacgaaaatgaatcctcaatcgatccgatcttccacattctccgtatcatccctttctccttcctccgaccaccacgtcttcgtctcaagctcccttccttcactctcccatctccaatgactgtcttctcactgattctcctcacttacttcctcgtcgtctccggtttcgtctacgacgtgattgtcgagcctccaggtatcggatcgacacaggatccaatcaccgggtcagtaagacccgtcgtgtttatgtcgggtcgggtcaatggtcaatacatcattgaaggtctttcttccggattcatgttcgtactcggtgggattggaatcataatgttggatctggcattggataagaatcgagctaagagtgttaaagcatcttatgcaacagctggagtctcctccattgtgattgcttatgttatgagtatgctcttcattcgcattaagatccctggttatctccgttagagggttagatcacttttggcttcaattctgtaattggatctttagtataagatcgatcattagaaaaaatgtgactttttgttttgtttgtttgctaaagcttatgtgtttcttgtttgataatgagaatttagctttgaatgttagtatctgcacttgcattattgttgaattttgcgttgaagaagataatgggaaattttctgtaacagttatatgacaacacaaacaataaagtagagatttttgaagtttggtttgttggatcgctttgttgcttcaggtgttgttgactaaggcttggaagttgaggtctgcaataatattgcagatgcagatttctaatttcacaaagaagttccaacacagaaatgctatatgtaaaagaaatatcggtcaaaattgttatttatgattttaattacatgatttacaataagaagtaatgaaatctgaatgctgtgtatttacatactttatacatttagtgatgaatttaagtaaatgattgatagattcaaaattgtgtttgctgtgtgcattgttcttatctgctgaaataggttcttggggagaagagacgtcgaggtgagcacgtcacaggaaacttggtggaagttaggatatcaatgggacggtactcaggcatgatgagcccttctcgctcttccctggtccaaacccttgatctgccattgaatgtcccgtacttgactagtttacggaaaccccatgtcttcttctttgctgcggtgttcaccagtttaccattcatcttttggctcagatactctcgcaccgcatgcaagctctgttccacaacctcaatgggtggggagacgagtgggtttccttccgcgctcagttttcgtaggcgcctcatgcatccaatagactcaggcaacactgttatcttgttgtagctaatatccagttcgaggaggttcaggagaagaccgatagaagatggaagagcagaaagatactggaagttctgactgacattgaggatttcgaggttgatgaggttctcgaggtcctcagggaggatcataaggcaattgagacgagcatcgaggacacgcagggaagtgaggcaggtgatggtggctggtaggctaatgagcttgtttgagttgacacagagctttttcagattggttagttctaagcctatgttgtctggtaatctaatcagctcgttgaagttggcgtttagttcttcgagtgacctggaaaatccaaaacaaaagaaaacagaggaatttatcagcattatcatcatatatgattggtttggtccagatttggttgaggtgtgaaacctgcaattttgaatagtttgggggagggaaacgagaaagttgccggagacattaaggatcttgagcttagaaagacaaccaatggagtttggaagagctttgatctggtttgagtgaatatccaatgctatcaagttgagtaatcttgctgttagagattctggtattttctgttacaattcatagacaaacccccaaaaagaacattagaaacgtatattctgactgtgtatgagtgtatgcatagagatatgaaccttgatatgattgttggagagatcaagcttgcaaatatttgccaaattgagggaaggatttgggagagattgtaatgccatgccactcaaattcacaacctctagtctctcttcctcgttgttattgtatgatggtgactttggcgataaggatggtgaaagtggtgatgatggtggtgatgtactcaagtccatcatcatcattgtcatcatgtgatccttttgtccatgtaattgctgatactgatatgcatcttcgcatatcatcgttttatgtgtgtttgtatggaggaaaaagatgataatggtgaaatgatgtggaatgagtgattcttgatctgcttataatggcaacacagagagattaaggaggttatgtatggacgatcaaactttagtgggaaattgaaggaaatgaatactcttcggaaattaatgatttgtaattaaggaaattataaaaggtgattagctgatgaaggagagatactcatgcgtcgccaagtttttctaaacacctgatcgaaaaatgttagagctacccgcaaatcactcataagtaaaaaaataaaataaaaaagttcccataaatttcatttcaactttgagactaattttataatcagagtctgaaatgtaacaaatcaaaatttgtggggttaaaacagaaataattaaaaatatgccacttgtaataattccaaagcaagctctggtgacacgatcatcggaacaaaatagagtacccggtgacgatg

SEQ ID NO: 19463 - DNA, 3003 bp, Unknown; identical to SEQ ID NO: 19462
  misc_feature (1)..( 3003): 2750-1469P.txt file - cDNA_ID_1821963; gDNA_ID_1620665; Annot_ID_163903

SEQ ID NO: 19464 - DNA, 3003 bp, Unknown; identical to SEQ ID NO: 19462
  misc_feature (1)..( 3003): 2750-1469P.txt file - cDNA_ID_1821963; gDNA_ID_2926196; Annot_ID_141303

SEQ ID NO: 19465 - DNA, 3003 bp, Unknown; identical to SEQ ID NO: 19462
  misc_feature (1)..( 3003): 2750-1469P.txt file - cDNA_ID_1821963; gDNA_ID_2926196; Annot_ID_201488

SEQ ID NO: 19466 - DNA, 3000 bp, Unknown; identical to SEQ ID NO: 3799
  misc_feature (1)..( 3000): 2750-1469P.txt file - cDNA_ID_1821979; gDNA_ID_1620665; Annot_ID_48035

SEQ ID NO: 19467 - DNA, 3000 bp, Unknown; identical to SEQ ID NO: 3799
  misc_feature (1)..( 3000): 2750-1469P.txt file - cDNA_ID_1821979; gDNA_ID_2926196; Annot_ID_141296

SEQ ID NO: 19468 - DNA, 3003 bp, Unknown
  misc_feature (1)..( 3003): 2750-1469P.txt file - cDNA_ID_1821987; gDNA_ID_1620665; Annot_ID_48032
gacggtgggcttgtttgcagaaacggacggaggtgaagcttcaggatctgccgtacgtgcttggagcttgttgtgtgttgcataacatttgtgagatgaggaaggaggagatgttgccggagttgaagtttgaggtttttgatgatgtggcggtgccggagaataatatccgatctgctagtgcggttaatacgagggatcatatctctcacaatctcttgcatcgtggacttgccgggacaagaactctataggctctgtttttcaccttttcttattttgaaactgattttttattgcaaattctttttccaaattaggaataaaaacattttagggattggttggatacagaaagaatagttgaattgagagtagaagtggctgatgatattgtttgtgttacttattagcattgtgtaatctttagttcatgtattttctatacaaattgaatctgaaacctcttaagtataagcttcttctctttcgatttttcacaaaattggtcgactagaaaaagaagaagcaattccacttttattacaagctcaggctcagacagaagtacaagtgtacaaccatgaataaatggaagttgtacttaatctgtttcgtttgcaggatcttccttatctattgatgtgttgagctctttgagaaggaatgcaaatttggaagcatgttttcctttgtcattcattatttgtgggctaaatgatacaaagaggaaagccatatgaacatgttatttactgtcacatggcgcacacagaggaaaagccatatgaaatacaacatttgaatatgaaacttgttggaacttttttgacaaaacttttccggtgactttccggccaaattccggccaaacggctgaacggaattgtagggtcattagtgcattggaaagttagtaaagagtactacaaaatggtatacacatacgtcaaaaatgaagttgtattgaatgagaaataaaggtgtaaagtgggacacttgggccaaaccggaccgaaccgaaccaggctgcgggttgtcgggacgtcccgtcgtcggctcaagggctttcagacttgcgaaccgtcatacttgtgagttattgagtttgctgagttgaatcttatggaaatattctcaggatggtctcaaaatattctcaagatagtttcaaaatatgtcatgtttatcctgagaatgttctgcaaaatcttatctacttctactatataaagagattcaacctctcattatttctaaaactctcaaacacaaaacagtctaaattctaaaatctctcctctctcttgctttttaaaagtaatttcttagtttactttcacataaacatagtcatgattccattgatttaaaacttaaaagtttctaatcatgtttttttttacaaacgtgaatgtggattaaatgagatttcaatggaaagaaaacaaagaattggagatgcaaatttccttaaaagccattaagcttactttgtgattgtgattatccaagtatataatttaattcataaacagtaacaataatcttcattcatcaatcgtcgcagcttatttccttaaaaagccaatataagctacttttcaagccggcttgactcatacatattaccagattaccccaacagtcaccatgaggggacgaatctcctctggggttaaccaatgggtactatcgtaatttcacaatcaccaataccattgccgatcaaaaacagcaagcaacgaacgcgcggttcgtctcgatcccgtcctctcatggctgttgtcgttgcagagacgtcgttgattttcgatttcgatttcaagcttttcacgtactcattggaacgatccaatctcaaaagtctctgattttgggagagagcttcgttaaactcagcgcgaattgtaatttcccttttgccgcgattttggattacaaggtacgaggtttttgatttctcatcttcaatgattgaagtttgatctgggttctagaattctaattctgtgtgttgccctttgttttattcggcttattgaagatgcttgacttcgttttatgaagttcgtatcttttttgattcagttctcttctagggttttcttgtgttagagctctgaattttggtaatttttttggtaatgaagtttgattatggtggaaacacgaattttcaggagaagggttagttcaattttatacttttgcttggaaaagtaatatgtttgaagttggacatttagtttcataattagtcggcaatgcagataagctgtgaagaagacatttaaaggaattatctttcgttcttttcgaattgaatatggtgttggggttggtttaggtattttgtttggattggtgattcttcaacacatttcacctggatcttagttagagaaagaaaggacagttccatgttagacttgtttgtgtagttcagttgccacttgactagaacttctccttttttttgtacattagctaaatgggtagattcattttgtttccttatttgttgaagctcttttattgggttggttagttgcttcgttttagatgaaaattatatgcggtgttatatggctctgagcatgtttccggaagttgctggcttaatgaagcaaatacatgcgaagattatgtgaagaacctaaagtactctgaaaccaaatttatacttatattctagtgtttctatttatgtatagattttaaaatttttatgtttttttttggttttaagacttggttagtgcaaatggaatggttcattatcttggttgtttttatgtatactcttgtttctattgcaatgtcattctcgtggtcaatgtttgttgctaaggttttgattccatttgtcacttttgcaggtgaaataatttgacagctgaggatttaagcatttatgtgctgcaactctgcaagcttgtcatgtaccactgtttgtatattgtttataaataaaacagtggacttaaagttaagggaatg

SEQ ID NO: 19469 - DNA, 3003 bp, Unknown; identical to SEQ ID NO: 19468
  misc_feature (1)..( 3003): 2750-1469P.txt file - cDNA_ID_1821987; gDNA_ID_1620665; Annot_ID_163893

SEQ ID NO: 19470 - DNA, 3003 bp, Unknown; identical to SEQ ID NO: 19468
  misc_feature (1)..( 3003): 2750-1469P.txt file - cDNA_ID_1821987; gDNA_ID_2926196; Annot_ID_141293

SEQ ID NO: 19471 - DNA, 3003 bp, Unknown; identical to SEQ ID NO: 19468
  misc_feature (1)..( 3003): 2750-1469P.txt file - cDNA_ID_1821987; gDNA_ID_2926196; Annot_ID_201478

SEQ ID NO: 19472 - DNA, 774 bp, Unknown; identical to SEQ ID NO: 3784
  misc_feature (1)..( 774): 2750-1469P.txt file - cDNA_ID_1821991; gDNA_ID_1620665; Annot_ID_48030

SEQ ID NO: 19473 - DNA, 3003 bp, Unknown
  misc_feature (1)..( 3003): 2750-1469P.txt file - cDNA_ID_1821991; gDNA_ID_2926196; Annot_ID_141291
aagtattcaaatctcttgaaaaatatttctaatacaaaaataattcaagacccgccaaaccggttgatgaaggatcaattaatatataacgattgataaattataatagagaagatccatatgtctatttaccattcttcagtttctcttgcaacttcaatacgcatgtgtcctagtttcccatccatggttttccttactattgctctgtgatcaccctccaaacacctagctgaaggagcatcaccatcatacctgtaacttatgtagaatattagcttacaaaattttgtatcatgctagctctttttttaaattgagctttactcttattacttaatttcataggacgtgctcgtgctcgtgttaaggaattctgaaaacgacatctggtagtataaagggaaatagggttacacgcgagtgctttctcatttggcaactttctctgatttttctctacgcgagcggcgattgcgactatcatttccttgtgaattctcgtctgtctccggtaactttctctccattttgctagctctgttgttagcttgttacgcattatgctcgtagtttggcctgtctcagtgcgattagtgaaccagtaatgaactttaagtaacgttttagggttttaatttttccttggttgaatgatgtaaacccttctttaggttaaaggagctattcaacgtttgtttggtttatagtctatagcttctcgctcgacctctgcaacttaaaaatggttatgtttatgtcaaaacttgaaaccatgtttatgcttgatacttgggtctttttggctctgctttatatgtgtcttctttcctctatgtgtttttctgcttgattctgctggattatgaatatctttcttctgcttgcttctacttgaaaccagggataagtgattgcagatggctgagcgattattacaatctatgtcaagggtggctggccgatgtcatccagattgcgtaaaagcaagtgatgagcaagaagattaccgtaaattctcaaatccttttgaactgactcgttttcatatgaataggttcagtatatgaattgactacaacattttcatcttttgttgttgttgtttggcagatgcatctcaaaatgcagctttggtagctgtgaatctgattagctctgcaaggttaatactgaaactcgacgctgagtttactgagtactcagctcagtttttgatggacaatgctggaaaggaagacgacccgggagaagtggatcaacaacgcaatcaggtcacgaccgaaaactgccttcgctacttggccgaaaacgtttggaccaagaaggaaaatgggcagggaggaatggatcaacaacgccctgtgctcactgtcaaagactgcttggaacttgcttttaaaaaagggctgccgagaagagaacactgggcacatttgggatgtaccttcaaggctcccccatttgcttgtcagatacctcgcgttcctgtgaaaggagaagtggttgaggttaagacttttgatgaagcattcaagctgttggtgcatcaacccattggagcaaaactgcatttgttcagtccgcagattgataatgttggagaggttaagtgttgtaagttaaatttcaaaatcttaagagattagtgacaaagttttgttctaatcttgttcatctttttttatgtgtgatagggagtttacaaaggcctcacgacaggtaatgaaacacactatgttggacttagagatgtgctaatagcttcagtggaggagttcgagggagattctgttgctattgtgaagatctgctacaagaagaagctttcatttatcaaagtgtctttgagcgttaggtttctctcagtagcacatgatggtgataagtctaagttcatagcgccaacaggtctgcttgttgacttctgtgtcccgcgcttatctatcaactaaaccaaaagctgagatcttggtaagtatctggactatatgctagatgtggaacttgtttgtggtgctacaataagagttgttttatgagactattttctttaagttaagaagtcaagtatcttgaaaaccatatcctatttgtggaacttgtttgttgtccgacattatgattgtcttaggatgaacttttatctataagttgaagaagtatttgaacttgtttatcattccaaattactgttgcccaaatttgaagggatcttttcaagcttctgaattcataattggatttgctcatagtttagtgagttcttctatatagattacacaataatgattgtattatccgtgtttaccaatataattttagtgaaaaatgcaatgtaaagttttactgagaaatgagaagaattgagtcaccaagctgatggtacatactacataagatagactactaagaattttacattgaccagtagaaatcttcaaatctctataaagtggcccaaaataaaaacgatttaaaattgcataaacgatgttgttgtttaagccttcaacattggcaaatgatggcaatctcagaaaaaggagtcatggcaatctcagaaaaaggagtcatggcaacgaaaattgacaaaaacggcgtcgtattgagggttaaaagttgaagtccctaaaccgtcatcgtattggaactacgctgagggggaaataagctttcgcgaagcttcgagagttaaggcgacatttcactgagttttctctacgcgacgtagatctgtgtctccggtaactttctcttcattttttctttctctgttggattattttacttttttttttggctttgttacggaacctgctcatgatttgacctagtgaactcttagtaacgttttagggttttaactttttttcttggatgaatgatgctgggtccttctttatgttagagttgttctttgtttaaagaagttatcaacgtcagtttgctttagtttataaagcttctcgttcgacgatttttcctctgcaactagaaatg

SEQ ID NO: 19474 - DNA, 3003 bp, Unknown
  misc_feature (1)..( 3003): 2750-1469P.txt file - cDNA_ID_1822007; gDNA_ID_1620666; Annot_ID_48057
attgtcgtcatctgtttgctttgtgctcttgcatgcttacttgaatgagttataacaatagagaactttttagttttattttagcaacaacacttgaaagtataacttgttctactcgatttcataataagtgtgtgtgagatcttttgattactactagagactagagttgcttttaaaagtgtaatttttatttttattttgactcgatatacttttcaacaaaaaccaacttatatttttcttatcttttaataaaaaaagaggtatgatatgcattatcaaaggatctcctaaacttgtctataaaagatctcacgaggcggtctctgatcaaaacatcgtacaacccatctctttttttttttttaacttgtcttctctctttccttaactttgatggcactgtcccttctctcctacaacgtctccgacctctgtctcggcaaacctcctcttcgttgtctttcctcctcttcctcctccgtatccgacgccatcgctgccctcaaatcctctgaagacactttcctctccgtctggaattgcaatcacgacgatgacaataacacagagtgcgagtgcttggggaaaatatcaatggctgacgtcatctgccacttgtccaaagaccatgaccacagtctctgtgccttaaactcatccgtctctgttcttctccccaaaactcgttccattgtcctccatgttcaaccatcctgcaggttctttattcttccaaactctctctgttttgagggtctacataaaaattcaacctttagttgtgcttactctgtttctatgctctgtttttttgtaatgttctttaaattaatggtttttgtggggttactctggtttgactaatcagcttaatagaagccattgatctgataatcaaaggagcacagaatctgattgtcccgatacatacaaagccctacactaagaaaaagcagcacaacgacaacgtttcggtcaccaccaccacccactcgaacggacaacgattctgctggatcacacaagaagacatcattcagtttctcctcggattcatcgccgcattctctcctttgccagcgatgtccctctctgatctcggtgtcatcaacagcacacacacagttgttgcggtcgattaccactcctcagcgtccgcagttgtctctgccgtatccaacgctcttgccgtccaaacctctgtcgcagtggtcgacggtgagggagatgacccttttacgtctttgatcggcgaaatatccccgatgacattaacttgctgcgacgagacagcagctgcggcggtggcgacgctctccgctggagatctgatggcgtacatagacggagcaaatcctccggagagtcttgttcagatcgttaggaaccgtttggaggataaaggattgattggtttgatgtcgcttttcgattctctctcatcttattcgacgtcgtcgggttattcgtcggaggaagaagctccagtgagaacgacgtcgtatggacggtcgatgagtagctcagcaagaatggcaaggaagtcggaggcgatagtgtgtaatccaaagagctcgttaatggcagtgatgatccaagcggttgctcatcgagtgaactacgcgtgggtggttgagaaggatggttgtttcgttggcatggttacttttgttgatatcttaaaagtttttaggaaatttttggagaatgacatgtgaaaagttttttaaatatattttcttgtgttttgtcgattactaaaacccaacaaaaatgtgtatttaggggtgttttgtttgtttgttttgtgttttggtgatgagccggttggagtttgagattaactaaaactgaatcaaacgtttttggtttgtttagttggtactttaatagcaatcaattgatttgctcattttgtcaacaaatagtgtatatctttgaaacgtttttagaccatctccaatgtattttcattctaaaataaagtaagtggggttggagatgtctttagtcttgctatatttttttaatagcttcttatgtttattacatgtaccatgatgaagtgttgtaaacttgatgctagtgttcttgctaggctagggctatggaaaggtatgaaaaactttagaatgaacaagcttattttctcagctaaggacgaagattttattggtgaggttttgaggccacatgtttggaaaaatgaaatctaattttaatcggctaagataaatgtagtaatcctcatttggaaaatgaaatctaattttaatcggctaagattttaacataatccaccgagtagttttaacttttaatccgacattagtggatgggaagatatttagatagaggcattatccaattattaacaaaacaaaaaactgcccccaccgtcgttgtctaaaaatatattatattaaaataattggcaaagacgaagacgaagcaccctcatctccgtcgtttgtctttaaaaccttttgccattaccatcttcgcacgttgaatatacgtcgactttaaacatcttccaatctctgaaagcccctctcttttctccatttcgtgcttcatcatattcgtcgtcgcttcggtaggttcttcttcatctctcttcgattggattggattggattctatttgagtaaatttgttgttggttcgttgatcgcgtatgtcaacggattatttagggttccaccaatttttcgattcatctgtgctagtcttctggaatttgaaaaatgggaattggatgggtttgaaattggaattctagtttctcccgtattgatttttgctggcaattatgctgatctagattgttttcttatagctggattgttgttttgcatatgagattctcgcaatctctttgaattgcttaagatttgaccacaagtctagtatattggatatttgatttttgtaatgttctctgattaatttctcacatttccttttatgactgtgctctgatgacattttatg

SEQ ID NO: 19475 - DNA, 3003 bp, Unknown; identical to SEQ ID NO: 19474
  misc_feature (1)..( 3003): 2750-1469P.txt file - cDNA_ID_1822007; gDNA_ID_2926191; Annot_ID_141031

SEQ ID NO: 19476 - DNA, 3003 bp, Unknown
  misc_feature (1)..( 3003): 2750-1469P.txt file - cDNA_ID_1822011; gDNA_ID_1620666; Annot_ID_48056
ctaatctcggggtaatgagacctcctaatagtagtttcataaactttttttattttttcataaactttttattatacaaaatggtttatgttttcagcatttgacttactaacataacaacaacaaaaataagcctgcttcaaattgtttaatagatctcgtgaagtcaaagttaagagtttttcacatactgcagtcaaataaattttcgactatctaaacaatgtactaagtgtaatcagtggaaatcaatctttgacataaccaaatttcaaaagttacattgcatgacttcttttgtgtttctagtatgcatccaaaagttacattgcatataacttgttttacgttggacacatcaccgtagatgcatggacgaggattttgaatccaaattaccatataataattcaagataagtcacgtccaatatcatctaatgcaaatttacaactagtaaccaattaaatagttacgaaagataagcaaacacacgtctcactctcagccctatttgtgttttcatgtctcatctcttttaaagttcctgaactactagccttaattaaaatatacgttaaagactctatttgaaggttctttttcgccttttttgggttaattattgtatgcaatattatttttgtaaatgaaaatcaaggtctgcttatctgtactgcacgttccatataaggacaaccacagatcacgttgcttacgtcagcgactgtacaaaatgctggaggcccgtcacgttcgtatcgcctactttcgttgaatctaatattgttcacgccaacgccgattcatatatcatttcatttagatgccatgttcacttttatatcatatatactgttttcattttcaaattcaaattcataaataaaatctaagttaacaaagtggttagtattgtagactatgttatatatatgatgatgcttcatttgtttaattgtttgtttccaccatccttataaccaaactgatggtagattagtagttatatatatgcacatactacacatgcaaatgtaaagactaaaaatagtatccgttttcctaaaattaattatactgtttaactggtaaacgcaatgattagttggtccgaataacttaatgaaagcatcatagaaaaaaaaacaaaggcttggaaacataaagccaacatgcaaggtcactgaggttttataaataacattgatcgacaatttgttatttagtgaaaacgtacaattatcagtgaatattaattattatattcgtacggttctgatcagtgtcttagattattatcctttacttaaaatatactcgatctaccagtgacgtcactgtgcaaagtcacactggtcagatttgttgatgtaccaccttcatctatgttccttttgggctggacctgtcaatttgtagcttgtttactgaattacgtacttaatgggcatgtgaacataaatttttaactagattatccaacgtttcatagattaagctaattggtgtacttcccctatacttctgttaggttttattatagtgaccaattagtttcatttgcatatgatgactaatcgttttactttacttccttttcttaatgttaagtgatatgagttccaatttaaaaccacttaaaaatcagtggcttggttcatatcctctatatattattgtaaatcgcatatcttgtcctgttgtccactgtggaattttaaaagtttaaagataaaacaattatgtcagttcgtgacatatagagagctattcagataatcacattcagcatatatatactgaaattccgagtaaaaaatgctgtaggcaaatgaggttcacatgatcacttacgtacatagaatcgaataatttacagagaaaacacaacacattgcgaaaacaagaaggtcgagaaaacatattttgtattaaagtaagtacttggaaaacacttggccaggaaaaaaaaaaaacaacagtcaaacacttggccaagttgttacattgcgtgcaagtacgatttgtttatatgtaagaattggaaagcgtattttaatggggcgtttagttagggtcgaaatatgaaaacaccatctatgaccaaaacaaatcagggtcaagctagttttaaatctgcattttttttataagaaattgtttgtaagaaatcaatagtatataaggaaaatagacttggtgtaacagaaaaagttatttaatcaacagaggtgagaaaaagtgtttgatagaagatatgatgcagaccaggtgccattgccagcatgttgcattgttggacttgaagtaaccgagtaagtagataattgaaacgtgtcttataattgtcattaagggtcacaccacaaaaaggtttttgtgattattaaggtcataattcccctcacaaaagttggaaatataaaaattgaaaaactttggtcatatctaatctaatctttatctttggtttggttttatacgatcatcccgaagaaacatcatataaacctctcccatatcatacctacaaagaacatgcatgattttaacttattttcagttgtttcttctagtgggtttgagaactcatcatcaattgtcgtcatctgtttgctttgtgctcttgcatgcttacttgaatgagttataacaatagagaactttttagttttattttagcaacaacacttgaaagtataacttgttctactcgatttcataataagtgtgtgtgagatcttttgattactactagagactagagttgcttttaaaagtgtaatttttatttttattttgactcgatatacttttcaacaaaaaccaacttatatttttcttatcttttaataaaaaaagaggtatgatatgcattatcaaaggatctcctaaacttgtctataaaagatctcacgaggcggtctctgatcaaaacatcgtacaacccatctctttttttttttttaacttgtcttctctctttccttaactttgatg

SEQ ID NO: 19477 - DNA, 3003 bp, Unknown; identical to SEQ ID NO: 19476
  misc_feature (1)..( 3003): 2750-1469P.txt file - cDNA_ID_1822011; gDNA_ID_2926191; Annot_ID_141030

SEQ ID NO: 19478 - DNA, 3000 bp, Unknown; identical to SEQ ID NO: 3808
  misc_feature (1)..( 3000): 2750-1469P.txt file - cDNA_ID_1822015; gDNA_ID_1620666; Annot_ID_48055

SEQ ID NO: 19479 - DNA, 3000 bp, Unknown; identical to SEQ ID NO: 3808
  misc_feature (1)..( 3000): 2750-1469P.txt file - cDNA_ID_1822015; gDNA_ID_2926191; Annot_ID_141029

SEQ ID NO: 19480 - DNA, 3003 bp, Unknown
  misc_feature (1)..( 3003): 2750-1469P.txt file - cDNA_ID_1822019; gDNA_ID_1620666; Annot_ID_48053
taggagattatggttcgagtcttcccatcacaatttcaatcattaattgttggttaactagtaagaatattcagtttttccacacattttggagattataagttaggattctataatttgatccgagtactcatgttatcaaaaaagaattgttttataaaaaaaggtgcaatcaaatatagttgcattttacatatagaacgaagaagtctactttgaggggaatatggttgcattcagtaacattttttagtgaaagtttaatcgtcagtgcttagaccttttccactgaacgaaaaggccttaacctgcattttctccactctcatatgagattcaatttgtatggaaactaaaaatgtaggtactttactcttacaattattaaagtttaattggattaaaacatattatgtagtaatctcctttcaagttaaggattaagtttcaaaaaaagaaagtccaagcgaatcctctggatgagacagagagttatgaaattacatctttaaagaccgttagctgagtcaacttccggtggttgcaacccccacacataaaataagaaaattggtccaaatattgtattgtcactctcgtctacagttcaacgtacccctcacaaaaagctttagccataactagtctcaagtatcgagtttattatcgaagacattagtgagattgcaaaggaaaagaagtggaagatatgatagctgaaacgggaatggtgatggtaggtgttttgggattatgggcacgctttgtccgaaaaccgctccttcaattcaccggagaaatgatgcaagtaatctccgaagtcgtgtcgaggatgtgtcaaccagatacaacatcttatgctactctttcttcaactgctaattaataaccctcctcccaatatcgtcggaaggtgataacatatttaaatttagagttacatataactttttttaaccttgttatttgtaggttctcgattctataatatatacgtttttcgttttcttttgaatgttaaaattatggatcaacaaaagaaaagttatatacctggttttgtgttcctctctcgacatatgatatatatgtttacatgaaagcttaaccgcaatagagtactagtgaggcatcatagaggcttagtagatctattttaggcgaagctgcacgacatcagtaaattgattgataatcaaaggtttagaaatcgcaaaaaccatatgtgattagaataacgacatcggaagaagatgtgttctcgggttcatgaagctgatccacataaattagagcacgtgtataaatgagtctcgttataataacgacatatatatgatttattcggtttgtttgattcgggtacactaaaattaggttcggttcagatttggttttgattttctattttggtgttaccgtttctgctaagatcgttgattgtctgcttcatttgcttttacttcgtccacaaagttttacgagaaaggttggcacgggacttacgggtccccattgacctggttcatatgtggttcctagttcaagtcgtttgatcttaatttcggctactttttataattaattatttgggtttgggctgggccatgtaagcccaatataaaaacaaaaaaacacacagtttcactaacgacgtagaaccatggaaaattttactcatgggcctatttgcttcaatcatctttcttttttgtcacttcttgatgccttgtctcttatttggaccacaaaatatctgttgcagcaacaaaggaaaaaaagttgtaaacgtttaatttgttttctgtttataatgtaaatgtaacaaaatctcaagaaaagtaataatgaaacattcgtttctcaatatcctttgacaagaagtataagaagaaaagtagctacaattgatcaatcacgtgacccacattagtattaatcacaatacttaataattgcttataattattacaaacacaacttcactgtgactattcttgagttggttcttcctacaagtggttatatatcttttgacgataatcttgtgatatgaattaatgaagcatatgttctaactaacaatggaaaactttctggtgactacccactttaccatcattaatgattataatttccaaccttacactatataacgtatcaaacagatagcaaatttacattttgcaattattaagaacttcaagcacttatcttgtgcaataaggtcgtcgccccattctcaacctcacatggttagttatgaaatcatttgtgtatttcgattgtctcccctccaagctaagataaatcataattactaaacatcataaaacctcacactgctatctttgcagtatattctactattatctttatcttgagtaactgttactatcatttgtctctcttcgtacccaagttttgacatgtgacatgtcaactaacactttcacttccaacaaaacacttgtttattcaaattcatactatacacttctcatataatttacgaacattttctgttgtcgtataaaatatttctatacaatttatgctgttttcttattctcagtttctcaccatacaatactaacagtaatagaatatgtgtctatcggtgaagtgggtgtgtcggcgtacataacgaagggaccaaattgatcatttattaaatatttaatcaaaagaagaaaaacaaaaagaatcaaaaacctccatgaaataaaataaaatcctctctcttcttcttcatgtgaatgtctgagtttcaatgcatgtgctcgctcttggatctcaatcgttcttctacagctttttcttcactctcttctctatcccttagctgtcacgaaacattctctttcactcttcccttctctctccccaaaataaatcagaaacctatcaacattcttcaacagccacaagtaaaatttatagacatttctgtctgaagaagaaaaagattgaatttttttgcttgttgtgggttctttaatg

SEQ ID NO: 19481 - DNA, 3003 bp, Unknown; identical to SEQ ID NO: 19480
  misc_feature (1)..( 3003): 2750-1469P.txt file - cDNA_ID_1822019; gDNA_ID_2926191; Annot_ID_141027

SEQ ID NO: 19482 - DNA, 3000 bp, Unknown
  misc_feature (1)..( 3000): 2750-1469P.txt file - cDNA_ID_1822027; gDNA_ID_1620666; Annot_ID_48051
gaatttgtggtgcatatatagtaaacgtactatggtctatgggcttccaagcctcctatccaaatgatatgatcacataacccattatttgagattacttcaagcaataagtggtgttaggggaacaatgatttaacttggtttccagacaataccctaaaaaattcagccaattttttttgtagtttcttgcaaagtaacgtttttatgtgttataaataaaattaaagaacaaaaaaaacaagacatcaagcgtttgagaaaacataaaactctaatttacataaatgagataataaaattattttaatttttctgtttaaagaaaattaggaagaggacttaaaaagttaattaattagtcgctggtacccattgcggccttcttagtttctcattttatttttaatatataaaccagctgattgttttgtatgttgtacgctattcatcatatatacgaacaaaataattattcaacaatttcagaaaacaattgcagctacagatcgctattttacacttagaattgtcttcttaattaataaccattttccaatttatgtttttaagttcatttaaaactatatatatatatatatatatatatatatatatatatatatatatatgttgaagtttgtcatttttggaagaattgtgttgaagtgggaactatttaaacatttcattggtaaaaaagggtctaagaatcatcgatctctatatagattaggtgctaccatctacaaaattttagaagagtctaaaattcagaatggaatagtcatcactaaatcaattatgagtgtcgaattaattatgtagtccagattttgcttatctactataagtattgtcgaattaattatgtacaaatgtagagtgcatatatagactatgcatttagaaagcataatgccttttgtttttgttttctctctttttctttttggtaaaccttcgtgatcaccttatctcttttaaagctttaaccaacatgtaacttggcagagaaaaacatactttagaaaagaccatatataatatacgtttagaactcattaaatagaagtctacctatttattctctaaacaaatattaaaatgatttaaacgtcaccaacgatatttatcgcaaaagtggtaaatttctgtcaattaaaatgtatttttgaaaaaaaagtagaaaaatgttattaaaataaaataaattcattgaagaattttttgaacaagtttagattatggcaatctgttctttacctcattgtcatcaaaaccatatctcttaatttatttttttgtcaggatcataagagcattatacgctaattgaatagcgattgatgagtttcttatcaacacattttgcagttatgcgaatcgttgaaccaaacttgtcgtatctttgctgatattcagaaattattatcttacaaaagaaatgggtgggcatgtccatctctctgtgaacaagaattctccacgttcactaaaatctaaaaatccgaaaagcaattgaaaacgatttgtagagaataataataattaagaacaaaaaaaaaagaattatcaagaagaagaagaatcgagttctttgaatcgcgtcacatgtttatatataaaaaggcttctctgacctgttcagcatggtccaaatattcacttgtcaacttcttaggccatttctagtatttcttgagtgaacgaaaccctaattaacctctttttgtttaaatataaactaaaatatatgaaataagtcttttatgagataatcattgaaatatatataaaaatcgaatttagttgttctgacaaaacttgaaatttatcctttaatcaaaaacaaagagactacttgctacatttgtgagataatcttaatggtataatacaaacgatcatatattctcaaatgttattatctttaactaaaaaatattaaaatcatactattagtgttctgtatatacgtgtcttatgttaacgtatcttttcaatttattttagttagaactttgtagtttgtacacttgttcaatattttctgctgtttttattattactttttcttcttttttgtctcttttgattcttttatattgaagtcttgcctaactctcccaacacgtgtacaattcacacggacgggaaaatgcattccacgcgtgtctgattaatactcttttgttcataaaaacgtcttagtgccatttgttttactcaatagatttatctgtcaaatagttagtgcttcttcttttctttttctgactccaatctatgtagtgatcgagtgcttcaggacaaactaaatatcgaactggcctctaattatttggagcattttgatacacatcgttgttaggcttttgatcaaaattctagaagaaaggacaactggcttaacacgtgtcgataaactttagcttttcctgacggttcatgcacccgaacggcaccaatatagtcgaatatagaaataataaagcttcattgctttctcagtggaaaaaaacttactataattagaatatttctagtaaatatttagacattttacatgtcacgatggaataagaaaaaataaattactgcaatcactcagcggacttttctcataatcgtagtacacaaatttcttactcatgagaaaattttcctcgtgttttttgcacatttatatcgctggaaaatattgtacaacacatcgataaggtcggccagttcatagacgtggcagtatctaaatggttaaacgggtccacaaagaaaatcgtaattagattttagaacagtaagacaaggacgaccgtacttatccttgaagaacctttggcttttccgtagcctatataaaccaactacttactatattgtccaaaagatcgacgaacataaaaacaaaaacatataatttgggtttttagagttcgaaacttgaaatctttttttttttggttgctgaggaatcgaagtagaagagtataaatg

SEQ ID NO: 19483 - DNA, 3000 bp, Unknown; identical to SEQ ID NO: 19482
  misc_feature (1)..( 3000): 2750-1469P.txt file - cDNA_ID_1822027; gDNA_ID_2926191; Annot_ID_141025

SEQ ID NO: 19484 - DNA, 3003 bp, Unknown
  misc_feature (1)..( 3003): 2750-1469P.txt file - cDNA_ID_1822030; gDNA_ID_1620667; Annot_ID_48084
ggaacttttatacgtttttttctctcaaaatatttaacatttactttcttctttatacaacgtttccttctacatagaagatcaaaagaagttttgtatagtagatcaaatactatcatcacttaaccaaattggcttgatatactgtcaaatcatgaacataaacggtcgctgtacttagagttgttcaatacaacaatcttgttcacgagccgtgcctattcccgactttttccaaagtagttgatcaatttaaagcatccacactagcgccacacatacaataaatattatcaatgtatacaaccaaaaaataatgtgaacaacgttataacaaactatagagaagattccaataatgatgatatgacttatatacatgtctcgactttcttttgtatagctgcgataaaacataactttttgttattctgggaccattaattataatgtttcacttaaaaagtgattttggtcccaaaatgttacaggtactaattaccaagttctacaactaggttaaaagtgaaaacacacactcacaatatagttcgactatttatctatatattaaatcagtatggttctgattctactgagtaccgagatttatatatataacttccatgctctaggatttgtgtccggaaagtgttattttgatctgttgccaattttgtgtccggaaagagtcatctcgaactttatcgacgttgtctaatttctgttttcagttctagtaaaacttttattcatttactaggaaaaaaaaggatccgagtactcaacatacataaaaagaattcaggtgcctaaaacttagattcgatcatatatataaaaatacaacacataccatacatgtatcgttgttttttttgtgtgtgtgtgtgtagccatgttgccattttgtagtacaaaaatgtctcatgagtcttgtaaaagacacgtgataacggcttccttcgaccaaccaaattactaatttccaaaatatagaaatcggtggaccatgcgtactccatacctcccatttattagttttatccgaatcctatgccaattcttcacttgtgttgtacgtatattaattaggaacaagtaaatttctttaaagtgttgaagctatatatgatctacactgaattgtgaactaattctgtgatctataggcatacgttatatttacagttaagattagttatatcatatagcaagtttagattttgaaattacatcttcctcgtttttgttttcacaaaaataacaaaagtaacttgaaaaattagtgatcatctcggcctcaatgtgtgcacgtgatctgacgttgaccgtaatattatagtccggagttttttttttgtcgtatcctattctttgggtgcttgtataattgcagttttgggagtaattaaaacacaccaagtccatatttttcataatggaaatttggaattttatttgagacagtaaacatttcgatagtttattttataacaacctaggattttcttttgttccgccatatttagaaacaaatcttagtccatcacttacagtcttacactgttaaacactattcatctcgatcatttttaatgatttttatagtaatcatctttacaattgatgagacaaatcaattttgagtggttgcaaaatagaaaccttaacttaatcaaaagaggcctgatattaattaagagcttccacaaatttagaatctttcttttcatcatgattaaaagggaaaatatatgataattattttggattattactattttgatgagtagaaagatttgactagcttgagtggacattgttctccttttaccatatttattgagaaaataaaaaagaattcgttatttaaccaacattatttcaaatgtagtaattttcgaaagtaaattttaatggatatttccaagcattcaaatagtcaaatggaccaatgatattactaagaaacatcagaaaaaaaagaaaaacacaagaataagaaaataaaatgccaacgactagttttaaaatctgtacttttttttcctagaaaatttgtacaaaaaataacaaaaacccaaggcgtatattcaaaggtcgaaactttatggtaatgtactaatgtctcagtgaaaaaattcagaaactttttaataccctaaattttttttttttttttttaataccctaaaactttttaataccctaaatctttttaatttaggaaaagaaagaaaaaagaacatactaatttctattgcatgcttctctcctacaaacggacacttctttattggttttgttcctatcataagcctctgtgttcgtgtctgcaacagatctgtctcctctttcatttttctttttctctttagaagaaaccggaaaacaacaaaaccctctacccgaaagggaggtttttaaagcactgtgccaaaaagccatcgttttctccagaaacccatcagtttcctctgaatcctgcatgtgaaagtttggtgaagaaagaggagagagatctgtgatttcctttaaaacgctgccgtttctctccttttttttgtttctctttctcttgatctctgttgttctgtggctgatgatgtcactaacaacgatgcccacttgcctccatcaatttttcaatctctctcatcttctttaatgtgatacaagttctcatcttcagtgtataagaatcataaattttgatcctttagcttctctgtttcttcttcttcttcttcttcccttgtaacagagagctcgaaagttttcatttttctttctttccccatctgggttttcaatttcactaatttactactcctgatttgggttttttgagattttgtggacttaaagctattgccatagtttgtcacacaaaatcacttcaaatttggaaactttttgcaaaaatgagatacaattcgatttggtacttatgcaagattccgaggaggaaagagatgatatttttctgctgaattaatg

SEQ ID NO: 19485 - DNA, 3003 bp, Unknown; identical to SEQ ID NO: 19484
  misc_feature (1)..( 3003): 2750-1469P.txt file - cDNA_ID_1822030; gDNA_ID_2926171; Annot_ID_140129

SEQ ID NO: 19486 - DNA, 3000 bp, Unknown
  misc_feature (1)..( 3000): 2750-1469P.txt file - cDNA_ID_1822034; gDNA_ID_1620667; Annot_ID_48083
aaaaaaaaaactccggactataatattacggtcaacgtcagatcacgtgcacacattgaggccgagatgatcactaatttttcaagttacttttgttatttttgtgaaaacaaaaacgaggaagatgtaatttcaaaatctaaacttgctatatgatataactaatcttaactgtaaatataacgtatgcctatagatcacagaattagttcacaattcagtgtagatcatatatagcttcaacactttaaagaaatttacttgttcctaattaatatacgtacaacacaagtgaagaattggcataggattcggataaaactaataaatgggaggtatggagtacgcatggtccaccgatttctatattttggaaattagtaatttggttggtcgaaggaagccgttatcacgtgtcttttacaagactcatgagacatttttgtactacaaaatggcaacatggctacacacacacacacaaaaaaaacaacgatacatgtatggtatgtgttgtatttttatatatatgatcgaatctaagttttaggcacctgaattctttttatgtatgttgagtactcggatccttttttttcctagtaaatgaataaaagttttactagaactgaaaacagaaattagacaacgtcgataaagttcgagatgactctttccggacacaaaattggcaacagatcaaaataacactttccggacacaaatcctagagcatggaagttatatatataaatctcggtactcagtagaatcagaaccatactgatttaatatatagataaatagtcgaactatattgtgagtgtgtgttttcacttttaacctagttgtagaacttggtaattagtacctgtaacattttgggaccaaaatcactttttaagtgaaacattataattaatggtcccagaataacaaaaagttatgttttatcgcagctatacaaaagaaagtcgagacatgtatataagtcatatcatcattattggaatcttctctatagtttgttataacgttgttcacattattttttggttgtatacattgataatatttattgtatgtgtggcgctagtgtggatgctttaaattgatcaactactttggaaaaagtcgggaataggcacggctcgtgaacaagattgttgtattgaacaactctaagtacagcgaccgtttatgttcatgatttgacagtatatcaagccaatttggttaagtgatgatagtatttgatctactatacaaaacttcttttgatcttctatgtagaaggaaacgttgtataaagaagaaagtaaatgttaaatattttgagagaaaaaaacgtataaaagttccaatccatttaagaagaaaaagaacatttaaatgttgacaaatggttgaatttatttgtgatttcatctctgacatatgtatctgattcccaacgtatttgtaattaatgtgatcattagaaccacattaaaatacagtactacagtatgtatcatggtttagcgtttctgcaataaatacttccatactgttatctatacccaaaagaaaatattggagacaaatttgactttttctttttgtacatttgactttttaaaatagaacaggtagtataattagtgttgcgaggatgaatttgttttttaattaagggatgagtttataaaatacacctaaaaatcgaggttgttgtagttccaaaatacagtggactaaaaaggtgacttcacataggtagacatctctctgacgcataaactttaacgttttaatttggaaagtgttttgattctcgagcccaaactgatgctttaacacttggaacttgtaagtggtgaagagaatctttatctaataaactcaggatttactttgctataaacttataaccctatttttataaatttgttctaactaatgtagacaaatgttaaaatccaaagaaaaagaaactccatgatgtatttgttctttaaaaaaatataatttgaatctaaatagtaatgtattttgagaatttttacctaatttgaatcttttgaatatatatttttcttttgtgcaccaaacaatttggatattcaatttttgaaattttggctatccgtagatggacaaatacaaaccgatccaaacatagaactcactgcatatttcagatggaatttcaacatccaaatctaaaatttcagtacctaatacttagaaaatgtctaaacctaaatggctaaatttatgtacaaattagaaatcacgtgcccattgcccaccattgcttctttgcggcggcattgctaggctccacgtgtcagtcttgaatattaagcaaaactaaccaccacacagaactaaattgtcccccacatgttcttctatgtaatgtttgataaagcctagtttcagttatcctataaaatttactagtctcaaacaaaagtcaaaagctcaagataagaaaaagccagctctattacatgttactatgatgacattggcttaagaatagtaacttatacatacttaaacaactgaatgttttatgtggttattttcttaaatctcattatcaatatagtaaaacaattggtagtcctcaggtagcaagtgcaacaagctttttaacttctgtttagtttggtatttataattaagttttcatatgcttaacaatagcgtctgtagtccaacggttaggataattgccttccaagcaatagacccgggttcgactcccggcagacgcatttcctcattaaatcttttgcgtgaaacttcatcagagtaaaactatgtcgtttgaattagatcggtatcaccggaaccaccctaccggttaattaaaccggaaaacaaaccgctgagacttccccacgtgtgtggtctacaatctctatcgattccacagcacaaaaatcttttgcgcttttgagatttttccagaattcaatctttcgagtgttgttgaattcagaaatg

SEQ ID NO: 19487 - DNA, 3000 bp, Unknown; identical to SEQ ID NO: 19486
  misc_feature (1)..( 3000): 2750-1469P.txt file - cDNA_ID_1822034; gDNA_ID_2926171; Annot_ID_140128

SEQ ID NO: 19488 - DNA, 3000 bp, Unknown; identical to SEQ ID NO: 3824
  misc_feature (1)..( 3000): 2750-1469P.txt file - cDNA_ID_1822077; gDNA_ID_1620667; Annot_ID_48069

SEQ ID NO: 19489 - DNA, 3000 bp, Unknown; identical to SEQ ID NO: 3824
  misc_feature (1)..( 3000): 2750-1469P.txt file - cDNA_ID_1822077; gDNA_ID_1620667; Annot_ID_163981

SEQ ID NO: 19490 - DNA, 3000 bp, Unknown; identical to SEQ ID NO: 3824
  misc_feature (1)..( 3000): 2750-1469P.txt file - cDNA_ID_1822077; gDNA_ID_2926171; Annot_ID_140114

SEQ ID NO: 19491 - DNA, 3000 bp, Unknown; identical to SEQ ID NO: 3824
  misc_feature (1)..( 3000): 2750-1469P.txt file - cDNA_ID_1822077; gDNA_ID_2926171; Annot_ID_199496

SEQ ID NO: 19492 - DNA, 3003 bp, Unknown
  misc_feature (1)..( 3003): 2750-1469P.txt file - cDNA_ID_1822181; gDNA_ID_1620669; Annot_ID_48130
acgtgtaactgtagatgcacacagagattgtgtaataccttcaccgatagggtttgtcgaaatgactaatatataaaatatttaaaagctaaacgtttatctatagcaaacaacaacaaaaatagagttaaaaagtatagtccaaaacttgaaatgaagatttggctattagattaatagggttggtacattaatgactgatggcttatagatagatatggataccatttcattttatcgttctgcttagaacttagaagaataaacaaaacaaaagcatgtgggaagagaaagctccctttaacacctcaaatatggctaagagtccccaacacaaatcctattaataaattcacacatacaacaagtgttcatgacctaaccaacaaattcaatagagcccacttttttgagagacaaagatgcaatactcaaaataggaacaattctcttaatatgtctaattacatttttgttactagacaagtcagcatcaccaacttcaaaactaatgaaccttatttaatgtaccgaccaaaagtttaacaaaataaatagtaaatttgctagatttttatcttctgatccaatctaatccctattacgatggaatcaagttcaaaacaaaaacatgtcacaagggatcataatcggaaaagcaatctttatgtataagatatagttaggtatgtgtacacatgtgttaatgtgtataaatttgtgtatattttgtatgttacagcaaactatagaagagacaagatgttgattttttgtaaaaggaccaccttcaaaatattattattaagggttttattaattgaaacatatacatatatacacacatatgaatagatatattcacccccacaaggttatgtgacattcttttcaattctctgttctttccccttcttcgacgctgctcaacattaatttctcctttcactttcatagtaattagctaagtttttttcctcaataaatcaatctaagaaacctctaaatgactaaaccacgtatacgtttataccttctatttttttttttgtctaatacaaatttaacaataaaacattttatgttgacaaaaaaaaatacaatcaaaattttaataaagtgacccatattcgagtttcaatgatgactgcaatcaataagttgcattgtaattaaggttcattagattatcaatatctcacgtcattctacttcatcatcgatttgttttatagtttaattacaattactaaatgagagttgtagtgtcatttgtcaaacttttttatttttattatataaatagatgtgttaattaatttgtgtttgatcaaaacacaaatagaagtttaacacacctttttttcgtcaagaagtttaacacacatgaacacgcaaaagaagggggaaagcaatatgcatgatgagatgtgctgagaaagcaatgcgggaaaaagtcagcatcaaaacagctctttctctttccaattgttctatgagtttaaatactgatggtaaaacaacatatacaattacaaactgttaggctacatatcttagtccatatgtatatcacttgattaattaacattttatgtacgtatctaacaaactttaattttagatgtgcgagttttattacattattggcttaagtcttataacgggattaacatctttaaaagattgccatttttgaactaatttcgaagtaatttcggtgacactaaaaatatcataattttcacacgcacaaacaaaaattcatgatcttcaaatcatcgaatgatcatcttattagttacttatattcacaatttaaaatgcacctcataccgttactactttttataatgcagtggcttcgagtactacatctatgatattacctattagattgttcaaattgtagttgatgatgatacgtatatagaatgatggagaacatattattaggtttacgaatagtgtcattttgacatatgttacatattacatatatacaccctaattaataaaaataataattcaacatacaaataaacccctatctaacactatgattaatgaaatgataatgacttatattcaaagtttattaaatttgaataaagggaaaattataatttttgtttgaaaaataacattaaaatagaaaacgtcatttattttgtgaaacagaaagagtactaattaaaagttacaaatttaatgtgggatttaaatcagcttaactagcattgaaacaattttaatgtcactaatgctgttatttaccattcttaaaccttatcgtcaataactctatcacccagctatcataacagtttattaccatacattttttttggaaacgagttattacaaatttcttcgaatcgagttattgccatttttacgaaaaataaaacaaaaattataattgctcatgatttcatatttttctatatatgattctatggtctaaccattgtcagcatttccgaacacaactgaaattgtcaaagacaaaggtaatctaaagaaaagaaccaaagcactccaaagccttaaagtgttctttactttggttttaaaatttgaatctaaaatgaacagaagaacgttcctcgttatatgtgtacactctctcaacactgtacttaaaaataaaataaagcacagtgtagtttcaatttcatatgctaaatgtaggattatttttccaacggtcgaaaaaagcttaaagcatttttaaccaattctttatttattttttaaaacattacaaacttttcatatttttattactctctcaagtagtctcatcttcttcttaatccaaaggcccaaactttgaatcatcactatcactctctctctctctctctatctctcaagaactgcacggacaacgacatgcttttaatttccatgcaaatctctcctttcttctcaagtcatttttgaaaatcaatcaaaaaactgaaacttggtggagcttttatcattcactcatcaatg

SEQ ID NO: 19493 - DNA, 3003 bp, Unknown; identical to SEQ ID NO: 19492
  misc_feature (1)..( 3003): 2750-1469P.txt file - cDNA_ID_1822181; gDNA_ID_1620669; Annot_ID_164040

SEQ ID NO: 19494 - DNA, 3003 bp, Unknown; identical to SEQ ID NO: 19492
  misc_feature (1)..( 3003): 2750-1469P.txt file - cDNA_ID_1822181; gDNA_ID_2926171; Annot_ID_140103

SEQ ID NO: 19495 - DNA, 3003 bp, Unknown; identical to SEQ ID NO: 19492
  misc_feature (1)..( 3003): 2750-1469P.txt file - cDNA_ID_1822181; gDNA_ID_2926171; Annot_ID_199483

SEQ ID NO: 19496 - DNA, 3000 bp, Unknown
  misc_feature (1)..( 3000): 2750-1469P.txt file - cDNA_ID_1822185; gDNA_ID_1620669; Annot_ID_48129
tgcatattgctttcccccttcttttgcgtgttcatgtgtgttaaacttcttgacgaaaaaaaggtgtgttaaacttctatttgtgttttgatcaaacacaaattaattaacacatctatttatataataaaaataaaaaagtttgacaaatgacactacaactctcatttagtaattgtaattaaactataaaacaaatcgatgatgaagtagaatgacgtgagatattgataatctaatgaaccttaattacaatgcaacttattgattgcagtcatcattgaaactcgaatatgggtcactttattaaaattttgattgtatttttttttgtcaacataaaatgttttattgttaaatttgtattagacaaaaaaaaaaatagaaggtataaacgtatacgtggtttagtcatttagaggtttcttagattgatttattgaggaaaaaaacttagctaattactatgaaagtgaaaggagaaattaatgttgagcagcgtcgaagaaggggaaagaacagagaattgaaaagaatgtcacataaccttgtgggggtgaatatatctattcatatgtgtgtatatatgtatatgtttcaattaataaaacccttaataataatattttgaaggtggtccttttacaaaaaatcaacatcttgtctcttctatagtttgctgtaacatacaaaatatacacaaatttatacacattaacacatgtgtacacatacctaactatatcttatacataaagattgcttttccgattatgatcccttgtgacatgtttttgttttgaacttgattccatcgtaatagggattagattggatcagaagataaaaatctagcaaatttactatttattttgttaaacttttggtcggtacattaaataaggttcattagttttgaagttggtgatgctgacttgtctagtaacaaaaatgtaattagacatattaagagaattgttcctattttgagtattgcatctttgtctctcaaaaaagtgggctctattgaatttgttggttaggtcatgaacacttgttgtatgtgtgaatttattaataggatttgtgttggggactcttagccatatttgaggtgttaaagggagctttctcttcccacatgcttttgttttgtttattcttctaagttctaagcagaacgataaaatgaaatggtatccatatctatctataagccatcagtcattaatgtaccaaccctattaatctaatagccaaatcttcatttcaagttttggactatactttttaactctatttttgttgttgtttgctatagataaacgtttagcttttaaatattttatatattagtcatttcgacaaaccctatcggtgaaggtattacacaatctctgtgtgcatctacagttacacgtctctgtatgtgaccgttcgtttttgtggagacagtagtgaaatggagcctcgtgtagccaccatgcattggactcaggaccattttcactaaaatgttcatactttaacattagcaattattacgtactgttgtacatttggatttctgcagctgtacaatcatatgtaccatgtacaacaaattatcaaaaatttcaccgaatattgtggcggtcaaattgagaatcatctaatctttgtgtaagagaggcgtatgaacaagtacatgagaaattaggcctatatggacgaaagatgtactcttcaagcccattttgtaaaaaggcctatcttcatggtttagtttgaacataaaggatttagtacccaataaaatatgtaaatctgcagattagtgtatcgaacaatttattatttaattttacccactaatccgctatatttaatcatctagatttgtttcacagcttttatatgcataacgtgatataataaatgcagggttgtaattagtagacctccattggttacgaagcgtccactactaagaaaatactaattaaaaacaaaataatctatatttgtgatctgaaaatgaaatcatgtaatgtatcaatatgtgggttttatagttggtaaacacataaatgacatgaccgtcaatttcggagctatacctggctcattatcgactatattatctgagataatgttaaattatttgtataaattttgttgcaaatcacttttaatggttttctataacaaaaacgaatatatgatattattccaaagaagataaagctgtatcgacctatccaaacatatagtattacgttagatagcttgctccacgtttacaagcaattgacaattactcaattagtgacatgaccacactataatgctttcacgtaacatgatgattcaatctcatagcaatatacattaatgtttttatatggactatttttaaagtacatatgctcgattcgtaatttcattcgaattttgactttacggtttaacaaaatataggaataatcaaatttaaaataatcctagtttggtaaggttcggtacaaaattagtttcactgttgattccttataaaatatatcttcaaatttgagtaaatttgacattgaaccgcttttaggtttggttaaaccatttgcagcatggcaaaaagtgaaaaaaagattacaagaagagaaaggaatcgtttgtactgtgtatgttgatgcaaaggtgagctattgctttccttaaacgttaaaagaacatcttttcggatcaattaagaaactttatcaaataaaaaatactttatattttaataccatatcgagaacgatacttcctctgcaacacgcctacaatacgccaacgaatatttatatcatcaaaccactctattgttttcatttttcaacaaaattcatctttaatttttcgatccaaggagcttctctgatcctaattaacctaaacaaaacattcattacaggtatcttaaagattatggaggaagaagacaagaaagtgatgaagtgttttagcttcaagagaatcatg

SEQ ID NO: 19497 - DNA, 3000 bp, Unknown; identical to SEQ ID NO: 19496
  misc_feature (1)..( 3000): 2750-1469P.txt file - cDNA_ID_1822185; gDNA_ID_1620669; Annot_ID_164037

SEQ ID NO: 19498 - skipped

SEQ ID NO: 19499 - DNA, 3000 bp, Unknown; identical to SEQ ID NO: 3838
  misc_feature (1)..( 3000): 2750-1469P.txt file - cDNA_ID_1822197; gDNA_ID_1620669; Annot_ID_48126

SEQ ID NO: 19500 - DNA, 3000 bp, Unknown; identical to SEQ ID NO: 3838
  misc_feature (1)..( 3000): 2750-1469P.txt file - cDNA_ID_1822197; gDNA_ID_2926170; Annot_ID_140099

SEQ ID NO: 19501 - DNA, 3003 bp, Unknown
  misc_feature (1)..( 3003): 2750-1469P.txt file - cDNA_ID_1822213; gDNA_ID_1620669; Annot_ID_48120
atatacaacaactttctcttcagacaaagttctttaaactggctgttgggcctttgcccatgtatgttttatatttggcatgttaaattggcgttgtagtatgtagtatgaataaaaacacacttgtgacagaaaaatagattaacgtttttttttgtgaaaaatgtaaaataaataaataatcttgacatataattatacaatatatacatgtctatatatgtatacctatcaaattagcaacggtagttttcaatgtatttctgtcaaaaagaagataataacgtctccaaataatcacttcccaaatcctcaaactcaaacaaaccaaacacatcacatactgtctcttctccagtaaccgtcttctgcatttcaacttcttgacacatagaatcttcattactccttcgtctctttcttaaatcgaaccaagtttcttcactcccacgcaaaccacgagtctccgagtgctccttagttgaacaatagctaagggcacaatggttttcaaccatcccatcaacgacttcatcataagccttaaccgcctcttttcctgttctcaatccgattttgcggctgcttcttaatggatcggacgtatttgagttgttcatccggtagtagtttgggttgcaatccatttccatagcttttataactgtttcgagctgaaaatttgtgtgagctttttgagtacctctaattctaaccgcggctttatcgtaagccatagctgcttcctctgcagtttggaacgttccgagccaaaccctaacaccgtttctcgtcgaatccctgatttcggctgcaaatttcccccacggacgcttccgtactcccctgtattttcttgttttgcaagaaacccgagaagacaaagaacatgaatcaatggtagggttggttaatggatcatgattggttttgtttgggaaagaagcaatagcatcgagaatctctgtccattcctggtcctccgtcgacatatctaggctttgaagcatttctctagaaccttctggtatgtcatcaagggtaggcaacgcttcccaagttctagaaacttctggaacttgaattgatcttgtatcggtttgtggtgttccgatgtaattcgcccaaacgttctttaggatctcgccgtctagttcttggatattgccaaaagccattgttgaatcagagaggagtatgtgttggtgagatttagggcattttaaagagattgttgctttgggggttttgtgtgtacgttgaatgggaaatctgcggcaggataattgggaagtacagttggtgaaacttgtgttctaaggtactgaccgcatttcatggagggttttaggttccacataaaatcaggggttttctgtgtatacacacacacacgtaccattatgtgaatagatcatcttaagtcaacttcaataaattaatttaataatgttacctcagtttgaagtataaagattgtgtactattttcattaaaaaagtgcagattgtgtactcttgaaaaggactagatgcagagtattaattcacttttgtataataaacatattaatcttcagtttaacgcttcatgagaatctatgacgtgttcccaccagaggcacaaatccgttttggagaattgtgattattaaatcaaacataagtttattgttttaatgtttcgttccacgctcgtcgcattttaaaaaactttttaactatttttttggttataaaaagaaatatagcttctaaatgacttgtttctactgttagattgatgaaccttaatactgatttagcttttcatacatcgataaagaattcttcggtgtttagttaagtttgttagaagttattattttaccatacgatcacagtttaacgcatattgcctagagaatataatataatgataactaaacgctatcaaaatgtgaaacgaaataagaaaaaacatgtaagggctaagtcatcactaactttttatccaagtattatttgtatgagatcattttccgtaagtccaaagatttgaaacaatgatgagaggtgaatagaatatataaattccacacgctttgaaacatagcttacaattgaaaaaaaatgaaaaagagattaatatctctattcaatgtattatagagaatgagctagagatactttatatggtaggttcaagtcacctcaagtacgtatcagctaatattaaaaaactatctgctaatttttatatcaatcgtttaagattcattcattcgttctccactacgagagtttcttgctttggcacatatatagttcaagaaagtctcgtgttggagagactccaagcgtgctagagcgtttcgattagaaaggtgttttgttcgagcattaaagattgttgcaatggttctatcttaaggtagtcatttgttaaattttggtattcaatctcgagagcttcataagtctagcgagcttcataaacacactacaagtcatgtgtataaaatttccaattctgtaatcacaagtctaaacttaatctgaatccaaatcacaaaaagcattttcaaaattgattaaaaaaaaaactacaatatagaaaagattttaattgatgcttggaacggaactaacattacctgttatgatttcgggcctgaaagtattctgagttttgattcagaaccactcggtattaaagaaaaagaagacttactacaaaaaaaaaattatatatatttttatgaattattataaccaactaatattgtctctattggttctaagttcaaacttctaaccttcgagggccgggttcaaattccagtaagtgatttattttttgctaacaattctcttatggcgggaaaattgacttctgtcgagaattagggtttctacaaatctttctccgttctaatttcggattaagatttcaatctctccttctcgttttcttctttggtgctgctgagaagaaattagtgaaattgtgaaagagaagatg

SEQ ID NO: 19502 - DNA, 3003 bp, Unknown; identical to SEQ ID NO: 19501
  misc_feature (1)..( 3003): 2750-1469P.txt file - cDNA_ID_1822213; gDNA_ID_2926170; Annot_ID_140093

SEQ ID NO: 19503 - DNA, 3000 bp, Unknown; identical to SEQ ID NO: 3835
  misc_feature (1)..( 3000): 2750-1469P.txt file - cDNA_ID_1822221; gDNA_ID_1620669; Annot_ID_48118

SEQ ID NO: 19504 - DNA, 3000 bp, Unknown; identical to SEQ ID NO: 3835
  misc_feature (1)..( 3000): 2750-1469P.txt file - cDNA_ID_1822221; gDNA_ID_2926170; Annot_ID_140091

SEQ ID NO: 19505 - DNA, 3003 bp, Unknown
  misc_feature (1)..( 3003): 2750-1469P.txt file - cDNA_ID_1822266; gDNA_ID_2926148; Annot_ID_197882
cgcgtccgtgggagtgatcaaagctgatgtgttcatcatccatatctgaatattctgtatatttttgtttatagaatgaatcctattgacattaaaatatataactttggatgagtctacgtatggccttttttgagatgttgctgacattatcatatactaaaataataaagtgcaatgtggttcactcgcaatagccgcattttgtcaccatttaagggaatttactatttttgtggtgaaattatgtaaattaccacatgttaaaaaaagaaaaaatattagatctcacaacttcatttgaactagggaacggttgacattgttttttttttaaatagttaagaaaatttggaaataattttgaaaagtaactttgacataaagaaaatcttgagaattgatcttttatttgttttcagaaatgattaattttatgatgatttttcttgaatcatagaaaagtcatataggaattgctccatgaacaaagcgacaagtttctccgtcatttagaagatctgtagataacatttgccaagaaaggactcacaatcacttctcaaaatgatccagctgacgagccattgatcgaaccatcttatagctgacaagacatttaatgaaagtcgcgcttacgtcacttacactcaaaacacgttcttctttctaagaaatcgtcaaaaaaaaaaaaaaatagattgcacgaaaatgccgagaatacaacttggaatgttttaactagtcccattaattcgatattttacctaggtcaagtaacactcttataaataatccttgcactctcgaagaaaaagaaatagggagtaaggtaattcaccagttcccaccttaaaagtaaacctaacttgctatatctaaatacaacaaaatttcactcatgaggaggagaacagttcacggatcatccaacttgttctctctcattccttctttcttattctcaaatggacatcatcgtgtttcaaagattttcagcacttattacagagacaatctacatttctacatctcattcattttgtcatttgtaatcaagtcattcaagttaaataataaaaagtgtgttttttctttcaaaagtttgtaatcttttgaagctttgtcaattcaagtttattggtgtgattccatagtcttgtttgattgcgtttctagtgtgtttgtgagattcaaacattctagttcgtgtgttgttgtggattcaacgacaaaacttccattttccatctctaccatcgttccatcgaatcattcaaaccgtaggccgagaaaccgagaaacataaaccttaggtaaattccaaggtttgcatcagattgctttgaccaaggctcataagtcattacttgacaccactctatctttcacgaatttaagaatttagagagactttgtgaccttttggatatggttagatctctgttattatttggttttgagagtcattggtaattgattcaacatctttatcacttaatagtgatactttttctatgtgtttttttttgttggttctatttggcttaccctttaagaattctagtggtcttgtatcttcctatatatctaataacatatggttgtttctatttcatttattttttatatttaccgcgacacgcatcagaaaacgaacttggcaacttaacaaattagctattaatcaatggacatgacatgtacatgccaaattaaattgggcttaataaaacacgtgttcgttggaaaaaattaaatatgttttgtatttttatagttaatagtgtaacgatttatcatgatctgcgccgaaattcacgctcagagttatatttgagttctttaaattattatttataaaaagtaagtcagaatatgaaaaaaccggaaacatcgatcacattaacttaaaagtaataatttttcattttaggatatattttggataccgacagctttgtcactacatcgaacaattttatgtttttttagaatttgttaatatgatgataccatttgatatccaataagatacttatttactttatattattagattagaatcatctacaacataaaatctaattatttagatgagtattatagatttgttacctctcgagtttaagatcgataactcatgttgttgaaacaagaaacataaaagatagttctgaaatttaaaacataaaagagagtttgaaattgaaaattatatatattgtagaaagtttatgacaagaggagaaagtatgattcttttagtatttgtttctatataatattaagaggaaaaagtaaagttcttatagaatatattctttcaagcaatttagctacttccagctaaatcattaaactcctttgactagcaaattaaataaatttaaatcatataaaggtaaaaaaacacacataaaatattagttttaagaaagatgaaaacaagtaaaaaacataaacaaccgaacatgtgtcaattgttttcagcagtctaatactcgtgtgactggccaatttaatgactatgactcactttcaactacctaacggtttcaaaacatgttaaccttgttttttttctttaaacaaaatcccattagttgtcactttaaatctctattattatagtaattattacaatctttttttaagaaacacttagtgacccatattaagaaaaaaataactttatttttaaacccatatcttatattttgtatctatccaattccttcctattatgtaaatttaattctatattattatattttgttgtgacatcttctcataaaataaataaatagctatcacaatttgatagcacctgaatacttcacctgaaactttccccacctctctctctcatcttatctatcaccattgcttcatctccaaatcttgaaattctctgttttattttcaagaaaagacagaaagtgaaacaagtcttttttttttttttttttggtgtggaacattgatatttgagtgacgatg

SEQ ID NO: 19506 - DNA, 3003 bp, Unknown; identical to SEQ ID NO: 19505
  misc_feature (1)..( 3003): 2750-1469P.txt file - cDNA_ID_1822266; gDNA_ID_2926148; Annot_ID_139196

SEQ ID NO: 19507 - DNA, 3003 bp, Unknown; identical to SEQ ID NO: 19505
  misc_feature (1)..( 3003): 2750-1469P.txt file - cDNA_ID_1822266; gDNA_ID_1620670; Annot_ID_48141

SEQ ID NO: 19508 - DNA, 3000 bp, Unknown; identical to SEQ ID NO: 8138
  misc_feature (1)..( 3000): 2750-1469P.txt file - cDNA_ID_1822266; gDNA_ID_1621195; Annot_ID_174723

SEQ ID NO: 19509 - DNA, 3003 bp, Unknown; identical to SEQ ID NO: 19505
  misc_feature (1)..( 3003): 2750-1469P.txt file - cDNA_ID_1822266; gDNA_ID_1620670; Annot_ID_164080

SEQ ID NO: 19510 - DNA, 3003 bp, Unknown
  misc_feature (1)..( 3003): 2750-1469P.txt file - cDNA_ID_1822270; gDNA_ID_2926148; Annot_ID_197879
taaatggagctgttttttgaagattttccagtaacatttgccataaacaaaactatcttataacttcaaacttagccattggtgcaaggaaaaccatgttttaaataacatgtgcaccgatgcttgtccacattgttgcgtcgatcatcccagcacttgcagtgggtaatagttttaaccacatctttattaaattttcgttccatttcactaaaacataacttaggtccgtcatgcccacattttccgtttgccgacagtccaagcgggcatggtggttttttttttccctgccctattttcaatcaataaaaaagtataaaatatatagaatttagttgataatacaaaaaaatgaaagctctatttttaatgcatatttgttttatagatataatcaatgttttcgatcttgtgaataaggtattagttaaatcttaacgagactaagatattacctttaacattgttcataaggaggaacatgagaaaacaataaattataagtgaagtagcatttttcatgattcagatttgtaaaaacgttttgtatcttacttggaacgttgtttttttcttaataaatatacttaacacatactaaaaatagatttttattttattcaaaaactaaaaatagaaagcagatataccagagaaggtcaaccagctagaaaaaaaattagtgtgttgtaagaattgattgatatttagaaaattaaagttgaatgcgtcaataaaaattaaaaaattgttttttgtcaatctatctttatttagagctcaaaagagtcaactctaagaaatgttgtttgcatatgtgatatgatacggttagatatcgagaaaggtagaaaaaaaaaagaaatagttgtggttggaaaaaataatgagattttcttttcattgatagtatattagtatgtggttaagaaaaatatttgactgcatcggaaatatgtggttagttaatatttgaacttttattttcaattgcctattttatctgcttgtatgattggtaaatagtaactaaataagggttatatctttaactgtctttaatatgattaccaatgaaagcaacaattaactttttgactgttgggaatttgggctgagctttacactcttaaaagaaaaagattgatgtagaaagaaagaaaaaaaaaacaccaatacataagtttcaccgcaaaaaaaattcagtgtatcatccatcaataaactgacaaacaatgagccctatataattaacagatttactctaataaatatctgaaaaatctctactggattgaagaatactttgaagttgtcacaataagtctaagagtctctttcggtgggcaagtggacgttatcctaaatctgtgaataatgggtgtgaaagctttacttaagaactagaatcgtagaaagagtcgaatggtcacaaagctccttacccgtttttggatattccttgacatattcattatggggcttgtgtagtaatgcatttcattttatcttttaaatattatatcaaagtccaatatagacacaagattataactataatttgcttattttataatataactggtagtttggaattttaggttttggttataatcttagaaaacaatgaccctaaaatttatgtcaatatcaaattcccaaatattataaaaaaatactattataaacaaattattacacattaaaagaaatgaattaagagggatcacagtttagttttcgtttcattcatatttttcttaataaaatgaaaatgataaataattggctaaactataataaaagaaaaactacatattttgggtagatgaaaaaaaacaatatccatgaatttgtcatttgttgttcactcgaataataaatttcatatttattgctatattacaattttgagtttggatatttcccctatgaaagaaaagaacatataacatctttgttgtctctttttccatgtcactcgttccaatctcatgatcccatttacactcaagatatattattgtgcaaatgagcatcaacatgatttatatagactttaaagtccatactatttcagttaacctttaccatctcctactcagattcttcttcaactatagaaaccattcacattagttttcgggtttgaagtggcttaaaggtatccaatttgtgaaagcctggaatatgctctgttccattacctccacatgccaaaaacagagctaactacatacttatacgactttaaatcccttttcttcacgtctctacctgcaataatacacatcatcatattacactcatctttctcaacctcaatcatattcacagaaaacaaacttggtcaccgtgtcgaaaacagggtttaatcgagttagttatttagaggttttggtcccgaacaaagacgttgaagttcagtgagagattgagaaggcagactcgagaaaacatgaggctatagaaacaagtctaatgggaacaaatgaagaaaaaggccttgtgccactcattattctctatctccacaaaagaaaagaagagacaaacttgaaaaaggaaatgggtgattcttattcttttagagaatctgataatgcaaaaaaacttactaaaaaagaagattctctttgagattaggacagaatatttgtctttccagagtttaacggttataacatgacgttgtaatatgccatctgagagatgataatacaaataacaagaaccacaccaaagttaagcaaatatttgaaattaaatatcaagaaataaaagagtaaagagaaaaaggagggaccttttgtatgagattataaaatgcaaagctaagttgatatacaaaactaggcctctcttccaccctatagctgaaggagattcggtatgtaaaatgccgaaaaatcgaatttgttccttttatctattgctgtgtgtatagatgtttatgtaaattttgtcaaaggagttttcagtgcaacaatcagagagatg

SEQ ID NO: 19511 - DNA, 195 bp, Unknown; identical to SEQ ID NO: 8142
  misc_feature (1)..( 195): 2750-1469P.txt file - cDNA_ID_1822270; gDNA_ID_1621195; Annot_ID_57560

SEQ ID NO: 19512 - DNA, 3003 bp, Unknown; identical to SEQ ID NO: 19510
  misc_feature (1)..( 3003): 2750-1469P.txt file - cDNA_ID_1822270; gDNA_ID_2926148; Annot_ID_139193

SEQ ID NO: 19513 - DNA, 3003 bp, Unknown; identical to SEQ ID NO: 19510
  misc_feature (1)..( 3003): 2750-1469P.txt file - cDNA_ID_1822270; gDNA_ID_1620670; Annot_ID_48138

SEQ ID NO: 19514 - DNA, 3003 bp, Unknown; identical to SEQ ID NO: 19510
  misc_feature (1)..( 3003): 2750-1469P.txt file - cDNA_ID_1822270; gDNA_ID_1620670; Annot_ID_164076

SEQ ID NO: 19515 - DNA, 3003 bp, Unknown
  misc_feature (1)..( 3003): 2750-1469P.txt file - cDNA_ID_1822276; gDNA_ID_2926148; Annot_ID_139190
cataccgtcatcgattacgcttgaactctctaatttcgtctccgatgtgattgaatcagttgattctgtatcagagccatgatgaagaagctcccaatcatccattgatgatcgaattcgaagatttcagattgggattgcaataatcagaaaccctaatggataaaaccccaaatattggaaaaggatcgcaacaaattagagcggttgatgatggaaaagaatggttcttatccactttgagaaagtaattacgtggaggtatctaattggttgcgtgtcaatctcagtcctcaactaaattttttggcattaaagtttagtagattcagagaactatagtatttattcattttgttctttcatttttattttattttttaaaacgatttaattaggattcggcaataaatcgtatggtgcggatcaaatgaattaaacaaatatgtatcggttaaaatagagtagacgatgtaagaaaaatatatataatcaagattcaaacggttgaggtgggttttgcaaataaatccatcggtagattgaaatattttcttatttattatttatagattagtatttataatagtactgaccaaaaatatagaaaaaaaaaatcggtaaaaactttagaccgattttatatagaaataaatttagtttataacggattattgtccgctccaaaattaaatggtttagtctctaatagtttagtttgtttcgaaaagaatggttcttatccactttgaggaagtagttatgtagaggtatctaattggtcacgtaacattctcagtactcaactagatcttttgacattaaaggttggtagattgagagaagtatggtatttattccttttgttctttcatttttttggtttttcacaatgatttaattagggttcacgacgaatcgtatggtgcagatcaaatgaattaatcaaatactagatgatttacccgaactatgtacagggagaaatagttatatgaaatatataaacaagtttttggaaacagattttatattatcacttgatatataagtgtgaatatttgaatatgatttagtaactgatatattttggagattttattagttaggaattaggatattctatatttggaataagattttaaattaaaatattgacccaaaagaaaatctgaaatatcattcctataattcagaaatatattcgaatattttttgtattttataagattttattttggaaacaattcaatataaaaactgaaaagagtatgaataattatgttttaaacgtaataaatttttgattatcttttattattcttcataattctatgtagttaggattgatttattgcatatcccttattttattaatcaatttatattgttacgataaggttttgggttgtaaataaattttaactaaaatgagtaaatgactaattaaattgaataaactgtgtaaaagttttaataaattgataaggtaaaaatttgaaaagaaataatattgaaagtaatcagtaagcggatacatttttaacatagattaatattgaaatattgttcatagtgaatgtgtaataaatgaaatgttactaactaatttatgtaaaactatgttccgaatatattcaagaatcatatgggctcacatatacatttagattttttgcaatttataacaaaaaaatagaatgtcatatatgttaaaattctaaatgttttctataaaacctaaaaaaataaagtacgaaacatataataaacatttatattatatgttgttcatcataatttatgatatatactttttacttgtttgctcaaatatatatggttttttgattaattttctttattaattgctactctcttaaatgtagaggaaaaatatgcataagtaccactaatggcattatatgtaattagtctagtaaatattggataactattaagtttgttgaaagtttttctggttacgacatgtcagcatgatagtcttgtaaatcacacgtgaatgtaaggttttttatttaaaatacttctcaattaatatataggggatgtatcagttaaaatagagtagacggtctaaaaccatctccaatgcacacctctatttttttctttcattttagagacaaatttattttagaggaaattagattttgctccaatgtattcttctaaaatagtttttttctccaaaatagagaaaataaatagattttactctttatatagattaaaacgtaagattcctttattttagagaaaaatctattttagagacatatattgaagcaaaatgtatctaacatagaatcacctctaaatggagaaaaaaaatagagatggacattggagatgtttagaagaatatagattcgagcggttgaggcgaataaatctttctgtagattgaaatgtttattatttattatgaataaattatcatataatagtgtaaaccaaaaattatagaaaaaaccccgctaaaactacatacccattttctagaaataaacttaggttacaacggattgttgtctaccccaaaatttggatggtgtaatctgctaatggtttagtccgcttcgagtaacatttaagcaaatcgttagtataaaatgggtaaaataagtgatactcaaatacatattaaataatgtcaactttaaaatattttaaatatttttcatgtttcaaataattttcttacaaaatatatcatttaaattcttaaagaataaacaaattttaacaagaaagtaaacgtgaaccatacttcaattcttagtccaaatgtagttcatacaaatatgacaataatttaacaaaaaataagaaaaagtattcttccgggttaaaaaaatagattcgatcaaacttaaggtcttttttgttaaagtcttcttttcgcaaaaacctaaaatctcctctcctttgtactctcaagcttcgttttttcttcttctccgtccaaatttctccatg

SEQ ID NO: 19516 - DNA, 3003 bp, Unknown; identical to SEQ ID NO: 15603
  misc_feature (1)..( 3003): 2750-1469P.txt file - cDNA_ID_1822276; gDNA_ID_1620670; Annot_ID_48135

SEQ ID NO: 19517 - DNA, 636 bp, Unknown; identical to SEQ ID NO: 3864
  misc_feature (1)..( 636): 2750-1469P.txt file - cDNA_ID_1822280; gDNA_ID_1620671; Annot_ID_48171

SEQ ID NO: 19518 - DNA, 3003 bp, Unknown
  misc_feature (1)..( 3003): 2750-1469P.txt file - cDNA_ID_1822280; gDNA_ID_2926200; Annot_ID_141468
atatttgtagtcctattagttttgtttcataagtcttaatctcacttcagttacagttaatacatgcatgatcaattctactatatatgcatatataatgcatgcatgttgtagagttgagggttatgacacaatgctatgcctattttacttgtactaattaaataaacattgaaagaaagctgtaaggaagaatatgtagataaaagacaaaaagtaaaatgagagtggaatccaatgtggacttcaactagatgtcatattttgtatttttctaatatcaatgtttaacgcatatttggatgtaacgttgggtgtcgaataattttgctttatattcttcactttaacgtctaaacatgaaccaagcacatggtggtcttggaagatgaactataaatatcaagaaaatgatgtataatgggtgatccaaaccaaagcacatataatctctagagttaaagtgggtcgaataatctctagagtttgtggaacgcatagtatctttgccatttaacgtacgtacgtatctagaaccaataatgataaaaactgtagtggattaattactcgaaactcaaaagtcttattcccaacatcaagataagtggtaaattttaatactggaataaaccattatcccacgaaagagaatattataaagtttatatattggttgactttgtgttaaataatgatgggattatattaagaaaaacttgttaaatgaatatcagaatcaataatcgtatcaattagacaacttgattaagatttgattctggtcagtaaaatatatgaaacatgctccatatgctatcatatcttcaataaaataaacgaattgaagacgagtatatcgctatcatggcaggttccaattagttatctccatcctcttttttgtttccacaaaggagccactttgtgttctttatttttgaaaatgtttgattggttaattaaccaagtgaagttgtaatactattatgcaagaattaattgcagcactctatgggtttcgtaatttggttaatagtttaatgggcctcgtacaagtcagcccattggatatatttcagattaatcgggtcgggtcacaaatgattatccttgttgccttgcctttgccaatcgtttgtttccaaaataaaaatcatggcgagacttttcgtctctatccctatgcaacccacacaaataagcttccctgcgtcttcttctcagccactattatctccgccggcgaacaatttcaccgatggtggagctgggggattatgtcttacacggagaatcagagacagttccgtggtgacgcgagcagggcctagtacgagcagctacttgctcgcgttcgccattcctgctactcttatcgccgccactgtcttcacttcaatcaaaatcgctgacaaactcgacgaagatttccttgaggatgtaagatccttcaatcttcgtcatatctaattcagattcgatttttgtctagctctctagtgttttaccttgctttaggtctagtttgtctcagtcttagtttaggtaatcgtggttaagcaaattttatttgggggaaacaattaagcaaatgactaacttttgaattttgggttgaattggttcaagttgttgaattaacggcatcgttagaaagtaagagataatcacatcctctaagagcgcattgcaatctaatagaattgaatctatctctttctggaaggagctcattcttatatccttgaggtggaatggatagaaacagtgttattgtatcatctataaggtctgtaaaactaactgctttgtactattatttttctgcttctgtagattgcgttgaaccaagcgataaaagcagcagaaaagggagagaatggagaaggtgatatctcactggacgatgtgattcaagaacctgtgcttcaacgaacacgtaaccggcctaaacgtgaagtttaaaaacgcacacacagcttcttcatgatgggaatagacgttgtaactgtaatacatgttgtgttttgtataagaaaatttaagcgtgtagcctttcctagtcccgtttatagttgtagttactggttttacattaccgtttgatcattttgtaaagaaaaaacggatgatgaatcaaaaacctcattacagttaccattttaagttgagagcagattattttattgtggccgagctttcttctgctgtaaatttgtaattttggaagaaatagaaggacatcttttgtatgcttccattgaccaaatactgtttcgtgtaatcgtctaatccgttttagattgggcttttaaggcccagtatgagttgtctctttacttttgaagtagtagtgtttaggaattcttctcttcgcttcaaatcgacgtctgtgtgaggttaaatcgcgtcgcgttttcatctagcagttttttttggttcaaacgaacgagacacaccagctaaaggccatttgcgttagatctaaggagagagcgacgtatacgtggtttcaagcaaattctccacgggaaggagattaacgagcaaagtcgatttcagtctcctttgtggagttttctcttcaacgcatcgagggtatggtttagctcagtttcgtgatttctagcgtgttattcatcgagttcctgtgtgtaatttgatgatctccaattgtggttattggaaacgagtttggatttagcttctgatgggtttgtttttcaattgaatctggagattgattttcgtttagctgctgcacaatttgggtctgtttttttacaaaatttaaagccacacaagctttttatttgtcttgttcataattctaagccactatatttgtgtcggtatcatataagttttgtgaaatttagctcagttttctttgttgtgattggattctgcgtcaatcaggtggcacgaaccatggttatctaaacttggtggtgatccacgaagagtcattgtgggaacaagaacacagtgaatcgaatg

SEQ ID NO: 19519 - DNA, 3000 bp, Unknown; identical to SEQ ID NO: 3884
  misc_feature (1)..( 3000): 2750-1469P.txt file - cDNA_ID_1822288; gDNA_ID_1620671; Annot_ID_48167

SEQ ID NO: 19520 - DNA, 3003 bp, Unknown
  misc_feature (1)..( 3003): 2750-1469P.txt file - cDNA_ID_1822288; gDNA_ID_2926200; Annot_ID_141472
aattcaaaaaccaaaaatattagttatgatccgtatgcacaaaccgtagatttaaggaaacgaattaagacttaaacagaggtcactgacgttgtaatgacttatgtgctgtctttttctatcacaaaatgtcttaatccaaagtattaattagtagtagtagtagacccatttaaaaaacttttccaccattaaatagaacaaacatttcatgtgttcttgatagttgatagttgataccaacacatgtctaatgtttaatatggttatgctacagccacaacttaacaattatacattagcatgattgcatctacatataaaaataggtattgattttttttttttcttaacctaaacgagaaattaactgatcaatgaagtttcacatcaaaattaaatctcactctaggaccgattttcctggttcaactctcaaatacatcggttcgttctgatcattgatttgagtggcaaagtctataaaccggggtaatgccttcccaaacgaaaccaaaccggaccgaaattctcattttttgtgagcttccaaatcagacattagcttagccggtttagcctttttctgtcggtacttggcatatgagtaccacacaccaccagctgtgttgaccactaaaccggacacgttcaaagcatgtacttcaacaccacccaagaggacaaaaccgagcgtctaggagattaaaaaggaggcaaagattagtaaatgattgcctctatagatttcatctcgaaagagagccaaatgagggtttatacttacagtggaaccaacgcctttgagaacaccaacgatggttgttgttagtgcagagttcacaatggtgcaaagaaacatggtgaagttgaggacaatgcccataaccagtgaaagaatgagaatcaccaagaacggcaaataagaacactgtcaaagaaaaaaaaattgattttgacattttgaagagactagtttctgagaatagccgcaagcttggaatgatgaagtttctaacctttgcaagtaatagtgatagagagtttgggaattcgccggtaactatgatgaggatggacaaaaatgggagagaaaggaagctgttatagaacattatctcgatggaggaaagcccgtcttctgcaccagacttctccaccagcacaaggtacatagtctgcagcaatgatgagaaacaatattcatttactcgtatgggtgagtggagactgatttaagagaaggaaaagaacaaatgaaaccaacctggaaaaagacagatgttaaagccaaaccatacccaaaaagatcaaaagaaaaatcaccaagagctgcaattacacagcctgcagcggtaagtagtacagatagagcaacctgaaaattaaacaaaagattcagagcttgaaacattatacaaattcacaataaaaaatcaacattcttatggtaagtacctgagttgttggtttgcctttaccaaacaaaaccccagaaatcaaaacagcaagtggagtgagtctcttaatggcgatatacattggaatgtttactcctttcaaacttgcaagagcaaatgcaacattagcattgtagaagatagaaaccggaagaagctttttggccgtagccatatcaattcctttagctcttgtgtatcccattcgtctaccaaagtgtataagcaaagaagtagccaattgctaacacaaccaaacaaaagcaaacgggaccgaattcataatcagcatttacaggaagtgaataatctctttagatatctagtacttgagaaatatggatatcagtacctgaagagtaagaacagtcatggaatgtggatactgcataatcacagccttgttgataaaaaccattgccattgaagcaatgccatatgaaacagctgcgactaaactgcatcatagaacaaaccagtaaataaggttacttaaaatgtctatagctttgattctctataactctctagagatccagatctacccagatgaagaaccgcaattcaaagtttcaaaaatcacaactttaagaagttatcgaatcctctgaaccaataattatcacccctactaactaaatcgatcagaaacatccctaatcgaattgaatttgaagaaacagagcactaaagaaggagactacagtacctaatggacgaggtaggctccatttcagcttgaacctccatggggaaagaagagtgatttgagttataaatctttggaaaattcctctcagggtacacgtttcttggcagattcaacgtgatttagacgcatttcgagaagaaagagcgattaaaaattacttctttatcagattttcatttcaatttacagtttttttcccttggattgaggatcttagttcttaagcgaggttacagctttttccagtggattactaaattggacgagagagtaatagtcaacactcaaaaagtctttaaccttctgtcggaacaagaagggcttgctgtccgttgctcatctcatatagtaaggcccaaaaggcccaaaggcttctttttccaattaaaactaatttttgtatagcgaaattatgatgaagaaaatcgtttcatggcacgtcaaaaaactttcgcacaacaatttttttttacaaaagggtcacttttatcagaacctaatctatcatagagttcccatcaacaaaaaacctatcatagagtctagtcctgtgttaacgtaggtgatgggttggtttcatggtttacatggacaattattatggtgtaagaaaaagatgatgggtacacatattccatttaaccaatgtgaaagattcacatcacctttttcgatttttaatagattcggttttaccttctcgtaacgtaattctaagaaaagaaaacgtcaatcatatttactaggaaagataattataatttattgctttttctctcactctctgacctgaaatctcctactgagatttttgaagtgtattcaacaatg

SEQ ID NO: 19521 - DNA, 3000 bp, Unknown
  misc_feature (1)..( 3000): 2750-1469P.txt file - cDNA_ID_1822304; gDNA_ID_1620671; Annot_ID_48163
tgtttctattagggcatgtcagaagacttcgaagtaagcaaaaccaaaagagtaaaaactatcttttcgctttttgcattattggatttaagtagaattgtaaaattaaagaagtaaacagagtagtactcttccaaagcaactcaaaagctccaaaatttctgtgaatctccccaagaacactttttggatctttaattcgaagtgatcggcaatgaagaatccgacactctttgctccaaaaagtccacactttttccagcctattcttcccggtttcaagagccacatcgtaagtaatctctctgtttctctctctctgaacatatagactcatgtcacagttctactcgtttgttgcagaaaatccctgtgaagttcttctccaagcatatagagggaaaacacgagggaaatactgtctatttgagatcatatccttcgaggagaacgtggaaagtgaagatggagggccataaactcactgaaggttggaaagagttcgtggaggcacatgatcttcgagtcggtgacttcgtcgtcttcaaacacaaaggagacatgttgttccatgtgactgctataggacccagttgctgtgaagtccaatacgcaccatctcgtagccacgacagaaacgaagagagtgatgaaattggtataacataatcatcattcagagagcatttagatttatctagactctttactatttgttaagcgttagatttctgcttcaggggaatcttcaagaaatgagaaaattattgaggagaatgtgaaaacagaacctgatcagttttcaccagatctaacatgttttagccaatctgtgaccgcttcaaacctaacgagagatttagtggttagttagttatgattgtgttccatatatcgattttagagtttgagtatgtgtgactgtgtttgtgtttgtgtttgataactactgcagggtattcccagagatttcgcaaagcgatatggtttgaacataggtaggcatgagatagttttgatggacgaagaaggaaatacatgggaatcagaagttaaaagttacaagtctggtcgggtttttatagctggaggttggacaagtctctgcactgcaaataaattagaagttggagattcttgtacatttaaactgctccgcaacccgaaaattcccgtgtttcggctctgcagccgcccaaaggctggagcagaggctcggccacacaagagatctcgagtccaaagtagcagcggggggagtagacagaagcatgacgtgaggcagaagttagatgaagaaggagggccatctcgttgcactcggtcatctaacaaggctactggtgatcaagaaaagttgcagcaaacgcaatcttgctttatctttgatcatgtggctaaggtgaaacagagcgttgaagatactttaaatagtattagacggttccgggctaaactcgagacaaaggaacataatttggaagctttgttacaggaaacgaaaactaagttatgatttgaaacatgatctacgcatgtatggagcgttaggttggactttttatagcactctcccacgtaatattaaactactagctacaatgggggatcaagaaagcacattcgttttagggtttaatttattttagggtttcttcagtaagagtttttagattttcttttaacaaaaaggttaaatgtttagattcttttaccaatatagtactcactagaaatatactccacctcaggtaatgcagaggccataaatactagctgagttccctgactcattaatggaaaataaatgttgtgactcattaaaacaggtagcgggatgtctaataaataagaggagccatgagatgataacgaaaagacactgatctttaacttagacttgagtcatttttttgttgaacaatggcggatccagttcttcaatctacgacaaacccacatttctttcagcctcttcttccttgcttcgactcctacctcgtactctgtctctgtccctttctacgagcattagcttattgagaaaggtggtttcgttttaaaaactctttttcatatttttgcagaacactcctgtaaccttctaatttgtaaagattaagttatttggatctttatgtttgtttgtttttttttttttttttttttttttaactaaaatatatttatagaattgggcttcccagaaaatgggcctggccttgaacaaatacaattcagaaaacagccacaaaaagggttaaacggaaaagtcgaatgcttcaccggagagaagatccggacctgctgatggacggaggcaaagaatgagatagataacccagcaaacacaagacccacggtttagttaccacatttggatctttatgttgttgattcatttagttaccacatttatatcaagatttttttttttcaactctttttttacatttatatctagagatattggtagaaaaatgtaatgagtttattatgttacttcttcttttttatatacagaagatttatttcttttacattaaactttatatattgacccatacattctaatagaaacagttaacatagtgatttatctttttgtcaaccatttaattaacatgcataagattggtcaatttattccctgctttatgtgatttagttagttttttcataagttaaataacagagactaatgaagactctgtttataagtctgtgcttaaacaaattatgtacgttaattctctgtaagttttattcacatagttgactttattgaggatcccatactgtttctattattgcatgtcagaagacttcgaagtaggccaaaccaaaagagtacaacatatctttttacttatttgcattattggatttaaaagaaaacagagtactcttccaaagcaactcaaaagctctaaactttctgtgaatctccccaagaacaacaacaaccttcggatctttagttcgaagtgatcggcaatg

SEQ ID NO: 19522 - DNA, 3003 bp, Unknown
  misc_feature (1)..( 3003): 2750-1469P.txt file - cDNA_ID_1822304; gDNA_ID_2926200; Annot_ID_141476
tactgtttctattagggcatgtcagaagacttcgaagtaagcaaaaccaaaagagtaaaaactatcttttcgctttttgcattattggatttaagtagaattgtaaaattaaagaagtaaacagagtagtactcttccaaagcaactcaaaagctccaaaatttctgtgaatctccccaagaacactttttggatctttaattcgaagtgatcggcaatgaagaatccgacactctttgctccaaaaagtccacactttttccagcctattcttcccggtttcaagagccacatcgtaagtaatctctctgtttctctctctctgaacatatagactcatgtcacagttctactcgtttgttgcagaaaatccctgtgaagttcttctccaagcatatagagggaaaacacgagggaaatactgtctatttgagatcatatccttcgaggagaacgtggaaagtgaagatggagggccataaactcactgaaggttggaaagagttcgtggaggcacatgatcttcgagtcggtgacttcgtcgtcttcaaacacaaaggagacatgttgttccatgtgactgctataggacccagttgctgtgaagtccaatacgcaccatctcgtagccacgacagaaacgaagagagtgatgaaattggtataacataatcatcattcagagagcatttagatttatctagactctttactatttgttaagcgttagatttctgcttcaggggaatcttcaagaaatgagaaaattattgaggagaatgtgaaaacagaacctgatcagttttcaccagatctaacatgttttagccaatctgtgaccgcttcaaacctaacgagagatttagtggttagttagttatgattgtgttccatatatcgattttagagtttgagtatgtgtgactgtgtttgtgtttgtgtttgataactactgcagggtattcccagagatttcgcaaagcgatatggtttgaacataggtaggcatgagatagttttgatggacgaagaaggaaatacatgggaatcagaagttaaaagttacaagtctggtcgggtttttatagctggaggttggacaagtctctgcactgcaaataaattagaagttggagattcttgtacatttaaactgctccgcaacccgaaaattcccgtgtttcggctctgcagccgcccaaaggctggagcagaggctcggccacacaagagatctcgagtccaaagtagcagcggggggagtagacagaagcatgacgtgaggcagaagttagatgaagaaggagggccatctcgttgcactcggtcatctaacaaggctactggtgatcaagaaaagttgcagcaaacgcaatcttgctttatctttgatcatgtggctaaggtgaaacagagcgttgaagatactttaaatagtattagacggttccgggctaaactcgagacaaaggaacataatttggaagctttgttacaggaaacgaaaactaagttatgatttgaaacatgatctacgcatgtatggagcgttaggttggactttttatagcactctcccacgtaatattaaactactagctacaatgggggatcaagaaagcacattcgttttagggtttaatttattttagggtttcttcagtaagagtttttagattttcttttaacaaaaaggttaaatgtttagattcttttaccaatatagtactcactagaaatatactccacctcaggtaatgcagaggccataaatactagctgagttccctgactcattaatggaaaataaatgttgtgactcattaaaacaggtagcgggatgtctaataaataagaggagccatgagatgataacgaaaagacactgatctttaacttagacttgagtcatttttttgttgaacaatggcggatccagttcttcaatctacgacaaacccacatttctttcagcctcttcttccttgcttcgactcctacctcgtactctgtctctgtccctttctacgagcattagcttattgagaaaggtggtttcgttttaaaaactctttttcatatttttgcagaacactcctgtaaccttctaatttgtaaagattaagttatttggatctttatgtttgtttgtttttttttttttttttttttttttaactaaaatatatttatagaattgggcttcccagaaaatgggcctggccttgaacaaatacaattcagaaaacagccacaaaaagggttaaacggaaaagtcgaatgcttcaccggagagaagatccggacctgctgatggacggaggcaaagaatgagatagataacccagcaaacacaagacccacggtttagttaccacatttggatctttatgttgttgattcatttagttaccacatttatatcaagatttttttttttcaactctttttttacatttatatctagagatattggtagaaaaatgtaatgagtttattatgttacttcttcttttttatatacagaagatttatttcttttacattaaactttatatattgacccatacattctaatagaaacagttaacatagtgatttatctttttgtcaaccatttaattaacatgcataagattggtcaatttattccctgctttatgtgatttagttagttttttcataagttaaataacagagactaatgaagactctgtttataagtctgtgcttaaacaaattatgtacgttaattctctgtaagttttattcacatagttgactttattgaggatcccatactgtttctattattgcatgtcagaagacttcgaagtaggccaaaccaaaagagtacaacatatctttttacttatttgcattattggatttaaaagaaaacagagtactcttccaaagcaactcaaaagctctaaactttctgtgaatctccccaagaacaacaacaaccttcggatctttagttcgaagtgatcggcaatg

SEQ ID NO: 19523 - DNA, 3003 bp, Unknown
  misc_feature (1)..( 3003): 2750-1469P.txt file - cDNA_ID_1822330; gDNA_ID_1620671; Annot_ID_48153
acactaacatcaaatgcaaattatgaagtgaacagttgcagtttattacaacaaccttcaagattcctctcattctcctttctattttcattgtcactttattcgagtcaaaacacagagacaataaaaatggcgtcctcttacagaataaactgttccactcttcttcatctccttatgtttctgtctagtcttctcacttcctccgccaacctctcctttaatttctatgctagttcttgttctgtagccgagtttctagtcagaaacaccgttagatcagctacctcctccgatccaacgatccccgggaaactccttcgtcttttcttccacgactgtttcgtccaggtaacacgcactaattacgaattactgaggaaagttcaaacaatttggcttaaactttgtttgttggttgaacttgcaagggttgtgatgcatcagtgttgatacaagggaatagcacagagaaaagcgatcccggaaacgcatctcttggaggattctcagtcatagacacagccaagaatgccatcgagaatttatgtccggccactgtttcttgcgctgacatagttgcacttgctgctagagacgccgtcgaagctgtaacatttacttcactcccacttcacttcaatctatattgctctaatccggtttaaccaatcccaactgaaccgaaagcatacacatgaaatcgaaaaaaagaaacaaaccaattctgtatcattttcgcatagactacacaatgaaccaaatataaccggagttgtagatacattaaaccggttatccttattaaggtttgaatgtttttcttctttggcgggacaggcaggaggaccggtggttgagattccgacagggaggagagacgggaaagaatcgatggctgcaaacgtgagaccgaacatcatcgacacagattttactctcgatcaaatgatcgatgccttctcttccaaaggcttgtccattcaagatctcgtcgtcctctcaggtatatatcaacgtttcttgaaacttctaatcaattttaccaacatgttttgctaaacgcaaacagagtatgaaacagagttttttttctttaactatggtaaagtcaattcttgtagcaaaatctgtttcatattctgttacactcagcttcttctttttttatttacattcaggagcacacacaattggagcatcacactgtaacgcattcaatggaaggtttcaacgagactcgaaaggaaacttcgaggtaattgatgcgtctctcgacaactcctacgcagagacactaatgaacaagtgttcgtcctcggaatcctcatcattgactgtgagcaacgatccagagacatctgccgtattcgataatcagtactataggaatcttgagacgcacaagggtttgtttcagacggattctgctttgatggaggataatcggacgaggacaatggtggaggaattagcgagtgatgaggaaagcttttttcaaagatggagtgagtcgtttgtgaaactgagtatggttggtgtgagagttggtgaagatggtgagataagacgttcttgttcttccgtcaattaaaaacattgtccgcttcttaattaatttgtcccattttggatagtctgtaatgttatctcttaaattttgtatttgtgacgagttttggtacttgaaaatcgtcttctagttgtcgagacagatcctctttctaaagttgcgtctaatatgggaaacacattttcgatttggaaacaaacaagaaaacgagtagcaagtaaagtgaaattatttactactactagttagtacagaggaggacgtgagataaatcaagcgtagaacaatcagctgcatgtgacagccacgtgtcgaaatctagtgagaaggacggttgattcattctaacttgggttcaccgtaaagttgacaaacccaaaaaaaaaagaaaaaaggaaggaataataatcatctttttaggcccacgagattgctctttgcttatagagataacatcaaatatatttatttctcaaattaccaactacttatccgtaattaaatcattattattaattgctaataatgaaaacatataattgtatccataattaattgggtatcatatttcaaaaagttagctggttcttcgtcataaatttctccagttttgtcaaaaacgaagaccacagcgagccctaaatcttgtcgggcgttgaatcttacaaatttgcaagtgattctcgtcatacctgtatcttcttcttcttcttcgttcttcttctggtacgcccaaattactctcaaatctcccccaaattactcttatttttcgatctgatcgtgctcaatccattgccatttcaatttgtttgctcaatccattggctatttccaattatctgctcattatttgtgctgtggatagtcgttctggcttcaggactcggtctcgtcattggtttgatatgtctgttgagcatttggtgattattgacatattgttttacatgtttttcgacgttgtgttaggatttgattggtggacaaaggtagctgaatcagcttcagaattgaatttgatctttgtttgagacaagaagcattggtgtttggagcatttctgaggagttatgggatatctgaattctgttttgtcatcttcgagccaggttcactccgacgatggacctgttagcggtggtggcctcaggttcacttttctctttctccccagcttaatctttctcaggtttttagtattaagttataggattaagaatgcaactacagattatagattgctcagaatcatatactctttttagcctttattaatgtctgattcaagtcctagctactgatttgaaaccttgtcttggctgatttcttctgataactcttgcgttatacttatctttattggaagctcatctctgttggtgtgagttaaagagttattgtgcaaaataatatctcaattatacatg

SEQ ID NO: 19524 - DNA, 3000 bp, Unknown
  misc_feature (1)..( 3000): 2750-1469P.txt file - cDNA_ID_1822330; gDNA_ID_2926200; Annot_ID_141486
ctaacatcaaatgcaaattatgaagtgaacagttgcagtttattacaacaaccttcaagattcctctcattctcctttctattttcattgtcactttattcgagtcaaaacacagagacaataaaaatggcgtcctcttacagaataaactgttccactcttcttcatctccttatgtttctgtctagtcttctcacttcctccgccaacctctcctttaatttctatgctagttcttgttctgtagccgagtttctagtcagaaacaccgttagatcagctacctcctccgatccaacgatccccgggaaactccttcgtcttttcttccacgactgtttcgtccaggtaacacgcactaattacgaattactgaggaaagttcaaacaatttggcttaaactttgtttgttggttgaacttgcaagggttgtgatgcatcagtgttgatacaagggaatagcacagagaaaagcgatcccggaaacgcatctcttggaggattctcagtcatagacacagccaagaatgccatcgagaatttatgtccggccactgtttcttgcgctgacatagttgcacttgctgctagagacgccgtcgaagctgtaacatttacttcactcccacttcacttcaatctatattgctctaatccggtttaaccaatcccaactgaaccgaaagcatacacatgaaatcgaaaaaaagaaacaaaccaattctgtatcattttcgcatagactacacaatgaaccaaatataaccggagttgtagatacattaaaccggttatccttattaaggtttgaatgtttttcttctttggcgggacaggcaggaggaccggtggttgagattccgacagggaggagagacgggaaagaatcgatggctgcaaacgtgagaccgaacatcatcgacacagattttactctcgatcaaatgatcgatgccttctcttccaaaggcttgtccattcaagatctcgtcgtcctctcaggtatatatcaacgtttcttgaaacttctaatcaattttaccaacatgttttgctaaacgcaaacagagtatgaaacagagttttttttctttaactatggtaaagtcaattcttgtagcaaaatctgtttcatattctgttacactcagcttcttctttttttatttacattcaggagcacacacaattggagcatcacactgtaacgcattcaatggaaggtttcaacgagactcgaaaggaaacttcgaggtaattgatgcgtctctcgacaactcctacgcagagacactaatgaacaagtgttcgtcctcggaatcctcatcattgactgtgagcaacgatccagagacatctgccgtattcgataatcagtactataggaatcttgagacgcacaagggtttgtttcagacggattctgctttgatggaggataatcggacgaggacaatggtggaggaattagcgagtgatgaggaaagcttttttcaaagatggagtgagtcgtttgtgaaactgagtatggttggtgtgagagttggtgaagatggtgagataagacgttcttgttcttccgtcaattaaaaacattgtccgcttcttaattaatttgtcccattttggatagtctgtaatgttatctcttaaattttgtatttgtgacgagttttggtacttgaaaatcgtcttctagttgtcgagacagatcctctttctaaagttgcgtctaatatgggaaacacattttcgatttggaaacaaacaagaaaacgagtagcaagtaaagtgaaattatttactactactagttagtacagaggaggacgtgagataaatcaagcgtagaacaatcagctgcatgtgacagccacgtgtcgaaatctagtgagaaggacggttgattcattctaacttgggttcaccgtaaagttgacaaacccaaaaaaaaaagaaaaaaggaaggaataataatcatctttttaggcccacgagattgctctttgcttatagagataacatcaaatatatttatttctcaaattaccaactacttatccgtaattaaatcattattattaattgctaataatgaaaacatataattgtatccataattaattgggtatcatatttcaaaaagttagctggttcttcgtcataaatttctccagttttgtcaaaaacgaagaccacagcgagccctaaatcttgtcgggcgttgaatcttacaaatttgcaagtgattctcgtcatacctgtatcttcttcttcttcttcgttcttcttctggtacgcccaaattactctcaaatctcccccaaattactcttatttttcgatctgatcgtgctcaatccattgccatttcaatttgtttgctcaatccattggctatttccaattatctgctcattatttgtgctgtggatagtcgttctggcttcaggactcggtctcgtcattggtttgatatgtctgttgagcatttggtgattattgacatattgttttacatgtttttcgacgttgtgttaggatttgattggtggacaaaggtagctgaatcagcttcagaattgaatttgatctttgtttgagacaagaagcattggtgtttggagcatttctgaggagttatgggatatctgaattctgttttgtcatcttcgagccaggttcactccgacgatggacctgttagcggtggtggcctcaggttcacttttctctttctccccagcttaatctttctcaggtttttagtattaagttataggattaagaatgcaactacagattatagattgctcagaatcatatactctttttagcctttattaatgtctgattcaagtcctagctactgatttgaaaccttgtcttggctgatttcttctgataactcttgcgttatacttatctttattggaagctcatctctgttggtgtgagttaaagagttattgtgcaaaataatatctcaattatacatg

SEQ ID NO: 19525 - DNA, 3003 bp, Unknown
  misc_feature (1)..( 3003): 2750-1469P.txt file - cDNA_ID_1822338; gDNA_ID_1620671; Annot_ID_48151
gaacagacaaatgaattatgaaggagtaaccaaactatagaccttaatcctcacctggcaataaaagtggaagttgcagcaaaattagattgatgaacaatgcgtggagatgtaccataataagtcattttccacagagttccatgtttcaccagaaaattatagctcctgggaagctggttgaacggccagggcgtatgatctgtccacaaatccgtaataaacacctgcgcaagcactcttagaacggaacaaaatcaacaatggctcacactacttaaagtaccaaagatctagactttcaaatgtatttggttaattattccaagaaccaaatttaatttaaagtcagtttcacactcttcagctggaacattcctaagccatcaagtgaatgtaacgcaatgctatccacttacatgaaccaaacatctaaatcctattttctctaattcaagaaactctaaacctgactacaattacaagtttataagtaaactgaatctgaagcttcgaagaactctaaaactaagaagacagaatagagattctccgaacatccaaacagatacttcaatttactaccaaaacttgtaaaagtcccaaactgaaatccatcaatgatcaatcaatcgtgattctacccaaaaagatggatggaaatatcaagacgaacctggtactcatctccaaactcctgattaaaagcagctctaatggcttccgcagaagctctgtgaccaccaccagtatcactcatcaaaatcaaaactttcttcggccgatcagcttcaacaccattcaacggcaatccctcctcacccaaaaccccaccagtcccattttccctaatcccattctcatcactcgataatccgactcctccgacggaggcaaagctctccggaaccactttatcgcagtgaaacctaataaagctattgaaatcgctgataaacctacggagactcgaaccagcactgctcttagtgttgaagctcaaggaagctagggtttttcccatccttcgggagggtaaagtccggaaaccattgaagtacaaggcattggacgatgagagagcatacccatctgaattcgaacacggggatcgatttctagaggttaaacctctgagccgtgggaagaaatcaaagaccggtgcggctgattcctgggttaccgttgaagggttttgcatatttgatagagagagagaagagagattcaaatagccatgaatgatgaagcgcgtcgtgggagagattgcaaaccacaaagataggatttttaagaggagagtggatgatggatggattcaggacgagggaggacgattggagttttgttgtttttgtgtaagaagacgacactgcttttggctaaaccgaaatacttatccgaatattctgtgggcaatttctaccaaaattcaggtaaccaatcaaccaatttatgtaaatgtaaatatcgtgtactcattaatagtttccaaataaaataataaaaatatttatttgttgattctagtatcatgttaaaagcttataaatggatgtcggcataatggacaaattaatttcaaattttagcacatttatcagccattgtatcactatcacctttaaaatctagagtaacaatgtgaggaaatgttcaagtttttcttatatatatatatatcagtttatttgatttttgttttttggtgagagagtgattatcatgagtttgggaatggttttaaccaacttataatgaatagagatacggtatatgttttttatatactggattgatattttagctcaattctctcaaccaaaagattttccgccttaggcttatagtacttcggacccgatccaagccacatggtataatactatagatatagatagtctacatgggttctttggtaaaatgattcattaaacagcgatttttctttttttcttaaacaaccgattcttgtatctgaaaaagagttatgaaaaaacgaagtataatccgactcagacgatttatcgaattcattaagatttcaaaactcgtgagtcaacgttggcattctgatgcacatgtgtttcatgcttccaattctccactcgttcctataccttaatactataattttgaggtacttttgttatttatagttatatttgagctactcactcagatataatcaataatttataaaaggtttagattagaaaggagaaaagtggaaggaactcgtcatggaatagaattcgttattagtaagaagactacgaccgaccaaagaacaagaaaaaggcacgcatggtgtgaaaactaaaagttggcgaggcatgcctttcacatgctttagattctaaaacaaaacgtgttttacaaggaaactacgacgaacatgaatttaattattctaatatctaacaaatataggtgcaaaacctaggatatccctcacattcgtttagtttcgagaaaaattaacagacaaaaaattatttatatatcaaactcataatcaactgttgcaactatgattttaacccattatcaaaaaaagaaagacagaccatttcttataataggccctattttaacggactaaaatcaaaactcgcagtacacatggaaaatgtttagtgggcttttgggcctaacccaaatttattttcaattttagcttttgggcttttggttgttcttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagagatg

SEQ ID NO: 19526 - DNA, 3000 bp, Unknown
  misc_feature (1)..( 3000): 2750-1469P.txt file - cDNA_ID_1822338; gDNA_ID_2926200; Annot_ID_141488
cagacaaatgaattatgaaggagtaaccaaactatagaccttaatcctcacctggcaataaaagtggaagttgcagcaaaattagattgatgaacaatgcgtggagatgtaccataataagtcattttccacagagttccatgtttcaccagaaaattatagctcctgggaagctggttgaacggccagggcgtatgatctgtccacaaatccgtaataaacacctgcgcaagcactcttagaacggaacaaaatcaacaatggctcacactacttaaagtaccaaagatctagactttcaaatgtatttggttaattattccaagaaccaaatttaatttaaagtcagtttcacactcttcagctggaacattcctaagccatcaagtgaatgtaacgcaatgctatccacttacatgaaccaaacatctaaatcctattttctctaattcaagaaactctaaacctgactacaattacaagtttataagtaaactgaatctgaagcttcgaagaactctaaaactaagaagacagaatagagattctccgaacatccaaacagatacttcaatttactaccaaaacttgtaaaagtcccaaactgaaatccatcaatgatcaatcaatcgtgattctacccaaaaagatggatggaaatatcaagacgaacctggtactcatctccaaactcctgattaaaagcagctctaatggcttccgcagaagctctgtgaccaccaccagtatcactcatcaaaatcaaaactttcttcggccgatcagcttcaacaccattcaacggcaatccctcctcacccaaaaccccaccagtcccattttccctaatcccattctcatcactcgataatccgactcctccgacggaggcaaagctctccggaaccactttatcgcagtgaaacctaataaagctattgaaatcgctgataaacctacggagactcgaaccagcactgctcttagtgttgaagctcaaggaagctagggtttttcccatccttcgggagggtaaagtccggaaaccattgaagtacaaggcattggacgatgagagagcatacccatctgaattcgaacacggggatcgatttctagaggttaaacctctgagccgtgggaagaaatcaaagaccggtgcggctgattcctgggttaccgttgaagggttttgcatatttgatagagagagagaagagagattcaaatagccatgaatgatgaagcgcgtcgtgggagagattgcaaaccacaaagataggatttttaagaggagagtggatgatggatggattcaggacgagggaggacgattggagttttgttgtttttgtgtaagaagacgacactgcttttggctaaaccgaaatacttatccgaatattctgtgggcaatttctaccaaaattcaggtaaccaatcaaccaatttatgtaaatgtaaatatcgtgtactcattaatagtttccaaataaaataataaaaatatttatttgttgattctagtatcatgttaaaagcttataaatggatgtcggcataatggacaaattaatttcaaattttagcacatttatcagccattgtatcactatcacctttaaaatctagagtaacaatgtgaggaaatgttcaagtttttcttatatatatatatatcagtttatttgatttttgttttttggtgagagagtgattatcatgagtttgggaatggttttaaccaacttataatgaatagagatacggtatatgttttttatatactggattgatattttagctcaattctctcaaccaaaagattttccgccttaggcttatagtacttcggacccgatccaagccacatggtataatactatagatatagatagtctacatgggttctttggtaaaatgattcattaaacagcgatttttctttttttcttaaacaaccgattcttgtatctgaaaaagagttatgaaaaaacgaagtataatccgactcagacgatttatcgaattcattaagatttcaaaactcgtgagtcaacgttggcattctgatgcacatgtgtttcatgcttccaattctccactcgttcctataccttaatactataattttgaggtacttttgttatttatagttatatttgagctactcactcagatataatcaataatttataaaaggtttagattagaaaggagaaaagtggaaggaactcgtcatggaatagaattcgttattagtaagaagactacgaccgaccaaagaacaagaaaaaggcacgcatggtgtgaaaactaaaagttggcgaggcatgcctttcacatgctttagattctaaaacaaaacgtgttttacaaggaaactacgacgaacatgaatttaattattctaatatctaacaaatataggtgcaaaacctaggatatccctcacattcgtttagtttcgagaaaaattaacagacaaaaaattatttatatatcaaactcataatcaactgttgcaactatgattttaacccattatcaaaaaaagaaagacagaccatttcttataataggccctattttaacggactaaaatcaaaactcgcagtacacatggaaaatgtttagtgggcttttgggcctaacccaaatttattttcaattttagcttttgggcttttggttgttcttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagagatg

SEQ ID NO: 19527 - DNA, 3000 bp, Unknown; identical to SEQ ID NO: 3863
  misc_feature (1)..( 3000): 2750-1469P.txt file - cDNA_ID_1822346; gDNA_ID_1620671; Annot_ID_48148

SEQ ID NO: 19528 - DNA, 3003 bp, Unknown
  misc_feature (1)..( 3003): 2750-1469P.txt file - cDNA_ID_1822346; gDNA_ID_2926200; Annot_ID_141491
gggaacagatcattccacttatgaatccccattactaattttccattcctattacagacgttttacgtagtagggaatctagtttattaatatacatatcacatagattaatcttgattgtttcgcaaattttaatggttttcggaaacaaaaagggggtacaaagtgagctttccgaaatagtgtagttcccagcatccaaatctctcaaaattccttccacaattagaacgattgttcgttcgttcgttttcacaatgtatctcgacctcttttagcaagagtttgctactaaactcgaaccaagtggaaacatgtgggttttgcaatctaaattgaatttgttttgtcaaaaaaggttcttatatttagtacactgtaaaaaatttcgtttctaataacataaatacctagtatagtgtaatggtgttcagagttagcatgcaaacttgtgttaggaaaggatatcaaaagtctcttgtttcaacaatttttattttatattcaaaaattattatgatttgatctttcaagttgattcaattcatgaagatcacataaagcttcttctctgaaatgaatgtcacatggaataattatgtattgaagagcaaaaaccgcatatagtaacctagcttaaaccgaatatacccgaagtcaagactttaatgagaatcagactaaatcctgaatttatttgaaaacaaatcatatgatttggtcttcggtccggtaaaaaaactcagataagtttgaaaacaagttttaatatttatactatatgattccgtcttaatcaaaattgtcaacttacatcaataaaatcaaaactcattttaactagattctaagaatctcatcgaacaatcgatctttgtaaatcttcatggaatagtggttagcatttgtatcattgagtttgaaagaaacggaataattaaagatgacactaaattcacaactttgaacaaacaaacaaaaaaaagtgacaagaaaaatagaggtcggtgtcggagccgcccaaggtggcaacttgttcacacctcataataaaagcttctcacaagttggaagtcgcggtcgagtccagtcaagattttgttgcccttttcccgtgtgggctcaccaccctctttgtcttcttctccccaaaaattttccacgttttttgtttcactctctcaatttatttatattttttttgtcggctcatatttaatttgtgttaattaacacttccttgattagaaagtttttttgtaccgacttaaatttatcatgcaatgtgattggtcgctttcccaaaacaatctctcaacgacaaaaaagtagtaattagtaattaaatacattatattttgttgttaaatagtactcattctatttcaaaatataaaatatttaagtaaatatcacacggttaatgaatttaaatatataactcaagtatagtactaaaaagaatactttaacaaacaaacagaaacctattgtacagtaaaatatcaatcagtgaattattaatcaaatagtaagggaaactaggatataatagaaaaagaattgccgacctacaaatcagagtcaatggtcaagcaagtcaagggaaagttcgtaattgttatggatctggagtctggacaaattaaaaaaaatttgttaaatagaagaggatataaagggaacacagatcctacatattgaaatttatgtatgacgtccaaatttttcttcagcatgggacactgccccgccgaaattattgatttttcggatctttcttctacttgcttcttttttgtttgcttttataagttttgcatagctaattcttaatttcttatcatttatttctagttggtagagacttataaattgaacgtttcaagtctttggacggtatttgagatttcttgtaatttcacttgtaattgtaccacctaacagtgactaaagcagaataaattacgattcgtatacaacaaagtattcaaatttctaaatgtggatatattattgattttattttgggaaacatgtttatgataatcacctatatctcctctatagtctactagaaacgatatttgtcaccttcatcgtacaagactataatgtataattctatccataatgaacgatctagtttttaacatgtactatagagatgaatgattacgacagtaaatttaacccatgcatacgaaaatacataccgatagatataacacaattcagaatgttttacacaatcccatatttttagccaatcagtgtgattttaatagacagctttctatgtcttgttgtgctttttcttcttctttttttcccaaagtctttaatgtcttctggactttatagaagacagctttttatatgttatcttcactttcgaacgactttccttcctaacatatcccaaaacctatctctttaatttattcctatcgtacttacagcttttattaaaaaaactttcttattttaatcactaaacaattaataaaacatttatttatgatttttcattttcgttaaagctcttttattaaaaacttaatcacaacaaatttattaatcttaaatttgaccttaggataaaatttatatattaatcttatatctgttatacattaaataaactttaatttctgcgcaacaaactaatttattatttatttcttgtctctgtctttgtagttttagtataaataaagccattttgctccgaggaacttctcattcagtcggaccaacttgtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccggtaagtccggatttcgtctgatccattttcccgaaatctaagttgatttttgtatcccttcaatttctatgaactgggattttgggaattaatcatg

SEQ ID NO: 19529 - DNA, 3003 bp, Unknown
  misc_feature (1)..( 3003): 2750-1469P.txt file - cDNA_ID_1822350; gDNA_ID_1620672; Annot_ID_48175
agacagttgaatttgttatatcatcagggttgataaacgggcacgaggtagtcaggaaatcgtttctaacactactgtttccatcgcagtagagaaatctaaagttacacacttctggtatcttctcacaagcttcacgccagcatctgtcttctcgttctactgatattaagtaccataaggctccaaacacatgactggctaacatatagagagataggttccaagcagctccagcccaagcggtttcagtaactatgccagatgttcttgtaacttcagtgtaaagtggatagatacgaagaatccttggaatgtattgagtaaatatgacagttatcaaatagtccttagtgatcaaagagaccggcttgttgacattggggatgacagctaagactacaagctgcagcagatacaacagaatattaaagaaccatcaagaaggaactataaaaccattaggaactaaaggttacctgtgggagtggaaggatagaaagaagatcgatgatgaagtaggaggagaggtacttgatggctatagctttaggatcatcaaccaactcgcctcttccgaaaacacgagaagaaggagagatataagcagttctaaactgaaacacaatgtgaatgatgtagaaagcatctataaacgtgcgaagcacactagctgctatctccaagttacgatgcaaattaagacagtgtctttctccatcaacaataggaatatagaaaaacaatggatcaatagccaaagcaatcactgaagcaaaaagaaagattttgttccagttctgtaaaaaagatccttgtgggtttataatattcttctgtgtagtggtactagaattagaatctctcttcttattatgtgaaccaaaacttaaaggtttcttaagtcctctacgaacattcttcaaaactgtgtttagagatggtctagctttatttcttccgtaaccatactctgttccctctgaaatccaatctctgaacctaaacaaaaaatcatcaacaaaaaagaatattttttctgagaatcattcatatccatagtttctcagtaaattcattctaaaaaaaaaaaaagacagagattaaagaaagcaagcaaacaacaaccttacacgattgttgcggccaaaagccatgagtcaagctttttttgctataacggatcctgaatcataagaacatcgatttgatcgctttaattcgttatccccaagtttacagtaacagaaaaaaaaaaaaaagaagaagaagaagaaacggaaactaagaaattaaaacatttatatccgaaactgaccagaacgttgaagtaactgagagaagcgatataagaaagattatagtaagaattttccgatgatctgaaattgggaaaattctcgaaattaattctctgaagtttttttttgaagcagtcaaataagctatcatcgtagagtcaagcttggcatggcgctggaaaatggagactccattggcagtttcttcgaaattgtgtgcattttacaataaaagacaaaagagagggaattattaaagagtcaaaaacatttgatgggcctaaccttaattaaaagcccaattcgatattgaatttgattttaaaattcagaacttgttatatatcagaccaacacagtaaacatcatagattccagtaatgcatcagctataaacagatcctagcagtgtgaaatagtaaatatgctacgatttaaaggtttggatccaaagaattttaccaacttcatagcagattgttcacactctacactcaataagccaaatgtaaacaaaaagatgaccaaagatcttcacaaatctaccatgaatcacaaaatctatgaagacaatgtgatttaaagcaaagatcttacagtttttatgggctcttagttaaattttgagatagtaaattttcatataggcccaaccgcccaagtgagcaatcttgcaggacttttgtgttgtttatggcttttgtcttgtctgactcatgaaatcttgtttttttttgtagataaaagaacgataaatgacgcttttaaaactttttaaagacgagagttctaataaaattaggaaataataatatatgatgttgacaaaaaatgtagaaaaatatatgaaatttttattggcacgaaaaatttgtagcgaaccgcatcatatcatcacttatataagcaatattttttgaaaataactcatttgaatatcattaattaagcagatgagaaaaaatgatatgaggttattgaaatttttaaccaaattgttttttatataaaacatgtaacactttctgtttgttttttcttttatataattttgttaacacctttctatattttctgctttcaatattttctattttcttttattttgaaatagtatttttttttgtagggatttgaaaatagttttttttttgtagggattttaaaatagtttttgaaactactaactaattattaataaaattcaatgctttgaataaaatctaaatggtatacaaatattaaactttacaagaatatgagttaactatttaatacctttaagatttcatatttacttttgatgatatgtacattttaatacgtatatggcaatatcattggtagatacactatttctaacttaaattttaaaatgtggtaaaaacataaaattgaaatactaagaaatgttactttaacacttttatcctcaaatttggatttctggatgtttctataggtcgaaccaataattaaagaattgatagtaacaaaatgggttttaatattgattagaagaaaattaaattaggttaaagaaaaaggaaagagtagacgaaaagttaaataaattttaatagggttttaatattgattgatataactctctgactcttctgtgactcttttcaacttctgactctttctctttcgctctctcattcttaacaagaaaaaaaactggcatcatctcatcatg

SEQ ID NO: 19530 - DNA, 3003 bp, Unknown; identical to SEQ ID NO: 19529
  misc_feature (1)..( 3003): 2750-1469P.txt file - cDNA_ID_1822350; gDNA_ID_2926150; Annot_ID_139254

SEQ ID NO: 19531 - DNA, 3000 bp, Unknown; identical to SEQ ID NO: 3888
  misc_feature (1)..( 3000): 2750-1469P.txt file - cDNA_ID_1822354; gDNA_ID_1620672; Annot_ID_48174

SEQ ID NO: 19532 - DNA, 3000 bp, Unknown; identical to SEQ ID NO: 3887
  misc_feature (1)..( 3000): 2750-1469P.txt file - cDNA_ID_1822358; gDNA_ID_2926150; Annot_ID_197988

SEQ ID NO: 19533 - DNA, 3000 bp, Unknown; identical to SEQ ID NO: 3887
  misc_feature (1)..( 3000): 2750-1469P.txt file - cDNA_ID_1822358; gDNA_ID_1620672; Annot_ID_48173

SEQ ID NO: 19534 - DNA, 3000 bp, Unknown; identical to SEQ ID NO: 3887
  misc_feature (1)..( 3000): 2750-1469P.txt file - cDNA_ID_1822358; gDNA_ID_1620672; Annot_ID_164133

SEQ ID NO: 19535 - DNA, 3000 bp, Unknown; identical to SEQ ID NO: 3887
  misc_feature (1)..( 3000): 2750-1469P.txt file - cDNA_ID_1822358; gDNA_ID_2926150; Annot_ID_139252

SEQ ID NO: 19536 - DNA, 3003 bp, Unknown
  misc_feature (1)..( 3003): 2750-1469P.txt file - cDNA_ID_1822366; gDNA_ID_1620673; Annot_ID_48186
tcctgttcgatatcatcactcccaggcaacgccacttcatcatcatcactttcttgcaataaatcaacattgggaacattgctgaagacattgacttctccatactttttaggtctggcaatgggacctccaggacggccacggtcttttttcactagtagcaaagggttgatctgaaattacaataatgtaattactggttaaccacatacactgattattttgttccaattaacaaatcaaatacttctgctacctctctgaacaatgctatgagggaagcagatgctgctgagatggcttttctatgggtacggtactttttatccgttttatactgagcaagatcatgcagcaagtcttctgtcatcaactgaagtatagcagacaaaaaaaaatatagaagaagcaaaaagacaactcagaaaaaaaaaaaaaaaaaaggattggtgctgtaaaactacatttatatgagaatgttaaaccagagttaagaactagttacctcgggaatcctaaggaacatttctcgtaccacattgagtgcgacaggaatagcctggttacatatatgaaaacaatgaattaaaaaggaaaaatataaatgatagaataagctttctagttaagtccctccctaggtgtttgaaatcacacctccggacttgagcgatcgtgtaaaaacttattcactatttgcttgaacagtggctccacggcatccgaaggtacctgctcgatataaaaatgattggaaggattgcaggatgagaaaagggatgatgctttaaagtgtaagatgtttgtataccccatcatggcaagcctgaactgctgctgcaagtatttgtgtaatgtcctttacaccatcctgcatttaagagcatccctgtttcaataaattttcagcaaagaaattgtaaaaagggcagttagcaaatcttaccttagcatacgcttgaagataagtataaaatttgaataaaagcaacttgtgaagaccaattgttcgtgcaataacttttataatcatcaacctggtctgcaaaatttattgaatacatggttagttagctcatatgtttctatagaatggatgaagcgagttaaaatacaattacctcgcgccgttcataagtttccccagtgctcttgtcatcagtttccccactgctcttgtcattagtttccacagtgctctcgtcaggcttaggcctaataaggggaagcaacctctctgcaaaattctgtaaaagaagaaaaacattcaagtacatagccacatagaaaaagctaggaaatgaccactacaaaaaagctaggaaatgaacctgtgcatcatttagatgattaagaggtgaataagttgaagtagtgttctcagacgacgcacgctgctttcgtttaatacttcgcatggcgcgttgcagttttgcttgctttttcttcttgctagaagatgtacctttgttgttggcctaaacatcggaaacaggacctagtattatacttaattcataatgataaaaatgatagtgacaactatatgaaggtggaaaattctattcacaaccagtagtaagcgtcttcgtcatagtctctaacaaaattcatgtataaatatgttgtttaccttgtaaacagcctctctgttaaacacaacctgagatcactatcatcctcatcgttaatgttgtcgtagtcaagaagaaaccgaagggaagatatcctgatcctgaacatgtaaaaaaaaagagaagttagtaattcgaccaaccaaatcatatcgaaatcttgcacagttaggaagatatacctaggtgaagtatgaaagcaggcttcacaaatggcaattgctactctgtcatgtttatcaccaaaccagacttttttcttgtgaagctcacaaagggtaacaagtgctctcttagccttggtttcatcttcttgctacaaccgaagttaaaaatcatctacttgattatacactgatcagttacacaaaaaacccatgaaaagggaaaagaaaaaagaaatacctccaacatagagaaaacaatcttgtgaagagatttgtgccttggatcagtgatactcattttacgaatggtttgaacaatatgagagaaagcaagctttcgcaagtttttatcaccaagagtttgaatatctagaaacagagctaacaaatcctcgatgacaagactctttaacacacaccaaagcaaacatattaaaaaaacattactttcgattacgatcatcttagaattcgtatcaatcacgtaataaataaaaaaacatacctttcgattcataagaagaatcagagattgcgcaacttggtaccgaagccccgacggcattgccaggcatgaggtacggagtaaatcagtcaattgagctggaaaagcggcgagctggttcggataaaacggagtgacatgagcgagaaacatggctcggtctcggagttccttagcaacggaagggccggggccgacggaggagaaagtgagagccgcctgttgctgaaagagatcgacggaggctctgaactgtttgtaaatcaaatggacctccgtttcgtaaccctctggttcacgcttgatttggctctgaaggataggaaggctgagcttctaggagatccggctagaagccttcaaggactccggcgtaagacctagagatccggccataatcggaggttttttcagagagggaaaggaaccaaccaaaccctttaggttttatacaaacacacagacttttgatatatttataggtttagttcttcactgtaccagttcggtttaggatttgattctctcggtttaggattttatttgaaaccattacaaggccaaagcccatacggccagaggcccaatacaaggaaaaaacgcaccaattgaatgaacaaatttatttgatttttgaatgaacaaattaaataatggcttctccttaaaattatctaagctcgcttgaccaatcatg

SEQ ID NO: 19537 - DNA, 3003 bp, Unknown; identical to SEQ ID NO: 19536
  misc_feature (1)..( 3003): 2750-1469P.txt file - cDNA_ID_1822366; gDNA_ID_2926200; Annot_ID_141464

SEQ ID NO: 19538 - DNA, 3003 bp, Unknown
  misc_feature (1)..( 3003): 2750-1469P.txt file - cDNA_ID_1822376; gDNA_ID_1620673; Annot_ID_48182
ctaaagcgtgcaactggagaattcaccaaggacgagaacgatgctaacaaacttaaccgcattcttcaactcacaggattcagtgacccagtctatgctgaagcatatgtgacggtacaccattatgatattgctcttgaagttacagtaatcaaccgaaccaaggaaacccttcagaacttgtgcttggagttagcaaccatgggtgatctcaaacttgttgagcgtcctcagaactacagtctggcacctgaaagaagcatgcagattaaagcaaacatcaaggtgtcgtccacagagacgggagtcatattcgggaacatcgtctatgagacatcaaatgtaatggagcgaaacgtcgttgttcttaatgacatacacattgatatcatggactatatctcccctgctgtgtgttcagaggttgctttcagaactatgtgggcagagttcgaatgggaaaacaaggtaatttattgaaaccttttatagttgtaccttcttttcgtatgtttgttggagtttggtataaccaattcctgttgtattctttatgtcaggttgctgtgaacaccacaatacaaaacgaaagagaattcctcgaccacattatcaaatctacaaacatgaaatgtctcactgctccgtaagtgtaaattcttctttcatcctgtagaaacgaaaaactcttcttactaattaatacttctttacttgcagatccgcaatagaaggcgaatgtggattccttgcagcaaacttatacgcaaaaagtgtatttggtgaggatgctcttgtgaatgtgagtattgagaagcaaacggatggagcattgagtggttacataaggataaggagcaagacgcaagggattgccctaagtcttggggacaaaatcaccctcaaacaaaagggtagtagctgaggttagctaatcttttcaaaacatattctatttctcgattaatacatgttttaatccttaaaccgcaattggtctaaatttcagtaccataccgatgatttctcacagtggcgtgcaaaggtaacaggtttagactacgtacgtttctcttgagcaattatcgttggttgaatctgcttattatatggagggaggaggcgttcaagggtatatgtaaaaagagtaattggctatcgttcttacttaaccggtatattttctggtatggtaccgatggatttcttcatctcatatggcagtgtgttttttactgtactagacgattttgttttatttgtaatgctttttcttctataatgtcgtttgttgaggactttaaaccgtgaactttatgatattgtagatttcaaagctacatttggtttgctccattttagaactcgtcatttcagatttgatctctattcttttctttcatatgcatttgaagtgaactattcaattgtcaaagctagactttaatttgctagtagctatataatacgggttatgttagcaagtaagttgtaatgaaacgcatgtattaatatggaccatattcaaaatctacaagccaaagaaaccaattgcttcacaaccaaacccataacatttgattcttacagccttttctattctcaagaaaaccaagcaataatttttaagcaaaatttaataatcttaaatcacttgcctcaaggtaccaagggacgatcacatacacattcgcgtaactagatatcgctaacatcattagacaagaaaatactagacgcgagtagaagaggaaagatccaaatacatcatcttctatcataaaatcatccatctctaaccgaaagttggagcacgtttcaaggaaaaactgacataattcctaattacgctcacttttaaaagtttggggtcgttttggaaacaataaaaaagtaggggctatgctttctcaacttctattggactgggcttgtcaacaatcaatatttgggcctgcgaggttgactcgcttctttccgttcttcgttttccaaacagaaggaaaaaaaactaaaaaacaaaatcggatttggaggagtaaacacaagggaagacgaatccacgataatattaaggacatttcataatctctcactttgtgcgagtgtttttttttccgagatccaaaatcttctaacggatccaaagctttgttactccgtggatctcctaccttgaggttcgtctctatctgttaaacttgcgactcagatttcgtagagatcgatcccacttttgcttttcctttgtgaaaatctacaatgttcaatattctctggcgttctttgcttgatctcgttgaatattgatccgatcccggtaggcaaacgattttcatgtttgtgcagctgagtgagactgcgaactatgtagattccattgtttgttcatcaaatctggggagatatattgcatttgtgatatgaactttggttgatccgaagcttttttattattcgattttatgttaatgttttggtcgtagttgtagtaaaagtgatgtgtattgctggatctgaggatttgaatttgtcaatgtcttgcatctttgggtcgttgattagacattaccgaatattcttcagcgattatgatgctttctcatataccgtggatttgagaacatagatgctttcttcattgtactgaaatatatgtagagaggtgtagattattattgctgagtagtattatggggatactctgaaacttcttgtttagaacttactcgagcagtgatgaagatactagtaaggtgcttatactaacttagtaattaaaagaaaattcttaaaattttggatatattgattgttacctgtgatctatactacttcattttatctttaaatcgattttcagtattttaggttcctattctctattcgctttgaatttcttatgttaacataggtacacttgttcttgcatgatttttccttttcatatgagctcacaattttattttatttttcactctttgtgcagcacctgaaaagatg

SEQ ID NO: 19539 - DNA, 3003 bp, Unknown; identical to SEQ ID NO: 19538
  misc_feature (1)..( 3003): 2750-1469P.txt file - cDNA_ID_1822376; gDNA_ID_1620673; Annot_ID_164159

SEQ ID NO: 19540 - DNA, 3003 bp, Unknown; identical to SEQ ID NO: 19538
  misc_feature (1)..( 3003): 2750-1469P.txt file - cDNA_ID_1822376; gDNA_ID_2926200; Annot_ID_141460

SEQ ID NO: 19541 - DNA, 3003 bp, Unknown; identical to SEQ ID NO: 19538
  misc_feature (1)..( 3003): 2750-1469P.txt file - cDNA_ID_1822376; gDNA_ID_2926200; Annot_ID_201774

SEQ ID NO: 19542 - DNA, 3003 bp, Unknown
  misc_feature (1)..( 3003): 2750-1469P.txt file - cDNA_ID_1822380; gDNA_ID_1620673; Annot_ID_48181
aacagacgacaggatcgaggagaagctgacctgaagtgaaccaaaccacataaatggtcaagcaacgagagagaagaagcagaaatgaaactgacgatggcacgagtcgaggtttcggccggcgatgagaaccggcgtcgatcttagccatagggttcaatttctgagttttgaagcgttgggcttttttaattcgttggctcttaggcccaaattaattctctcattaatttacggttcggttttaatcggttctaatttgtcaatccggataaaaagtcaataacatctaacatagaccaaaccattatcccaaagaaaaaaaaaacatagaccaaaccaagtcaacatgaattgaaatttaagaacctcggtcctcccaactcaaccgaaacacaatcaaaccggccaaacattgttttttttacggcaacaaagatatatcaaaacacaaattgcaacactaaaaatcatgtgttttattggtgccttatataacaaatgaaaccttacccgaaaggtttagcatatatgacatccagacaagagaaaacgtaattcatcattttcgttatctaacatacaagaatcaaaacaagatttcacattaacaaagataaagtgtacatagttgaggaaaataaaggtaaagataaagtgtagacaatattcaaaagggtggttgtccaacaatgttaccaggaggatcatagttacaaataataaatgtgtcaccggtcttgcaaaaactgattgcacacccaatcctcgaactcttcttccatacaagttgcgtgtaatgcaaacaatccccattcgccttgcagtgggaagtcctccggtcatagtatttcatctccgaggcccatgcagccaccgcatcccgtggagtccaaccttttccgcttccccagaagagattctccccgtaaggtcccccggagtggataagtttgcaatctccacggcgggttctggcccaccggctcgcatagagggcgaggctattgctccatttgagaggagggagacgaagcttggctcgtaagatgttgtgtggtcggagaaactgctgctgaatggtgttgcgggctagagctttgtcttgagaaaaaattagtgttgatgttgtcggtgttctgtttgatgggatttgaaaagagagagaaggaagtggagtgctgataactatgataatgatgatgaatatcagagttttttgttccattgggatgctaagttagatttgtttctgagcctctagatctagctagtacgatccttaccatatatatatacacacacacacataattgtttatgctttcatatttgtacgtatatatcatctaacgaatctaaacacatgctatgttaataatgcgcaatgacaagtgctaatcatttcggtggaacattgattatttgtagggaatgattttattcaaacaaagcatacattattgagctaattaatagatcattatatatgaaggaagttttaataggatgttttctttttttcttgtaagaagagactttatcatagcaacgagaatatatcccaagcataaaacattatatacaaactcattcaaatgaaaacctaagttagatatttaatttgaccactcttaaaatacttgtttagttataacatgtttactatgcagatttatgaggcgtatcagatggtgtgctagagaacgtgatacaaatttggatgccttgttttcaagaaatcttatacattccttggagatcaatttgtattgtgaggcttatagtcattgagcttaccgttgattaactaaatttatattatatagaacatcaaatagacgaaaaaaatcaatttagttgaccaccgtttgttagctaggttataaactctgacccaaagtgtcctatgctttcagtattcagtttattttataacgtgtggggtcgttttggaaacaattaaaacaataggggctatatttttctcaagttctgttggactgggcttgtcgttaatcaatatttgggcttttgaggttgactcgcttttttccgttcttcgttttccaaaatcaaacccaaaaggatttggaggagttaattcacctgacgaatccaccaccataatattaagcacatttgatctctcacttccttggtgcgagtgttttgttttccgagatccaaaatcttctcttggatccaaagctgtgttactgtggatctcctcctcctctctccctggatctcgtacctttgaggtttgtctctctgtgttaaacttgcgactcagatttcatagagatcgatcccacttttgccttttcctttgtgaaaatctacaatgttcaattattctctggcgctctttgtttgatctcgttgaatattgatctgattccggtaggaaaccgattttcatgtttgtgcagctgagtgagactgcgaattatgtagatttcattgtttgttcatctaatctggggagatagatcgcattttttttttttttgaattttggttgatccgaagctgttttaactgatttttcgtttttatgttattattttggtcgtagttgtagtacagtgatgtgtattgctggatctgaggatttagatttgtcaatgttttgcatctttgggtctctgattggacattaccgaatattcttctgaaattatgatgttttctcataaaccacggattcgagaatagagatcatgtattcaatgtattgaaatccaagcagagaggtatggattatcgccgatgatactgttgaacttcttgtatagaacttactctagcactgatgaggacactagtaaggtgcttatattcagtaattcgaacttgaaatcgccagaaatattaaaagttttgatatcttgtttttacttgtgatctatacttcattatgtctttaatcaattgtaacaattttgctctattcatcttctatttcttatattaacaaaggaacacttgttcgtgaatg

SEQ ID NO: 19543 - DNA, 3003 bp, Unknown
  misc_feature (1)..( 3003): 2750-1469P.txt file - cDNA_ID_1822380; gDNA_ID_1620673; Annot_ID_164158
agagaagaagcagaaatgaaactgacgatggcacgagtcgaggtttcggccggcgatgagaaccggcgtcgatcttagccatagggttcaatttctgagttttgaagcgttgggcttttttaattcgttggctcttaggcccaaattaattctctcattaatttacggttcggttttaatcggttctaatttgtcaatccggataaaaagtcaataacatctaacatagaccaaaccattatcccaaagaaaaaaaaaacatagaccaaaccaagtcaacatgaattgaaatttaagaacctcggtcctcccaactcaaccgaaacacaatcaaaccggccaaacattgttttttttacggcaacaaagatatatcaaaacacaaattgcaacactaaaaatcatgtgttttattggtgccttatataacaaatgaaaccttacccgaaaggtttagcatatatgacatccagacaagagaaaacgtaattcatcattttcgttatctaacatacaagaatcaaaacaagatttcacattaacaaagataaagtgtacatagttgaggaaaataaaggtaaagataaagtgtagacaatattcaaaagggtggttgtccaacaatgttaccaggaggatcatagttacaaataataaatgtgtcaccggtcttgcaaaaactgattgcacacccaatcctcgaactcttcttccatacaagttgcgtgtaatgcaaacaatccccattcgccttgcagtgggaagtcctccggtcatagtatttcatctccgaggcccatgcagccaccgcatcccgtggagtccaaccttttccgcttccccagaagagattctccccgtaaggtcccccggagtggataagtttgcaatctccacggcgggttctggcccaccggctcgcatagagggcgaggctattgctccatttgagaggagggagacgaagcttggctcgtaagatgttgtgtggtcggagaaactgctgctgaatggtgttgcgggctagagctttgtcttgagaaaaaattagtgttgatgttgtcggtgttctgtttgatgggatttgaaaagagagagaaggaagtggagtgctgataactatgataatgatgatgaatatcagagttttttgttccattgggatgctaagttagatttgtttctgagcctctagatctagctagtacgatccttaccatatatatatacacacacacacataattgtttatgctttcatatttgtacgtatatatcatctaacgaatctaaacacatgctatgttaataatgcgcaatgacaagtgctaatcatttcggtggaacattgattatttgtagggaatgattttattcaaacaaagcatacattattgagctaattaatagatcattatatatgaaggaagttttaataggatgttttctttttttcttgtaagaagagactttatcatagcaacgagaatatatcccaagcataaaacattatatacaaactcattcaaatgaaaacctaagttagatatttaatttgaccactcttaaaatacttgtttagttataacatgtttactatgcagatttatgaggcgtatcagatggtgtgctagagaacgtgatacaaatttggatgccttgttttcaagaaatcttatacattccttggagatcaatttgtattgtgaggcttatagtcattgagcttaccgttgattaactaaatttatattatatagaacatcaaatagacgaaaaaaatcaatttagttgaccaccgtttgttagctaggttataaactctgacccaaagtgtcctatgctttcagtattcagtttattttataacgtgtggggtcgttttggaaacaattaaaacaataggggctatatttttctcaagttctgttggactgggcttgtcgttaatcaatatttgggcttttgaggttgactcgcttttttccgttcttcgttttccaaaatcaaacccaaaaggatttggaggagttaattcacctgacgaatccaccaccataatattaagcacatttgatctctcacttccttggtgcgagtgttttgttttccgagatccaaaatcttctcttggatccaaagctgtgttactgtggatctcctcctcctctctccctggatctcgtacctttgaggtttgtctctctgtgttaaacttgcgactcagatttcatagagatcgatcccacttttgccttttcctttgtgaaaatctacaatgttcaattattctctggcgctctttgtttgatctcgttgaatattgatctgattccggtaggaaaccgattttcatgtttgtgcagctgagtgagactgcgaattatgtagatttcattgtttgttcatctaatctggggagatagatcgcattttttttttttttgaattttggttgatccgaagctgttttaactgatttttcgtttttatgttattattttggtcgtagttgtagtacagtgatgtgtattgctggatctgaggatttagatttgtcaatgttttgcatctttgggtctctgattggacattaccgaatattcttctgaaattatgatgttttctcataaaccacggattcgagaatagagatcatgtattcaatgtattgaaatccaagcagagaggtatggattatcgccgatgatactgttgaacttcttgtatagaacttactctagcactgatgaggacactagtaaggtgcttatattcagtaattcgaacttgaaatcgccagaaatattaaaagttttgatatcttgtttttacttgtgatctatacttcattatgtctttaatcaattgtaacaattttgctctattcatcttctatttcttatattaacaaaggaacacttgttcgtgaatggtttttccttttcatttgagctcacagatttttttctctttcactttttgtgcagcaccggagaagatg

SEQ ID NO: 19544 - DNA, 3003 bp, Unknown; identical to SEQ ID NO: 19542
  misc_feature (1)..( 3003): 2750-1469P.txt file - cDNA_ID_1822380; gDNA_ID_2926200; Annot_ID_141459

SEQ ID NO: 19545 - DNA, 3003 bp, Unknown; identical to SEQ ID NO: 19543
  misc_feature (1)..( 3003): 2750-1469P.txt file - cDNA_ID_1822380; gDNA_ID_2926200; Annot_ID_201773

SEQ ID NO: 19546 - DNA, 3003 bp, Unknown
  misc_feature (1)..( 3003): 2750-1469P.txt file - cDNA_ID_1822388; gDNA_ID_1620674; Annot_ID_48204
gcaatttttcaccagctgcgatgccaccgatttcatcaatgacaatagataattcattctctcctcctccatcttccggcgacttacctgaaatcccagatgcttggtacggcaacattcagtatctgcttaatatctcggtcattggtctcttatgctgcgtctccatctttctcttcgttaagctacgcagcgaccaccgtcgtatgcctggtccttctgctctcttctctaagctcctcgccgtttggaaagccacgtgtcgcgagatcgctcgtcactgtggtgctgatgctgctcagtttcttttaattgaaggtggaagctttgtgcttcttttctccattgctgttttagctgtttcggttatgcttccgttgaatttatatgctgggactgctttgttgagtgatgagctttcgaaaacgatgattacgcatattcagaaaggttcagctttgctttggctgcattttgtgtttgttgttattgttgttgttatctcgcattttggaatcgctgctattgaagctaggttgaagtttactaggtttagagatgggaatgggaatatcagtgacccgaacgcgaattctactgctgtgtttactataatggtgcagggtttgcctaagaatttagggtctgatagagttgagtttgaagattgctttaggctgaagtaccctgggaaagtttataagtttattgttcccatggatttgtgtgctttggatgatcttgctacagagttggttcgtgttcgagatgagattacttggttagttgccaagatggactctaggcttctaccggatgagtatgagaatgttggagataacggactagtgttctgtgtgtgttctttgtgggttagggtgaaggttttgtggtctcagattacagagaggtttggatttacagatgatgaaaaactgaggaagctgcaagaactgagagctgatttggagtctcagttagcagcttataaagaaggacgagcacaaggcgctggggttgcttttgtgatgtttaaggatgtgtacacagctaataaggctgttcaggattttcgaaacgagagatcaaggcgtactggaaagttcttctctgtcacagagctgcgattacagagaaaccagtggaaagtggacagagcacccttggctactgatatttattggaatcatctgggattgacaaaagttgctcttattgtgcgaagagtgattgttaatactattctactgttgattcttgtgtttttcagctccccattggccttgatcagtgcattggtaagtgccgggagaatcttcaatgctgaagcattggatagtgctcagtattggctcacttgggtgcaaacttctggctggattggatctctgatttttcagttcctgcccaacgtcttcatatttgttagtatgtacattgtaatcccttctgcgctctcgtatctttccaagtttgagcggcatctaacagtgtctggggaacaaagagcagctctcttgaagatggtttgcttcttccttgtgaacctcatcattctcaaggctcttgtggagtcgtcactggaaagtgcactcctgaaaatgagccgttgctatttagatggtgaggattgcaagaggattgaagaatacatgagcccttccttcttatcaaggtcatgcgtttcagctctagcttttctcatcacaagcacgttcctaggaatctccttcgatctactcgctccaatcccgtggatcaagaagaaaattcaaaagttcaggaagaatgacatgcttcagcttgtccccgagcaaaatgaagagtacgctttggaaaatcaagagccaagcagtaaccttgagacaccacttctccctgaaaacatgtttgagtctccaagattcggggacatagaacctatgagccaagacctctctgaatacccaatcagccgaacctcaccaatccctaaacagaaattcgactttgcccaatactacgccttcaatctcaccatctttgccttaacaatgatatactcttcattcgctccactcgtggtccctgtaggcgcagtttactttggttacagatacattgtcgacaaatacaacttcctttacgtgtacagagtccgtggcttccctgcagggaatgaaggaaagctaatggacacggttttgtgtatcatgagattctgtgtcgacctgtacctcgtctcaatgctgctcttcttctcagttaaaggagattccacaaagcttcaagccatattcacacttggagtgcttgtgatgtacaagcttttgccttcggatacagaccggtatcacccagctttactaagaagtattcagaccgtcgatagcatcatcgacggacctgtggattacgaagcttattctcacccaaacttcgattgggacacttacaacaacagatgattctacgaccttttaagtcttacaaattttgctctttgaccaaatacaactggaatctatttgtatatctcttctttgtgtatattccatcttttgtgcaattattttttgttcacgggttaagtttgcaagatttatcagttgagtccctttaatcattaattttggggttgtaatagcttcattcttaaaatatggggtatgaaatcggaagaaagagaattataaaaatagtaggtgggacccagtgttctctgaagtgagtatatcagagttctcttttcaacacatggactgttacactcacctaacgacgacgaagaagaaccaacatagatctcttctcttcctctcaaactcactaagcttcattgttaccccaaataaaccctaattttgctctcactattcgaagatctaaaatcatctcgcattttgatttccgaatactttcctgagttttgctggtcatgatttctcatttgctctttgttttcccgagaaaaatcttcaggagagtaggataatctctcgagtttcgaaatcgtttccaatg

SEQ ID NO: 19547 - DNA, 287 bp, Unknown; identical to SEQ ID NO: 4472
  misc_feature (1)..( 287): 2750-1469P.txt file - cDNA_ID_1822388; gDNA_ID_1620708; Annot_ID_48925

SEQ ID NO: 19548 - DNA, 3003 bp, Unknown; identical to SEQ ID NO: 19546
  misc_feature (1)..( 3003): 2750-1469P.txt file - cDNA_ID_1822388; gDNA_ID_2926210; Annot_ID_141935

SEQ ID NO: 19549 - DNA, 3000 bp, Unknown; identical to SEQ ID NO: 3917
  misc_feature (1)..( 3000): 2750-1469P.txt file - cDNA_ID_1822404; gDNA_ID_1620674; Annot_ID_48199

SEQ ID NO: 19550 - DNA, 3000 bp, Unknown; identical to SEQ ID NO: 3917
  misc_feature (1)..( 3000): 2750-1469P.txt file - cDNA_ID_1822404; gDNA_ID_1620674; Annot_ID_164194

SEQ ID NO: 19551 - DNA, 3000 bp, Unknown; identical to SEQ ID NO: 3917
  misc_feature (1)..( 3000): 2750-1469P.txt file - cDNA_ID_1822404; gDNA_ID_2926210; Annot_ID_141930

SEQ ID NO: 19552 - DNA, 3000 bp, Unknown; identical to SEQ ID NO: 3917
  misc_feature (1)..( 3000): 2750-1469P.txt file - cDNA_ID_1822404; gDNA_ID_2926210; Annot_ID_202542

SEQ ID NO: 19553 - DNA, 3000 bp, Unknown; identical to SEQ ID NO: 3915
  misc_feature (1)..( 3000): 2750-1469P.txt file - cDNA_ID_1822416; gDNA_ID_1620674; Annot_ID_48196

SEQ ID NO: 19554 - DNA, 3000 bp, Unknown; identical to SEQ ID NO: 3915
  misc_feature (1)..( 3000): 2750-1469P.txt file - cDNA_ID_1822416; gDNA_ID_1620674; Annot_ID_164191

SEQ ID NO: 19555 - DNA, 3000 bp, Unknown; identical to SEQ ID NO: 3915
  misc_feature (1)..( 3000): 2750-1469P.txt file - cDNA_ID_1822416; gDNA_ID_2926210; Annot_ID_141927

SEQ ID NO: 19556 - DNA, 3000 bp, Unknown; identical to SEQ ID NO: 3915
  misc_feature (1)..( 3000): 2750-1469P.txt file - cDNA_ID_1822416; gDNA_ID_2926210; Annot_ID_202539

SEQ ID NO: 19557 - DNA, 3000 bp, Unknown; identical to SEQ ID NO: 3914
  misc_feature (1)..( 3000): 2750-1469P.txt file - cDNA_ID_1822420; gDNA_ID_1620674; Annot_ID_48195

SEQ ID NO: 19558 - DNA, 3000 bp, Unknown; identical to SEQ ID NO: 3914
  misc_feature (1)..( 3000): 2750-1469P.txt file - cDNA_ID_1822420; gDNA_ID_2926210; Annot_ID_141926

SEQ ID NO: 19559 - DNA, 3000 bp, Unknown; identical to SEQ ID NO: 3913
  misc_feature (1)..( 3000): 2750-1469P.txt file - cDNA_ID_1822424; gDNA_ID_1620674; Annot_ID_48194

SEQ ID NO: 19560 - DNA, 3003 bp, Unknown
  misc_feature (1)..( 3003): 2750-1469P.txt file - cDNA_ID_1822445; gDNA_ID_1620675; Annot_ID_48233
actaagcaactcggaccgaggatcaactgaattcttaccagaaggcaatggatgcaatctactcgcagatggtgaaccaggagtaacagaatttgaaggaaactgggtacagtttggatcaaaccgtgaagacagcattattgcagcattagcttcaagattctcctcatcatcttcccgtgataccttggatattctaccagaagcatcacctgaagacttggcctcttttcccacgcgtctgtttgatgctgaggacttcctttttctgctgttactatttctttgtttaacaacaaccagctgatcatctttcactggagactgattagaatgcccattttccaactgcaacggagctgcggaattagattctttgatatctttgtcagagtccttctcttcaactttagagggttgatcctgaacactagattcttcagcagtaaccttagggatattaacaaccagctcctcctgactatcagactcccctgcagacttctgtgctaggccattctcaaacctactcctcccaacaaaatctctcctgcgtctaggaacataaatcgtactacttgccaaaccaacagaaatcacttgaagcccattactgtcacacaatttctcatccaaacccacctccttggagtcctccaaattgtgcaatatagtggtgccattgcatgccttatccagaatactctcgttctggctacctactttcttaaaactacttagagaaacaactttcctgctcttcttgtcctgcttcaactgatcaccatcaatcccagacctatgttttcttttaaagctcttattcactgaatccttggaaatgctagacttatagagcgtcttaagatctaaagacctggatttcttcgaaattcccactccattagagttacctagtctattttccatgaaagccacctcgaaccaatacccagaatcaaaagccagcaggtctcaaattccatcatatacgcaagcaaacatttttcagatctgtgacaccaaaaccaaacccagaatcacaaaaagtacccaaagtatgataaaagaagaacacacaagtcacccaaagaaacagatcaaatcccacttcaggaaaaaactttgcattgaaatccaagcaattgttttttcaacaatcaagcaaaatttaactgcaaaaaattaaaaaaaaaaagagagaaatttgcatgcctacctgcatcactttatcagacgaaatcgagtctcttaaggacctttatagtcgccacaatcccaaaatcaaaattagggtttcggtaaatcggactgcgaatcggatccctaaatcaaacaatcgaaaatttcccaaaagtattcgttcaatttagccgaaaataaaaaaagcaaaatttgcttcttttttttttcttttttaaccgggagaaacgggagagctagggtttcgtctggttccgcgagagtaaggttttttcagttataaagaaaacatattccaaataaacatcgtatcacgggtaccgtccgatggagacgcgttactatatctacggtccatatttagtttcgaaataagcactaaatttttaactctgcaacagaaaagatataatggacgttcgagattctcagctgcgaaatatttgtttggacggtcaggatttaaagatttcttcagagagaataatttattgttgtcacgtgtgttgctaacctaccgcaatcttgtgtttgtccacctagccaacaattgttagagacatcattcaacttaacaactattattactagaatactaggggataatttaagtataaaatcatcacattacagtattatctttttaataatttatatatatatatatatattattgttattttcttttaatatataaacttcattcatccattagcttaacaattttccaatattttgtaaaaatatatatatacatattattaggagttttcggaccatatttaagtattagtgtattactaccttattatgtgtttaaatatatatttttattaaatatagacatatagcaaaaagaattagtagtagagagattgattggaatcaatttttgattaattatatagtgtaaactaagctttaagaatatttaaaaaatagatttggtttccttataaatatgaattaaggtcattattaacgtatcataagatttagagcaatgtataaacacaagaagaaaaacaataaaagttcagaaattcctttttcgattcaaaaatacgttaaaaattgacaaaatattttggcgggtggattgtatattggaacccaaaatttgcttttttaatacagaaaaataaaataaaattggcttaattggaaaaactaatattgagttcataaaccaaattaaggtttaattagacagtctaatccaatgttcggttcaattttgtaatcaaatgttcggttcaattttgtaatcaaatgttcggtttgatgatccataagagaggagataacatcccaaatagagacagatccccttcccttgtcgtgtagcccagtagctctaatcgctacgattgctacacaccacatcccttaagaaaaccctaatcatctctctctcgcattctataggaatcgcttcccgaagcttccaacattctcttgtttctcctttgtctctcaatttcagtttcctatattatacgcttgtattaatcaccagtatacattttgtcgtttctgggtctggaaccctagtagttattatagcatccatcgctttcttcaatcgccgtccatcagagtttcaagggatttgctttaaagatcaatcctttcctaagaaaatagcgacaattcatcagcttttcctttcccatccttcattaccttaacttactcgagattcatcttccagctgaaattgtgaaacttcgtttctgggtttttatcagaaaacactctgtgacttattgtgtggtgatcgaggaaagaaaaaagatg

SEQ ID NO: 19561 - DNA, 3000 bp, Unknown
  misc_feature (1)..( 3000): 2750-1469P.txt file - cDNA_ID_1822445; gDNA_ID_2926202; Annot_ID_141570
aagcaactcggaccgaggatcaactgaattcttaccagaaggcaatggatgcaatctactcgcagatggtgaaccaggagtaacagaatttgaaggaaactgggtacagtttggatcaaaccgtgaagacagcattattgcagcattagcttcaagattctcctcatcatcttcccgtgataccttggatattctaccagaagcatcacctgaagacttggcctcttttcccacgcgtctgtttgatgctgaggacttcctttttctgctgttactatttctttgtttaacaacaaccagctgatcatctttcactggagactgattagaatgcccattttccaactgcaacggagctgcggaattagattctttgatatctttgtcagagtccttctcttcaactttagagggttgatcctgaacactagattcttcagcagtaaccttagggatattaacaaccagctcctcctgactatcagactcccctgcagacttctgtgctaggccattctcaaacctactcctcccaacaaaatctctcctgcgtctaggaacataaatcgtactacttgccaaaccaacagaaatcacttgaagcccattactgtcacacaatttctcatccaaacccacctccttggagtcctccaaattgtgcaatatagtggtgccattgcatgccttatccagaatactctcgttctggctacctactttcttaaaactacttagagaaacaactttcctgctcttcttgtcctgcttcaactgatcaccatcaatcccagacctatgttttcttttaaagctcttattcactgaatccttggaaatgctagacttatagagcgtcttaagatctaaagacctggatttcttcgaaattcccactccattagagttacctagtctattttccatgaaagccacctcgaaccaatacccagaatcaaaagccagcaggtctcaaattccatcatatacgcaagcaaacatttttcagatctgtgacaccaaaaccaaacccagaatcacaaaaagtacccaaagtatgataaaagaagaacacacaagtcacccaaagaaacagatcaaatcccacttcaggaaaaaactttgcattgaaatccaagcaattgttttttcaacaatcaagcaaaatttaactgcaaaaaattaaaaaaaaaaagagagaaatttgcatgcctacctgcatcactttatcagacgaaatcgagtctcttaaggacctttatagtcgccacaatcccaaaatcaaaattagggtttcggtaaatcggactgcgaatcggatccctaaatcaaacaatcgaaaatttcccaaaagtattcgttcaatttagccgaaaataaaaaaagcaaaatttgcttcttttttttttcttttttaaccgggagaaacgggagagctagggtttcgtctggttccgcgagagtaaggttttttcagttataaagaaaacatattccaaataaacatcgtatcacgggtaccgtccgatggagacgcgttactatatctacggtccatatttagtttcgaaataagcactaaatttttaactctgcaacagaaaagatataatggacgttcgagattctcagctgcgaaatatttgtttggacggtcaggatttaaagatttcttcagagagaataatttattgttgtcacgtgtgttgctaacctaccgcaatcttgtgtttgtccacctagccaacaattgttagagacatcattcaacttaacaactattattactagaatactaggggataatttaagtataaaatcatcacattacagtattatctttttaataatttatatatatatatatatattattgttattttcttttaatatataaacttcattcatccattagcttaacaattttccaatattttgtaaaaatatatatatacatattattaggagttttcggaccatatttaagtattagtgtattactaccttattatgtgtttaaatatatatttttattaaatatagacatatagcaaaaagaattagtagtagagagattgattggaatcaatttttgattaattatatagtgtaaactaagctttaagaatatttaaaaaatagatttggtttccttataaatatgaattaaggtcattattaacgtatcataagatttagagcaatgtataaacacaagaagaaaaacaataaaagttcagaaattcctttttcgattcaaaaatacgttaaaaattgacaaaatattttggcgggtggattgtatattggaacccaaaatttgcttttttaatacagaaaaataaaataaaattggcttaattggaaaaactaatattgagttcataaaccaaattaaggtttaattagacagtctaatccaatgttcggttcaattttgtaatcaaatgttcggttcaattttgtaatcaaatgttcggtttgatgatccataagagaggagataacatcccaaatagagacagatccccttcccttgtcgtgtagcccagtagctctaatcgctacgattgctacacaccacatcccttaagaaaaccctaatcatctctctctcgcattctataggaatcgcttcccgaagcttccaacattctcttgtttctcctttgtctctcaatttcagtttcctatattatacgcttgtattaatcaccagtatacattttgtcgtttctgggtctggaaccctagtagttattatagcatccatcgctttcttcaatcgccgtccatcagagtttcaagggatttgctttaaagatcaatcctttcctaagaaaatagcgacaattcatcagcttttcctttcccatccttcattaccttaacttactcgagattcatcttccagctgaaattgtgaaacttcgtttctgggtttttatcagaaaacactctgtgacttattgtgtggtgatcgaggaaagaaaaaagatg

SEQ ID NO: 19562 - DNA, 3000 bp, Unknown; identical to SEQ ID NO: 3960
  misc_feature (1)..( 3000): 2750-1469P.txt file - cDNA_ID_1822449; gDNA_ID_1620675; Annot_ID_48232

SEQ ID NO: 19563 - DNA, 3003 bp, Unknown
  misc_feature (1)..( 3003): 2750-1469P.txt file - cDNA_ID_1822449; gDNA_ID_2926202; Annot_ID_141571
tgattctccggttgtgttctccttcttctctccctcatcattcacttctttcttctcccccttatctgttcatatttgcagaagaaacgtctatcagtattagccataacatggttttctcagccagtgatacctcagcgtagaaaggtatccacagataaatatcaccaacgagtgaatagagtagagtagaattgttaccaacgagtgaatatagtaaagtgaaattgtgctataccttgagagtcttgttgaccattctcatctttggttgcaactccaaaatctgctagcaaagcctcaagctcagcaagttccttctttttcctctctttcttggaaagttgcctctctgcctccttaggaggagcacgaacttcaggagcctttttcacctcaggctctgcttctggatgaacttgtgtctctgttccctgctcgtgatcttcctccacatcatcatcatctccatcatcaagagtgtcttcttcgctttcaatttcctgcgacattgaaatcaaatgcatctctatgagaaacaaatgaacagataggcacacaaccacggtttagagaaaccattgcacaacaaacttacattgcctagaaaaatttcgataacaatgcaattagatatatgaaccttcaggagacaaagcagcttacttcacaataacattaatttccctttcagaattcagacaacacaagcctaagcctaagcgagataacaacagtagaaaaaaaggccaactcattcaattcgtggaagcatttgaaatctaaagaggcttattgcaagagacatattaaaccagtgttacaattttcaacatgtgaaatgcataaagctatgatgatgaacccaaaatcaacatatatatgaaagatttggacttgtgacctcagcgggaacgtctttagcatctgaatgggaggcttcagaagtgctccacagggactgaggtggagcagtggtagcgtaataatcatcatcttcatcatcgctatcgatatcagcccaagcctttgctttgagaggcgtaggtgcccagaaaacctgtggctcaggctccttctgtgaatcttctctcttagaggaagctttgctcttaccagccttatcagacttcttcttcttcctcgaagtatccaaagcagcaaacaagttggtgttctgaatcggcatcgatccctcatctctcctgtttccaccaccaaccatcttttttctttcctcgatcaccacacaataagtcacagagtgttttctgataaaaacccagaaacgaagtttcacaatttcagctggaagatgaatctcgagtaagttaaggtaatgaaggatgggaaaggaaaagctgatgaattgtcgctattttcttaggaaaggattgatctttaaagcaaatcccttgaaactctgatggacggcgattgaagaaagcgatggatgctataataactactagggttccagacccagaaacgacaaaatgtatactggtgattaatacaagcgtataatataggaaactgaaattgagagacaaaggagaaacaagagaatgttggaagcttcgggaagcgattcctatagaatgcgagagagagatgattagggttttcttaagggatgtggtgtgtagcaatcgtagcgattagagctactgggctacacgacaagggaaggggatctgtctctatttgggatgttatctcctctcttatggatcatcaaaccgaacatttgattacaaaattgaaccgaacatttgattacaaaattgaaccgaacattggattagactgtctaattaaaccttaatttggtttatgaactcaatattagtttttccaattaagccaattttattttatttttctgtattaaaaaagcaaattttgggttccaatatacaatccacccgccaaaatattttgtcaatttttaacgtatttttgaatcgaaaaaggaatttctgaacttttattgtttttcttcttgtgtttatacattgctctaaatcttatgatacgttaataatgaccttaattcatatttataaggaaaccaaatctattttttaaatattcttaaagcttagtttacactatataattaatcaaaaattgattccaatcaatctctctactactaattctttttgctatatgtctatatttaataaaaatatatatttaaacacataataaggtagtaatacactaatacttaaatatggtccgaaaactcctaataatatgtatatatatatttttacaaaatattggaaaattgttaagctaatggatgaatgaagtttatatattaaaagaaaataacaataatatatatatatatatataaattattaaaaagataatactgtaatgtgatgattttatacttaaattatcccctagtattctagtaataatagttgttaagttgaatgatgtctctaacaattgttggctaggtggacaaacacaagattgcggtaggttagcaacacacgtgacaacaataaattattctctctgaagaaatctttaaatcctgaccgtccaaacaaatatttcgcagctgagaatctcgaacgtccattatatcttttctgttgcagagttaaaaatttagtgcttatttcgaaactaaatatggaccgtagatatagtaacgcgtctccatcggacggtacccgtgatacgatgtttatttggaatatgttttctttataactgaaaaaaccttactctcgcggaaccagacgaaaccctagctctcccgtttctcccggttaaaaaagaaaaaaaaaagaagcaaattttgctttttttattttcggctaaattgaacgaatacttttgggaaattttcgattgtttgatttagggatccgattcgcagtccgatttaccgaaaccctaattttgattttgggattgtggcgactataaaggtccttaagagactcgatttcgtctgataaagtgatg

SEQ ID NO: 19564 - DNA, 3000 bp, Unknown; identical to SEQ ID NO: 3958
  misc_feature (1)..( 3000): 2750-1469P.txt file - cDNA_ID_1822457; gDNA_ID_1620675; Annot_ID_48230

SEQ ID NO: 19565 - DNA, 3003 bp, Unknown
  misc_feature (1)..( 3003): 2750-1469P.txt file - cDNA_ID_1822461; gDNA_ID_1620675; Annot_ID_48229
tgctacagattccaaaagctggcatccaaaatcccgaacaagggccagaggaaatgcggagtatttatttctctttagaaagtcaaacaaacttggcccaagcttctcgaacacctggtatcaccattagagttcattcacaggaaggttccgtttagttccaaacttcgaaaaaatccacatgagtaaacaaactacacaaacactatacacggaattggatttctgtcacttgggcatcaaacaaagaaaggtagccagaaatattatgattcattcatttgtaacactaacaaacctcacaggtcactgaacatagaaccaattaaatattagagatgcatttgaacggtggtggaaatcaatgagcttagttgggatacttacaatgcaaatatgatttcggtaatcaaaccagttcttcatctgtacacagctgcaaggacaaagcagaaatgaagaaactgagcaatgatatacacctctgaaggaaacgatgtcatcaactaaagtctagaagataaataaataccgtgtgcggcctttatcactcttaacaagtttctgaagtacatcaatttcaatcattgctgcatcccggtatttcttaatgcttcgaattatctttattgccacatattcttttgtatcacgatcccaacattccaaaacccgaccaaatgtgcctacaacaccagcaagttcactgaaatggcacgatttgattcacataaacattttttttatctcgaacacaccatgccacttgacagctaaccttcacccatcttgctaagtattttatctgtcaaaagtcaaaacagaacacacaatagcgtaagttaagcaattaaaaatgttcaggaaggattctcatcccaatgaaacgaaagcgaaaaaagattatccctaaggcaatggtgccaaacaaaacaaagagttactagcaacaatacacatatagaagcaacataggtaaatatcttagctcacatagaatagaaagttagcaactttatccatcaaaaactcacatctaggagtgagattgtccctcaaactgaaaacataatgaccatcacgatcatcgtcccttaatggtggtgacaaaatcctcccatcgcttccatgtcctttaatcacagcccttttagcctatcacaaaaaagtcaaaattcattcattgtcagcatatcaaaatctcaccaaagaaacataaatgctcggtctttcctccacattctaaaccctaattcgaagttctaaatgtcaaagattaattaaaaaaagaagaagaagaaagaggagcaacctctggttcagctggggcctcgtcccaggtcatacgaggacgtttcctgactcgttctttatccatactctcgaatccgttagctatcatcaccgacgcggaaaatcgatcaccgacacatccagaacggaatctgatgccaatctgcagctaaaagagggaaaatttctaccagaaactctttacgtagatgtaatcacaaggcggcgaatcggggagaaggtgataatctccgaaaatggtgaaaacagaggaattgctagggtttggaactagagagagtgcaagagaaagacaactcccaataattttaccggccaaatcccttggggtcgaaccgcgacgacatccaccaattgcattttttttgcactttccaccgaaaaaattgggtctacacgatcacccggaatgtttcgcccacccggcccaaatgaaatgtggtgagatcttcttataatcttggcccaaatttccatcatggatcttaaacgttcgtttcattgtttcttggattttttttcattaactggtccatctcaaaatgggcttccataaaaatgggcttttttacaaaagggttttgtttcattaattgattttcgtgtttttttatccgtaacaattatgctttcgtttcctaatttatacgagcaaacgtaaaaatgtatagtatttgactatttggttttacgtatcaacaatcaacaacatactgtacatcagtacatacacaatttttttttaacatacacaaacttactttatgtacaaatgaactattaagaaatggctttagccttgttattgcatgcatcttcttaatttgtgtatgtgaaattcttcataggagctaattaagggacgaagacaaagtgtatcccccttcatgtattacctaaacgtatcttagaatttcaaaacattgttttccttagaattttttaaaaaaattgtaaacatgcacatccaacactggaaagtggaaagaagtatatatatatgatatgttatctcaaaaaaactgaaatgattgtattaaaaacatactaaattctgactgatgatagatattgatacgtaattcatttgtttattattgttcgttttgttttcaacactactattcctgtcacggtctcatttaataacaacaacaaaaaagacgtcaagatttgacttttgagttcctcaattttttcaactccagtatttaaacagctaattattacataatttatcgtaagaaaaaaaaaaaaaaaaaccttatccccctgatattgtagatctcgattgtaatcactacacctgatgccacattaaatacacacagagacgtaaataagagtcaaaaaagtcgatgaagccttctgcatatataacaacaaagttgaatatataaagagtaaaattcatcatactacaatcttgaaaaattataatttattagatggttaagtaaatttgttttatagtattgttatattctttttttccaaaaaatatagggaaaacaaaaaccagtaaaaaaaaaagtcaacttaatttgctcaccaccttcttgatcatctaaacacctctttaataattcaaaactaaaaaaaaaaggtataaatgaaagagacaaaagagggaagtatatatcatcaagcttgaagaagagagagaagaagaagaaggaaaaaagaatg

SEQ ID NO: 19566 - DNA, 3003 bp, Unknown; identical to SEQ ID NO: 19565
  misc_feature (1)..( 3003): 2750-1469P.txt file - cDNA_ID_1822461; gDNA_ID_1620675; Annot_ID_164242

SEQ ID NO: 19567 - DNA, 3000 bp, Unknown
  misc_feature (1)..( 3000): 2750-1469P.txt file - cDNA_ID_1822461; gDNA_ID_2926202; Annot_ID_141574
tacagattccaaaagctggcatccaaaatcccgaacaagggccagaggaaatgcggagtatttatttctctttagaaagtcaaacaaacttggcccaagcttctcgaacacctggtatcaccattagagttcattcacaggaaggttccgtttagttccaaacttcgaaaaaatccacatgagtaaacaaactacacaaacactatacacggaattggatttctgtcacttgggcatcaaacaaagaaaggtagccagaaatattatgattcattcatttgtaacactaacaaacctcacaggtcactgaacatagaaccaattaaatattagagatgcatttgaacggtggtggaaatcaatgagcttagttgggatacttacaatgcaaatatgatttcggtaatcaaaccagttcttcatctgtacacagctgcaaggacaaagcagaaatgaagaaactgagcaatgatatacacctctgaaggaaacgatgtcatcaactaaagtctagaagataaataaataccgtgtgcggcctttatcactcttaacaagtttctgaagtacatcaatttcaatcattgctgcatcccggtatttcttaatgcttcgaattatctttattgccacatattcttttgtatcacgatcccaacattccaaaacccgaccaaatgtgcctacaacaccagcaagttcactgaaatggcacgatttgattcacataaacattttttttatctcgaacacaccatgccacttgacagctaaccttcacccatcttgctaagtattttatctgtcaaaagtcaaaacagaacacacaatagcgtaagttaagcaattaaaaatgttcaggaaggattctcatcccaatgaaacgaaagcgaaaaaagattatccctaaggcaatggtgccaaacaaaacaaagagttactagcaacaatacacatatagaagcaacataggtaaatatcttagctcacatagaatagaaagttagcaactttatccatcaaaaactcacatctaggagtgagattgtccctcaaactgaaaacataatgaccatcacgatcatcgtcccttaatggtggtgacaaaatcctcccatcgcttccatgtcctttaatcacagcccttttagcctatcacaaaaaagtcaaaattcattcattgtcagcatatcaaaatctcaccaaagaaacataaatgctcggtctttcctccacattctaaaccctaattcgaagttctaaatgtcaaagattaattaaaaaaagaagaagaagaaagaggagcaacctctggttcagctggggcctcgtcccaggtcatacgaggacgtttcctgactcgttctttatccatactctcgaatccgttagctatcatcaccgacgcggaaaatcgatcaccgacacatccagaacggaatctgatgccaatctgcagctaaaagagggaaaatttctaccagaaactctttacgtagatgtaatcacaaggcggcgaatcggggagaaggtgataatctccgaaaatggtgaaaacagaggaattgctagggtttggaactagagagagtgcaagagaaagacaactcccaataattttaccggccaaatcccttggggtcgaaccgcgacgacatccaccaattgcattttttttgcactttccaccgaaaaaattgggtctacacgatcacccggaatgtttcgcccacccggcccaaatgaaatgtggtgagatcttcttataatcttggcccaaatttccatcatggatcttaaacgttcgtttcattgtttcttggattttttttcattaactggtccatctcaaaatgggcttccataaaaatgggcttttttacaaaagggttttgtttcattaattgattttcgtgtttttttatccgtaacaattatgctttcgtttcctaatttatacgagcaaacgtaaaaatgtatagtatttgactatttggttttacgtatcaacaatcaacaacatactgtacatcagtacatacacaatttttttttaacatacacaaacttactttatgtacaaatgaactattaagaaatggctttagccttgttattgcatgcatcttcttaatttgtgtatgtgaaattcttcataggagctaattaagggacgaagacaaagtgtatcccccttcatgtattacctaaacgtatcttagaatttcaaaacattgttttccttagaattttttaaaaaaattgtaaacatgcacatccaacactggaaagtggaaagaagtatatatatatgatatgttatctcaaaaaaactgaaatgattgtattaaaaacatactaaattctgactgatgatagatattgatacgtaattcatttgtttattattgttcgttttgttttcaacactactattcctgtcacggtctcatttaataacaacaacaaaaaagacgtcaagatttgacttttgagttcctcaattttttcaactccagtatttaaacagctaattattacataatttatcgtaagaaaaaaaaaaaaaaaaaccttatccccctgatattgtagatctcgattgtaatcactacacctgatgccacattaaatacacacagagacgtaaataagagtcaaaaaagtcgatgaagccttctgcatatataacaacaaagttgaatatataaagagtaaaattcatcatactacaatcttgaaaaattataatttattagatggttaagtaaatttgttttatagtattgttatattctttttttccaaaaaatatagggaaaacaaaaaccagtaaaaaaaaaagtcaacttaatttgctcaccaccttcttgatcatctaaacacctctttaataattcaaaactaaaaaaaaaaggtataaatgaaagagacaaaagagggaagtatatatcatcaagcttgaagaagagagagaagaagaagaaggaaaaaagaatg

SEQ ID NO: 19568 - DNA, 3000 bp, Unknown; identical to SEQ ID NO: 19567
  misc_feature (1)..( 3000): 2750-1469P.txt file - cDNA_ID_1822461; gDNA_ID_2926202; Annot_ID_201946

SEQ ID NO: 19569 - DNA, 3003 bp, Unknown
  misc_feature (1)..( 3003): 2750-1469P.txt file - cDNA_ID_1822469; gDNA_ID_1620675; Annot_ID_48227
caccgatgccttatcttgcagcgattgcatctccctctctctctctctctctctggttttcgtctctctcgcagtgatgaagaaactgtgggtgattgaattgaattttaaaaaggaatggtgggggctctggtcgtggtcgcgtggaggcaacgctctcttttttctattacactagttgggcctttttggcatatgccgtgaccaaaactaaagacacttgtcttgatgattctctttgacttttggtcctatccaatcaatttaggattttgaagtaattgggcacacttgaattggcccgttaagaagcccattattctaaacgcgacaaactctttagtgacgacgatttgcgtttgaagaaataagtgatttaaaatccgcgtttaaaaaggactaagctgagctgaccccgtcgagaattggtttcctcttttcctcgctccgaagacaagaaatattccggtgaggcaatggcgtcgaacagcagagaagccaggaggcggaagatcctagatagaggatctgatcgtttagcctttatcactggtcagatcaacggcgttccttctccacctccttccgattctacttcttccctttcccagtctgaccttcaaactgaccaatccttaccggatacgattccccctcgcgatcagattcttaaagctcaagaaatcggtactctttcgctctctctttctctagggaatattgtcatccttggattgtttgtgtgtgtaagaatttgagcgacacaatcgaattttacttactctattgggtgaaaggataatcaaattggcttctttgatcagattttatgtgtgtttggctcgtttcagagtggaattcatgtgtgttaagaacccggcttgaaccattggatgtttgaaatagggcaaatttgtagagaagaataggacaacgcattatctacatttttatcttttagtttattttgtcctctgagtatagtagttaatgggcagtgaagctgttaaatccagatttcaacttggaacctacttgtcttaagctgaaattagatattatgaacctgatttcactgttctctacttttgcttaagtcacctcgccccttgaaattttctttgccattctgtgaaattctttataggtgtggttcaaccacagtcaagtgtttggaaagcttattatgttgtgtgtttttgaaatttgcttgccttgtattgtgtcacaaagtttggaaggaaaagattgctacgctgcttgattggagccaataaatcttaaggcgttgtatatattcacaatcagtgggttcttagtggtggtggaaaaacccattgattgtgaatgttctttttggcgtttcttgaagctaacctttgctgattttgatgatccttggttgtgaaattgcagctttcacaagtcaccaggacaacatctctgatgctgcaatgcttgagaatgtggatcatatcatccatcaaagcagggaagaacctcttcagcctcagaggcatgctgaaacattggcagaagcctctgcttcagatcctagagacacaacaacaatacaaccgcctcctacaacatcaagtgttcaaaacccatcagtggtagatttaggtgcttctcaagcatttattcctgtggttagttttgtgaacgccatcacaccaaagcacattggagcggccattgatgcttcggaatacgcacggatgttcacagctcttgcgattgcacttgttgtcatactatctcatctcggtttctcttccctaggcaacattgtaagcttcaggccagttttcttgcttgtcttgactgatgccacaattgtgcttggacgtgttctgctgagtcatcgtggagactcttcctcggcctcagggacggtgatgagcgggcagggtattgtggaccaagtaggcaacgctttggagacggtgatgatggtgaagaagataatggatgcacttcttatggattttagcttatacgctgtgattctcatatgtggcctcttggtcacccaaagcatctttccttaggtcaccttttaaattaggtttctttgtgctcggtagatttgtgttttgcttatggtttgaatatcttaaaattatagttagttccaaaacataattacatgtttcagatatctttctctttccttttcttttgcgtgagaagatcaatatttattggtgtttggtagtttggaagaataaatttaaaggttctcctccaattttttttaaagttatcattgcatcactgaattagggtgtattttttcttgttttgagattttgtgatctctgaaaggaaaagaaaagttaaggtgggaaagtgcagactgaagagaaagacaaaggaagaagtaaataaatttttggctgtcacacaataaattaccgagaaattagggaagcaacgtaagaaagtccctctgtcgctgtcaaaaaaacaaaggtaaaaatacgtcatacgacgaatcataaacgtttgtttctttttttttttctttttttttgattatttataaattacttttttttttctttttggcagccatttttttcatttgccgctaaagtgaaagtgcagactgaagagaaagagagagatacaatcgaagttccaaggtttctagttcccggaaatggagatttctccggcggaagacaaactcgttggctccggcgaagctgttactacagaagaagtatcagacataaataacaaagctgtagacatttgtcggatttgccaatcaccggaggaaccagacaatccgttgagacatccgtgcgcgtgtagaggctctctcaagtatatccactcagattgtcttttcctctggctcaatcgccgtaaacgcaaccattgcgaggttttaaacccctttttcaaaaactctgtttctgctacgaattgagtttaaagtttacttctttttcaaaaatttcctcttttctatgtgatttgaggaagatg

SEQ ID NO: 19570 - DNA, 3003 bp, Unknown; identical to SEQ ID NO: 19569
  misc_feature (1)..( 3003): 2750-1469P.txt file - cDNA_ID_1822469; gDNA_ID_1620675; Annot_ID_164240

SEQ ID NO: 19571 - DNA, 3000 bp, Unknown
  misc_feature (1)..( 3000): 2750-1469P.txt file - cDNA_ID_1822469; gDNA_ID_2926202; Annot_ID_141576
cgatgccttatcttgcagcgattgcatctccctctctctctctctctctctggttttcgtctctctcgcagtgatgaagaaactgtgggtgattgaattgaattttaaaaaggaatggtgggggctctggtcgtggtcgcgtggaggcaacgctctcttttttctattacactagttgggcctttttggcatatgccgtgaccaaaactaaagacacttgtcttgatgattctctttgacttttggtcctatccaatcaatttaggattttgaagtaattgggcacacttgaattggcccgttaagaagcccattattctaaacgcgacaaactctttagtgacgacgatttgcgtttgaagaaataagtgatttaaaatccgcgtttaaaaaggactaagctgagctgaccccgtcgagaattggtttcctcttttcctcgctccgaagacaagaaatattccggtgaggcaatggcgtcgaacagcagagaagccaggaggcggaagatcctagatagaggatctgatcgtttagcctttatcactggtcagatcaacggcgttccttctccacctccttccgattctacttcttccctttcccagtctgaccttcaaactgaccaatccttaccggatacgattccccctcgcgatcagattcttaaagctcaagaaatcggtactctttcgctctctctttctctagggaatattgtcatccttggattgtttgtgtgtgtaagaatttgagcgacacaatcgaattttacttactctattgggtgaaaggataatcaaattggcttctttgatcagattttatgtgtgtttggctcgtttcagagtggaattcatgtgtgttaagaacccggcttgaaccattggatgtttgaaatagggcaaatttgtagagaagaataggacaacgcattatctacatttttatcttttagtttattttgtcctctgagtatagtagttaatgggcagtgaagctgttaaatccagatttcaacttggaacctacttgtcttaagctgaaattagatattatgaacctgatttcactgttctctacttttgcttaagtcacctcgccccttgaaattttctttgccattctgtgaaattctttataggtgtggttcaaccacagtcaagtgtttggaaagcttattatgttgtgtgtttttgaaatttgcttgccttgtattgtgtcacaaagtttggaaggaaaagattgctacgctgcttgattggagccaataaatcttaaggcgttgtatatattcacaatcagtgggttcttagtggtggtggaaaaacccattgattgtgaatgttctttttggcgtttcttgaagctaacctttgctgattttgatgatccttggttgtgaaattgcagctttcacaagtcaccaggacaacatctctgatgctgcaatgcttgagaatgtggatcatatcatccatcaaagcagggaagaacctcttcagcctcagaggcatgctgaaacattggcagaagcctctgcttcagatcctagagacacaacaacaatacaaccgcctcctacaacatcaagtgttcaaaacccatcagtggtagatttaggtgcttctcaagcatttattcctgtggttagttttgtgaacgccatcacaccaaagcacattggagcggccattgatgcttcggaatacgcacggatgttcacagctcttgcgattgcacttgttgtcatactatctcatctcggtttctcttccctaggcaacattgtaagcttcaggccagttttcttgcttgtcttgactgatgccacaattgtgcttggacgtgttctgctgagtcatcgtggagactcttcctcggcctcagggacggtgatgagcgggcagggtattgtggaccaagtaggcaacgctttggagacggtgatgatggtgaagaagataatggatgcacttcttatggattttagcttatacgctgtgattctcatatgtggcctcttggtcacccaaagcatctttccttaggtcaccttttaaattaggtttctttgtgctcggtagatttgtgttttgcttatggtttgaatatcttaaaattatagttagttccaaaacataattacatgtttcagatatctttctctttccttttcttttgcgtgagaagatcaatatttattggtgtttggtagtttggaagaataaatttaaaggttctcctccaattttttttaaagttatcattgcatcactgaattagggtgtattttttcttgttttgagattttgtgatctctgaaaggaaaagaaaagttaaggtgggaaagtgcagactgaagagaaagacaaaggaagaagtaaataaatttttggctgtcacacaataaattaccgagaaattagggaagcaacgtaagaaagtccctctgtcgctgtcaaaaaaacaaaggtaaaaatacgtcatacgacgaatcataaacgtttgtttctttttttttttctttttttttgattatttataaattacttttttttttctttttggcagccatttttttcatttgccgctaaagtgaaagtgcagactgaagagaaagagagagatacaatcgaagttccaaggtttctagttcccggaaatggagatttctccggcggaagacaaactcgttggctccggcgaagctgttactacagaagaagtatcagacataaataacaaagctgtagacatttgtcggatttgccaatcaccggaggaaccagacaatccgttgagacatccgtgcgcgtgtagaggctctctcaagtatatccactcagattgtcttttcctctggctcaatcgccgtaaacgcaaccattgcgaggttttaaacccctttttcaaaaactctgtttctgctacgaattgagtttaaagtttacttctttttcaaaaatttcctcttttctatgtgatttgaggaagatg

SEQ ID NO: 19572 - DNA, 3000 bp, Unknown; identical to SEQ ID NO: 19571
  misc_feature (1)..( 3000): 2750-1469P.txt file - cDNA_ID_1822469; gDNA_ID_2926202; Annot_ID_201948

SEQ ID NO: 19573 - DNA, 3000 bp, Unknown
  misc_feature (1)..( 3000): 2750-1469P.txt file - cDNA_ID_1822476; gDNA_ID_1620675; Annot_ID_48225
agaaaaagagagaaactttagagacatcttcctcaaatcacatagaaaagaggaaatttttgaaaaagaagtaaactttaaactcaattcgtagcagaaacagagtttttgaaaaaggggtttaaaacctcgcaatggttgcgtttacggcgattgagccagaggaaaagacaatctgagtggatatacttgagagagcctctacacgcgcacggatgtctcaacggattgtctggttcctccggtgattggcaaatccgacaaatgtctacagctttgttatttatgtctgatacttcttctgtagtaacagcttcgccggagccaacgagtttgtcttccgccggagaaatctccatttccgggaactagaaaccttggaacttcgattgtatctctctctttctcttcagtctgcactttcactttagcggcaaatgaaaaaaatggctgccaaaaagaaaaaaaaaagtaatttataaataatcaaaaaaaaagaaaaaaaaaaagaaacaaacgtttatgattcgtcgtatgacgtatttttacctttgtttttttgacagcgacagagggactttcttacgttgcttccctaatttctcggtaatttattgtgtgacagccaaaaatttatttacttcttcctttgtctttctcttcagtctgcactttcccaccttaacttttcttttcctttcagagatcacaaaatctcaaaacaagaaaaaatacaccctaattcagtgatgcaatgataactttaaaaaaaattggaggagaacctttaaatttattcttccaaactaccaaacaccaataaatattgatcttctcacgcaaaagaaaaggaaagagaaagatatctgaaacatgtaattatgttttggaactaactataattttaagatattcaaaccataagcaaaacacaaatctaccgagcacaaagaaacctaatttaaaaggtgacctaaggaaagatgctttgggtgaccaagaggccacatatgagaatcacagcgtataagctaaaatccataagaagtgcatccattatcttcttcaccatcatcaccgtctccaaagcgttgcctacttggtccacaataccctgcccgctcatcaccgtccctgaggccgaggaagagtctccacgatgactcagcagaacacgtccaagcacaattgtggcatcagtcaagacaagcaagaaaactggcctgaagcttacaatgttgcctagggaagagaaaccgagatgagatagtatgacaacaagtgcaatcgcaagagctgtgaacatccgtgcgtattccgaagcatcaatggccgctccaatgtgctttggtgtgatggcgttcacaaaactaaccacaggaataaatgcttgagaagcacctaaatctaccactgatgggttttgaacacttgatgttgtaggaggcggttgtattgttgttgtgtctctaggatctgaagcagaggcttctgccaatgtttcagcatgcctctgaggctgaagaggttcttccctgctttgatggatgatatgatccacattctcaagcattgcagcatcagagatgttgtcctggtgacttgtgaaagctgcaatttcacaaccaaggatcatcaaaatcagcaaaggttagcttcaagaaacgccaaaaagaacattcacaatcaatgggtttttccaccaccactaagaacccactgattgtgaatatatacaacgccttaagatttattggctccaatcaagcagcgtagcaatcttttccttccaaactttgtgacacaatacaaggcaagcaaatttcaaaaacacacaacataataagctttccaaacacttgactgtggttgaaccacacctataaagaatttcacagaatggcaaagaaaatttcaaggggcgaggtgacttaagcaaaagtagagaacagtgaaatcaggttcataatatctaatttcagcttaagacaagtaggttccaagttgaaatctggatttaacagcttcactgcccattaactactatactcagaggacaaaataaactaaaagataaaaatgtagataatgcgttgtcctattcttctctacaaatttgccctatttcaaacatccaatggttcaagccgggttcttaacacacatgaattccactctgaaacgagccaaacacacataaaatctgatcaaagaagccaatttgattatcctttcacccaatagagtaagtaaaattcgattgtgtcgctcaaattcttacacacacaaacaatccaaggatgacaatattccctagagaaagagagagcgaaagagtaccgatttcttgagctttaagaatctgatcgcgagggggaatcgtatccggtaaggattggtcagtttgaaggtcagactgggaaagggaagaagtagaatcggaaggaggtggagaaggaacgccgttgatctgaccagtgataaaggctaaacgatcagatcctctatctaggatcttccgcctcctggcttctctgctgttcgacgccattgcctcaccggaatatttcttgtcttcggagcgaggaaaagaggaaaccaattctcgacggggtcagctcagcttagtcctttttaaacgcggattttaaatcacttatttcttcaaacgcaaatcgtcgtcactaaagagtttgtcgcgtttagaataatgggcttcttaacgggccaattcaagtgtgcccaattacttcaaaatcctaaattgattggataggaccaaaagtcaaagagaatcatcaagacaagtgtctttagttttggtcacggcatatgccaaaaaggcccaactagtgtaatagaaaaaagagagcgttgcctccacgcgaccacgaccagagcccccaccattcctttttaaaattcaattcaatcacccacagtttcttcatcactgcgagagagacgaaaaccagagagagagagagagagagggagatg

SEQ ID NO: 19574 - DNA, 3003 bp, Unknown
  misc_feature (1)..( 3003): 2750-1469P.txt file - cDNA_ID_1822476; gDNA_ID_2926202; Annot_ID_141578
acaagaaaaagagagaaactttagagacatcttcctcaaatcacatagaaaagaggaaatttttgaaaaagaagtaaactttaaactcaattcgtagcagaaacagagtttttgaaaaaggggtttaaaacctcgcaatggttgcgtttacggcgattgagccagaggaaaagacaatctgagtggatatacttgagagagcctctacacgcgcacggatgtctcaacggattgtctggttcctccggtgattggcaaatccgacaaatgtctacagctttgttatttatgtctgatacttcttctgtagtaacagcttcgccggagccaacgagtttgtcttccgccggagaaatctccatttccgggaactagaaaccttggaacttcgattgtatctctctctttctcttcagtctgcactttcactttagcggcaaatgaaaaaaatggctgccaaaaagaaaaaaaaaagtaatttataaataatcaaaaaaaaagaaaaaaaaaaagaaacaaacgtttatgattcgtcgtatgacgtatttttacctttgtttttttgacagcgacagagggactttcttacgttgcttccctaatttctcggtaatttattgtgtgacagccaaaaatttatttacttcttcctttgtctttctcttcagtctgcactttcccaccttaacttttcttttcctttcagagatcacaaaatctcaaaacaagaaaaaatacaccctaattcagtgatgcaatgataactttaaaaaaaattggaggagaacctttaaatttattcttccaaactaccaaacaccaataaatattgatcttctcacgcaaaagaaaaggaaagagaaagatatctgaaacatgtaattatgttttggaactaactataattttaagatattcaaaccataagcaaaacacaaatctaccgagcacaaagaaacctaatttaaaaggtgacctaaggaaagatgctttgggtgaccaagaggccacatatgagaatcacagcgtataagctaaaatccataagaagtgcatccattatcttcttcaccatcatcaccgtctccaaagcgttgcctacttggtccacaataccctgcccgctcatcaccgtccctgaggccgaggaagagtctccacgatgactcagcagaacacgtccaagcacaattgtggcatcagtcaagacaagcaagaaaactggcctgaagcttacaatgttgcctagggaagagaaaccgagatgagatagtatgacaacaagtgcaatcgcaagagctgtgaacatccgtgcgtattccgaagcatcaatggccgctccaatgtgctttggtgtgatggcgttcacaaaactaaccacaggaataaatgcttgagaagcacctaaatctaccactgatgggttttgaacacttgatgttgtaggaggcggttgtattgttgttgtgtctctaggatctgaagcagaggcttctgccaatgtttcagcatgcctctgaggctgaagaggttcttccctgctttgatggatgatatgatccacattctcaagcattgcagcatcagagatgttgtcctggtgacttgtgaaagctgcaatttcacaaccaaggatcatcaaaatcagcaaaggttagcttcaagaaacgccaaaaagaacattcacaatcaatgggtttttccaccaccactaagaacccactgattgtgaatatatacaacgccttaagatttattggctccaatcaagcagcgtagcaatcttttccttccaaactttgtgacacaatacaaggcaagcaaatttcaaaaacacacaacataataagctttccaaacacttgactgtggttgaaccacacctataaagaatttcacagaatggcaaagaaaatttcaaggggcgaggtgacttaagcaaaagtagagaacagtgaaatcaggttcataatatctaatttcagcttaagacaagtaggttccaagttgaaatctggatttaacagcttcactgcccattaactactatactcagaggacaaaataaactaaaagataaaaatgtagataatgcgttgtcctattcttctctacaaatttgccctatttcaaacatccaatggttcaagccgggttcttaacacacatgaattccactctgaaacgagccaaacacacataaaatctgatcaaagaagccaatttgattatcctttcacccaatagagtaagtaaaattcgattgtgtcgctcaaattcttacacacacaaacaatccaaggatgacaatattccctagagaaagagagagcgaaagagtaccgatttcttgagctttaagaatctgatcgcgagggggaatcgtatccggtaaggattggtcagtttgaaggtcagactgggaaagggaagaagtagaatcggaaggaggtggagaaggaacgccgttgatctgaccagtgataaaggctaaacgatcagatcctctatctaggatcttccgcctcctggcttctctgctgttcgacgccattgcctcaccggaatatttcttgtcttcggagcgaggaaaagaggaaaccaattctcgacggggtcagctcagcttagtcctttttaaacgcggattttaaatcacttatttcttcaaacgcaaatcgtcgtcactaaagagtttgtcgcgtttagaataatgggcttcttaacgggccaattcaagtgtgcccaattacttcaaaatcctaaattgattggataggaccaaaagtcaaagagaatcatcaagacaagtgtctttagttttggtcacggcatatgccaaaaaggcccaactagtgtaatagaaaaaagagagcgttgcctccacgcgaccacgaccagagcccccaccattcctttttaaaattcaattcaatcacccacagtttcttcatcactgcgagagagacgaaaaccagagagagagagagagagagggagatg

SEQ ID NO: 19575 - DNA, 3003 bp, Unknown; identical to SEQ ID NO: 15631
  misc_feature (1)..( 3003): 2750-1469P.txt file - cDNA_ID_1822496; gDNA_ID_1620675; Annot_ID_48219

SEQ ID NO: 19576 - DNA, 3000 bp, Unknown; identical to SEQ ID NO: 15632
  misc_feature (1)..( 3000): 2750-1469P.txt file - cDNA_ID_1822496; gDNA_ID_2926203; Annot_ID_141584

SEQ ID NO: 19577 - DNA, 3000 bp, Unknown; identical to SEQ ID NO: 3940
  misc_feature (1)..( 3000): 2750-1469P.txt file - cDNA_ID_1822500; gDNA_ID_1620675; Annot_ID_48218

SEQ ID NO: 19578 - DNA, 3003 bp, Unknown
  misc_feature (1)..( 3003): 2750-1469P.txt file - cDNA_ID_1822500; gDNA_ID_2926203; Annot_ID_141585
gtttgcataagtgtcataccaaattcttctttgcaagaatcaagatctttgcctgcttgaaagagtatgagttacattcggcacttcattgtaaaagtcaggttcgtcttcttcttcatcagatgataataaagatggtcccatccatgctttaaacccctcgttcactcgtctttcaacgtctggtgtgaattccaacggattagcttcaagcatctccaagccctgatcatttctgttcccaaactctccttcgtcaatagttaaagcagctcttcttctaagggagaaagcagttccagcatacaagattactaaaccccatgaagaaatctcgtagcaccaaaacaaaggcacagaacagctgcttcctaatgtgaggaggcttgagccgagaaatatagcaaggagaccatagatgatagcaaacacaacattcagaattgacagacaacggaccccacctgtgaatttattggacatgataaagaagatcaataacctattttgaggtccaagcttagtgataaactctgaagagcccagattctcaaaggtagaaacatagtaattactagcagatgaaatagaattacacataaaaatttataagataaagtctggcactgaaaaggaatgaatctattacacgaatgcatggatatacaaagaacaaatatggaaagctgaatacatattaaagagagaagagagtatacctcttcttgaagcacagtagttattttcaacgacttttagaaacccatgacggtgaggagcggaataagccacaaaaattcctgcagtattgcaacaaaatagcgagaataataagcagcagacataccacacctgtaaaacttagaagggctgccatgtggaggcagaaagcaataaaggaaataaatcagctccactaagttacatccatataaaattcaaatccaacaaaatctagcagaggaattaactggatttagcaaactccacagcttgctctatggctaaccccctaaaatcccaataaacctgaaccatcatcagacctgtctttatatagtggcttcaatcaaaacgagtgattctagaactaaacataacaacgagcattcagattttgaggacacatcaatcaatcaaccctctctgacaatatttcacctcaccaatcgaaaaattcagaagccattttgccagaaatttgctaagcatcaatatctagcgtaaagccactcagaactgagcatcatctaatgaaatcagccaacaaaacacaaatgcaaacccagctctgtagatatgaaataacgaagaacaaaagctagagacttgacgctcacctgctacaagataaacagatgatacaaggaaaattatagtcgagggaacgaaaacgaccatccagtaataatcaacagtttcttgatcggtcaagtaaaaagcaccgggaaagagatcggagtcacgagctttgccatagataggcaaaggttgtagctttatgtcgctgcaaaatggcctcttaagaacattcgaaggaaatacaattttcaagctgacgatcgtgcaagtgaagatgacaaaacaaaggaaagccacgatcgagactaaagtcggcctctgaagcttaatccaggctctatcttcttccctaaggctctcgtactcttgctttggcataaacgcttgacgcaacgcatctccaatgatcgccattgaagaaacacaaaaaaaaaactaatccacaatcgaattagacccttctcaccagataattccgaaacaattcaaaataggggtttccgaagtttatcaggaaccctaaatcaatgaacaccgaactggggaaatgaggaagaagtattagtgatgcagaaacaattaggcgcgtgtaaaggtacttgctttgataacttctgtgtaattacagtttgacccccaatagtttgttaaagttcgaatctatccccacttcccgctcaattattatcataatcatagaattagaatatgcttagctatagagtcctaattaattcaactgatgaagttagaactaacactcttatgcaattttgatgtctataaatctaaattattttttgcaagtgggtgaatacatccaacacagaaagtgataaagaaacgagaactcaatagaatagaatagagagtaaatagatgtgtagcaagttggtttaggtttgtatcacaccaatcacgactttcataagaccaaaatgttttctttatgatgaattttgtaaagatgtggatttaacggtttcatagcgttatcaaatgacactcataattaattgcatacgtgtgcaatcgcaatcgtaatcgctggttagttttgttttgcaaatactttgtttcgatcattaaaaagaaaacattgtaagctgttgagaatcgaccaatcatcaaactgtaatgttccatctaaatctaattcattcatttagattggataacattattatatttagctcccaaaaacgaaaaaataataatactaataactaacatttactgttagtgaaacgatgaccgtcggatttataggtgggtcaaaagcaacggtccgatggaaagcaatgacctgactgaattggtgtaactatccaaacacaacgatatgaacacgtggcaatcttttagtggacccttttccagaagatattcgacttatttccttttttgctatttcgtggaaaataaaaaatgatctgaagtacagaaaatacatttttaaaaaacaaattctgaaaattaacaattagagaaaaagaaaagaaaaggaaaaaaaaaagatttctagtagaaagagagaagggcgtgaattcctgagcgagagattcttcgccggagtaatctctttgcgtgatcttaccggctgcttaattcgtcttcgcctgattcgttggtttcaaaattcgtctctctctttcaatcggaggttaattgtttttctgtttgggggtcaaagcgaagatg

SEQ ID NO: 19579 - DNA, 3000 bp, Unknown; identical to SEQ ID NO: 3939
  misc_feature (1)..( 3000): 2750-1469P.txt file - cDNA_ID_1822504; gDNA_ID_1620675; Annot_ID_48217

SEQ ID NO: 19580 - DNA, 3003 bp, Unknown
  misc_feature (1)..( 3003): 2750-1469P.txt file - cDNA_ID_1822504; gDNA_ID_2926203; Annot_ID_141586
tttcaggccaagtgaccttgtaaaagttttttttttgtcttataacatagctattgatttatactgtccaacgttttcacagagctacatcgagctctggtaacggggttctaaatcagttggccctccctgcaccacctgtaactaatggttcagccaattccaaaatagacctcctcagtggcgatgatcttgcccttgttcctgttggacctcctcagccagcaagtccggttgcatcagatcaaaatgcactcgcccttatcgacatgttctcagataatactaataatccaagtcctgcaactgcaccaagtggcaatccagctcagaatattcctttgaatcctcaagggcaccaacaaccaaatagtcaagctggagaagctggattacaacaatccaatggatttgcgcctcaagtgggttattcgcagtttgagcagccatcatacgggcaaggagtctcttctccctggagcagtcagcctgcacagcaaccagtccagccatcttatggtaatatatataaacagtttttgtttttcacacatctggagattagattgcagtatgccaatgtttctctggttatggcaacaaggagaaagaatttccttcttttggattcagaagaatcagcttcaattgtgtctcatgtctaatcattaattgttctgtttttatggtaatcttgtaatataaagaaggtgcccaagacagtacggcatttccacctcccccatgggaagctcagctccaagactatagtccctctgcggagtcaggaagtccgttttctcctggaatgcatccaactcagactgccttcacacatgctcaaccagttaacaacaacaatccatatcctcaaattccccaaaccgggccaccagtcaacaataacagtccatatgctcaaatgccccaaacaggtcaagcagttgccaacatcagtccatatcctcaaattccacaaaacggcgtgtacatgccaaaccaaccaaatcaggctcttgggtcaggctatcaaccacagcaacaacagcagcagcagatgatgatggctcagtactatgcccaacagcaacagctacagcaacaacaacagcaacaggcgtatggaaaccagatgggaggatacggatatggctataatcaacagcaacaaggaagcagcccatatctggaccagcaaatgtacggtttatccatgagagaccagacatcgcatcaggtagcatcatcatcatctaccacatcttatctgcctccaatgaaacctaagaataaaccagaggacaagctatttggggatcttgtggacatctccaaattcaagcctacaaaaccgacttccggaagagctggtaccatgtgaaaattcctccatccattcatcatttaccagtattcatctcctctatcctcctcagctaactctctttcttctctttgttaagcttttttcatcattgattttattaccctcttgggagataacatagatatacatatgtgttatgttcttccttataatttaccgttggttatgggtttgtatatttcttgtagagaaaagaaaactggaaaatcttttgttgagaactcagcgatttggggtttgtctcgagattctattttaggacattttaatctctcatttgtattttcagaccttttatttgttatatccattggcaataaagtttgatatcaattggatgagagttatggttcttaaatttgccaaaaggacagtttatgttctttgtatatgattgcaaccctaattccatagtcaatggagacatcaaaatgtcaaactatgcttgcattatataatctctttcgactcaatgatgtcaattaccgaaaaagtagaaaggaaggatttgttttgtttgcgactgttgttagttcttatgttgctcgtcgtaaacaagaaaaacctgccattcgtttgggtttttgaaatctagtctaacagaaagaaacaagagacaaatgaagaagagtaaatctagtccattcatcatcatcagtcttttggatcgtgcatatattaatttgtataagagtctgtctaacaaaattgtcaatatgtccgagtggttaaggagattgactcgaaatcaattgggctttgcccgcgcaggttcgaatcctgctgttgacgtattctattttgttttcttttcagctctcttcagaatttttgtaaatattttaaaagggaaaaaaatctcaaaatacgatttcaattaaaattgtagagattctcctcacgtctgtttgtgaaatgttgtctctaataaatttccgtaaattactgaaaacaagacacgagaaattgttaatttaacaaaataaaaatacgttacgtttggggtttgccacgtaactacttaccgccacacgttctcgtccttttcttcttcctctctgcattcttcacagagtttgtcaccaccaacaccaaacacacaatttcacattcttttgcatatttcttcttcttcttccattatggagatacggagcttgattgtttctatgaaccctaatttatcttcctttgagctctctcgccctgtatctcctctcactcgctcactagttccgttccgatcgactaaactagttccccgctccatttctagggtttcggcgtcgatctccaccccgaatagtgaaactgacaagatctccgttaaacctgtttacgtcccgacgtctcccaatcgcgaactccggactcctcacagtgggtaaattgatccattccattccatttctcttctcttgtttgttttattaagctccaatttcagtttcgtcttttaatttatatgttcttcttacgatcagtgggacttaaaaaattgctcctttaaatgcttcagtatgttttgagtattacaaagttgtaagattttatttttattcatttggtggctcaccattcgacgactacttttgaatttgagtttttgaaaaatg

SEQ ID NO: 19581 - DNA, 3000 bp, Unknown; identical to SEQ ID NO: 3937
  misc_feature (1)..( 3000): 2750-1469P.txt file - cDNA_ID_1822512; gDNA_ID_1620675; Annot_ID_48215

SEQ ID NO: 19582 - DNA, 3003 bp, Unknown
  misc_feature (1)..( 3003): 2750-1469P.txt file - cDNA_ID_1822512; gDNA_ID_2926203; Annot_ID_141588
ttaattaaaattgtaaattgctatttattctgcatattttcccttctgttttatcacacggccgctcaagtttatttttaatttgtttttgggtaaaagtaactaaactttgcgcatgaaaacttttatgtgaggtttatgtattattttttttggtttgttgctgacttgttgttgagtgttattaaagaactaaatcgattttacctaaagcgtaacttttgttataggttttattacttaaatattaatttacactttcattttcaatgctacaagaaaaagaacagaaaatttacaattctgattccatttttcagctgctgccacatgtgggaaataagaccagccctccaataactccaagaaccggtagagaaatgaaggtatatatgatctattaaaccggggggtttccggtttatcattgtctcaaatcaaatcatatctttattaaaaggagtcgacgtaaagaatgaaaaaaagctggttggtttcggaactttttcgttgattataaaaattaaccgagagaaaagagaaagcattataattgtcatgatgaaatcatgcaattgtttattcaatccatatccttttctttttgaaataataaaaagggtaacacagtgagtaatgtgcaatgagcggaaattctatggttaacttttttttacgttcgaaataattgctgacaaaaagaaggacttcatttgagaaaactcaaatataatgtcaaacatcaatttggctagatctacccgttacatgaattcggttctagttttattggatttttagattcggattaatatgttatgtctggagaatataataatatatactagtcaattagactactcctcgccaagtgactattactagatgatatattatgagaatcaaaacatatgagcaaatatgaataaaatcgttgtgaatgatacagcatttgtacaagagcatgataagaggaagaacaatgggaagaagattaaaggatcagaaggagaagaagaaacaagagaccagaactcgcaacgctgagattcacgccgcggtctctgtcgcaggagtagctgcagttgttgccgcaaccgcagcatctaacgctattgcggccgcagaagatgcggttgaatcaacaaccgttgcagctgcaatggcatctgcagctgctctcatcgcttcacattgcatcgagatagcgggagagattggggcgggttataaccagattgccacggctgttagctccgcgaccaatgctaggactaacggagacattatggctttaacggcaagtgctgcaacaggtatcatttattgttttctcgcatagtctaccgctttcaaatgataccccatatgtgattttgaggttttgttgagagattttagcgttgcgaggagctgcgattctaaggtcacgaatggaaaggaacaacgagaacaaagcaatgctatatgcaacaaaggagcacgtcgtagaaatggaagagagaaatgtatttggagcgatgactttcgtctctagaggagaagagcttctcaaacgcacccgcaaaggtaacttgtgctccaagaaaacaccgttttgatcatgtgatgaatctgtcagggttaagtttccgaggatatttggtgacaggggatcttcattggaagcaagtatcttttaacatcaattccaattggcaagtaagttttttttttttttttttaagaactttcataaaaaaatgatatatatgatgttcctcatactcataggctcttgattttgaaataggtggttcttaaaatgaagagcaaacatgtgggtggaactttcacgaagacgaagaaatgtaagcttacatgacacaagtttctagcgaattagtgaataccaaagttgatagtcttcttaattaccttgtacaaaccaacattcccttggcggtttatttggatgcaggcgttgtcaatggagtgtgccgagatatacccgaatgggcacatagaggacgagcagataaaatggtagagcgaagagcctactttggggtgaaaacagtggaaagggtgattgaattcgaatgtggaaacaaaagagagaagcaaatgtggatagaggggattcaacagttgcttaactcactcgaaatcggttctagtgttcaatggaaacattagagttaggatcaaattaaaacactatttcacatttgaacatcatgtaataacgattgattttttttttcgatttcacgtgtgttgaagaatgtatgtttgtgtctggtgtaataatatttgacattgatatttatttgtcacactaacgacatttattatttcccgtctttctcactttatcgatttacagctggatttctgagtttttatttctttcttaaaaaggaaaacaaatataagaaaattagaacttaaaaaattccctctatcagtcaaatggagttcttcgtccttccggtggaaaattctcggaaacgattgaacttctgataatcaaatccggttcatgcgagttatgtaacatttatcggtaatatatcttcccactctactgcagtaattcgagttcaatttaggatagaattgctttacaaataaatttgagttatcttctacttcagtcttgtattgtatcttacaagttcatgggtcaattcaagatctcccttttcatgtttccgaatcaattttcttttacttgagagaaccaaaacttagcaggattcgcgttttcttaatttaatttgtttcgattcagctccgtttgcttcttgtcgcttccaatttcccgaccaatgggtgatagatttgtcctagcatagaaaaaaataagattaattgatgtctcagatgtaagatccattacagtaaaattcagttgtaacatccaattcgtgtgtttgaattcaattctctgttttttattctatcctgcagatcattcgttaagatggtgatattgagttgtttcatggagtctacatg

SEQ ID NO: 19583 - DNA, 301 bp, Unknown; identical to SEQ ID NO: 3973
  misc_feature (1)..( 301): 2750-1469P.txt file - cDNA_ID_1822589; gDNA_ID_1620677; Annot_ID_48289

SEQ ID NO: 19584 - DNA, 3000 bp, Unknown; identical to SEQ ID NO: 3974
  misc_feature (1)..( 3000): 2750-1469P.txt file - cDNA_ID_1822589; gDNA_ID_1620677; Annot_ID_164291

SEQ ID NO: 19585 - DNA, 3000 bp, Unknown; identical to SEQ ID NO: 3284
  misc_feature (1)..( 3000): 2750-1469P.txt file - cDNA_ID_1822589; gDNA_ID_1620636; Annot_ID_162892

SEQ ID NO: 19586 - DNA, 3000 bp, Unknown
  misc_feature (1)..( 3000): 2750-1469P.txt file - cDNA_ID_1822589; gDNA_ID_2926204; Annot_ID_141632
cttttatgcagtttgagcctgagcgcatgaacactcatatcgtggctcgaatcttggtcaaggctcttatggctatgccaactccagacttcagcctttgcctcttcttgattcccgaaagagtggtattcttctttcctcttaacttcacaatgttttgctttcttacatatatagcttatcgtagatacagaagaaacgattgttcaaatgtttctgactcaagttattatgccattccaagttatttctgtcagttcagtctgtgtactgagcattcatgataaagtgtgagtttcaatgtgttggattcttgaggactaataaatgtacttgtttggattgtgtgtttcagcaaatggaggagcagttcaagtcactaattgttctatcacactaccttgaggtacgcaaacatcagtattagttagttgagagttgaaaaggtgtgcattgagtatttaaagcacttgtttttcttttgcagactgggaggttccaacagttctgggatgaagctgccaagaaccgtcacattctcgaggctgttccaggtaactaacttctgaatcataaataaatcgtctactaataacaaatttctagatgtagatttgttacttaaggatatttgtgtgtagatgtcttatggtacgaacaaagtcctcagtagtggtttatggtactgtctattcattttatgattgtgtctagtgtagatgtcttatatgcgagagattaaatgcaggttttgagcaagctattcaagcatatgcaagtcaccttcttagcttaagctaccaaaaggttccaagatcagtgctggctgaggtatgatgtttggtttatgatctcgttttcaccacggatagcttaagtcatcaaaatagtagaacttcggatgtgaaatcttttactttctcatataattttctgttacgaatattccacatcatagttctggaaatctaatttgttgaccttttatttgtcaataaatgacaattttcacaggctgttaacatggatggtgcatctctagacaaattcatcgagcagcaagtgactaacagtggatggattgttgagaaagagggtggaagtattgtcttaccacaaaatgaatttaaccatccggagctcaagaaaaatacaggtgagaatgttcccttggaacacattgcccgcatcttccccatccttggttgaaccaattcatgagaacactgcaaattttccttttgtctcttgttatcttgtgatgtacacttttaagacaccgtaatgtgaattttggcaatggccttcctctttgcaatttgacagattttcttaaaaatctagtagaccgagactttgccataattagtagatcttcatagtctgagctctgcttcttacctttttttttaccttccatggattccaatactggtttctcaacaagtgttggaattggctcgtttctgattgattatcttctgtttacttcattacatctaaataaactaaacgaatcttcagacaacccaaacaattgtcttctttaaaaagcaaaggaaaaaaaaaacttttgtttaggtttcttggaatatagaaactgacacggcaaatttgtattgagaaagtttgaaatacaaagagactgtctatgtcttgtcgtcctctctacacagatcacatacgaagattgacagccatccatttggaagctcacatgttgacaccaaatcatgtcacgtgcacaattttctcttttcccatgcatattttgactgctccctatgtgataaatttgactgattaaactataattagttagatcatctcgtatctaagatgattgcttaaaacaatactattattctactaacaactaggttattcccaagatcataacttttgattttgatgtaactagttttgtaattttgtacatatatgagacttttttgaattgcttaacagaataaataattgaattttatgaatataatatataaattttcaatttgatcgacaacaatgaacggtgttttatttataattgtttttttgacaatcatgaacctaatgatttgttttttctattttatttagtcgacataatgaagactaatgaagatacaatatgtgattgaagtgaacaagttagatttaattaagatacgtggaggatataaagaagggtgataaatacgtgaataaaaagtgaaataaacaaaggcaaacgatcagacagacaagtcgtgaacataaaaacgggagagacaggaaaaacaaaagaaagccagacgagcaccaaaaaagaaactgcaaatcttcgtttatgtaaatcttcttaccgtctctctcttgtatttcttcaatttcaaaggtggcttttttttctttctttgttgggtattaatctgagagaaattgaggaaaactgttttcccctttctatgttctcagcttggcacttttctttgagattatggttaattggttcccttttggaaattgatttcaaatcttatccagaagaaatttggtgccttctgtttttaaacaaattttctagagtttccgtgtttaatttttgtttcttattttgttttctattaaaaaattcgtttcttgctcgtgttagttttcgcatttggagtttcctgacagcgagagttgctcgttttctggggtcacaacagaagaattcgagcttggaagattgaaatttgagatcttttgatcttgaatcaagcataaattctggattttgaagtttgagagtgacccagtgactttggtctgaatctcggaggtatcttattccaggtaaaatccattaacatctctctctctctctctcaagctcctttcttcttttaagagaagtttatgttgattttcgtggttaccattcatcttcagggatcaaggattagacttaatgcgattaagcaaatgggtttttcacgatgactctccttgttgttggggagattcaataaaatg

SEQ ID NO: 19587 - DNA, 3000 bp, Unknown; identical to SEQ ID NO: 3974
  misc_feature (1)..( 3000): 2750-1469P.txt file - cDNA_ID_1822589; gDNA_ID_2926204; Annot_ID_202041

SEQ ID NO: 19588 - DNA, 3003 bp, Unknown
  misc_feature (1)..( 3003): 2750-1469P.txt file - cDNA_ID_1822597; gDNA_ID_1620677; Annot_ID_48287
ctggaaaaagctttcactgatatgaccctttcctattgttaagacctcaagattcctgaaacagatcaaaagcattacgtttgatatataataactaagttatcgaaagcatatccgagggtaaacaagacagatacctcaaagtggtagcggctttcatagccagagcattaacagcaggagcgccataaacattaacttcagtagcatttggatagcgactacacatgttttcaactgcacataaagcacaggaggttatattgtatcccacgtatatttccacaattagcaactgtttttttgttttcctcaaacggcaaataacagaaaagacagatttaatgtatgtatgaagaacaacttacattgttccatagaaatccttatattttcaaagttcaagaccctccagaaatcctcatgagcactagctactctccactgccgacataccatagcagagcgacagaggtcgacatgattcaagaacgagaatacctgaaagaaagaaaatttttaaaaaaacaaaaaaaaggatacttacatgtatttatcttaaaatgcaagaaagaaaaaaagaataccatatgtaagaggtcatcagtcaaatcaatatgaacttcaaaatcttctgtgtctgaagaaccattatcatctccatcatcctttttcccatctttccgattataattcaagatgaaattctggcagaacatatcagtatccgtccgggaagaagaggcaatgccaaaactaacagttctctccaccgacgaaacagaatttccagcatctgaagatacccccgaaactgacctgcactcactgcaattgaacttcatagtcagaaacacatgaaatcagacagacgaataaatgacagattaaggattgatgtcaactaaaatatcactcttgatgacgctgataagccttaaacaaaacaaaaatccaagaaatcgattctacactaaagtaattgaacaaaacagagtttacgaatcatgcatgatacaaaagtaagagagctcacgcaagcccagagtagactttggcacgcttgtgatacgaatcatgatcagcttcctccatcgtacaatcctctgcttctgcaaccacattgctactactctcaccctgaaccaactgattcaagggaatctcagaggtccaaaagcgatccaattcagcccaagcggcttcactttcctcggcacacagcctcagcctccaacgtgggactcttggtgccctctcgttttcaccgaaattaacaaaatcaccatcgccgttactgttatccatggccgttgctaaagattgtttcttcactctgccgccgttatcgtcttcctcgtcttcgtcttcgtcggtgaagcaagaaaaacaccaaatcctcatgcaacccctaagcccacctccccaaaaacgaaatcttgtctctcgatctaccacatttatagaaaacttgctcacaaaaaccagaatttggggaaaagtaacggaattcggaaagcccagatagaattgagaggaaacagaattgaatctctaattctggatttaaagtgacgggaaggagaagatcaaacgctaatctgattcaggattagggtttgagagaaatgaaaaggtagaatcggatcagatcttgcgaggggcgagtagaggcatattgtgaggtttctttggaagaaaaggtggtcgatgatataatctggatgccgattcggaagaagaagcaaaataaaaatcggcgaaaatggaaagggaatgataaaaattaaaaagacaaaactaatcgcgaaacacaagggactttggaagtctttggttcttgcttcaccgttgtttttgttcagaaaggacgatgtaaaaacggtgtcgtttgacaataagtactactgtgtgtaaagtagatagatagatactctgaactctgaatactaggatattataacaatgtttagttcgtacgataaaataatggtttagacacaaccgtttatgtttgggtcaaagttacaaaatttgcgtcacgtgagcagtcgactgaaaatcgaagatagtcaggcgtcagtaggtagaccgagccacaactgtagtatattgtattagcaatttagcatacgtaacgtacaaatacttgttgttttagtattttggtgatgttatcgttttgtgatttaaataaaaaaatttttgtttttattcaatcaaaattctaaatttttttatcaaaatttgatattactagtttaagatttgtaaaaaataatctaaaatcttcataaatctgaagttattggattcatacttttataaaattattttgaaaagtttatattatttaattaaaacaaaataaagtatgattgctaattaattaaaattattgtattattgatttatgactttctaccatttttttgtgttaaattctatcattttcttcacaaaataaaatcatcaaaataaagaaattgattgaaaaagtttcaaaattataaaaaactaatcaacaatattatataaaactctgtgtttaaaataattcatttatttacgttcgatgatattattaaagttaataaagtttgggatcactaatcaaaattcatttccgagtaaaaaacacagacatcacatcactgtaacttttgtaccagcgaaacccacattaatattggggttgtttctctttatggcccaatggctatatcttcgttgtaactaggtcacgtgagccattgacttttcgcccaatatttaagcccatttaaaggcccaatatttaagcaacactcatatacaacatgatgataaaattaaaaccgttgaagtatgtaattaagattgagatgacggtggatgtgtgaaacagctgcttccggtgtgctagtgccccgataggaccaaagctgagaatataattgaatatgtggacggttgagttataattaggagaatctcataaatattattgaaatatcaacgatg

SEQ ID NO: 19589 - DNA, 3003 bp, Unknown; identical to SEQ ID NO: 19588
  misc_feature (1)..( 3003): 2750-1469P.txt file - cDNA_ID_1822597; gDNA_ID_1620677; Annot_ID_164289

SEQ ID NO: 19590 - DNA, 3003 bp, Unknown; identical to SEQ ID NO: 19588
  misc_feature (1)..( 3003): 2750-1469P.txt file - cDNA_ID_1822597; gDNA_ID_2926204; Annot_ID_141630

SEQ ID NO: 19591 - DNA, 3003 bp, Unknown; identical to SEQ ID NO: 19588
  misc_feature (1)..( 3003): 2750-1469P.txt file - cDNA_ID_1822597; gDNA_ID_2926204; Annot_ID_202039

SEQ ID NO: 19592 - DNA, 3000 bp, Unknown; identical to SEQ ID NO: 3984
  misc_feature (1)..( 3000): 2750-1469P.txt file - cDNA_ID_1822601; gDNA_ID_1620677; Annot_ID_48286

SEQ ID NO: 19593 - DNA, 3000 bp, Unknown; identical to SEQ ID NO: 3984
  misc_feature (1)..( 3000): 2750-1469P.txt file - cDNA_ID_1822601; gDNA_ID_2926204; Annot_ID_141629

SEQ ID NO: 19594 - DNA, 3000 bp, Unknown; identical to SEQ ID NO: 3983
  misc_feature (1)..( 3000): 2750-1469P.txt file - cDNA_ID_1822605; gDNA_ID_1620677; Annot_ID_48285

SEQ ID NO: 19595 - DNA, 3003 bp, Unknown
  misc_feature (1)..( 3003): 2750-1469P.txt file - cDNA_ID_1822620; gDNA_ID_1620677; Annot_ID_48281
atatatatatagaagaaaaaaaggaactctttttaatgcaaattcccacacctcaggttgtttgattccaagtataagcccacaatcagacaaatcatcagaaatttcacacccaacatcttcatacaaggcatcatgatggatacgcttagcagatggctgaaccacaatgcgggaaatgccggttctgtctttcccaccgtgtaaaaggcgagcgcaatgcgatggcgtcaatggtgttcgtctctcccatttgttaactgtttcagctagaatccccacaactccattccccaacttcttctcctcctcatggccatttgaattcatctttcatgtaaaaacatataatctctgcagatgaacaacaaacccttattttaaacaccctggaatagattcacaaacatttcatatttcgagtttcatcaaccaaacatcaaaaacccaaactttaatgtgaaactgttgaaaatcgaacaaactgggaacagaaatttaacgagttgagaaatagcttttgctcgagcgattaattgaaaactcaaatcagaacagaacagaacagaacagagcagagaggaagagaggaacgcaaattattaaatccaaagtgaaaaaatgaaggcagtgatttagctaaagcgctctccaaatttgcattcctcaagatgggaaaattatggaagaaggaatcaaaacgtacctgatgagtttgatcatgcaatgcctgtgagctggtttgtcaagaaaaaatacaagtttttttttttctttggaattagtgagttttttaggcgcagtaataatctctttccgtcctttttataagctaaattacgtatatgattaatatattgtgggcgtgttagcgaaagattaaattaatataatataatatttcttgttataatgtatgatgtgacaagaattctttttgttaataatgatctgtaatcagctataattattttcccctttcttcaggtaatcatttttgttaataatgatctgtcaaaaaaaaaaaaaaatcctcgtgttcatttttttttgaaacagaacataacttaattaagctctttcgaaaactacttttagttataacttaatgtggctttcacataatggatatgctccgaaactatctaatgcaatagagagacattaattaagtttgttgtatacacgagaacaacgtgagccagccaatgttgtaaaaataatatatatagtatataatgccatagacaataataatgaaatcaaacgaaacaaatgaaataagtatttttactatttaaagaaagcaaaaacaagaaaggaacaagctcttgtttacgtggatggatacttggataggaccgagggaggatcaatccaatcgaaaatgtattacgtgtattcgaagagaaatagacagagatgagtgaagacgtttgctcacgtagctactatatcctcgatgacgacgcttaccagttaccactttccgtgttctctacgtctctctcttctgagactttttttaacattattaactctttaatatgttgggttacgtatatgatgatttcaagttagggatattaatagattcttggatgaaacgcaccgttttactaaaaattcccaagtattatttgcagagagtgggcttgagttgttgtcttaatttggcccaagttccttttgccttggcatttgtaacccaaagaagaatgagaacaagcttcttcaatttaggaattaaggagtgcacaaaggtgacttcaaaatcagtgtgtacgaacaatagtatggcctaaaacgattatgctaccaacagaggatgcatgggccgcggtgggcagacatacgattcaacctcgacaagtgttcttcttatgaaatatctatgggccttacccaataaactatttcaagaaaaaacaatttgaaagtgaaacttgaacattgttttggtatcagttcatcgatatcgctgcaagcttagatttcgttgacggcttttcttttgtttaatttattaggttttcttttaaaagtttaattaaatagacgtagttaattggagatggcctgggaacaagttctgggcattgactttgcaatggcacaaaagtcgagatgcgagaagagattcctcaacgaggctacaaagtaacagtggtcctatccttttgctttttacacccatctctttttttttcatacattttttctcacaaataaagaacttttcttctttcttttttctgctattttttttaacgttgtgcatgtgtaaatctgaaactctctagtaaaacttttctgtaatatcatttgcttacataatttgactatgatttttttggtaaatgaaacatcatgcaacaacctcgagttgaatgtgcatctagaaacatgatgttggatttataaatattcactttcaactcaaccttttaccaaaaaaaataaaaaatatattcactttcaaagtgagagatttcacaaactcaaataaccatagaacaatagcatttgtatgacatgaccacaaaaggttgttgtattcttggatggagaattcaacgccaagtttgacaaaatgataaaagacaaatgtgacttgatgcccaaaaaaaaaagagaaaagagatttgtttgttttatggaattttaatttgatacgtatatatataagagaaacacgagcaaaagaaaaagtagttacttttaatttattattcgaaaggtaaaactgtttaaaataaaaaaagaaaaagaaaaaggaatgaaaaaaaaagaaagaaagaaagaaagaaagaagagaagacaacccacacgaatcgccacttttgaagagagaagagaagagaagaggcagctcctaactttctcttttgcttttgtctccatcttttatttcacacccgtgaccgtgccatctccacactctccgtgcgttaatcctggttttatgatttactttaattctcctgtatgtgaacatcaatg

SEQ ID NO: 19596 - DNA, 3003 bp, Unknown; identical to SEQ ID NO: 19595
  misc_feature (1)..( 3003): 2750-1469P.txt file - cDNA_ID_1822620; gDNA_ID_2926204; Annot_ID_141624

SEQ ID NO: 19597 - DNA, 3000 bp, Unknown; identical to SEQ ID NO: 3966
  misc_feature (1)..( 3000): 2750-1469P.txt file - cDNA_ID_1822624; gDNA_ID_1620677; Annot_ID_48280

SEQ ID NO: 19598 - DNA, 3000 bp, Unknown; identical to SEQ ID NO: 3966
  misc_feature (1)..( 3000): 2750-1469P.txt file - cDNA_ID_1822624; gDNA_ID_1620677; Annot_ID_164283

SEQ ID NO: 19599 - DNA, 3000 bp, Unknown; identical to SEQ ID NO: 3966
  misc_feature (1)..( 3000): 2750-1469P.txt file - cDNA_ID_1822624; gDNA_ID_2926204; Annot_ID_141623

SEQ ID NO: 19600 - DNA, 3000 bp, Unknown; identical to SEQ ID NO: 3966
  misc_feature (1)..( 3000): 2750-1469P.txt file - cDNA_ID_1822624; gDNA_ID_2926204; Annot_ID_202033

SEQ ID NO: 19601 - DNA, 3003 bp, Unknown
  misc_feature (1)..( 3003): 2750-1469P.txt file - cDNA_ID_1822628; gDNA_ID_1620677; Annot_ID_48279
ttttcaatgcagcaatcacaatcttcaggtgtaattttatattttggacaggccatagtgtttatccattaaggctcaatataattataaacctaacgcctcacattatcattcttttaatttaatcggtagttaaccgatcataatatagattaattacttttatatcttctgttagtccaattgtaattacaaaacctactctttaagttcttaaaaatttagttccggatggcaactactagttcatgttctaatcaacaagcattagtccattatcaacagtttctttgttaatattttcaatgcaacaattgtatggttgttacaaattttaataaggttatgataaactaatagaggaaccaaaaaattaaaaatcttacgtaatttactttaaatccaagggagatgactttaacttatacaaccaataatccccttagtgattataagcctaccacaatggattctatgcttagatgcagaatacaattaagctcctcactgcagctcctcctgcagggcataacccgtcctatcaaccttaccccttagtgtatctttctaagatctcagagttcttattgaatagatgctcagggaccagctcggtgagtctgaaaggtgattctaaaattagaggagaaagagtttgcccatgggttgatctctccagccaatatggctatccctaagatcacataataactctttgcttcttcattctacttgcaaagcttcactatccaaagaatccacttgtttactctctcttttcctcgtcacctgtcaaaccagaaggaattatctgtttagaaactagaacaaaagaaggcagaaaactttgtaaagagagtcataccgacttgttagggaaattttgagcattagtgaactttgaaggagcagaataatgagacttcttttgtagaatctcagagagacgccgctcgtttttctcttgcctaagtagatatctcaaggaaactgattcttgctcaagctttgacaccgtgatttccaatattgctaagctatccaaaagctcctgtgcctgaaaaaaatctctataaagttattaaagaaactcaatagcaaaaacaacaaataagatttttatatgtcggagaaagaggattgagtaccttatcaggaagttcacaaggcgaatccataaacggtgaactagaatgctcaactgcgctagttagagctaaccgtaagttaatctcctcttgtaactgctgctgcaatctcttaatctgtatcatcatcccaaatatcattaaccattaccattagcagtagtagtacaaacttttcagtggtttcttaaatgtgacttagttctataaataagtacgacaaagagaagcaagtgagggatctgagtgacttacatcttgttcaagctcacatttgtaccatagtttggtctttccatcaaatctaccactagtttgatcaatcatcttgctttcctgcttccaaaaaaaaaacaaaaatgcaatttcaaaacctttggcgtgaccataaccccctcaaaaccctagatttactaaatacattccaagaaatcagataagaataaaaggcagagatatatgagagagagaaagaggtacattacatcgagatcaggaaaaaacaaagagccatcaccagaagagtaagatcttctcgagaatgtaccagtcttcttcagatatctccggatcgagcttcccctgtatcagaaaacatcagcaaaccaaaaaaacaaaacaaatcgggagcatagagagaaggaagaagaagtatagatttagagagagtatatataccaattgatgggaagacgaaaagtggcatttccgaaggtgcgatcggtgctaggagaagaagaagaggaagcaaggttttgatcttcatgaagagcttcggctttgatacagagcatcgtttgtcacggagcagagaagaagaagaaagactctgaagaaagaaaggttccaactttgaggtttttttattattgtattgaagacagaagagtttggttgggttctctcactgctcacacttcactctctttcctttttttggtctgtcgcttttatgattttgtaacataaaattataagtagaaaaaagctgaaaagggaaacgaaggaatttattcgtgtctcacacaatttgactaggtgctcctcattttcataatttcattttacacacttttttttttggtcaaacatttacattgtctctatattttctagtagtatattatttaatagaaaaagagaagaaatttcggtttcatattattgcttttcatttcattatattccatttcggtatttatttttccataaattacgaaaaatgcttcatgtgtttttgaggactcaatgtatcatgtgtagggtaaatgatgacgcagataaacaaacagtggaatatctaactttaacatgttctttttctgaatcggactcaaaagaaagacctgattgcaacatatgagtcacacactcacatagagaaaaagattccaatcgtatcaaagagtgaaccgtattatggtttagtcaatttgacacaaaaccggatcaacccaatcgaaccagcctcaatgacaattttgggaccgacttttaaagacgtgtgtctctttattgtcgccgttcaattggtaagaggccacggcgtaatcgtaggacgacgacgaaacatatttttctttagtgtttattttatttttgtgttgggtttcagtttcaaagagtcccaccaatgaccaaaaagtgctccaatgcatgattattacgttggagcctcttcgatagagagatttttgctttctcaatttattattttttgtgtctctctctcgcccgatttggagtttttagggtttgatttttgtaatgtgagaaaggtttcgttatgttaaagaggcactctatcgccattctctccagaatcgcaagcttcgattcccataaaacccttatg

SEQ ID NO: 19602 - DNA, 3003 bp, Unknown; identical to SEQ ID NO: 19601
  misc_feature (1)..( 3003): 2750-1469P.txt file - cDNA_ID_1822628; gDNA_ID_2926204; Annot_ID_141622

SEQ ID NO: 19603 - DNA, 3000 bp, Unknown; identical to SEQ ID NO: 3963
  misc_feature (1)..( 3000): 2750-1469P.txt file - cDNA_ID_1822633; gDNA_ID_1620677; Annot_ID_48274

SEQ ID NO: 19604 - DNA, 3000 bp, Unknown; identical to SEQ ID NO: 3963
  misc_feature (1)..( 3000): 2750-1469P.txt file - cDNA_ID_1822633; gDNA_ID_2926203; Annot_ID_141617

SEQ ID NO: 19605 - DNA, 3000 bp, Unknown; identical to SEQ ID NO: 3997
  misc_feature (1)..( 3000): 2750-1469P.txt file - cDNA_ID_1822644; gDNA_ID_1620678; Annot_ID_48303

SEQ ID NO: 19606 - DNA, 3000 bp, Unknown; identical to SEQ ID NO: 3997
  misc_feature (1)..( 3000): 2750-1469P.txt file - cDNA_ID_1822644; gDNA_ID_1620678; Annot_ID_164321

SEQ ID NO: 19607 - DNA, 3000 bp, Unknown; identical to SEQ ID NO: 3997
  misc_feature (1)..( 3000): 2750-1469P.txt file - cDNA_ID_1822644; gDNA_ID_2926213; Annot_ID_142089

SEQ ID NO: 19608 - DNA, 3000 bp, Unknown; identical to SEQ ID NO: 3997
  misc_feature (1)..( 3000): 2750-1469P.txt file - cDNA_ID_1822644; gDNA_ID_2926213; Annot_ID_202773

SEQ ID NO: 19609 - DNA, 3003 bp, Unknown
  misc_feature (1)..( 3003): 2750-1469P.txt file - cDNA_ID_1822648; gDNA_ID_1620678; Annot_ID_48302
agaagttttatataaagtgaattataaaatggaagtttaatcatagtattgactagtaagaagcaatacaatatttaccattttgttttgtatcactaattttttaaagctatttacttaccaatctataactaatttcataaacaacaaatcgaataaaatctgagcaggcgcgtcaataaaatttgaaagttattagtgataaatgataatatagaaaacaatatcttttgcaccgcatccctataataacatcaaacaaatccataatttcataagcaaacaaacctaacaaaatatgacttaactccatcctaattcaaaaccctaaattttcattttactttgtttaaaacttggctaatttttgttcacaaacaaacaaatttcaaaaccatcacaatatgtatgttttatggtttggattacccatccataaatgcaaactcaatgctaattcctagtatcacatgttaattactcttcacacagtatagcacaagcactcttgcaaagttgcaataattcactatggaccatcaattacgaacatcactattacatcaagcaataatgagctctgagcaaagctgtggacaaaagacagagacttttcgttaaacaagataagaacaacaaagatcaagatactcaagataaacgaatcagaaccaaacgacaacgaaataatgttctcaatagactagacagacatatcacatcagatattttttttcaacttttcttacatcgtttaataattaactaattaaatctcttacaatcacatagcaatgtcattacgaatgtgacggaggatgacaggaataacagaatctggtgagctaagctgaggaagatgaccatcagaaggaataacctcgacgacggattcacagccaagattggcgtgaagatactcggagacaacgactggtacagctaagtccttaacactttggagaatgtgacacggaacagtgacaaaaggtaagatctgtctcatgtcactttggaaaatggtctggccgacggagagagctatgtcgggacgcatattgaagagtgttctgctgaattcttgaacggcgatggagtccatgtcgccaccgacggcgagtggagcgaaacctaagcaccacgctttgtagttgcttcggatggcttcgaatagttggtttaagtcttcttgttcgaatccaccttggtaatcaacatcgtttacgtatctataaacgtaccaaaacaatataatttgattatatatgtttcttttgtcagaagaaaattaaaatatataatatactgtgtgagcaccgtttcaacaattttttttaaaaaaagtgtaagtaacacctcagtaaaaccaaataaaaaaaaacaaataaacaaatgggtatttcatgattttttgttcataatttacggatttttattgaaatatataatgaaatgcttcactgattttgagaaataggataattcagacaagaggataaacaaagaggcactttgtcgaaattatgtcagaatgagaaataaatatttcgaaataatagataattgtgtaaatttaaggacttaagatgatttttttttatttaaattgtaatgtttaatagtttttatgaaatcagacaagagaaggaacagagaagcccttttgtctaaactatgtcaggatgagataaaaagcaaaacatatttctatgtacaacttgtgaaaaagttatacctcggagaagcagagatcatgacgattttggagaagagatcaggacggttaagagaagccaagacaccaatcatggcagaaacagagtggccaacaaagatacaagactcaatcttgagatcttccaagattgcaatcaaatcgaaagagtagccttcgagatttgagtaacgatcgaagtcgaaatagtcagggttggtcgtaccggctcccatgttgtcgtagaggacgacgcggtaatcgtcgaccagatgtggaaccaagtgtttccatactgactggtccgtgccgaacccgtgacctaacacgatcgtggcttctcctgaaccaatcaccttcacgttgtgagcttcttctaccacacccatctctctaaagaagattcttctctggttttcttcttggtacctctcttagtcagttcgtggagaaattatgatatttgtgttgttttagagtgttacgtattattctttataaaaaaattcgtatctgtggaagaggaaataaattatttaaaatatcgcgatttacaggtggcaaaaaaaggtgaatggaaccatgtttgttggattgtcaaacatcgctattcgtgataatttgttttttggaatcaagcccaaaatattttggaacatttaatggagtacatgacgtggagttactgacttctgttcaacaataaaattgttacattgggttacaaatacatgaaccaattatttttaattttgtgcatgaatttcaacaatgcattaatgcgaaagaaaattagtttcaatcattcaaagagtggcagcaaatagtcaaaagctgatataattattattttaacaacactagttaaatttcgcatgtatacaacttgcaatgaatatagcatctaaaaacctcataatatttgtttttttctgcttgactttaacttgtcagtacttttcgatcatttagaagttagaagacattaattattcatggaatgccatggtgagtatacgaccacgtattcacatccacttcctcatcattttaagagtcaaaaatatctgtgagaggatcctggcccattaaaattcaaggcccatttagtgtaatatggcttcatgttctctctttcctaagaccgtttttactgttgaccaataaagtctgaactcgtgatgacgtggcgtgaaatcgagagacccacgtgtcatcggcgtgccgttatcctctttccacttccggtctccgttcccacctgagtaaaccatactggtcgtgaaatg

SEQ ID NO: 19610 - DNA, 3003 bp, Unknown; identical to SEQ ID NO: 19609
  misc_feature (1)..( 3003): 2750-1469P.txt file - cDNA_ID_1822648; gDNA_ID_2926213; Annot_ID_142088

SEQ ID NO: 19611 - DNA, 3000 bp, Unknown; identical to SEQ ID NO: 3994
  misc_feature (1)..( 3000): 2750-1469P.txt file - cDNA_ID_1822652; gDNA_ID_1620678; Annot_ID_48300

SEQ ID NO: 19612 - DNA, 3000 bp, Unknown; identical to SEQ ID NO: 3994
  misc_feature (1)..( 3000): 2750-1469P.txt file - cDNA_ID_1822652; gDNA_ID_2926213; Annot_ID_142086

SEQ ID NO: 19613 - DNA, 3003 bp, Unknown
  misc_feature (1)..( 3003): 2750-1469P.txt file - cDNA_ID_1822659; gDNA_ID_1620678; Annot_ID_48298
gccggattaggtcagaggattgtgacattggcgcttggatcgttgattcaatgctttgaatgggagaatgtgaaaggggaagagatggatatgtctgagagtactgggttgggtatgcgtaagatggatcctttacgggccatgtgtaggcctaggcccattatgtcaaagcttttactctaataagatgagtagaggttaaaaaagaaaaaataacttattggatgtaactggtaattatctttaagataaagatgaataaaatgaatctttgcctcataaataacaaataaataatagataatttagattctttttattgttaactaaattatctccataaaatactttttatatatatataatttattccagtaaaattgagtttaggatgttattttactaagatgcagttttcttatacaaacgatttcaaagcttattttccgatataaaaattaattttgcttaaatcctcaagaatttttttattccactgacgaaatttccaggcttcaaatctcgctgaaatgaaaaataaagttagcaataagcaaataatcagtttaaaatacgtatcagaataataaaataacatgattttaaactaactagcattttctataagatactaaaaatgttagcaattgcgttttaacgaatggataaattttcattttaactagttacatttaagtttactctaactagttacataagatttagacttttttacaataattaataatcggaatcatgtcaaaactgaaaattttgtatgtgaattgtgaatgatacgtgactaaaatgctcgttgttgttctttaactgtgactttcataaataatcattgttatctatataaatttaccttccgagattgaactatatccaacgtcttctggaaatcttcctctcgacgtttaagttcagctagtgattcccactgatctggtatttccaggaaacgccttaaaaaagaaaattagagaaaccaatattaacgatttatccaaaaatacattatccatgtctattagaaatatttaataagcatatctataaaataagatatttactccaattgtttttccacttcggccagtcgtgcattgacttcttcgatctcatcttcgatctcctattttaagaaaaaaaaaagcatgcataagtactttaacttttttttgtttatatacctatatattgccaaatcatgagatttttattttattttaatcaacatgcctttggttgaattagataacgaagcccatcgtcaagactctcgtcactgcacttggtttctgaacgcatctgcatgaccaaccgttgtatattctagattctccataccaatcaagaaaaacaaaaaatttaggtaacgttaaacaaaatcactatacgaaaatcgagatgaattaaccgttagatagttttgatttttttaccggttcatgagggaggctgtgttcgatcagatggaccaaccgagtacaatatcaggagttcatgcatatgtataaaataagaatattagaactcatacaataaaattaaacaaacctattactttatgttcttatatataaatgcatgcattaacacaatgaatttaccgtgtgcgtacagcccgagcaagaaacttgcatataatctcttcgggtctataatcatgaacaataacgatgatttgatatcagatgatagtaataatatatatgatgaaataataaaatattggagctacaagaagaagaagaaaatgaaaacgtaatttattaatataatatacctctctttggcataaaagacgaagagtttaccagaaggagagaaaagaatgagagcaactggtacattacatagaacaaagagttcataagctttctttaaaagcccattttttcttttggcgaatgcaatatttctttgttgcctatcatttattcttttaatctgtatttttactctccccattttttcttgtcttcttttcacaatgttttctctttctcaattagctttcaaaatattttttataagtttatttatatagttatgagaaagaactttctatggctaaacttgtagattttccattaaattgtatcaaaattactaattactttaaattaaataaatttattaattaacatagaaccataatcttgtttgtcaatcaaaagatttagttttcttagttaatcttttcttctccagatatataaatgggtattatctattgcacatatattttataaattgaagtaaataattaatatatttataatataaagtaaatgttatattcattagattatgaatttggataagaaatctcatttattatggctcagtggcccatttcatcccatatatgaattgtgttatcaaaatttatgtcctggatgaattttttttaccaaatactatatgtaatgaaatgttttgaccaaatatatgtaatgaaaaaaataaaaaaaattgggtcaaaagggaaagaaatccttctctagaggataatggaccccacttgtgtaagataaaacagtctctctctctcccccacaagaaaaagcctcgaccacctaacgataatggtggctatgagatctccgtcttttctccgtcgtgtttctcaccgccgattataaaatacttatctactaccatctccttgtcggaaacggcgagctaagtcgattaggtatttattccttttatctcttttatctgttaaagctttcttagggtttttgtttttgttgttttgcatttgaaattgtgatctcatcgactatcaagcttcgaactttacattagggttttgtgtaaattcgtgttcttcttcactttctctttccaattcgacgcatatggatacgtgatgaaagttttcgaaaatttgttcaatttcaagtttagttctttatgactctactgattccggatttttctagggttttaattgagaagaaataaaaaggatattttggtatg

SEQ ID NO: 19614 - DNA, 3003 bp, Unknown; identical to SEQ ID NO: 19613
  misc_feature (1)..( 3003): 2750-1469P.txt file - cDNA_ID_1822659; gDNA_ID_2926213; Annot_ID_142084

SEQ ID NO: 19615 - DNA, 3003 bp, Unknown; identical to SEQ ID NO: 19613
  misc_feature (1)..( 3003): 2750-1469P.txt file - cDNA_ID_1822659; gDNA_ID_2926213; Annot_ID_202767

SEQ ID NO: 19616 - DNA, 3003 bp, Unknown
  misc_feature (1)..( 3003): 2750-1469P.txt file - cDNA_ID_1822669; gDNA_ID_1620678; Annot_ID_48293
cgaaattattggcggaatggttgttgccaagaagggtcccaagtctatattatccaaagatatcttcacaaatatcgtcagcaacgaaaaaccataaaataaatagtaacgacgccatgccttctttggatctaatctatatatctctctctttaacatagaataatcgtgttcttttttctttttttcttttttgatagaagttgaattggtcaaattttagtttgtacaaaactaaattcgcttactagatgtttttttttatgatcaaggaaatctcaggcaaaaaaagtaaaccaatcattaacatatgtaaaaaaaactgtaataatatgttgaaaaatagtcacacattgaaaagactaatcatttttatttttatcctctgtttgatttttgttctataaaatctaccaaaactatcgccaaaagtaatctaatgatcatgacattatcactcattcaactatggcgtccagtaaatgggctagattgaattaaatgtgcgagttataaattttgattgtcaaatttggattttaaaatggtcgtggaatattatcatttatcagtactattgcctacctaattcaagggtcaacttgagtactgtataatattgactttaattatatatggacaattgacaacaaattaacgtaaaaaggaccatataaaacaccctatgttttactgtctatatgaacatctatttcaaatttgttttgaaatttacataatatgttacatactaattaattgaatggtaattttgtacaggggacaataaatatcttttagtgaataagaatcagccttccaaaaatatattgataataattattattatagtagtcagcagccttcgaatatatctactattcatataagaaaaagctaatgccgttaaaacaaaatcctactaatatatgagatagttgaagtgactattctaatgaacaatttgctccagaagaaaatttgttcccgaaatgtctaatcaaagataatgcattatccgtgcgattagcctcttcctaaaatagcgaccaacgtctttttatttcgttaagttatttataattattggtccctttggctttttaatcttattgttaatattagtactatttaatcaaggcccacatgtcgagcgacccaacgccatgaccgaatttatattctatcaaatatgcatatatcatattgtttataaatggtcttggtgttgaaacataaatgtatatacagttgatgcattcgtttaaaaaaattccagagtcctattgtggtaaagaaatagactatatataatatagtgaaaactagtgttgtatgtctataacttcaaattagtctatttcagttttgacaaatcgttatccaataaacaaaatttagtaatcataccaaaaatgtagaaacctaattcaatctgcactgcggcataccatttaaaccccgaatgattaaactttattcattggtgattttttttttcttagtttgaaaatatggtttacctaaacaacggaaaacaaagaagaataaagttttgatgaattattgcaaacacaactacacaaggaacaacaagtaggagattaaagtctcgaaaccatattaaaaggagattggtgacataagtgctctgtaattaccgttgtttgtaaaaagaacgaattttcaggaaaaaaataaaatgaattaaatggagcaagttggggagggtacagcacgagcgacgatcatgaagccaattaccaaatgaaattgtgatttagggtgctgatattcataaacttgggttaagtcgttgtttaaaattgtgttttggctgttagcgatgaattatagtaaaacaagaaagagttctagtaaaaaacaaaaattgcttagtactaataaatttcacaagaccattcacactatacaacaataatccttcgttgccagcagtctaatgggactgtgttataggttaatctctctttcacggactattaatttttggctcaacctcaatgtaatttatttaaattatatttcaacgcatacacgtgaatttatacatcttttcataggatttgcaattccggattctcatccgtcctaggaggttgtatatgtatattattggtaactacagcattaaacaactttaacactaagtacgatgatattatatgtacatgtacgtatgctatagattgatataagaaaaaagtaaagagagagcggatgattgttgattgaactaattaacaatagtgtattaggtaggcttgtatccgacagtcaacttaaacttcatagttgaaaccaataaaaccagaagaaaaaaaatttatatactaatcataatcagcatgatgttagacgatttgatatctaactttcttcgttatgatagagaaataatattcgcaataaatcacatataaaaaaaattactttacgtcatagattatcaacttgcctccaaacacaacaacatgatcccctacgctacaatacataatatgaaaaataaattaatcgttgattaacttaaagtcactccgttaataacgttataagcaaagcttattagtttttttgaccgtcattatcgacgaccaaacaaagaaagagtcccaacaaattatgccacgtaagtccagaacgacgcctatgaaaccaataagacaaaaattcaaaaaccaaaacatccgtgaaaactcttacgtggcggtgacatgtgggtcccttatgtctccattaactaacataagcttattgtcgactgtaccttttgtcccccgtctcggctacaaccctgtgacaaacaaagatcaagtcaaaatatctaacctaaagtactctcgtccacgtggacattgctgacgtggaacttctcccttctataaatacaggcttctcttcgccgaattatactcatcaaacgagtaaaacatttgctaatattaaacactttttcttttagaaaaaaaaacaaatatg

SEQ ID NO: 19617 - DNA, 3003 bp, Unknown; identical to SEQ ID NO: 19616
  misc_feature (1)..( 3003): 2750-1469P.txt file - cDNA_ID_1822669; gDNA_ID_1620678; Annot_ID_164309

SEQ ID NO: 19618 - DNA, 3003 bp, Unknown; identical to SEQ ID NO: 19616
  misc_feature (1)..( 3003): 2750-1469P.txt file - cDNA_ID_1822669; gDNA_ID_2926213; Annot_ID_142079

SEQ ID NO: 19619 - DNA, 3003 bp, Unknown; identical to SEQ ID NO: 19616
  misc_feature (1)..( 3003): 2750-1469P.txt file - cDNA_ID_1822669; gDNA_ID_2926213; Annot_ID_202761

SEQ ID NO: 19620 - DNA, 3003 bp, Unknown
  misc_feature (1)..( 3003): 2750-1469P.txt file - cDNA_ID_1822685; gDNA_ID_1620679; Annot_ID_48323
tcaaactgattctctcaccctatttatatgttcaagattttaggtttttttaaagtattatatatatttatttatcgtagggttgttaccatattttcgctggtttcttcgcggataccgccggcaccggaagcatagttgagtccgatgttagcttgtgcctgtgatgctccggcaaatggtggaattgggttattgaaacccgctagttcagctaaaagtaaaaatagttcaactttgttaaatatatgaactattaaataaataataatgagacaagacgcttgaattaatattaatctgataactttgaattttcttttaaaatatatttttattagtattgttgaactccacaacaatgaattttcattccaaatataattatactcttttaataccaaagtatatgtttgttttggatcggattcaagtatactaaaatatatgattaatgtaattaagtttgactgaaattttaggaattcttctcaaagttttggaaatgtttagaattttaagattttggtggtgattttagaaagaaaatataaaatgctgtattttctaaccttgaatacttttttgaaaaaaaaaaaaagaagttcatccatatccaagtgatgttagaaaagaaaatttaaaatgctgtattttctaaagttaaccttcacttctttttttgaaaaaaataaattcatgcatatacagtttaaacattatggacaactgtctttataatttttttctgtaagaacccgatcatggtcggctatatgacaatcgaataacgtaagaaaaaatggattcagctaattaaatcaagaaaaccggattgaaaacttaccgataacgtctggaatattccgaccgttgctaaaccgaccggttggaccttgaaagtaatctataccataaggtaaatagttgaccttggccttggtgttcaaggcattgttgttaccgttgtcgaagacagagtctccaaacacgaagtaacacggcgtttgctgtccatgcaccgctggtgccaccgccgcgactgcaaacacggtggccaaaataatccacaatgccttggactctccctcgaccatttttcgcaaatcgaattatacgaaaaatgaggagagaagaaaaagcttgatgagagaagaagaaaagtgggcttattgtattatatggactagatttgtaagtctgatggttagaggggattttgcttagacaagtagaaaattatgcgactatatataggatgaggcagtgagtgaatcaagggagacttggagaactatataaattgttttgcatgaattaagaggtttttcttttaatattatttatttgaggtggacgtgttggtaatattattattttttgttaagctgaagaattgtcatgtaatttacttatgtttactaaaatatatgttacaaaatacacataggttgtttttttccaaagcatacaaataggtagagaaagctttatatatatatatatatatatatatatatatatatatatatatattatttaaggtggacgtgttggtaatatatatgacggctgtaaaattttatttgtaagaaaaatatgaaaaaggtataattaataaaccatagacaaaatctttcaaaaccaaacaagtgcataacgatcccatgcaaaaagtttggttaagaattaggatatgccagattccaccaaatgcaaatgaaacctaaccatacatgctttcaatgacatcttcaaaatgatccacaaatagtttatcgttctctgcatccactaataatttttccttcactcccaataagatattgtagtgaaattactaacttgaaaatatacttgggctaaaattcaagtttgtaaatgtatcacatattttcttaacaatatgaaatcatcaaaattaaatataatatatcaaaattcgttatagtttatctctcaacatcgtaattgtagtgtatatagatgtttattttgcaacaaagttatacaagtttaccgttgaacaaagatatgtatatacattgtggccgtgtaagatttaaaagaaaaacaaaaagaagttagttaattggttaattagaaaaagggctacaaatgccgtattgagaaggttataccgtatactcaacatatgtttaattatttgactatatacaaattaaatttgaaatccgtgtctaatacggatcaataagtcaatgtctttcattattcggtaaaataataaaaacagatttgttttgaacgagttggccactttctagtaaccataatacgatatgccttttttttgggtcaacttgtaactataaactttgatagacgacttttcatattgtcttattgatgatgtaactagttctttatatttagagatggaccagatgatattacataataggtaatgtagaaacatgtattatcgaaaatatattatatgtaagtccccaaaacaatgataatatgatataataactaaccattatccaattttaacactcaaccatttataatttgttgaccaatgataacacacaagaccttttattgaggtaactgtaataatttcattttttgggggtcaaatgttataagtctaacaagagtgtttcttacaaaaagtctttacagtgttaattatccaaacaccatactaaataaactcaagttgatcacatttttaacatgttaacatctttgtagatatgaaataagagttgacttttgaaaagagtttatcaataacaatgttacttctgaactttcatcacttgtaatggcccaatgggcttttttcaatgaatccattaatagacaaaaaccaaaaaaaaaaaaaaaaagtcgccgtcgatttgtttatcaccgactcaaccaccggtagggtttaaggtttctcatacactctccttctattgccgccgtaataatcaaatcaatcttcttcttctcctctaacccaattttggaacttgaaagatg

SEQ ID NO: 19621 - DNA, 3003 bp, Unknown; identical to SEQ ID NO: 19620
  misc_feature (1)..( 3003): 2750-1469P.txt file - cDNA_ID_1822685; gDNA_ID_2926197; Annot_ID_141329

SEQ ID NO: 19622 - DNA, 3003 bp, Unknown
  misc_feature (1)..( 3003): 2750-1469P.txt file - cDNA_ID_1822689; gDNA_ID_1620679; Annot_ID_48321
ctcatccacatcacagcttccatccaccacaactccatcgatcggtatactttctccagctttaactgaaacaacggtgttgatcccaacctcatcaacatcaacttctagtccagtatccgcgatcactgccttccgtggcgctaagctcatcagtgatgacattactatgcttgcctgaaaacaattgttacttcagaacaatgatcaactgatagaattaatgaaaaccagaactgattttcacatttttgtatgactatgactgtttaaaatcatcaagaaacagaaaccctagattaagtaaccttatgagcagcactagactcaagccaatctgcaactgagaataaaaacacaattgtagcagcttctgtgaaatcctgcatacatagcgttgctatcactgttgaacaaaattaaccaaatcagattcatttacctcatcaaacaaaacataagctgatgctcagggaaaaggatttgtgttttaccagcaattagagtgagagcgttgatgtcaagcctgaaccttgtgactgaagcaacagctttagcaagaatggggaaaactccagccaccacggcaacaatagcgagccattcaagcggactataaaagtatttgaagaaggagagaactagcagtacaccagaaactattgcgaaagggcttggccattgactcttcaagcttgtttctccgtatggtctaacacttgcttctagtcttgcttgattcagagccttgactgtcaagaaatcaattttacacacaacaacaaaaaaaaagggtttaattgactttaagaaaacgtaaacctttgcctcatcaatagaccaatgattcaagacgaaagtcaaaacgtcgattgaaaaataacagtttctgttacttaccgatttgaagtggagaaatcaaaaaagtatcgtggacaacgatgacggttctagaaggaacgatgactgagaattctttaacgccgtccacttgacggagaacgttacctacgatagaaacctccgatgaacagcagattccaacgacgtcgaagtaacttgtctgtaaattcatcttctttgactcttcaccttccgccatcgttgagcttgagatctcggactaaatttcgaggagatacttttacgggatgatgtcggagggaaattaattatttggtttaggcttacattattatttataacatttgaaattttcagtctctataaggaatgttatattaattgctccacgattttttactatttccaaatgtcaatgctgagattggatacgcatttaaattttattttattaaccatgtaatttttgaaagatttacatttatttaatagaaataaatattaataaacaacaattaattagtcaattatagtagattcgattttattattgaaaaaaaacacttcaaaacctatatagttttccagatgttaaagaaaaaacctatatagttgatatattaaaatcttttttagcaaataatatttgagcagatagaatctaacaaattcttctaaatcaaattcagattttgttattaaagaaagagaaaagagcctattgggccataacatgggttcatacaattctcaatcagataacttccgaggccttataatgacttgtaatataaatggcaatttcgtgattaagtgagtatgaaagggtagacatgacaaaacctaactacagtaccgaggtagccaataatttatcttggctggggccatactctgaccgcagtttccattaatttacagaaatacccacgcttgggatatatatgtatatgtaaccataagtgtaacattttattagttttcagtcgttttccaaatttatgaatccatttacatgagacaaaccaaatccttgttggtaggtccatcctttacactattagaactgaatcatttttatttttctttcacaagaatagaatatttgtcgtaagcaaagaaacaaaagtaaggttaaaaattagtaaaacaacaaagggttgcatgtaacacaaggtttagaaggaataaaataaacaaaagttatgttagtaacgtctttagttaaaaaaaaagtttcatagatgaataaaacaaacaaaattgcatgtcccacgcagctataaaataagaaaaaaaaaaattgcatgtcctaacgccacctaataataaataaagtgaaataataagacaaaccaaaacaccattgactcattgagactgatgtcaaaaaatgagaaaaaaccaatcacattgagagttgagattttaaccaatgcaaggacaatggcaaaaccgaaaataaacgtaaaaatcgaggttgataataacataactcataaaatccgtattttcatggtgtcttcttcttcttcttcaccttcttcactcatcactactcacaaatatatttttgaccgttgttcactctcaccttcttcacacgctccacatcttcttctgattgacctttaacacctgaaaggttttgtcttctctctctatcgtccaaaaatctaaacttttctggttttattttatagatttgggtccctcagtttgtttattttacctttatttatgaacaaatgtgcaaagggtttagattttagctccttgaaggctcataacgcataaagttcttggcttcatcgttttctctcttgattaatttggcattgtatatcttatgtctgattgtgtgaaaaaaccacaaatgaaaggagtttagacacaaatcacagtttaagacaaaattatagtcttgtttctttcaaattatgcaaaaaaatcaagaatctgagacataagagaaacgtttatgtctctctcttttaatcaatgctatgttgcttttctcaactgtttcaagcgttattacattactagctaaaaatcttgatgtcttgttcttatttttgcagtttctcctcttgagctttggaattgaagctaagataagaaatttagagagaaatg

SEQ ID NO: 19623 - DNA, 2033 bp, Unknown; identical to SEQ ID NO: 8410
  misc_feature (1)..( 2033): 2750-1469P.txt file - cDNA_ID_1822689; gDNA_ID_1971791; Annot_ID_175552

SEQ ID NO: 19624 - DNA, 3003 bp, Unknown; identical to SEQ ID NO: 19622
  misc_feature (1)..( 3003): 2750-1469P.txt file - cDNA_ID_1822689; gDNA_ID_1620679; Annot_ID_164369

SEQ ID NO: 19625 - DNA, 3003 bp, Unknown; identical to SEQ ID NO: 19622
  misc_feature (1)..( 3003): 2750-1469P.txt file - cDNA_ID_1822689; gDNA_ID_2926197; Annot_ID_141327

SEQ ID NO: 19626 - DNA, 3003 bp, Unknown; identical to SEQ ID NO: 19622
  misc_feature (1)..( 3003): 2750-1469P.txt file - cDNA_ID_1822689; gDNA_ID_2926197; Annot_ID_201543

SEQ ID NO: 19627 - DNA, 3000 bp, Unknown; identical to SEQ ID NO: 4018
  misc_feature (1)..( 3000): 2750-1469P.txt file - cDNA_ID_1822697; gDNA_ID_1620679; Annot_ID_48319

SEQ ID NO: 19628 - DNA, 3000 bp, Unknown; identical to SEQ ID NO: 4018
  misc_feature (1)..( 3000): 2750-1469P.txt file - cDNA_ID_1822697; gDNA_ID_1620679; Annot_ID_164365

SEQ ID NO: 19629 - DNA, 3000 bp, Unknown; identical to SEQ ID NO: 4018
  misc_feature (1)..( 3000): 2750-1469P.txt file - cDNA_ID_1822697; gDNA_ID_2926197; Annot_ID_141325

SEQ ID NO: 19630 - DNA, 3000 bp, Unknown; identical to SEQ ID NO: 4018
  misc_feature (1)..( 3000): 2750-1469P.txt file - cDNA_ID_1822697; gDNA_ID_2926197; Annot_ID_201540

SEQ ID NO: 19631 - DNA, 3003 bp, Unknown
  misc_feature (1)..( 3003): 2750-1469P.txt file - cDNA_ID_1822701; gDNA_ID_1620679; Annot_ID_48318
ttacactcatttctacagaattttccaaagcaatgcaggtatgcaacaaatatcaaaagacctcttctcatattcgctacagttcttcataaacaaaactgaagaaatacccagaaaacaaaattcagctaatcgtagagaaagttcaaaaaggctaaacctttacattgacattaacgctctaaatttgcagacttttgaaagaaaacctgggaagctaggcccaaatcgaaaagggtaagagtgttatgaaccgtacgaagagcagagacggtggatttgagttcgttaagcaaatggttttgatctccattgcagccattgttctctgaggaagaagaagaagcttctccatttccagtgaatgaagcaatttggagcgttacgagaaaaagaaacaaaagtagcttaaaaaacgccattattggagactgcaacagaggactttgcacagtacgagagaaagagagagagagcgcgagtcgcgagagagagacagagactaacgcgtaccaagtcaaataaagggtcttactatcttttctataattacatatttgtctctttacttttgataaattctataaacggcccaaataagtttgtatagattttgatgaaaaggtgtcaattgaaaaatatcttatgcaaaacgcctaatttaggcgtatccgaaaagtcctaattagccttaatctgactcttaaaatcttaatgcaactaaaacggaaggatataaacttataatgttaaaatatatgttttaatggtccattgtgtagtatttttccttttacttcacacgtttttgttaagaatttccttcttctttttgccatatatagttgcttgtaaaaaaacaaatcttgactttttcttaaactaattattttgctgtaaatatagatttttaataaataaatgatatttaaaataattgttttcaggcaaaactattatcaatgttagatttatcttattctttttaatcaacgtggctctctgtagttaatcaataattcactgtgtaattgtcaaactgtaaatagaccatttcaatataactaagaaagaaaactttatattttcattagtttccatgtatctcaactcatttagagaaaataatatttacatatttcttactataaaataccaaaatatatctttatattttaatttaaatatatcattttaatgaattttatcttataaattttaacaaatttttcaattgctgtaaagaaagatgacctttaattaactactcactagatagtagaggcggtaaaaaaaccgtaaacgtatatttaatttgttttagtaaaatttaattataaactgtttactaaaatgcaaagtaatcaataatataaacttttcctattttatgttattgtgtcacaatgtttatagctttaaatacgatttattgtactattatatttttaatatatggtaacttaccatattctctcattatactttattgtaccgctatctattatcgtatactcttatttttaaatccgtaagaaaatttgatcgacttagtatcaatttttttataataaaaaagctaaaatcatgtaacttctaatgttcatcaccaataaggcacatagtcttgctaaatacactattttagatttataccatctacattatatgtttctactgcaattctacggcttcaacaaccccattttcatcacttcttattaaaaccacaataatttacgcacgatttgattaaaaagctttaaaaaaaaaagctatatgacattacatgacctatgtagtactaatctattcgacacaaccaataaataatgcattttaattgccccaatccccaactttcttcttcgtgacaagagtagcccacatgattttatgaaagaaaaaaaagtgtagtctaatacaaatttagttacatacgaaatcagtcgaatttaattattgatatataatcatagaaacaaagcttatattctttaacccaatcacaagcatatgacacaggggacctagacagtaatagagtatccaaatcttaaacaattcaccagtcaatattaataatacaataaaactatataataagatagtaataaataagaaataaaaataaataaataaatgaaaaacctagtttttgacgcaataataatagaagcgaaccaaacttggcctcctcttcgcctataaatacgatatagagattagcgtcaaaagagtatgtaaatcgcaaaaacaaccaaacaaggtcttcttcacacactctcatcgtcgtcacttttttttttatataacatagtctcgttctagaccgtcggattatttctattggtcaaatccaacggtcgtgatccaatttgattagaaagagtctcatcgtctctcaaccaccagattctctcgctcgctcgctccctcgtcgtcgtcctctctacgatatcgaccaacataccagatcttcttcgatcccgcctccgtcgccgttgctttcgttattttactcagccgccgtttccaactgtttttaactttttctcgccggagattgagattgggattgagatttctttagggcatttagacgatccgattaattttagagacgaggttttatcgacccccaccgacaccgttagtggtttgttctctcaatctcgatcctttgattgttataataacctaccctccattgatctatcgtctctgattcattggttttgtttgttaattcgtctgattgctatttaaattttacttcttttaaacaattttaggttgcagcgatttaaagatcgttttttttttcgtaattgaatgtgattcgtatttgtttcaatcaaatttgcattacactgtctattgattgtggtttgtgttgggtttaaattatgtctgcagaagctggtgtcgtgagaggggataagtcttttgatttgtgttattgtgggattatacactgtttatgactatacatacgagatg

SEQ ID NO: 19632 - DNA, 3003 bp, Unknown; identical to SEQ ID NO: 19631
  misc_feature (1)..( 3003): 2750-1469P.txt file - cDNA_ID_1822701; gDNA_ID_2926197; Annot_ID_141324

SEQ ID NO: 19633 - DNA, 3003 bp, Unknown; identical to SEQ ID NO: 19631
  misc_feature (1)..( 3003): 2750-1469P.txt file - cDNA_ID_1822701; gDNA_ID_2926197; Annot_ID_201539

SEQ ID NO: 19634 - DNA, 3000 bp, Unknown; identical to SEQ ID NO: 4016
  misc_feature (1)..( 3000): 2750-1469P.txt file - cDNA_ID_1822707; gDNA_ID_1620679; Annot_ID_48316

SEQ ID NO: 19635 - DNA, 3000 bp, Unknown; identical to SEQ ID NO: 4016
  misc_feature (1)..( 3000): 2750-1469P.txt file - cDNA_ID_1822707; gDNA_ID_2926197; Annot_ID_141322

SEQ ID NO: 19636 - DNA, 3000 bp, Unknown; identical to SEQ ID NO: 4015
  misc_feature (1)..( 3000): 2750-1469P.txt file - cDNA_ID_1822713; gDNA_ID_1620679; Annot_ID_48314

SEQ ID NO: 19637 - DNA, 3000 bp, Unknown; identical to SEQ ID NO: 4015
  misc_feature (1)..( 3000): 2750-1469P.txt file - cDNA_ID_1822713; gDNA_ID_2926197; Annot_ID_141320

SEQ ID NO: 19638 - DNA, 3003 bp, Unknown
  misc_feature (1)..( 3003): 2750-1469P.txt file - cDNA_ID_1822728; gDNA_ID_1620679; Annot_ID_48310
aagtaagttgtcacgatttcgcacataaacgaattctgtcccttttggaccgaaagacaaatctaaagttacttttaaaatcatcagcaacaaggttttccataatcagtgggtaaacaaaaataaaacaaagaatatttcctcttgaaaaaagttcttaaaactgtgtataaaaatttggtttttgctagtgccggcgaaaaatccatatatagcaagttcggcttaaattgttactgcatattcagatctgcataaacagataaaactcttcacatgcaaaaaaggggaaagaaaaaaaaaacaattagcgcggtaaatgatgtataaagatcaaataagtgagacgtttatttttggtaggtgtaagaggaatcaaagttttggacaagaagaagcgtcaaatgacacatgatgtgtttcgactaaacgacatatcacctgggaacaatccttcacatgtgcctttcgatgttaactttatacgaccacatacctccaattacattactacatcacaaataacttcgtattctcagttgtcactattaatcttcactacttatgtgataaatctcccgtgttctacgtactatagtttttaaacttaactgaaagtcttactacgaaatatattattacatccattttagcgaaaaaatgttgtttttatatcaagactagcatttcttcacatacgaattacatatatacatttatgtttatgatccattcaatatttttttttgtttgtatgaaaaggtcgaaacaatgttggtgaaagcattaatttcttagtttgaccgacgataaatgatctacctgtgaattgattcgaacagaagaattttggaattggagcctggtaaaatagtttgggtttttacactttcatgagttactagtaatattttttgttggtcacaaatattatactcctcataaatctaaggacaacaatttttctaatcataaatatttaatactgatttttgaatgattcaagctttaaattactttatcctctaaaatattactcaaaattatgaaaactggttattttttatttaattaaaagtctcctaagaatgtagtattttgaatgaagaaaaatttcttatccaaaaaacctaaatttttaaaaaacaccatagtgtttttgaaatccgtaatctaagacacaccatgaattattagaggagtctctagtagggaccgttttatcttaataattactccagaatttgttgatctgtaatccaaaaaagaaacacaatcaagtggtaattaactgtgttcataatgcttttggagggaagccgcgttttatgattgaaagatgaattctaatcaaacatcattactcttagaattctaatgataattctttaggtcccctcaaagattatgaaattaatatttgtttaacttttttagttgtatacttttcttttacctttcatcaattaagtcaactatcttttctctccctccttggacttttcacgtatttatttgtttcttccacctatttttccgtataagttaagtataataactcctattcattaaattattttccatttcttccaaaaccaaaagtttttacctatgatactatcaaattattgatttttttttttttcattttaacattctactactaacgtgaaataaataaattacagagaaatattccccgttcttttgtcatcattatataaactcaatattcaatttcaactagattcactttattatactcttagatttttatactttacataaacctcgtatagtgtggtaaattcccactactaatgctacatgtatgtctatattaagattattaaaaacataaatctttttaaaaagctacatatatgtgtgagagtctccattatcaacggttcattgtctgctactctgattagcattttcttaaaaaaaagtaattagaaaaagaaaacaaacgaattaaaaaaaagaacaaaaaccctaataaatctctaaaaagtccacacacactaacacactctctctccgtctctcactaaaagcttctcacttacatttctgctttcattcattaatctctgtgtttccttcttttgatctttttggcaagatctctatttttcttccaaaaaaggaaaaataaaaagatcataacttcagaatcaaagtttctctttgttcacattgttctatccatctgcacatttgattcatgtagtgactaatctcacagtctcgttctcaaatttactttatctgcttgattcgtttcgtgaatccaagtaagttttacactttttgtttttgctttttggctttattctattcaagtttcaagtttaaaggatcctcttttactaatgtagaagcatttttttttttttgttgttttggtttctgggctttgttatattgcttattccttgcttggatgatttgtgaaagtgggttaattcttctcatctttaaacttttgatgtgtgtttataattttctcaagatttgtttttttttgtctttctctgttccactgattgctcagcaacagttgctactgtagtttctgtatcgtcttcaaacagttgaatttgtttaggtatatttgtctatagagatgttgagtttaccaatctacagtgtgattgaagtttccccaagtttttatctttaagttactttggagtagcctttctttatgtgcttgaatctcttctctgctcatttgattttgagttgtcagacgtataaagtttagtcttttatcactgtgaaagatagcaacactatctcataatttctgagaagagtgtggagattaacttgtgtagtggtttttaatacaattccaattctgtgaagtgattgttgttgttgctcaatatctgttgtttttcagggatgctaatgttatacattggattttgatactgcagatttagtctgaagagaattaagcttggcgcttctttggtgagaagcaagatg

SEQ ID NO: 19639 - DNA, 3003 bp, Unknown; identical to SEQ ID NO: 19638
  misc_feature (1)..( 3003): 2750-1469P.txt file - cDNA_ID_1822728; gDNA_ID_1620679; Annot_ID_164350

SEQ ID NO: 19640 - DNA, 3003 bp, Unknown; identical to SEQ ID NO: 19638
  misc_feature (1)..( 3003): 2750-1469P.txt file - cDNA_ID_1822728; gDNA_ID_2926197; Annot_ID_141316

SEQ ID NO: 19641 - DNA, 3003 bp, Unknown; identical to SEQ ID NO: 19638
  misc_feature (1)..( 3003): 2750-1469P.txt file - cDNA_ID_1822728; gDNA_ID_2926197; Annot_ID_201527

SEQ ID NO: 19642 - DNA, 3000 bp, Unknown; identical to SEQ ID NO: 3792
  misc_feature (1)..( 3000): 2750-1469P.txt file - cDNA_ID_1822736; gDNA_ID_1620679; Annot_ID_48307

SEQ ID NO: 19643 - DNA, 3000 bp, Unknown; identical to SEQ ID NO: 3792
  misc_feature (1)..( 3000): 2750-1469P.txt file - cDNA_ID_1822736; gDNA_ID_1620679; Annot_ID_164346

SEQ ID NO: 19644 - DNA, 3000 bp, Unknown; identical to SEQ ID NO: 3792
  misc_feature (1)..( 3000): 2750-1469P.txt file - cDNA_ID_1822736; gDNA_ID_1620665; Annot_ID_163919

SEQ ID NO: 19645 - DNA, 3000 bp, Unknown; identical to SEQ ID NO: 3792
  misc_feature (1)..( 3000): 2750-1469P.txt file - cDNA_ID_1822736; gDNA_ID_2926197; Annot_ID_141313

SEQ ID NO: 19646 - DNA, 3000 bp, Unknown; identical to SEQ ID NO: 3792
  misc_feature (1)..( 3000): 2750-1469P.txt file - cDNA_ID_1822736; gDNA_ID_2926197; Annot_ID_201524

SEQ ID NO: 19647 - DNA, 3000 bp, Unknown; identical to SEQ ID NO: 4047
  misc_feature (1)..( 3000): 2750-1469P.txt file - cDNA_ID_1822744; gDNA_ID_1620680; Annot_ID_48343

SEQ ID NO: 19648 - DNA, 3003 bp, Unknown
  misc_feature (1)..( 3003): 2750-1469P.txt file - cDNA_ID_1822748; gDNA_ID_1620680; Annot_ID_48342
tcttccttcagagacaaatcaaaactctctctttatacataaactctgtggattccgatcgatgatgatgatccaagtagaagccgacgacgatgatccaagcaaaagccgatgcaacatccgtaagatttcagactgatcggagccgaaattaaagcatatcatcgtttcatagattgaatgataatctccttcaatccacggccgtcgtctaccgtccaaaacaaaatagatttcagttcaccggataatgatctagccaccgagatgctttcaccggagacaacgaggaactaagaggatggcgaaagaaaacacgaagacgctctcgtttgtggtttcaagtttcagaacaagcacgagtcgccgcctgagtatatcacgacttttaggtatattactttactaccctttttcttttttaataaagattatgattttgattttaaaaagaaaaaaaagattttatgtttttccgttctgatttttctgatttaaaactaatcacaaggttttcacaaatatttttttaaataaattgttttaatttttgtttttaatagattttttagtgttaaattttaaatatgtgtaaactattagatacattatcccgtccataatatgaggtctttaagaggtgttttaggtttaatatgttttgcacatataaatttttaacacttattctttttatttaaaattgtttttaaatttgtattttatgcactatttaatttttgttttgatttttaagtaatattttagataaaatgttttattttttaaaatatacataatatttttgtttttaagtgttaaattttaaatatgtgtaaactaattggacacaacatcccgtccatagtatgaggtcttttagaggtgttctaggttcaatatgttttacacatataaatttttaacacttatgtttttatttaaaaattaaattactactattttaaggttttcgattttttaactaatattttagataaaaatattttttatttttaaatatataatatttttgcttttaaatgttaaaatttaaatatgtgtaaactagttggacataacatcttgtccatagtaagaggtacttaagaggtgttctaggttcaataaattttatacatatataaattttaacacttatgattttatttaaaaatatatatattttttttaataccactattttaaggtttttgatttttaaagtaatattttaaatatatattatatttatgtttttaagtattaaaatttaaatactgtatgtgtaaactaattggacataacatcccgtcgatagtatgaggtccttaagaggtgttttaggttcaacatgttttacacataaataaatattgtaacacttatatttttattgatttgttttttaaaaatttgtatatttttaatacacattgtgttctaggttcatagtaaaaggtgattaaaaggtgttctaggttcaacatgttttacacatataaattttaaacacttataattttatttaaacatattttaaaatttatattttataccactattttaaggtttttgattttttaagtaaaattttatatttttaaatatataatattttaaaacaaaaatattaaaatttaaatatatgtaaactagttgaacataatattcggttcatagtatgaggtctttaaacacttaagaaaattaacttactatgttttttttatgtatttttgggttacttttatttaataaattatggggtcttccctctctcgaccaaaaaaaaaaaacattgtaaggtgagttttgagagtaacaataatattggggtatatttttaaaaatattgtagtggtaaataccgaatttccatatagtttctgtgtggcttatatttgtccttttatagggtgcaattttagagtaaagatagtatctaggtttaatgttaaagattctaataatgatggggcgttttcgtgttttctatttatttaagctccatttattattaccggctgttttctattttgtcgttcccggtaaattttgccggcgaagattgaaacttttccaaacgatgcaagcaacggcgaatcttccgacgatatggaatctgtcgcttcgtgggtcatcctctaaagtccatatagtgaaccctaggcatcgaaagtctcacgcgcttcattgtttgaggttttgagtttcgtctccttcgtgagatttctctttctgctctgttcgatccgattcttcaggttgatagtaatattagtgtagcattttacagaatttagttaatttcatgaaatcattgcttatctagagtgaacctttctcaatctttctggtttgtgtagaagaatattttgtgttgcaagaattgattttgcttctctgtaattaaactggattcttttcgattccagatcagaagggcatgaagagtttgacaattctcaggttactcttctttggtttgaagtttgctatcttctctgattttctagcagaatgtaactagtttagttcacagaaaagtcttggacaatcttctattacaaaagaagcaaaacataaggacatatggaacctctttagagaagctcaaaaaagtaaaaacaaaattggttgctatttgtttcggtttcatattctgaaagttaactcacccgattggattgtgtcgtctttgttgtgtgattagatataatgatcttaaacaaacaacgcctagctgcagttgacgagttagaacagctaaagaaagataaagaggaattgttagagaggataaaccaattggaggcagaaagtcagattgtaatcaagaaaggtctcatttttttgaatagtctctatagtttttgatgatttgtattcaagtgagcgatgtgatactagtcttttgaaccctgaagcttatcttgtaccatgttataagcagataagtcgtctctattctgggagttgcttctccgtattgattctatg

SEQ ID NO: 19649 - DNA, 3003 bp, Unknown
  misc_feature (1)..( 3003): 2750-1469P.txt file - cDNA_ID_1822752; gDNA_ID_1620366; Annot_ID_154840
gtgacttacgagtggtaataaatataatgttcagaacatgtttcctctctaattctctctgttttcccaatatttaaaatacagtttcgcaagtattgaaagtgttttaaaaagtgatcatacatagtaagagtaactcgtagagagagataagttatgggaactgactgtatcaaattagttggaccatgttttatgtccgtgatggtcggactcagaaacagagtggtgatgtgaagatgacatgtttatggtcccattttcacttttattgggtcgtgtttcacctttcaaatgaaccactagaaaattgaagcaacttttttttttcaaaccaaaggaaaaaagatgactttgttaagacctttgtcttggttttttttgcttcatcaagcgtcgctttcgcaacatgttctctctattattacatgatttcaaaacaagcaaaacatatcactgcctaattcttaactttgtgcttcagtctttccataaataatagttaactttcaaattcctaaatgtactaaaatcaactatggttgttgagctttattattcttccgtttaatcttggttcgaaagaaaaaagatatggtataatcattccattcatatacgtattactaatcatagttatctttttggtgagtaaagagatttgaatcaagattgtgtgttggtaataagaatccttatagagatgtgcatttaaggagacagaaaggaacacagcacgagacgatgcggttagagaataaacaaaacaaaaagaaacttggtaatggatacaacgtgattccatcgttaaacaactttgcttttggctttggattcttctctattttaactcttaacccaatgttatctcattatccttcatctcaatctatttttctatttacttaaatttgagttttcaagacactttttaaaaaaatgaaaaagggttagaaatagagaagagagtaagaaagaagtgtaaaatcaaataaacgaatctcattaagcacctacttcccacatctttcttaaagtttcttacataaagctcccttcacacgtgcttaccaaatcagattgtcaataattcttgctcaataatttttcgaaatttatttgaatttatctaataaaaatacattgtttgagtatgatattttgcttaagaaggttgattattctccctatcaaagtctaaaaagaagattacaaaacaattgtatggttaaattcatataaatttgtgactagtattttaatatttacatatatacaaatacttatagatgaaacgagaatgcagaaatgattatagatagatcagtgacagtgaactgtagcaaccggcaaagaaacctcgttagctggacacacgattacgatcatgcccccagtctcctctgtccagacggctgcattaataacaacgagctagagggtgttttcgtcttttcgatacttatcccaaaaccgacaatctctggtttggactcgaaggctgatttggtcaattcatagcaaccgaacgagcagtccattcaagtccaaagagctccttagtggtaaaagatgtaattacgtagatgttccatggtcaagaatgtattcagtcaaaataaatatttgaccaaaactttcggttaatttcctaccaccagcaaaattataactttttctaataattatcaatcattttcaatctcttttaattttctttttcacttttttttattaattaaagtcaattcacactatacaaaaagaaggaagtctaaatatttttttactttcatgttgcttttctaacttttatattttgctcttctcaacagattttgctggtttttgtattagaaatattattatgtttccagaaatgaattttttatatgtcgtctggattcgtatatatatattggaaagtgaaattaattcatttgatttttttctttgatatatcgaccaaatcaaataaatacgaccccattgtggcattgttaatgcaaaaaggcacaagtacaaaaaaaacataataattcactattttatttacagacacatgggcccaattcatacggcccaattaccataaacctctcttttaaagagtgggttccacagtggtaaactttttgactatccattggaatgattgcatctggaccgttcatctacattaattattgggttttttcgctttaaagcatcaattaacttattacgtataggattagattaccaataacgatctttttagcttttgtcgttttccgataaaaccatacgattaagaatatgacctcttgtatcttttgagggattttagttaatctttctacatttattttgttggatgctcatacaattatcctgtgtctctcaaaataaaacaaaaattactctatttattagtacattacacatgattatttagaaaatgtatattgtggtcatatgaaatgagaaattaaaggaaatttgtcaatacttgagaacatcaccattcaaatgtttcaagaacaacatgactccaaaacaaaataaatgaacctttccctaataatagtatattctccatcgtacaaagttctaaataatacaatattcatttcgtcaaagcatatgatgtgttggaatcagaattatctgcaaatgtttgaatttcaaatgttagtatcaggctatttttactgttttatcaaatatcgtttcttctgcaatctatcacttgattgttttatcaaatcagcactagtattattgattttgtaatttgtgtttgtctacctccaattactttttagtgttatgattagtaatgtaataaaatcacaaatctgacgtggcacctatatacaattccaaaaacaagtggaacgaatataaaacaaattcacaccttcctcatcttcttcttcgtcttcacttaccttctctctacactcacaccatctcacaaccctaatctctcccacacaagagagatagagagaaacaatg

SEQ ID NO: 19650 - DNA, 3000 bp, Unknown; identical to SEQ ID NO: 4049
  misc_feature (1)..( 3000): 2750-1469P.txt file - cDNA_ID_1822752; gDNA_ID_1620680; Annot_ID_48341

SEQ ID NO: 19651 - DNA, 3000 bp, Unknown; identical to SEQ ID NO: 4049
  misc_feature (1)..( 3000): 2750-1469P.txt file - cDNA_ID_1822752; gDNA_ID_1620680; Annot_ID_164412

SEQ ID NO: 19652 - DNA, 3000 bp, Unknown; identical to SEQ ID NO: 4038
  misc_feature (1)..( 3000): 2750-1469P.txt file - cDNA_ID_1822756; gDNA_ID_1620680; Annot_ID_48340

SEQ ID NO: 19653 - DNA, 3000 bp, Unknown; identical to SEQ ID NO: 4038
  misc_feature (1)..( 3000): 2750-1469P.txt file - cDNA_ID_1822756; gDNA_ID_1620680; Annot_ID_164408

SEQ ID NO: 19654 - DNA, 3000 bp, Unknown; identical to SEQ ID NO: 4036
  misc_feature (1)..( 3000): 2750-1469P.txt file - cDNA_ID_1822760; gDNA_ID_1620680; Annot_ID_48337

SEQ ID NO: 19655 - DNA, 3000 bp, Unknown; identical to SEQ ID NO: 4034
  misc_feature (1)..( 3000): 2750-1469P.txt file - cDNA_ID_1822764; gDNA_ID_1620680; Annot_ID_48335

SEQ ID NO: 19656 - DNA, 3003 bp, Unknown
  misc_feature (1)..( 3003): 2750-1469P.txt file - cDNA_ID_1822783; gDNA_ID_1620680; Annot_ID_48330
tgctcctattatctcatgttccattgtttgttgatttcaatttgaaatattagtttctttcttcttcccttcattccttcaacttttataccattttcctgttatctattgatttgaaagttttaatttttaagaggcggtgatgacaaaaaacatttctcgatgctgaaacttactcgagagaccaaatcactcttgtaatctttcgtgatgcttgtttttatgcgtgtctgagcctaaaccaaaaaatctttcatttatgctttgattatcatagatcccaatttatgcgtttcttttattgcttttcaatttgtaatgcgagttttgctttattttgtccagccatggaagaagcagatcagttatgtttagctgctaaatccggcgacttgaaaaaggttcaaactttaatttactccggcgccgacgttactcactttgataacgacggtttaacgccgttaatgcacgccgctaaaatcggaaacgcagagatagtaacggcgttactcgaatccggagctccatggaacgcattatctccatcaaatctctcagcaggagatttcgccatggaagcaggacatcaagaaactttcgatcttcttctcaaaaccgggatccaatcagagctaatcttaggaacaatcgcaagaaaccaaacaaagaacgaatattctaatcaagaatatcttcaagacagagttagtttcagtgaagacaagttaatggatagtgaaagcaaaggtgtgatgatggcttgggaaaaaccattaatggaagctcacgctaaagctatttgtctcaacggtggtcacattcttaacgttggtttcggtatgggacttgtcgatacagcgattcaacgatacaatccggttaaacacacgatcattgaagctcatcctgaagtttataagcgtatgattgaatctggttggggagagaaagagaatgtgaagattgtttttggaagatggcaagatgttcttgataagcttgatgataattcttttgatgggatcttttttgatacttatggtgagtattatgaagatttaagagagtttcatcagcatcttccgaggctgttgaagcctgatggtgtttattcgtatttcaatgggttttgtggaagcaacgcgttttttcatgttgtgtattgcaatttggtgactttggagattgagaatttagggtttagcactcagttgattccattgccggttaaggattgtcttggggatgaagtttgggaaggtgtcaagcaaaagtattggcagcttgatacttattatctccctgtttgtcagtttagtgactgaagaagttttatgataccagcaattttgcgatattgtaatttttcttactcataaaaagtagattttttatccatttgaaaatagtcatagtcatccaataagaagaaaagaacagtaataagtgtataacataagatcccatagtcatgtgataggaaccaagagccagactaattctgttacaaatatcttaagaaacaaaagtactaattaaaacatgttatgcagaagcttcacgttttctacatggtctaaatatgtgaagactaagtgaccctgaaacgcttccattccttgtattgcaacgctcatcatcgtctttctctcaatattgaagtagtagacgtcgaaaggcactgtttgatagcacggcgacaacataatctcatttgtacgagtcactccaacaaagcgtaaattcagggttccaatcctatgctgccaccaagcgggtaatacgtacgtatgcttcgaccattccttcttttcagcatcttgtagaacccacaactcaatactcttactacgtccatcaacaaagcaatatctttcagaaacaagtgaagctaatttaccattgtagtttataagagttccatcatgcgctgctttaatgaactcttccatgactgtaataaatctaaacttctctgacctaacatcgaagcaaacgataatgtaatcccctgaagacaaattgatcgctggataatacaacacaccattgatgcatatctcagacattccaagaatgtgaggcatggaacattcgatgattctccatgacagttctccagttcctagtgtcagaacttgatgctcatcacttttatatgacaacaataccttgaactgtttctgaatcggttcatacacgaaaaatcttgacggcccaatactcgtcttcattggtttaggtaagcttaaggtatgtccagtgctgggattacatatcactgtcactgtttcgttcatttccttgcgtttaaaacagatcaagccattgacaggacgcgaaattttatagcataaggagaaattctttagagaaatggcggacgagttctcatatggattttgaagctgaggagacgagaagaagaacaagttaccatcttttttgcagcagaataagagttgcggtcgatgcaaagatcgggtcaagaacagctctgtgaaatcttgacggcaaattacggagatccagagtttcgacacgcaacgacatgtcgctatagattttgccggtaatctcaggagtatctcgatgatgatatcaactgggatctggactgacttttctgttttattcggtgaggtcttcttctccgttctacgccgggagatggtaagacgattctccgtaacatttctccgcagtgttctcatggcggatacgccgacggttaaaaccctagagagtgagagtttatggggaagacgaaccaatttggatgagaaaatcgaaagcaattttcgtaattttgttttaatggacttggatttgaattgggctttcaaaataaatatgggctttaaactaaaaacgacgccggatacattctcggtccattattcgccacgtgtttaatttctagatgctcttgttcttattcttctcgtcttctccataagccaaattgagtttatgattttggtttctgaatcaccaatg

SEQ ID NO: 19657 - DNA, 3000 bp, Unknown; identical to SEQ ID NO: 4030
  misc_feature (1)..( 3000): 2750-1469P.txt file - cDNA_ID_1822794; gDNA_ID_1620680; Annot_ID_48326

SEQ ID NO: 19658 - DNA, 1207 bp, Unknown; identical to SEQ ID NO: 4029
  misc_feature (1)..( 1207): 2750-1469P.txt file - cDNA_ID_1822798; gDNA_ID_1620680; Annot_ID_48325

SEQ ID NO: 19659 - DNA, 3000 bp, Unknown; identical to SEQ ID NO: 4057
  misc_feature (1)..( 3000): 2750-1469P.txt file - cDNA_ID_1822810; gDNA_ID_1620681; Annot_ID_48350

SEQ ID NO: 19660 - DNA, 3000 bp, Unknown; identical to SEQ ID NO: 4057
  misc_feature (1)..( 3000): 2750-1469P.txt file - cDNA_ID_1822810; gDNA_ID_2926186; Annot_ID_140793

SEQ ID NO: 19661 - DNA, 3000 bp, Unknown; identical to SEQ ID NO: 4056
  misc_feature (1)..( 3000): 2750-1469P.txt file - cDNA_ID_1822814; gDNA_ID_1620681; Annot_ID_48349

SEQ ID NO: 19662 - DNA, 3000 bp, Unknown; identical to SEQ ID NO: 4056
  misc_feature (1)..( 3000): 2750-1469P.txt file - cDNA_ID_1822814; gDNA_ID_2926186; Annot_ID_140792

SEQ ID NO: 19663 - DNA, 3000 bp, Unknown
  misc_feature (1)..( 3000): 2750-1469P.txt file - cDNA_ID_1822817; gDNA_ID_1620681; Annot_ID_48348
ttcgcaggtagcttaaaatgtcagaatgtagctgttccaaaaactacttcccagttccaagaggtacatccatttgaaatcgatgctcatacttgttgtttcttcgatgatacaactaaattctgtatttgctttttactgaatttgcagttatctctgaaacgaagccagcttgttggcaatgccgttgttaccggtcatgttaccggatcccgcagctgcaagaatcaaggtaaagttagcattacactgaatcaatccatttcctttaacatatattctttatcccctcttgatgaaattttccattagtacgttttaaacaatttgctgtcttgaatattgcacagctattcgagctgttctatccggtgatggaaccgccttgactactgattcaaaggaggctggacttcgtggaaaactgaaaaaggtcgttctagcttacagtggaggcttagacacctctgtcattgtgccatggcttaagtatgttttcctttttcttgagtttatttctgacctctaacaagaatacgttttgaatcttcctctggttatgaaacaactagtctgaccttccttatatgtaactatttgttttctagggagaactatggttgtgaagttgtgtgcttcactgctgatgttggtcaggtacatcacaaaaatgccacatgtcaactgttttagttaagaaatgaagttttatgttgttgcaatctgcttatgtcttctcaacctctaaatactttgatgtgaagggcataaaagagttagagggtttagaacaaaaggctaaggctagtggtgcttctcagttggtcgttaaggatctcacagaggagtttgtgaaagatttcatcttcccttgtcttagagctggtgccatctatgaacgaaaatacttgcttggtacctccatggctcgacctgtcattgctaaggtaacatttcgaatggttttatatgattgacttgtgaggactacccccactatttctaatatctggatatatcttttggattacatattgtcactaatacattttctaaatgattaggccatggttgatgtagcagcagaggttggagctgatgccgttgcacatgggtgtactggaaaaggaaatgaccaggcaagtacttggaatgtcttgctaatgcgtcacattggaaaacacgcattgattcttacattacttttttgtactgattgattgaccaggttcggtttgagctcaccttcttttcattaaaccctgaacttaaagttgtggcaccatggagagaatgggaaatccaaggccgagaagatgctattgagtatgcaaagaagcataatgttcccgtcccagtgacaaagaagtccatttacagccgggacagaaacctgtggcaccttagtcatgaggtaaagtaaaagacaagtgttggttcgcatttttcttttggatacaaattgatccagtttgtcacattgctcagttcctaataatgtgtctcatgctctgatatcaaacttatgtgttttgttgaaagggtgatctattggaagatccagcaaacgagccaaagaaagatatgtacatgatgagtgtggatcctgaagatgctcctgatcagcctgagtaagttggaatttctttgagcccttgtgtttaactatgcactgtaattaccccaaggtggtttgtagtggattatagctgtgttgatagtttgaaaactaaagttgagtcagttagctacagagctgaggtttaggcagaatgagttggtgtgttcaggatttgtttatggtttgggattgggaatcagatctagaatagagagttctcgttattaaagtctctcaaaggagttaactggtttagctgctatgctatcaaatttagataccaagagtaggattttgcaatttgcatcctaacttttgatacttacacacttatacagatacatcgagatcgggatagaatctggacttccagtggcgctgaacgggaaggctctgagtccagccacacttctggccgagctaaacacaataggaggaaagcacgggattgggcggattgacatggttgagaaccgtctggttgggatgaaatcacgaggtgtgtatgaaactcctggaggcactatcctctttgcagctgtacaggaactagaatccctcactctagacagagagagtattcaggtaaaagacacattagcactgaaatatgcagagatggtctacgcaggaagatggtttgatccgcttagggagtccatggacgctttcatggagaagataaccgagacaaccacgggatctgtgacactgaagctgtacaaaggatctgtgtcggttacagggcgtcagagtcctaacagtctgtatagacaggacatatcttcgtttgaagggagtgagatctacaaccaagcggatgcagccgggtttattcgtctttacgggcttccaatgaaaattagagctatgcttaagaaaattagctagaaatggttttcattcatgtcttacttggaattgagagcctgacattagaacacatcccttattgtgatgcgtcgtcatagcttcagcttctttcgaaataattctatcatctttcttcactttggaaaaacttgagaaatttaataatgagtgcctctttcttttatgatttccattggaaagagatataaaatataaatatccattacttgaattcaacgatcttaagtttaaattatttataacgagaatttaaatgtaaatgttttttacttttttttcttatggtaaaaattccaaatttaaatgtaaaaaaagataagggtgtttaaggtaatgcgaaacttattttttttttacatacacaaaaaaaaaaaaccatcggacctgaaatctttgtaagctcttcctccttgctcaagcaaacctctttttatatatttgctctctctctctcagatccgattcaagctttccgatttgcgatg

SEQ ID NO: 19664 - DNA, 3000 bp, Unknown; identical to SEQ ID NO: 19663
  misc_feature (1)..( 3000): 2750-1469P.txt file - cDNA_ID_1822817; gDNA_ID_2926186; Annot_ID_140791

SEQ ID NO: 19665 - DNA, 3000 bp, Unknown; identical to SEQ ID NO: 4055
  misc_feature (1)..( 3000): 2750-1469P.txt file - cDNA_ID_1822821; gDNA_ID_1620681; Annot_ID_48347

SEQ ID NO: 19666 - DNA, 3000 bp, Unknown; identical to SEQ ID NO: 4055
  misc_feature (1)..( 3000): 2750-1469P.txt file - cDNA_ID_1822821; gDNA_ID_2926186; Annot_ID_140790

SEQ ID NO: 19667 - DNA, 3003 bp, Unknown
  misc_feature (1)..( 3003): 2750-1469P.txt file - cDNA_ID_1822825; gDNA_ID_1620681; Annot_ID_48346
atgtgatgcggatatatcaactaagctggctaagatttgtattgaagaaggcattgattttgatcaaggggcagttgatttcattgcttctaaatctgatggttcacttcgggatgctgagataatgcttgatcagttaagtttgctcggtaaaagaataacaacatctttggcctacaagcttgtaagtttacacttctttcttcatatttgtcttggaaacattagatagtttagaagtgaaagatcaacatttctttgattctgcagattggggttgtttctgatgatgaattgcttgatctgcttgatcttgccatgtcttctgatacttcaaacacggttataagggcgagggaacttatgagatccaaaatagatccaatgcagcttatttcacagctagctaatgtcattatggacatcattgctggaaactctcaagaaagtagttcagcaaccagacttcggtttcttacaaggcatacatgtaagcaccccagtgatgattactttgaatatcagcttcaaattaaaacctgatctcactctttatcatatactgttctactatatatagctgaagaagaaatgcagaaattgagaaatgcattgaagatactatctgatgctgagaaacacttgagagcatcgaaaaaccagacaacttggctcactgtggcacttttgcaacttagtaacaccgactcatcatcttttgcaacagatgaaaatggaagaaaccaaataaacaaaggtcctaattcataaattctcgtttcctttatttcatgcttctttttcgtgttgtcttggttactaactatatataacttacccttggtcatgtatctagacgttgagctctccagcacatcatcaggttgtcctggtgatgttattaaatcagatgccgagaagggtcaagagagaaactgtaatgaaacagttgaatctgtgtggaaaacggttacagatttgtgttgttctgattcactaaagagatttctgtggaaacgaggaaggttgacttcacttactgttgacaaaggtaacttatatttcccaaagatggtctgaaagttttactttggcttgtgtctcagataagtaaatgcatattcttttttcttttcaggtgtggcaatagctgagttagaattctacacacctcaacatgtagcaagagccgagaaatcatggaaattgattgcagactcgttccaatctgtgttaggatgcaacgttgagatccaaatgaatcttgttatctctgcgtgttctccaccaaagagtgctaaagcagcagcaagtcttttctttggacttttcagttgttctcgtagaatgcttcacaagtcgtatttgactacaagaaccgactctgactgcgcatctgaaaagcctgcagttacaaattctctgagaagttgccaaggaaatgtcttgagggctcgaagtgttcgttcttcagccaatgcatcatcgcgtatgagctgttccagtgatcaaggcgatgcaacttctgctatgtgtactccacacattcctccgggtgaaaaaaggtaaaacatggttcatatttattcatttcaaaagtaagttgttttgtgatttggctagctactcaagtatactctgcctctgactttgtgcaggccagaagatgacactgatgtgttgtgttggaagaagactcccctaggcaaggtaaacatctcgactatgcctaagaattcggtttcagatctctgtctgtacctttttggtgtttctaatttgtgatgatgatacatgtcttatagggtcagagcgagacacagaacagcaagagctcacggcttatcggccgagtccttccctgcagcactgcagctaattaagggagctcgatgagggtaatacccattttgtggaagtggaaccaataggttttagcaaacccattgtttaggacaatgtgacacaaaaatgtatagttgcaaaatgtgtttcaagaccatattttagattagcatatactaatcactcctttaacagacctgaattttactgtctttggacccttttattgactgagctcattatgttttcacaaattatctcattcattaaaacgaatcagaataaagtgaatacattagtcttcaacttttttgttacaaaaagtggataatgtttaattttttcaataaactgatttgaaattagaaacataatttggataaggttttagtaatttgggataagatattgacagagagatatttataaattatctggtttcactattttggtaggaaaactccaaaattaaatccataaccctaatcgatatctctcttggacaggccagcacatgtaacgagcaatcgtgaccgttgagacagtaacacgtggcaacagtccttatgatgagacctttgatgagaatcagcagcctccatttctgtaagctttttgttcctcccaaaattcccaaatccatcttcttctccaaacaatcttctctcaaacattactactattttccaggatagcttacgcagcttcagactcgggttcttcttttcgatctagcctccgtcctctttcttcttaccacggatctcgcctgctctttttccgtacgacggtctgctttgtggatagtttggctgacgacgaggcgatttgaacattaacagttactggtacttggagtttcaaacatttctccgatgttttggttttggcatttagtcacgggaatgattaattgattgattgctgtagaaatatgtgaagaatgacacgtagaagaatttgatgaaaccttgggatgcataggcttctgtattatggattggtgattttagatctccatttatgtcgtttcacatcagtgtcttgtggttttagctatatgctgttttggttttaggttgatatttattgtatggtatgtgtttgttaaaggaatgatttgatgatgtttcactgttagggtaattgccaaggatg

SEQ ID NO: 19668 - DNA, 3003 bp, Unknown; identical to SEQ ID NO: 19667
  misc_feature (1)..( 3003): 2750-1469P.txt file - cDNA_ID_1822825; gDNA_ID_2926186; Annot_ID_140789

SEQ ID NO: 19669 - DNA, 3003 bp, Unknown
  misc_feature (1)..( 3003): 2750-1469P.txt file - cDNA_ID_1822829; gDNA_ID_1620651; Annot_ID_47730
aaaaggatgttacccgcttttaggtctcgatgtatgattgtgagtcgtgaatcttgatggagatacagaattcctctagcaattcctcctatgatcttgtaccgtgtagtccaatccagctggctctgcattctagaatctgcacatccatatagttagaatacctaaaacatgagttccaaaaggaaatatctttcctaagctaaatcttaccaaacaagaagtaatcaaggcttttattagacacaaactcgtagacaagtattttctcttctctctccaaacaaaatccaagaagcttgaccagatttctgtgctgaagctttgccacaacaacaacttcgttcttgaactctttctcaccttgtcctgatgttttcgatagtctcttcacggcaacttgtactccattaggaagtgtgccctaaaaagattgtgaattaaacagagccatccccttatttgatcctcttatgcaagtaacaaggaaactcaatgaaccggtagtagtaccttgtaaacttgtccaaatccaccttgaccgagtttgttacacatcgaaaacttatctgttgcagcttcaataaccttgaaatcaaactgcagtgaccctgcagttgtgatgtcatcctcttctgcaaaatatttaagaattcaaatccataaaagtttaagcaacggacacatagattttggaatctttaccatcatttgcacctggtgtatcataagtcttctttgctctctttgatgcatggaagctaaaaacagctacacaaataagaactgagatagcgactggcacaacaattgctatgattatcactgtagaatttttgccttttcctgcataagtcttagattagacatgaactaaaaccaaactaactattaggtaaataaataaaacagagctctaaccaggcggaaaggaaggagttgaaaccagtggcagtggaggagccgaaaccggcggaggaagaacagttccctctatagtttccttgtaaaaggggtaaacctcgtaccttgagttacaacttgggacaagaaatcttcctccaactttgttgaaatataattctttgatggattgttgaagacacattacacaatcttcactagtcagatcaggaatgcactgaaccgatgcataaagcgactgagacgaactgaaatccgacttcttaaccgcgaatttcttgcttgtactattagccgcttcctctgcagactttttcatcagagaaagcactgcatcattaaaccggtcagattggtccgccgtaactttctgagtgttccaagtgattattgtagttgtggttacagtatccatgaatatattcctgtctgagtatccaagcatgcactcatcatactgaatcaagaactctttcccacctggacatcgactccgagtgtctttagcagcaaagatgacgcactcacggcaagattctggcgagagatctcctttgcagagataaagtccgaacaccatgtcggagttttgaccctttgtgagactatgagatcccaaagagaagtaagcattgttagaagaaagagaggtcaaaagtgtttggagatttgagaagtaaatggagtttcttgatatcctgttagtacaaacatggccaacgtaagtagggtcttgtaattgtgcagaaactctcaagcttccaatgaagaaggttagaaggaagagaaagtttaatgaggtataagcagacattatccaatttcttcacctttcttctctgttttttttttcttacttttaatgattggtttatgagtactaatgaatgaatgtgaaaccagccaagccagtcaaattttggtttttgtaaaataatacaatatcttgcaagtcaaggtcaactagacgagtaacatcaacttgtattgatgttaactaaaatgaatcaactataaaaatgttagaataaacatgtgaaagcgaaaaccagagaaaatacaattataaatttttaagttttcatgaatctgtttccggaaaaagatgaacctattggagttggatatttaataggtttgtgattattcagcaagccgcggagactttgggtcaataagacaacaccgttttacttccttaccaaagaagtaacaaacgaacagttacaagttaaaacagtaacttcccaaaccctagttgcttcagtttctagccttcactgcttcatcaaaccaatcaacactcttagtggaaggttgactctaaagattgtcgttgacttcatattttagtacttttccttctgaactttacaactgtgtataagaattttagagtcattttgggaaacaaagaactgaaacttgcctacttacatcatttcatctctctgttcctcacaaactctcttgcttctgcagaaaaccgtacttacttatcacatctctgttccaacaaaacaaactgattgtgtaagaatcagcagataagccattaattctctgcacccttttgttttcactctctagtaaataaaattctagacaagagtatcttacacttacttgtcaggcactaaaatattatgaaacaaaaatggaagtaatttaactaagaaaaatcgaagcttgaccgaaattctgcgttaagctttgctacaacaagaatctcattcttgaattccttttgtttctaataccaagttgtagtaggctagtggttcccaacttttaaggagctcccgtttatacactcattattgggctcaactggtgatatgtggatcactgatcaaataactaaattttgattcaaattcaagttaattttaacgtgggcttttcccaaataaaaatatatgttgtttaagagaaatgacaataataagaaaaagaatcatttactttgacttgttgactcttatagtcaccacaacccatcttatactacacgctagtgatcagcttataaatgggagctctatgatgtgaaactcaaatcaaggtactcaaacaatg

SEQ ID NO: 19670 - DNA, 3003 bp, Unknown; identical to SEQ ID NO: 19669
  misc_feature (1)..( 3003): 2750-1469P.txt file - cDNA_ID_1822829; gDNA_ID_1620682; Annot_ID_48384

SEQ ID NO: 19671 - DNA, 3003 bp, Unknown; identical to SEQ ID NO: 19669
  misc_feature (1)..( 3003): 2750-1469P.txt file - cDNA_ID_1822829; gDNA_ID_1620682; Annot_ID_164517

SEQ ID NO: 19672 - DNA, 3003 bp, Unknown; identical to SEQ ID NO: 19669
  misc_feature (1)..( 3003): 2750-1469P.txt file - cDNA_ID_1822829; gDNA_ID_1620651; Annot_ID_163459

SEQ ID NO: 19673 - DNA, 3003 bp, Unknown; identical to SEQ ID NO: 19669
  misc_feature (1)..( 3003): 2750-1469P.txt file - cDNA_ID_1822829; gDNA_ID_2926181; Annot_ID_140581

SEQ ID NO: 19674 - DNA, 3003 bp, Unknown; identical to SEQ ID NO: 19669
  misc_feature (1)..( 3003): 2750-1469P.txt file - cDNA_ID_1822829; gDNA_ID_2926181; Annot_ID_200292

SEQ ID NO: 19675 - DNA, 3000 bp, Unknown; identical to SEQ ID NO: 3549
  misc_feature (1)..( 3000): 2750-1469P.txt file - cDNA_ID_1822833; gDNA_ID_1620651; Annot_ID_47729

SEQ ID NO: 19676 - DNA, 3000 bp, Unknown; identical to SEQ ID NO: 3549
  misc_feature (1)..( 3000): 2750-1469P.txt file - cDNA_ID_1822833; gDNA_ID_1620682; Annot_ID_48383

SEQ ID NO: 19677 - DNA, 3000 bp, Unknown; identical to SEQ ID NO: 3549
  misc_feature (1)..( 3000): 2750-1469P.txt file - cDNA_ID_1822833; gDNA_ID_1620682; Annot_ID_164516

SEQ ID NO: 19678 - DNA, 3000 bp, Unknown; identical to SEQ ID NO: 3549
  misc_feature (1)..( 3000): 2750-1469P.txt file - cDNA_ID_1822833; gDNA_ID_1620651; Annot_ID_163458

SEQ ID NO: 19679 - DNA, 3000 bp, Unknown; identical to SEQ ID NO: 3549
  misc_feature (1)..( 3000): 2750-1469P.txt file - cDNA_ID_1822833; gDNA_ID_2926181; Annot_ID_140580

SEQ ID NO: 19680 - DNA, 3000 bp, Unknown; identical to SEQ ID NO: 3549
  misc_feature (1)..( 3000): 2750-1469P.txt file - cDNA_ID_1822833; gDNA_ID_2926181; Annot_ID_200291

SEQ ID NO: 19681 - DNA, 3000 bp, Unknown; identical to SEQ ID NO: 4086
  misc_feature (1)..( 3000): 2750-1469P.txt file - cDNA_ID_1822843; gDNA_ID_1620682; Annot_ID_48380

SEQ ID NO: 19682 - DNA, 3000 bp, Unknown; identical to SEQ ID NO: 4086
  misc_feature (1)..( 3000): 2750-1469P.txt file - cDNA_ID_1822843; gDNA_ID_2926181; Annot_ID_140577

SEQ ID NO: 19683 - DNA, 3003 bp, Unknown
  misc_feature (1)..( 3003): 2750-1469P.txt file - cDNA_ID_1822859; gDNA_ID_1620682; Annot_ID_48376
agcatcttgaaattgacgcagtcacaaaagcataattaaaaaaaaaaggatacaaagatgggtctattataccgagtatgtattgtgcatgcatgtgacgtgggtgaagggaacttctcttatagaagtattgaaaaaggagaaattttgggggattgaaaatatttgtctgtttgtctggttaggtcagaacaaatcacatcgagctgcatagtaatatttcgtttacaacacatggttgtgacctctagacaaataaactttttaacagttttcgctgttttgccttgcatgtatttcgtagtatttcaatttatatgtaactatatttcaattgaaacatctttaccatattattttcttttttgatgccaatttctttaccatgtgtttgctcttgtgttatttatgtgtgattgattgattgaccgtgtcgattacccaagcggaatcttgtaaagggatactccgtcaccgtaatacagtgacagcatatttaatttaaaataatataaagtcattgtaggatggaaaagtaatttctatgatattttcttccgaacattataaaatttattttgtcagaagtagagcagattaaagtttcgaagatggatactttcacttttttcttgtaagatattgattaggtatgattgaggctcatgatacgaaataatgtcagtgttgaactactaatttgttatgcttgaaatgcttttttataggtcagtaggtttttttattttatttttaggcatatttattctggtttagtttagttagttggtttctaaattttccttacgactaaaaaatctaatcccaaaaccaaacgaaaacaagaaataataaatcgaacaatatttttaataacaaatagaatatatatatatatatatatatatattatatcaaattattccaagatagagtttttcagttcattcctagttcctactcatatattcttaatttctattatctcaagattttatcttgtcctcatatctacgaattgtatgaaagggtttaataaccataatctattgcattgtcctatctacgtacaccataatcgcttgtgttggtggatctatagtaatctaaacaattttttatttccatggcgtgaaagtttgagccaacaactaacgatattaatcgtacaaatgagtttcatatttttttttgcaatctcatttcaaaaagtgaaaccaaaatttggatgcttctaattaaccataagattttttattaggtgcacctaatcttgttaataaattataatcttctttgattagttatgctcctatccagatttcatgcttcaactctatgattgatcaacttgcattattactgtaccataaatactttgccaacgaatgttagttgtgggggaaacaacaattccgctggtaattttgactgaattaaaaaattagagatagaatgcaaggagacacgtacgaacgagttcatacacgagaagcagttgaccagagtcaacaaacctgtaaaaagctaaagaaccaccgtccactcgcagtctactatatacgactaactaagattcatgcaggctcaagtttttgtacttgtatgacacgtggctagatcgtaacggccgtttagactgatgtctcttcgtctctccgagtctttgtcctgtctttttctcattgcatgagacataccgaagattccagtggattaattgtcggtccatttcttttttcctttttactactgacttcgagttagattctctaaagtagtacacgtgaaccataggattcgtttatgattacataaaacctttgttagtagtgtttgttcatttcttaattctggttatacatttgaaacatatgcaaatttatcactcgacttattaatcctaagttcgtaactaagttctttttggttaattagcttatatacttctcaagatttctgattctgacttatgctataaagtatatcttcgataagttgagtcgcatctctctcctcggaaaatattcttgtattttggacaaatttctcgtgtattgttttgatatttttgtggtcatgttgttttgtgaattagtatataagtagataaactacgtagttttcattcgtacaactatataaccaatcgtattcgacgaaataaatagtcagaaaatattctatttgttatgcaataatatctcactatacagtccaaaatattaacctccatataaatctgatagtaacaacaaacaattttttctctttgtcctataacatacataatacatttatgtttgaaagacaagagaagaacaaaaacaagaacccacaaatgtcaaaatagtgaaagaattggattccgacttcgatttcccattacacaaaacgacgtagcaacggacggcgctagctattacgttaagagacgaaaaacggagtagggaccaacaaaaaaacgtgatcatggatggattattaacgatagacattggattacggcgatggacccataaaactgacgtcatccgttatggggtccgtagtgtggtcctctaaaaagtattgacgctttttgtcatctctctgttctttaggactcgtcacaaattttacttcctcagattcacatgaccaaatcatgtaaccattttccaaataaaatctttacatttagatttagattcagaggaattgaattagcctcatcataatgtatgatactacatactacactagtgacacggaaattacacgacgaaaataaacaatgtgaagaataacgaaatttcccgggaaaagagagatagagagtgagacacacgcgcgagtgatgcgtgtggtagtaaatagaacactgtttgatgatactgctgcgactacttaactcttattacaaagctctctttttgttgtctctctcttgctctctctgcaaaactccggcgagaagagaacgttgtcgtttcattcgtatcaaagtcttcatcagcaatg

SEQ ID NO: 19684 - DNA, 3003 bp, Unknown; identical to SEQ ID NO: 19683
  misc_feature (1)..( 3003): 2750-1469P.txt file - cDNA_ID_1822859; gDNA_ID_2926181; Annot_ID_140573

SEQ ID NO: 19685 - DNA, 3003 bp, Unknown
  misc_feature (1)..( 3003): 2750-1469P.txt file - cDNA_ID_1822863; gDNA_ID_1620682; Annot_ID_48375
atcagggtcatcgtcatcatcatcatcatcatcctcagacagtgagctaggtgctgcgaatctacacatataaaaacaatttcttgggacattgtctaggaaacacagaagacaaactgatagactacaaaacagaacaaactaaccttccatttgaggctcgggaaccctgctgtactggaatagaaaccatttcagaagcttctctttctgaggatgaagccttccaaccttcactgcgcaacacttctcgctcagctgactgcactgtgacagattttgttacgtcatcaccagtctccattttggaggcctcaatagcagctcgaataatttgttcttctatatcattgtaatgttgcatattattttctgcagaaccaacaggtacagcatgcctactttgtccggttggagcagactgattatcatcatcacttacttcatctataatgaccgcctcttgggcagctggaccgtgagcttgagctgtctcggtcacatcctcaatagtaggagcatcattagattgacctgatggcccattgctgtctttaacctctataggtatctccctggcctcccttggatgactaacaaatgggggacgcgacataacaggatcattatcaaatagacttctcccaaagtttggatcacgaagcgggaacgggtccgttgttctagcttcagagaggactggagtcacaccatcatctatatccattgcatcatatgaattttgatctccatgagtaaagtatgcattcacagctctattgaggttcccacgatactcctgcaataatgatagcatgtaagttttggcaaacacgaggaacaccagccacacacaaaaaaaaaacttacaagttataatgatgctgagacaatagaataatgactaaaagataagaatgcacaaaggacacaataaaaagttctctaaacccaaactaaaattgtacacaagatgagttctgaaaaaaaattcattgacttcaataactaacttaaaccccacatgaatatctctaaaataccaaaaatccagaccaaaatccaaaaaagaacaaaacttttcacaactaatttcacaatgagcaggtataaactcgtttagatatcaatgaacaattaacaaaaccaataagcatgagaattctgtaagaagtccacataaaaactcaatcagataatcggataaactaaaattcaacacaattaactccaattgcgacctaaacgcatcaagatgagcttaacaacgatataacaaaagcgtagaggagatataattcgatgatccaacgaacaaccacttgagcgattcgagaaacttccaaaaatacttcaatcaaaaacaaaataacatctaaacaatagaaggaagacggaaaaaacccagggaagtgtaattgaatcacctcgagcttacgaacggcgacggcattggaagagccggtgatggtcatgaaggtgtcaatagcttcctgagtaggtgtcgccattagaaaagagaaagcttgagagaagtttttcgtcggagatttgtgtttggagctggagtgaaggaggaggcaagaattaatatatgttgtaaatcacaaaaattgcagtgaagaaaggaattggatcggtgactcttaagatttttaaagccttttttagggtctttcttcttttccattttttttaattctccttttttatttggtgtggattttcttaaactttattttctttattctttttgtatattttcggtgatattcaagatattattttcagagaacttgagataatatatggagtgtcctaatctgaataactaaataaataattattcagttgaaattggattttttttttcagagtctttatattttataaactggaattcgagtcaaattcagagtggattaaacttatctttttagtttttactagccaagaactttttgacctttttttttaacatgatattaattgttatagtgtatatacattaaaagttagataatttttaatgtacaaaaaaaaagttacataatttattttttttcacaccaattacatattttatttgtcaatttgacagtaaatatggaaataagccttaaaatgtaaaggcttttcggtccaacaacgaaaaaccaaaaccaaacccaaaactaaaatatccaaagatatcctcactttatgatcatcccaatcttccctctatatagtgcctttaaaggagctgtcatgttctctttcggccgtttgtaatataagaattgtcgtttttgtccaaaaaaaagggttggctttcagtttgtgtcccagaaacaaagtaaatctttagataaattgaaacaaaactagctttgtgactccaattaaactttgcttcctctaagaaaccttatggagagtattattctacaatgatttgaagtatactactaataattgattacatttaaattcaactataatttattgttattgttcttcaatcaacttgaactttgagtttattgggcacattacttttagaggaatgtgaatgtgaacattgaagagacgtgtattttattttcttcttgacaaataccgttggaggtataaaaacaccatcaaactcaggcccatttggcaatggcggcaacaagaatgggtattatattgaggttaatttcgtcaatcaccacttttaaatcgtgacaaattcgtctattatctctcaatcttcttcaaccttcaattacatcggcaattctacaagtggcagcatcctattagtaacaaacacacgtggcgtaagctaatgcgtcgtagtgtttataatagctggggtttgttaattatggcgtcacgagtgatttaagaagcagctgaaaaataataaacaatgagggaatgccaacgttttaaattatatttttaatttgtgaattttcatcagagtcggatcttgatgcgactgctcaaacagagtcaccggcgattacgatg

SEQ ID NO: 19686 - DNA, 3003 bp, Unknown; identical to SEQ ID NO: 19685
  misc_feature (1)..( 3003): 2750-1469P.txt file - cDNA_ID_1822863; gDNA_ID_1620682; Annot_ID_164504

SEQ ID NO: 19687 - DNA, 3003 bp, Unknown; identical to SEQ ID NO: 19685
  misc_feature (1)..( 3003): 2750-1469P.txt file - cDNA_ID_1822863; gDNA_ID_2926181; Annot_ID_140572

SEQ ID NO: 19688 - DNA, 3003 bp, Unknown; identical to SEQ ID NO: 19685
  misc_feature (1)..( 3003): 2750-1469P.txt file - cDNA_ID_1822863; gDNA_ID_2926181; Annot_ID_200280

SEQ ID NO: 19689 - DNA, 3000 bp, Unknown; identical to SEQ ID NO: 4081
  misc_feature (1)..( 3000): 2750-1469P.txt file - cDNA_ID_1822867; gDNA_ID_1620682; Annot_ID_48374

SEQ ID NO: 19690 - DNA, 3000 bp, Unknown; identical to SEQ ID NO: 4081
  misc_feature (1)..( 3000): 2750-1469P.txt file - cDNA_ID_1822867; gDNA_ID_2926181; Annot_ID_140571

SEQ ID NO: 19691 - DNA, 3003 bp, Unknown
  misc_feature (1)..( 3003): 2750-1469P.txt file - cDNA_ID_1822914; gDNA_ID_1620682; Annot_ID_48361
tagcacgccaatgtctctctcttttttagtctaaaaattgattacaatttttttttatgaattttaattaacacagaaagtgtaatcatgatcatcatcttcccatgcctctatcatcattgatccaattttctcctccactactgaacctattaattgcttttacgttgatttaaaaattttaaaacctctacgttagaacggtcatatgcttatttaacaattagatcatgtcttctataaaggtaaaagagaaatctgacaaatgaagtgtaagtgtttataatgtttgtgtcccaaaacacacatcccccacaaaagtaaaaacaccatcaaaactttctttctttcctcttatcttcacttcctcttgtaaaccctagattctcttgttcctcttatggattcattctctttttgtatcatcatcatgatacttctcttatcattccaccaatctaagtctcaattgattcaatctacacatcttcttgatctcatgatcagagattacaccattagaaactttaagctcaatttcaacacaggcgtcactcagaaaatctatctcccttctaatttctctggtatcgatattgacacggtcaagttaaggtgtgggagtttgagaagatatggcgcaaaaattggagagtttcacatcggttcaggccttacggtggagccatgtccggagagagtcatgctaattagacaaaactttggttcgaattggtcttcaatctactctactggttataacttatccggttacaattacaagctcgtgtcaccggttcttggtttgttggcttataatgctaaccctgacggtgtggccaggaacccttacgaggttaatgttgtaggtaccgatcaaaacccaatcttaatcgatttcttgatcaacaaggcaactaataacactagccctaaccctacgaagaagaactcgtcagtcttgtgtgcgtgttttacaagcaacagtaacacaacgtttagcgagcaagtctcgccgtatgtgtgtaaaggtacaagacaagggcattacgctctcgtgatgaagacagaagctcaaaaagatgatcatgaaggtggtggtagtagtggtggagtggtggcatcatcgacggaggtgaatggtggcaacggaggaggaaagttgagccgttggaaagtggcggtggggagtgtgatagggtcagggattggagcaattctgctgggaatgttagtggtggcgatgttggtgaaggggaagaagaaagcaatgagagaagaaatggagagaagagcttatgaagaagaagctcttcaggtgtcaatggtgggtcatgttagagctcctactgctcctggaactagaactcttcctagaatttccgatgataggtataataaaaacactcatttgaatagtaattatccataattatcatttgttttctgatttttcttctttttgtgttaattgagtatcttaagataaatagttttgtagaaatagtttcaatggcttcaaaatgaaatttcatccatttttttttagtttttggttaaacggctataatcgttagttttctttttactaaaagtaaagacttttacagaatggagaattttctcttttttattttctataaaatggtcagtgaaattatgcaaaaaaatttaaaaaaatcagagagtccccccaactttcatactgtaagctttatttttttcttttcattttgatttattaatctctttttccaactttttaattaaatgtatatttctgatttagtgaagaaaatatacttttatcagtattgtgactagttaacagaattttccacctacacatcaacaagcatcttctccagtaagctattgttaatgcgaagtacggaaatataaacaaatcaccaccttcattgcaacttgcaatcaatttttactcattttagtaaggttttgtttttctttttctttcagttttttgtgatttagtttaagaaaaaataaaataaaatatagatataatttgatcaatttcttatagttgacagaaaaaaaatcttataactattgtcttttgttatatttgattggattattttttgaatatttttttggtaaattttcttttatatctttgatatttaagttttggtttatactttgtatctcaattctgtaagatatgaaactaagatttttttttttctaagattttagactttagcttattaagaaaattaaaattaatttcttataactgtataagtgtatttttctaaaatttcattgaaccatttttgactagtatatatctttttggaaaaatttctagaacatctttattatttaagtttttaggtctgtacttttgtgtctcacaattctcttagatatgaaattaaaaaaccaattaaatacaaatcagatctaatttttaatatataaaatcagcatgttttggcttgatttgtccatagatctataacatttatcaactatttttatatattgtcaacgcctgccatctaagattcttctacaagatcactagagtgttttaactgcttttagtaaaaaatgccaaaaacagacattaatccataactatttaggcccatcttcaagcccattaaaccttttcctcttaatccaacgattaagattgaatcagaagcttaaacctcacggtcctcacctgaatcacaccgcttaacttcacatgtcgttttctgtttttccttagatttcccgggaaaaaggaaataattaaaaaaaattggcaaaaaggtaaaaaagttaagttaaaaaaaccaaactacaataaaaaggacaaagagatgtttcaacaacacttcaacaaaaaagccttttgttcaatctgaagaaaaaaaaagagtcaacaaaaaaaaaaaaccaatggaagaagaagatcctacagcaagcaatgtgataacgaattcgaattcttcatctatgagaaacctatcgccggcgatg

SEQ ID NO: 19692 - DNA, 3003 bp, Unknown; identical to SEQ ID NO: 19691
  misc_feature (1)..( 3003): 2750-1469P.txt file - cDNA_ID_1822914; gDNA_ID_2926181; Annot_ID_140559

SEQ ID NO: 19693 - DNA, 3003 bp, Unknown
  misc_feature (1)..( 3003): 2750-1469P.txt file - cDNA_ID_1822947; gDNA_ID_1620683; Annot_ID_48399
aatattctgcattagctgcgccgcggaatgatttttttatgaaacaaacctttttattgttatatatccaaacaatcatcattttttagtagttgttgtcagattttttcaatagaaaatgggatttagaccaactgatgattttggtcggtttttgtcgggagaaataatcgaaaaccattaaccaactcatggttccgaaaaaaaaaacccatcaaccaactcattagaagacataagttgcttttcaaaacaatatataaacattatactacgagtctgcgaacgtttatatctgaaaactttcaaacaattaacacgcctatacataactggaatcaaactaaccattttacatttacaatatcttagttatatctcttttttttttgtccaaaagagattatgtatcataacttttttcatatgtgtgttcaattaagaatttttgaataacctttaccaaaaaaaaagaaaagaattttctcaaataaaattttagtttactcagaacctctaaaaacaagctaggtacgatctagaaacatatagtacacactatttgtgtataatacataactacagtactatatggtgagaaaagaaaggaagagtcacgagaaaactgtctgtttggcaaatgagggataatggaagggaagaagaagtactcggacatgccaggctagctagctatatataaatacacacgtatataaattatcttgtgatcagtgtgtactaatgtgtgctggaatctgtacacattcttatatgtacatatgtatttgcatgcatgtggttgtcttacacatctttatgcattgtttcagcttctgtgcgtgtttgtgtatgtgtgaccacataccgttgttacttttcatagttggcgttctcttgataagtcactgttagtgtggcaatttgacaataaaatctaaaatgttattaattataacaccccaattcaatatatatatatatacacatataagaaaatgtatgtggaaagttcaaactataatccatgagataatagaaatatagatccgaattttattatggttttacagtgatctaatatattgtagacaaaaatggtttagaaaacacttgaatgcaaatgcctaaaaaggctaaaacacatgcatcaccgatcattttgctaaaatttcagttgaaaataagatgcaatactttatttttaaaaaataaaattagagatgaattttttttgtattaattttttttaataacttttgatccttaatctctttgaaaaaaacaaaacaaaacaaaacatgtataatccctttattaccgtctggtatttatatattagactgaccggattgtggtatagtcttccaaatgtccaatactttctagaccgagctaatccaaccggatgataaagtgaatagagttcatcattcaaatgtcaaatgaactatagtctatatacatagatgcatgcatataaagagtatccaaaaagagaaataatatagaagactcaaaattggaaaaagggtcccatgttcctaacaggtaggagatatctctatcatagagaaacaatggatcgtacacgtacacgtacatctcctctcaacctgattcatacccatttttccttctctactcgtccttgatttagtctcttgggacccttctccattatatctcacatgtctctcaaacttcctgccatttcacctccttacatgtcaatttgcttcgatcaccttaattatattatgggcatgttataatgttcttatcttctaatttgtttcacagctcaacaatggagaaatttgcttcggaatcagaggcattagcatatatgttggcagaggttcttgcagaaaaatctggacaaaattcaagtttcttcaaagaaaactgtgtgagaaatacatgttatctaaggatgaaccgatatccaccttgtcccaaaccatcggaggtgtacggattaatgccacacacggacagtgatttcctcacaatcttgtatcaagatcaagtcggaggactccaacttatcaaagacaatagatggatcgctgttaaacctaatcctaaagctctcattatcaatattggtgacttatttcaggtaattgagcttttattatgtcattctaccattaccattatatcattatccggagcttacaaattagtttggtattttatgttttgatatggtttggaaggatttaaacaatttgttcatacgcatgcatgatcaataattaaaaatgtggatttcttataaagataacatctaaggcaatgtattaaaaatgtctttaaattactagattgtacttatatatgtgtttggttaggcatggagcaatggcatgtacaaaagtgttgaacaccgtgtgatgacgaacccaaaggtggagagattctcaacggcttattttatgtgtccatcatacgacgccgttatagagtgttcaagtgatcgtcctgcttatagaaatttcagcttcagagaattcagacaacaagttcaagaagatgttaagaagtttggttttaaagttggccttcctaggttccttaatcacgtctactaatttatacacccaaatttttatttttcctttataatttattttaggttttatgatttatttgaattgtttttggtttgattttttccatataatttatttttcatgtttttccttaagaaatatattgttcctcattatcaaatttaattaaaatcgattagaaaaccaattttaagttacagaggaaaaaactgaactttattaattttgaattgtacattgcaaaaaaaaaaaaaaaactcaatccgataaaaagagaaaaaaaaactaatgaaaaatatttggcatttggttttattttatgttataaaaaaatgtcagaagatattagacgaagggtcacgataaataattagaaacaaaaagaattaaaaaaaaaaaaaaaaaaaagaataaagaaatg

SEQ ID NO: 19694 - DNA, 3003 bp, Unknown; identical to SEQ ID NO: 19693
  misc_feature (1)..( 3003): 2750-1469P.txt file - cDNA_ID_1822947; gDNA_ID_1620683; Annot_ID_164546

SEQ ID NO: 19695 - DNA, 3003 bp, Unknown; identical to SEQ ID NO: 19693
  misc_feature (1)..( 3003): 2750-1469P.txt file - cDNA_ID_1822947; gDNA_ID_2926177; Annot_ID_140396

SEQ ID NO: 19696 - DNA, 3003 bp, Unknown; identical to SEQ ID NO: 19693
  misc_feature (1)..( 3003): 2750-1469P.txt file - cDNA_ID_1822947; gDNA_ID_2926177; Annot_ID_199949

SEQ ID NO: 19697 - DNA, 3003 bp, Unknown
  misc_feature (1)..( 3003): 2750-1469P.txt file - cDNA_ID_1822951; gDNA_ID_1620683; Annot_ID_48398
aataaatgaaagaaaaaagaaacataacattattaattggaggcctactggagaagtcgcgagatcgaaacaggatggcccactattgagtattgactctctagagttgtcaattgaaataagttttttttttttcctttttggtgtcgacaaaaccaattaaaataatttcaagtggtccttctcaaaattttgggtaatttgactatgttagaaaattaaaattaatacaacatttgcattaaaaaggaaatgcggcagtttgaactacaatttgcagtatttataaaactaagaaaattttgtaattcgttgattcattgtatatatatactatatagtcttgttcagtcaaacaaaaagtttattcgttgacaaaaaagaagtgatctaaagattctgattagttatatatgttactgttgaaatagttaatttcttggattaagtttattattagatttatatagtattagctcaagatttgtagataatataagtttgagttaattcatataatatatgaactcagctaagctagctcatgagatttttaacaaaaaaaaaaaaagctagctcatgagatatacactaataaattgagtttaggtgagcgaatttggtcattctaacacccttctcttgaagcaatgtataattacacagaatagtgtttgtgaagtagctctatacgtcatactacacgtattatagaaaaaaactcacaaaaagatattgtaggattaagataaagcgagagaaagaacccagaaaaactaaagtcatataaagtaattatactgaatatgatctgtggactaatcggcaaagtgccttcctaggcttagctagttaaatcatcactttcttgaatcactattttctttagttatccacgtctaagaaaaaagcgtcggtaatcccttaggcacgtttccttttgggaatggatgcaagcagcaaattgctcaaagatctttatttatttttatgacaggaagattctgcataaaaacctgaaatgattttcaaagtctataaaatttctaatattattaccatttaaaagtatatgttagactcaagttgccaaaaaaaaaaaaaaaaaaaaacgttaaagacataaaatatgagaatgaagtgttgttggtgctaaataaataggaaacaaaaaaaaaaaaaaacgagttgaggaaatgcatgcattggaataaatattcattggatgataacttcaatattatatttttggtagagttttaaaagtatatttcattataacaatttaaataattttttaaacatatgcatgacggatgttttccctatatatatatatatatatatatatatatatatatatatatattctttttaataactaattcatacgtataagaaaaaaaaacaagtgaaacatattccatattgtgtcacaactcacaacatttggagctgagccagacttaacatgttgatgttccgttcacgatcttatctcttttaccttcttttcgtgaagttgaaaacaaagcaacattttttttttgttaaggaacaaagcaacatttggataaaatgttactagcaaagcaatatttataagaattctgtaacgctttgagttatccattaccattagtaaatttacacttattttagtagagaattacaatgggtcggtatgcatcctatctttatcaaagttaatgcaattaaatttgattttttttagtattaccaccatgtttgtataattcgaagtactacgtacatgcatgcattcactgcatttgtcaaagacacagacgcaaaaaaaaaaaatgtaaacggtttcaacttttgaatgttgtttggtttcgggtttgtatatatatatatatagatgggttactatttactaaatatggtaaaaagctcatgctttcgttggtgtacaacaaataataaactaattacctcagtgaaataatacacatataatataaataaataattatgtaaacatcgacagtgcatataatgagaaagcaaagtaaaagtcgtcgtggttctttttcttggaccccaagcttctcttgcttccataagttctcttattttactaccgcttttaaactaatacgtaccaaacaatgcaacataatgtttcttttattattgggtcttatccagcgaaggaaaaggtactgattagtctgattattaataattgattacaataataaagctaaatatatactgtatattattatagtagtaataacagtacaacatagaagcaagtgaaaaacatgagaaacgaaggacggtgtccagacaagcaaatattcaaacctttgaaaatgaaacaacatcatgttctccaagacagccccaacttaatttattctaataataccaaattcattaatccccattatcgtatcttgtccaccatagatatacaaatatacacattacccatatcgcatttttctaaaatctttttgtatttaatttctacatctgttacaaatatttgacaggtgaattttgatcttagagaatcaaataaaaaaataacattacgatcttaagagtacaaatactttgattagtaaactatcccatttccaactactaattagttgctactcttatttttaacccccccatatacttatttagacgttgcaaaagaatgtgatgaatatacaaatgatgactactcattaaattgtactcccaattaatggtgagtaattaacaatgtcgatgggcggcaaacaatatattttttctttcaaatatttgttttttttttaattgtcaacatggtatgctaaaaatcaaaatgttaacaaattgcactcgtatgtaaatgcatatgcatataggtggacgtgtatataaatgtaagaaatgtgtctctcctcacaacacgtattttgataaccttcacttcccataattctctctaactcatcactctttttcttcttctgcatagatcttctcatg

SEQ ID NO: 19698 - DNA, 3003 bp, Unknown
  misc_feature (1)..( 3003): 2750-1469P.txt file - cDNA_ID_1822951; gDNA_ID_1620683; Annot_ID_164545
ataacgatgtttctgaaataccctttagcttctcagtcacagccgtcgtcgaggaggtggagcttcctgtgattgacgtcagccgtttgattgatggagccgaggaggagagagagaaatgtaaggaagcgattgcgagagcttcgagggagtggggattttttcaagtgataaaccatggaatatcaatggatgtgttggagaagatgagacaagagcaaattagggtctttagagagccttttgacaagaaaagtaagtcggagaaattttccgccgggagttaccggtggggaacgccgtcagccacttctatccggcagctttcttggtcagaagcttttcatgttcccatgacagatatttctgacaacaaggactttactactctcaggtacacaaatattgttatcaattacatttttttagaattaatttacttattaaacttaattatttgaaaaaatatgtggagaattatcccaataacaagatgtaaattaaaatacaactttacctttcttttggttaagttaccttctaaacaactagtgttttgaggattagtaagtaaattttaatgacatatataatgatacaactatagtattaattaatatcaagtttttgactataagtaacactatttgcaaagaaaattaattaattagtcaaagattagacatgggagacaaacacagtttttaattcagtatatggtggttttgaagcatataatagagtgttgtcatttatatttaattaataatagttttggatattttagaaatttaatcctagaaaataaagttgttgggcattgggtcaaagatttattccccatatctcatgcgtttctatgttttccatttttaatactatttttgaatacgtctaattttgggatagcaagttggcatgtgaaatacaatgaataaataaacaatattaagacttttcaaacaaaaataaaatattatgtatttggaaaatatataagaaataaatcttaacgtagattttttttgtttgttaaagaacaatcttaagatagttaattaaactctagctaactttttttaagatacctctaatgttgttatttattctttgattcttcgtattcgtaggaacttcgtcaacttcaaattctttaacatgctagaaaatataatggacttcttagaattaatattctgcattagctgcgccgcggaatgatttttttatgaaacaaacctttttattgttatatatccaaacaatcatcattttttagtagttgttgtcagattttttcaatagaaaatgggatttagaccaactgatgattttggtcggtttttgtcgggagaaataatcgaaaaccattaaccaactcatggttccgaaaaaaaaaacccatcaaccaactcattagaagacataagttgcttttcaaaacaatatataaacattatactacgagtctgcgaacgtttatatctgaaaactttcaaacaattaacacgcctatacataactggaatcaaactaaccattttacatttacaatatcttagttatatctcttttttttttgtccaaaagagattatgtatcataacttttttcatatgtgtgttcaattaagaatttttgaataacctttaccaaaaaaaaagaaaagaattttctcaaataaaattttagtttactcagaacctctaaaaacaagctaggtacgatctagaaacatatagtacacactatttgtgtataatacataactacagtactatatggtgagaaaagaaaggaagagtcacgagaaaactgtctgtttggcaaatgagggataatggaagggaagaagaagtactcggacatgccaggctagctagctatatataaatacacacgtatataaattatcttgtgatcagtgtgtactaatgtgtgctggaatctgtacacattcttatatgtacatatgtatttgcatgcatgtggttgtcttacacatctttatgcattgtttcagcttctgtgcgtgtttgtgtatgtgtgaccacataccgttgttacttttcatagttggcgttctcttgataagtcactgttagtgtggcaatttgacaataaaatctaaaatgttattaattataacaccccaattcaatatatatatatatacacatataagaaaatgtatgtggaaagttcaaactataatccatgagataatagaaatatagatccgaattttattatggttttacagtgatctaatatattgtagacaaaaatggtttagaaaacacttgaatgcaaatgcctaaaaaggctaaaacacatgcatcaccgatcattttgctaaaatttcagttgaaaataagatgcaatactttatttttaaaaaataaaattagagatgaattttttttgtattaattttttttaataacttttgatccttaatctctttgaaaaaaacaaaacaaaacaaaacatgtataatccctttattaccgtctggtatttatatattagactgaccggattgtggtatagtcttccaaatgtccaatactttctagaccgagctaatccaaccggatgataaagtgaatagagttcatcattcaaatgtcaaatgaactatagtctatatacatagatgcatgcatataaagagtatccaaaaagagaaataatatagaagactcaaaattggaaaaagggtcccatgttcctaacaggtaggagatatctctatcatagagaaacaatggatcgtacacgtacacgtacatctcctctcaacctgattcatacccatttttccttctctactcgtccttgatttagtctcttgggacccttctccattatatctcacatgtctctcaaacttcctgccatttcacctccttacatgtcaatttgcttcgatcaccttaattatattatgggcatgttataatgttcttatcttctaatttgtttcacagctcaacaatg

SEQ ID NO: 19699 - DNA, 3003 bp, Unknown; identical to SEQ ID NO: 19697
  misc_feature (1)..( 3003): 2750-1469P.txt file - cDNA_ID_1822951; gDNA_ID_2926177; Annot_ID_140395

SEQ ID NO: 19700 - DNA, 3003 bp, Unknown; identical to SEQ ID NO: 19698
  misc_feature (1)..( 3003): 2750-1469P.txt file - cDNA_ID_1822951; gDNA_ID_2926177; Annot_ID_199948

SEQ ID NO: 19701 - DNA, 3000 bp, Unknown
  misc_feature (1)..( 3000): 2750-1469P.txt file - cDNA_ID_1822955; gDNA_ID_1620683; Annot_ID_48397
catatatcggaaacgtgccttgggcataaggaggatacttggttcattaatatacacagattggaaaggtcacatgctctatataatcttatactagtatcttttatttatagggttgtgaatcattaataaacaaattaatatcttggccgcctacacgaaatatccatttaaaacatgaatgtgagatgttctcggtcttacggctcttcttaacattcccttctatttttttagttgatgtcttagaaaaaaactttgtttcaaatcagataattataactttgaatacaaattaaattaaataaattataattagttttgacgatttctattatgcaaattaaattaaataaatttttaactagttttgatgatttactcaagggggtattaatttatttgttttcttctaattagtttcatttttgtttggtttctctctctcaaaaagataactggtcatcaaaaatgattggcaagtgtatgtgaacattaaattaggtcgaccctaaatatataataacaccatgacatttcgaaacaacttgatggatatcagaaaatccgcaagatagcattttggtagttagatagtaaactcttggtattttcaagattcaactatccacccccactattttggtacgacgtgacgagtgaacgtctagtggttatcgctctacgaaaaaacgtttctcatttaagttctaacatgaagagtcgcaaaagaaatgtccatataaaacttacgatatttgcaggttaatcagttaatcgaacctgcaagaaccaacaatagaaaagaaaaaaatgcaataaagatatgacatccaacttcaatcatttgaactaggcgtgttaaaacaagtcgatcttaacattacaccaaaaaaagaagaaaaaaattgattttatgatacattgacacaagtgagaacgaagatatggaggtggttctggtcttgaattggtccaacaagtcgtagacaataaaaatagaaaagaaaaacaaagcatgtgatgattagaataagatccagcaaaataaccgttaccctgaaaccttgtcggctcatacgtggtgatttctacgatcacatgcaatttttggcccgagttttctcgaatgcaaatatttgcatcaaacaatgttccaattgttgtttctttcccttattaaatagcatttttcttggtacttgtgaaataaattgatcagtcaaatggttggcttcttcttctgatgacttctggaagaaaattctttgaaatgttggagaccacgtgccaacaaacactgtgtaacagaaaactaacaaacacatggtctgattttccttgaccacctctgtttcagtggtataaaatcttggtagaacaaaattttgattacagaaaaacgttatgttctgtaacattttaagagtgatgttttgtagtcaatagaatttaattgctcaactaaagcaaagcaaaactgcaaaacatatttcttgttctcgtttgtaaggacgttttaatgataacagatcatttcagaacagaccttctaacatttgcataatgtttctttgaactcagtcctttagagatgttgttatactagagattcaacattcgctaaaactgtcatggagatcgaacataagatagagaactagcagtttccaaaacagactcaatgttaaggaactttagaagtcaatggaaactaaattgtagccacaataaaatgaaaatcgtgtagctactcgccttacttccatagataaaggtgtaagaaacaattttgctgcagacctagtatttcaaaacgctaaaccctaatcaatacaagtgcaatactatgtttttcactcatttacgaggcaaaagagtatcaaaactcttctttgtggatcaatttagaaatgtgttcttttgaaatagacacacgcacatgttctttataggattattatacaacaatgctcaagtctctgcggtttcttctttccttatagctttcagtctttcttgaagtttcttgctttgttcgaaatttaccttccgcttcacagctttctgcaaatatattgtaaagatatcatctctaagaggaaaactttgaaccgaaacatacttaatcgactattagtaacttattacctcttggcggaaacatcgatcaagctttactttcagctctgtacattctccaaagaatttcccaatcggatggtctatatgacacttttgaaattcctcaattatctaccaaacatatgacaaacagaaagaattagtaagtagaacaaaacatatcaaactgatttcttttgaaaggtttgctctttccaaatgcagtcatgtagcttgtttgcaaaggcttactaaagctagagattgacacacataggagttatcacataaattgcatatattttacaaaaatctctcatctcatttgcgtacagctctaatacactgttataagattgatcttattctcaaagaagcagtcacagaggttaaaactaacagaggattgaaactacaagttgagcaaactctcacctccagacacattggatgtctatgtggtgtaagtggaggatgcatctttcacttcttctgcaagaaaaaagcaaaatctgaatcgcttgtaatggatgttaaaaatcagatcttttatttctctgctaaaaacccataaggaatttacagcaaaactaagcaaaagacccttatgttgaagaagcaaaagaaggaaagatatggtttttgtatcatactaacatttcacaagtcattctaatattctaaaatttcggatctcaatttaacatggagcagaaccacatgattttcaagagcaaatcagttcgaaaatcatcgattcgagattcaaaccaaaacctaatcgaagaagaatcacgaagaagagtaaaattaccttaatttgggtatctataagctgagagagagagaattcgtttccagctcagagaatcgatg

SEQ ID NO: 19702 - DNA, 3000 bp, Unknown; identical to SEQ ID NO: 19701
  misc_feature (1)..( 3000): 2750-1469P.txt file - cDNA_ID_1822955; gDNA_ID_2926177; Annot_ID_140394

SEQ ID NO: 19703 - DNA, 3003 bp, Unknown
  misc_feature (1)..( 3003): 2750-1469P.txt file - cDNA_ID_1822959; gDNA_ID_1620683; Annot_ID_48396
atcgcacgacaatgctcttatagaagatagcatcatcaacattgcagatggtaaagtgaagcaagaggttcaaatcaagcttcagaatgttgaatctggtgaactagaactagaaatggagtggctacctcttgagcaataaataatcaactatataatagggtcattatatataaccaaacaaattttattactgtattcattattttaacattcccccttggttcttgtttgacaaatttttgaaactttgatctcattgaaaactttctttcgtactttgttgttgtaatgttcttttggcagattagatatttgtataactcatatgattatatgttttgactcatgttcttcaaaagatttcatttgaaacctaagataagacgcttataggttactaaatcaggtttcaaacccaatctcaacatttcatcatgggatctcatagctttcttcatctccttcacacgacacaacccttgaatcataattgtaaaactcttgctgttcactgaatttatctctttcatgtactcaaacactacaactgcttcttccaccatctctttttgcctcatcataagccgatcaagaaccgcgttataagcattcacatctaaacttcctttcattttctttatcttttcatgtagtaccagtgctttctctagtttcccgcttctgcagtaacgttccatcaacaatccacatgcaaaagaatcgaaataaacctccatttccataaccgaatcaagaagcttctctgcggatttccatcttcttttcctacacatagatgctaaaacttctgatagcttgtgtgtacaaggaacaaaaccgcgctttataacatctacaagcaattcctcttcttcctctgagctattatcatctctgcaaagggcatttgcgaattcgatatagcaactctcatcaagtacagtaatacctttccgacaaatcattcgatatacatcaacagcttcttttgttctcttctttcttgacagtgcttttaacatacaaccgtatgtcgaatcccacaatctcactgtttcaccattgcaggctttacggaaaagcatctcagaggcaaacgttttccccatatcgcaaagtctttcaatgattttatcattcacagccgaatcacctaaagtaacaaactttttctccaccatcaaacagagaaccttatcaatgaactcagcatctcctaatctacatgcatcatctaatacgcaaccgtaagaacaaaaactcaactctagtttcttgtcatccatctcatgaattaaactaaacacagcatcaaactctccatttctgctataacattccacaagattagtgtaaatcttgcagctttcaacacctgtttccatcaatttaaaaacactcttggatctcccttgttcgcataaaatctgagcaatcaaatcccaagtcaactcatcagagacaatcccgtttcgaaccatggcactatacaaacacaaagccactctaaactggttttctttaaccagagaaccaagaagagagttataagcactttgagaaggtgaaagtctcaatcttctcataaaaccaaacacttccaaaccattatgatgactaccctttaaggcataatactcaagcactaagctaagcgagacagacagtgaaacttcaccttcaaaccaccgatgcatttctccaacaactaaagacacagaattggtttcaaccagaggacgcaagagcatttctgctcgttccaagagacctgattcagcagcaacttcaattactcgacaatgagacttaagatccggctcgaaccgaagatgggttttggcaaaatcgaagaaatcaagagtggttttagggcattttcgagtttcacggaggatctggaggaatacaggtgaagtaagtgttgaccttgggagcttggatttaacatattggagatgagtgatccagttacgacgttgtaagagaattgaagatatttctgtggctactcggaacagagtctgttgggttttccaatcggaagcagaggatgttgatggagtcgctgaagtcgagaatcgtttgaagaatccaacacttgtgtggataagaaccatttaggtgcttcaccaattcaaaaatctgtcctcttttttctaacaaaccccaaaatcgattcttcaaccaaaattcatcctcaaagcccaaagggtttaaggaaagttgatcaagaacaacaaaagatgaaaacttgcctgaatcttagcattgacgttcagagtgtgagttatcctctgcaggtcagtgcacagaggctcagctgcgcaagcgcttcattacccggagatcttctgcctaattcagtcaacgtcattactcaatttatcttaacagtatccaaaacgcggcgtatatgtctcattatcatcgttacgtgtcgtcttttcattcgctgtaatgattcatcaccttctcttcttcataaacctcacttcttcttcttcttcttcttcttcttcttcttcttcttcttcagtttcgcaattcgattcctaaagtcagcagttttgtttcttcagtttcttctcaaaccgatacttgatcaaggtaaaatatttcttgcttctctctcgttttgaatggtatgcaatcgaaatccaattttttcctgaattttcctttcattcgtacgttgttctttgtaaattagacaaatttttgtcttctcttgatctccttcacgtttgttctgatgtgattttaaatcgatttgtaaatcaaaatttacttctgattaatcatgttaggcctgaaatttgaaaaaatgtgaggcaaactttaatctcaatgtctgataatgcaagcataacagagcaattttgttttatgtagaatctctgattgaaagggctctttaaaataagaagaagggtctaaaagatggcagaatcagaagagaatagcgttttgtttcccattttcattttgacaatgatg

SEQ ID NO: 19704 - DNA, 3003 bp, Unknown; identical to SEQ ID NO: 19703
  misc_feature (1)..( 3003): 2750-1469P.txt file - cDNA_ID_1822959; gDNA_ID_2926177; Annot_ID_140393

SEQ ID NO: 19705 - DNA, 3003 bp, Unknown
  misc_feature (1)..( 3003): 2750-1469P.txt file - cDNA_ID_1822967; gDNA_ID_1620683; Annot_ID_48394
aagtcagtggattcatctgtaattaataaccaggtaaataatgtatctcttactgtttgagcttgcaatagaaatgttccttattctctgcattaggccggtttacatttttccattacatttttggggtacaggagcttaagtttgacgctgacagtgcaacgtacttcctggactcctttcccaagaactttgacattggaaaatatacttttgtatttaaggtattgcacttctttggttttactacacccaagacttcatataaatgtatgatgacaacatgataagcttcgttttctgcagattgtgctggatgaatcagcacatgagaaagtatacataactgaagctcaaacaaaagtgcctatagctgccacaggagctattagcattgaaaatgcagaaattgctgtacttgacagtgacattggaagcgttgaatctcagaaaaagtatgtcacctgtattgttgatgaacaacttccttttttgcttattttgattgattgctaattgcttaaccatttttcttaggaaacttgtaccattattgcttacaatatatatttcaaactttttgttgttgtgcttagtgtcttctttttgtttattggttctctctgtaacatttgtaggctagatttaactaaagatggagcggtatcattatcagcaaaccaccttcaaaagctacgcctgtcattccagttaactactccacttggcaatgcgtttaagccacaccaggtttgttcattcttgatttttcgcttcatcaatggttatattctgttctattcactttcttgacttgcttacttccatgcaggcatttttcaagctgaaacatgagtcacaggtcgagcatatctttctcgtgaaaacttctggaaagaagtctgaattagttctagttaagttccttcaacttcatttaaaattgcttttgcaaaaaaagtttaatgatcaagtttggtgaaattaatgacgtcctaaatacaatattaatggttaatgttattttcttaccttcaggattttcttggattggttgagaagctctactacctctctggtaaatatgagatacagctaaccattggagatgcttctatggtaagtactttactttcaggtccaatgcagttgatgatttatgtcttctgagatttgaacagtgttattttcctttctcttttcccaggagaactctttactgagtaatattggtcacattgaactagacctaccagagcgtccagagaaggcgactcgtcctcctctacagtctactgagccttactcaagatatgggccaaaagctgaaatatcacacatattcaggattcctgaaaagcttccagcaaagcagctctcactagttttcttgggtgttatcgttctcccattcatcggtttcctgattggggtcagtctccctttgcttgtaaatagtatccgaaaaacatcatcacatttctttcactactcatatatattttttatgtttcagcttacgcggttgggagtgaacataaagagcttcccatcgtcgactggatctgcaatatccgctttacttttccactgcggaattggagctgttttgcttctatatgtgctattctggttgaaggcaagttttcataaccgattattgtttgtttgatctacagttgaatcattgcatcaaatcacaatttctttgttttgtttgtttgcattctacagttgaatcattgcatcaaatcacaatttctttgttttgtttgtttgcattctacagttggatctattcacgactctcaaggcactttctttgttgggagtgtttctgttgttcgtgggacacagaacactatctcaacttgcatcagcatcaaacaagttgaaatctgcttgaagaagaagaactcactatgaaggatctttttttggtttatgcgtattttcagttttgtagtattgcttatagattatggtgatagacaaattcaaaagaagttcagagtttacatactctctcagtttagtcttaaaaagtaatcaagagtctctttccttagcttttttgttgaaccaaatcaactaagataatgattagctcatgattagatcacatgagtttcttaattattcacactttatgagtgtttgtggaaagttaaaaggtctaacaaaattttgaaataggctggccataaaatcgaaatgaaattttatatataaaatcaaaccgaatttcattctagtcaaaatagaaataaatgctgataaaaatgtagaaattactttgggtagaaacgagtcaacgaaggaaatgtatttggtatttgacccttaacatggcaatggcaacgttacaacttttttttttttttttttttcttgcatcgttacaacttcacaaaactttacagttgattggaaaattaaattttagaagaaaaagcacgtagttgtcttttcagacaattatttgttcatcttgaatttgtgtcccaagaacatatctctctctctctctctcctcaccttggtaagaacgtccaatccaatctataaatctccttgatggaatttccgtacatattacttgttcctttctgatctcttcttcatcggttttatgtttcatcgagtttgaatatttctttgtaagtcttttcctgtcggttatgttttcgtcgttgaaatggtttcaggaattaacaaagatcagatttttggcctttttttctcttctaaatttgaatttcgattttgggaacacgaatcgatgatgctgatgatctacaaatgggtattgaaaacgatttgttcatggttattctgcggtcgtggtttccccaaaaaagtttggtttttaaatttgcaaagcagagtttgatctctcatttaacaataccatgttctaaccatattgtgcgtgatgggtgatttctttggtctgtgaaggattctctgtttgatgattgctagttctttagaagagcaatg

SEQ ID NO: 19706 - DNA, 3003 bp, Unknown; identical to SEQ ID NO: 19705
  misc_feature (1)..( 3003): 2750-1469P.txt file - cDNA_ID_1822967; gDNA_ID_2926177; Annot_ID_140391

SEQ ID NO: 19707 - DNA, 3003 bp, Unknown
  misc_feature (1)..( 3003): 2750-1469P.txt file - cDNA_ID_1822971; gDNA_ID_1620683; Annot_ID_48393
aagcttaaaaataatcaagttaaggattctgttcattgtgtcttgctctcagcctcttttattagatatgtatctattgcaggcttttacaggtcactgtggcattgtttctagtctatgctttagagaaggaactgcagaactcttttctggttcatatgatggaacattaagtatatggaatgcagaacatagaacatatatagaatcatgttttggacaccagtctgaacttctatccattgatgctctagggagggagcgtgttctcagtgttggacgcgatagaacaatgcagttatataaggtaggtattgtggtctgtttgatttgtttgtctatatctaagcacgatttttgtttcctatcaggttcccgagtctactcggttgatctatcgagcttccgaatcaaattttgagtgctgctgttttgttaatagtgatgagtttttgtccggatcagataatggaagtattgcactttggtccattttgaaaaagaaaccagtgtttatcgttaacaatgctcaccacgtgatagctgatcatgattctgttaaccataactgtacaccagcatgttcttgggtcagttcagttgctgtctgtagaggtagcgagcttgctgcatcgggagctggtaatggttgtgtgcgtttatggggtgttgaaagtggatctagtgctatacaacctttatacgagcttccacttgtaagtttgttttcctaggtcggctcttattgctatttgtgtgttgcatctgttactgacatccaatgcttatgacctttttgcagcctgggtttgtgaactctttagcttttgcaaaatctggtcggtttctgatcgctggtgttggacaggtacacattttcctttaaccagacatatatattcgtctctgtgaatgccaatcttaactgtaactttgggtatatggcaggaaccgcggctcggaagatggggttgcttaaaatctgcgcagaacggtgttgcaatacatcccttaaggctttcatgaagggatctcaatttagattgcaacttattttagaacttcagttatgtagaggtactacagctatatttttgacatggaagggaagaaagagaacatatagaggctctaattaaacaaaatcggaaagtcccattcctgctttatgcttaaaagtcttgttttattgatcaaacaacatatacaatctgatctttacgcatagaggaactttgttttagtggtattcaaaagatcctaaagaatactagaattgataaaaatttgtggtttaagaactcagatacacaaacttgattattttaccagagatttggactcaataggtctacaaaaatagctagtgaactaaggaaacatagaagccaagaggtccctagatgaagtctaatgactacgattctctctagactagctacctcagctttcaaactatgatgatccttggagaatcgtggtctttgtagctttaggactcttgccattgcactctactggaccgggtaacaagatgcagaaaatgatatggagagcttgaagaaaatacccagaaactatgcatttgaatgaagaagcacaagcagatgcaggacatcctttcctacataacattctgctgaacttccaacacaaagctcacagaggacaaacctcaactcccatattgattaaacagttgtaatcttggtgcagaactgtagattccaagatagtctgcagttcttatctaggaatatggttttggtaaggataaaaagttataccaagtttgagctgatcatgacccagtggccttcctaaaggttagaatatatgaagagacaaatcctaaatgtatgagtgtacagtgttcatacacataatactgaaaaatgaagatttgaaagaagtatgcaaacaggcaaacacgatcaaggaaagagatacaaaagaggtttaacaagattccatttacatcctagacaacttcacctctcagaaggccgatatgaaacaatataaagtagaaaaagattaaactttcaagcttcaactaatattctatcatatagtagcaactgccagtgaccattttatttcaagtagatcacaaaaataaagacaaatgtctcaaagttatatccattgatcgaaatccaatcaacacaactaataaaacaagagaaaaccaatgacgcaaagacaaattcctctaaccttaacaagatcatctcaacttctctttaccagagctcttcctagccgcagcattcataatcctctccaaatacccttcaataggtggagtaagcgtaccgtacctcgactcaccggaaacggagtcaaatcacgcactaaagccgccttcttcaaattctccggcaatgcctcaaccgcagcgttcctcatcttcatcaaactaatctccgctacacgtctcgctctatgctctctcataagcactctactatactctttcgcaagtctaatcccatcctccactgtaaccttatactttggtaactcatcttccgtaaaaatccctaacgaaatgtaatccaatcctggagtcccaatcctcatcggcgcagtagtaactcccatcgtaaaggatccacctttcttctgaaaatcaatctctttttgcctcgctttactgattagccctagcttctctcgtctcgcttctcgctctctttccttaggtctcaggtaacgaacaggacaaggagcgtttatgcattgatctgagattcttccttttcccttatccacctcatcaccacctctgccaccgccgtttccaccgccttttttgattgtgagtttgttgcgtttcaatgattggcctgtcttcagcttcgattttcctttgggggttccactagcgtaacatttctggagaagattgtaactcactgagtcaattataggttttggtctcgcgaatctgatcattttcagattctgatttcctcagagctctctctgtttgaaatg

SEQ ID NO: 19708 - DNA, 3003 bp, Unknown; identical to SEQ ID NO: 19707
  misc_feature (1)..( 3003): 2750-1469P.txt file - cDNA_ID_1822971; gDNA_ID_2926177; Annot_ID_140390

SEQ ID NO: 19709 - DNA, 3003 bp, Unknown
  misc_feature (1)..( 3003): 2750-1469P.txt file - cDNA_ID_1822980; gDNA_ID_1620683; Annot_ID_48390
ttgacgcagaaaccctaattttccggaagcgtccttgcttgttgtttcaattgcttaattgagaatctctttggaactatgaaagtcttagaatctctcgttttggtgaaagtatcccattttgcttaatttgttcctttgtttaacgttgtgaatttgcgttgtgtagaaaatgccaaaggttaaaactaaccgagtcaagtacccagaaggatgggagttgatcgagcctactcttcgagagcttgatgccaagatgagagaaggttagtttcatataaagattttgttatatctcaataacatatgcttttgcttgtttctttttcccgtgattttgctctaactatcgtgttccttgtgcagctgagactgattcacatgatggtaagagaaagtgtgaaactttatggccaatcttcaaagtttctcatcagaggagtcggtatgtatatgacctttattaccgaagggaagaaatatctaaagagctctatgaattctgcttggaccagggctatgcagatcgcagtctgattgccaaatggaaaaaggtatgtttttatatcattcttgaattaacttctgtttgtatgcctttttagttagttgtctaaggccaaattgaagcgatttggagtttctattatgtaaaatattgttgtattagtttagagagtctagtatcgccttactgcacaatgagtcttgaagctgtttctctgaaatatatgtccttagcatatgcacttacttggaatgatctcactaacgaataggttctagaattggtattgttgctttgtttggtgaagaaataagatttctggtaattatacttcgaacaaagtgcattgcctccacgatttgccaaattttggatagttctaacttctaaccatactcccacatcttaatgatggtcactcatgaatcgtttattaacaaactcctccctgtcaattctgttgcatcttctctttgtaggttatactatccagacatatacctagatttcacttttgttttctttcattgaactaagattttgtcatttatacgtgtctctatactttgtgttaagtaactctaaaaactctctgttttgtgttttgcagtcgggatacgaacgtttatgctgcttgcgctgcatacagccaagagaccacaactatggaacaacatgtgtatgccgtgttcccaaacacttgcgtgaagagaaagtggtcgaatgcgttcactgcggctgtcaaggatgcgcgagtggcgattaaattcaacatagctttattcgctatctctgactgtttgttacaatcttgtcacttgttaaatctggattatgtattattccataaaggctaaaaaccctgactaaaaatctccttgctcttacttatcaactctgggtggtattgcaaataaaaagaacgttccggtttggtatatagttgaaacttgaaagtagaaagacgtttcccggtttggtatcttactgaattaaaagagtgttttactattcccaaaagtgtcaatttctctaaattcgtgagatttgcagcaagtttatcatgacgccgtgagttatgttttggtcaaccggtgatagaacaagatattattgaagcagaaataattattaattcttgtatttatctagacgaaacttgattgcttgatccaaggaaattgttttgacttcaaaattgtattggttctcactacagttgacctgcccctatgtttccatgtggaacaagattcttcgtcttggtcatatggattagtattatttatttctaatcttatcgtgtaatgcatgtatgatgtatgttctaaacaagatgtccaccaaggtccaaaacgagaagagatgcccattacgctcgctctagatgctttgtgaaactcgatggactttcttctctttaaactcacataacatacatacatgatccaaaatccatgatcgttctttttttttttgggttcatttttcatggtttattggaagcacaaaagaaaccaaaaataggatcacagttcttggacatcgtttaatacaaaactagaggaagtaaacattaaaaaaaaaacttgaaaaattaggggaggctaaatcattttcttgacgcgcttgtaataggaggagcaattgtggtaagtggttggtgtgaattagaacccaattatcaactaagtcgagttttgtttaaaaccaataaatttcatatacaagtttgaaactgaacatataactttttctttatatatcataattttgagtataacggatataacattttacttaaatgagaaagtactattgaattatccagaagacgtgatccgatggaaaaattcgtatcacacatgatcttttctttttatggcacaccagattttgtttacatttataattcgatttcatctttttcttagaaaaaatggtcaaagaatgcagctggtgaccaactagtgaccatacaacaagaacaaaatctcatggactctatttaaggtttccataatttaatttaccgtatcacatttccagctaattacacaaaaccgtcgataaataattgtttatagaaagaaataaatacaagaaaaacgtcaaaggatagctactataagtaaggcagactttaggaacccaaaattctgttattaatttacaaaaactaaagagtttttcacttttcagtttctcttcttaccattcactctaaaaaaacagagtctttataaaaccgatctcagattctgaatctgaatcagaatctggatcaacataattttctaacaaaaaaaatggcttcgggtggtggtgacgatgggcttcgtcggcgaggctgttcatgcacaaaagacgatttcttaccggaagaatcgttccaaagcatggggaattacctaaaagcccttaaagaaacaccgagtcggttcatggatcgtattatgactcggtcactagactccgacgagattaacgagatg

SEQ ID NO: 19710 - DNA, 3003 bp, Unknown; identical to SEQ ID NO: 19709
  misc_feature (1)..( 3003): 2750-1469P.txt file - cDNA_ID_1822980; gDNA_ID_2926177; Annot_ID_140387

SEQ ID NO: 19711 - DNA, 3000 bp, Unknown; identical to SEQ ID NO: 4098
  misc_feature (1)..( 3000): 2750-1469P.txt file - cDNA_ID_1822984; gDNA_ID_1620683; Annot_ID_48388

SEQ ID NO: 19712 - DNA, 3000 bp, Unknown; identical to SEQ ID NO: 4098
  misc_feature (1)..( 3000): 2750-1469P.txt file - cDNA_ID_1822984; gDNA_ID_1620683; Annot_ID_164532

SEQ ID NO: 19713 - DNA, 3000 bp, Unknown; identical to SEQ ID NO: 4098
  misc_feature (1)..( 3000): 2750-1469P.txt file - cDNA_ID_1822984; gDNA_ID_2926177; Annot_ID_140385

SEQ ID NO: 19714 - DNA, 3000 bp, Unknown; identical to SEQ ID NO: 4098
  misc_feature (1)..( 3000): 2750-1469P.txt file - cDNA_ID_1822984; gDNA_ID_2926177; Annot_ID_199937

SEQ ID NO: 19715 - DNA, 3003 bp, Unknown
  misc_feature (1)..( 3003): 2750-1469P.txt file - cDNA_ID_1822994; gDNA_ID_1971814; Annot_ID_58202
gtgcaatcttttgtcaaagataattagctaactagtgcagttttaaacaagacttatttatggtatctaattgatttcggttttgtgtggcaaagcaggcaactctaatggaggagcaacgaaaaagattgttgcatcaatgggcctttttggtgtggttgcaagtctgttcttttaattcaactctacaaaattctgtgtaattgttcttctcatcatttttgtttgttttcaaatctgactactcgaacatttatcgaatcaacaaaccttaactttaataattccgcttcgtcaatgttggtattaaaacctggtctgcgtaatttgacagatgtgtatagattattttttaggtttgcattggttaatgtgattatcacgtcttcatacaaatgccccacccgaaatttcatttcaatatatattatggtaagccgtacgcagatgcagatcatttaaacatatttgttactacaagggtttcaatattcttatcaatttttagtaggtctaattaagatgtccagttatatacatttaatttgaattacagtggatttaatgaaacataccaaagtacatacattcaggtcaaaggcagtgagatattttattagtagataactatactagcaaaaacaacatactgaagaagcaagctgaaatatattttggtttgcgatgaagttgtaatttgaccattcacaaatgttcttaagaaaaaacaagaattgtttcataaacaaggaaaaaaaaaaaacgcatcatcattattcattagctaacagcaagaaattgaagaagcaagttgaaatcatcatgtatgcgaaaagcttggtaagaaccatcgagcagagagttcaagtaacgaacaatcgaaatcaaatttgtgcagtggctccatctcccgtgtctcgtaattgaacagaaagagatcttttgtggtcgtgtcatggctatcactgaaatatatagtatttctatggagtccctcaacttcattggcgagcacggtgatgcctagatccaaaagcattgcctcgtcgcccaaagaatcagcaagttcatatttatcaagaaatgtccctgacgaataaaacttgtagacgttgaatgactggattctagaccaatgtcttaacattctttcaaccaagaggacatctccggttactgtgactacaagttttgtctcagcaacgcaccatgaattacttaattgacgactacgaggacttaaccactcagatctatagacatgcataaaacattgaaaggcttttcgaggaatctctccagaaaaatctaggattgtgaaaagatttctgtagctaaatgagtaaagcttgtgatccttgtaaaccatgtcaagagaatctaaaataatttctggaatttgattccacaacttatctccgttcttggcataaaccacacaccaatatccaagcccccacagagctatgtactctttggttttctcgtcaatccaaaacacaggggtacgtacggtattattacctttgaataacttaacgtggttgtgatcgtcgaaagttagaaaatcatcatctatggtttggtcaacctttaccatgccaacttgttgtgattcaatagcgggaagaccgatcttctcgtaggtgaatggattcaaaatgtatagattatactttgaatcttgcatcaggagccaacttccataggttgctagacaaacactctttgcaaattcaacaccaagatcttgcgtttggtaaagttggtctttgtcctcgggattgaaaaaaatcgtgcatgaactgtttttgttgttgtttttgtctttggggaagagcatcagccaagggatctgatttttgggcacggattgtttcgaagcagagtaccaagacgaacacaccgatttggcttgtcgaaaattagcaaagctgaggcgtttgaaaactaagttcaagagatctagaggaagatccgaccaggtattagggttttggttcttctccatgaaaacgacaatatttgagatatatagagagagttctcttatcaacaaataattatttgagtgaggagatatctctaacaaaagattttataaaccgaatagatctcggaatttcatggtttgctttgttaaaatatgggcttttgtgaaattccgaaatattggccccattaattaatcagtatatattttgttcacttggatccaataaggtgcaagacatgaagagagaaaggtaacataggtgaacgattttgttccctaaataaaggttcaattcaacaatgtgattctcacgtcttatacacaaatgctccaccataaatttcatttcattatatacctattttgacaccgaaaagagtttggaataaatatacctattttcttcttaggtctgaaatgtccagtaaaatacatttgaattacaactgatttaatcatttaatgaaacagaccattagttatacatatacacgtcaacggcattgaaattgtattagtattcgcctttcttcatatatgattagaatgaatgaactgtcgaatccatatcaatgaatatttagttttgttataatcctaataaagatatgatctggattatattaatgacacatatctttgaattgtcagggccgtccagcttatattgattttcgacattctgtccttaacaacttcttcgcaaaacattccattttatgtattaatggttttattttaaattggcttccatatatatacatgaacatgccacataaaatattcattctcaaaatgcgaagaacatgggtactggcggaagaaagctgtaagtttttaggtcaactatgtaaaacatatttaataaatagtaatcaacaatctacatgccaagactcctatataagttaatgcagtgtttaagaagtcacatacgaaaaagaaagtgagataataatccaaaaaaaaaatccatatttttgccaacgtttttagacgatcaaatg

SEQ ID NO: 19716 - DNA, 3000 bp, Unknown; identical to SEQ ID NO: 8516
  misc_feature (1)..( 3000): 2750-1469P.txt file - cDNA_ID_1823020; gDNA_ID_1971814; Annot_ID_58189

SEQ ID NO: 19717 - DNA, 3000 bp, Unknown; identical to SEQ ID NO: 8516
  misc_feature (1)..( 3000): 2750-1469P.txt file - cDNA_ID_1823020; gDNA_ID_2926180; Annot_ID_140522

SEQ ID NO: 19718 - DNA, 3000 bp, Unknown; identical to SEQ ID NO: 8515
  misc_feature (1)..( 3000): 2750-1469P.txt file - cDNA_ID_1823032; gDNA_ID_1971814; Annot_ID_58186

SEQ ID NO: 19719 - DNA, 3000 bp, Unknown; identical to SEQ ID NO: 8515
  misc_feature (1)..( 3000): 2750-1469P.txt file - cDNA_ID_1823032; gDNA_ID_2926180; Annot_ID_140519

SEQ ID NO: 19720 - DNA, 3000 bp, Unknown
  misc_feature (1)..( 3000): 2750-1469P.txt file - cDNA_ID_1823076; gDNA_ID_2926149; Annot_ID_197928
aattaattatcaaaactaccttagtatttataatgcaaattctttttttttggtttagggatttagattatcctataattgttctaatttattatacgagtccaaatccttaaaagtttaaaatgcaaatggttgacacttaaaaagtcttttttaggggattttctccttttgtttttgtaataatttgcattttcaattttggtataatgaatttgtattttcaatttgaaaatttaataaaataagttatcctttactattttaatgaatacaaaaatttataaaattaaaattaaaagaaaaaatgaaatgatttttaaaagagttgtttttaagattaaaaccaaaaacaaaacctagagacgacctatatataagctttagggttttcttctctctgtacccttaaactccgttaccctaaacctcaagccgtcgtctccaaagttccccctcagagacgaaaaaatgaagaccattttgtcctcggagactatggacatccccgacggcgtcgccattaaggtaaacgccaaggtgattgaggtcgaaggtccacgaggtaaactcactcgtgacttcaagcatctgaatctcgatttccagttgattaaagaccaagtcactggaaaacgtcagcttaagattgattcttggtttggttctcgtaagacaagtgcttcgattagaactgctttaagccatgttgataatctcattgctggtgttactcaaggttttctttatagaatgagatttgtgtatgctcattttcctatcaatgcttctattgatggtaacaataagagtattgagattcgtaacttccttggtgagaagaaggttcgtgttttgtctcttgtgtgtttgatttttgtttcagttttggtgttctgttgttggatttgtgagtgatgtgttttgtgtgaattaacaggtgaggaaggttgagatgttggatggtgttaagattgttcgatctgagaaggttaaggatgagattattcttgagggaaatgatattgagcttgtttcacggtcttgtgctttgatcaatcaggtactttctttgttggttgttctgttttaaggtttatgagttatgaaatcttgtattgagaatgaaaatttggtaactttattagattggttacttggaaatgttgttgtcttggtgctaaattgtgatgaggttgttttgcatgataaagctgcagactttgtctatgtttcctcttgcttgttctgtttgaaagattaagtgttatgaaatcttgcattgaaacttaaaaatggtaaattttatcagatgggtttctaggaaatgttgttgtcatgctaatctgtgatggttttgattgtatcgtcatgttttgcttaataaagctataggctttgtctttgtttcttattacttgttctgttttaagccttaatgttatgaattcgtgcattgagaatgaaataatggtaaatgtaccagatgggtttctttaaaatgttatagatactacggaaaaatgtgtgtaatggtgtgaatcttatttgtgattggtttgagtgtgctttgcaaactaaagctgcaaactttgactttgtaaatgctctcttattgatgatggttttgatctttgaatagaaatgtcatgtgaagaagaaggatatcaggaagtttcttgatggtatctatgtgagcgagaaaggcaagatcgcagtcgaggaatgaagttcgctattgaaagttctatattagattttatatggtgaagcagtgatattatcgtagctttttgttttacatctttcttatggatttgtagttttgtttttccttttgaatcattgatgaatgcaaattcattatccgttcatgtttggtcttttatttactctcttcttacagaagttttggagacatctttttaactctattaaactgttatatgctatatgattgatagagttaaaccatattctgtgcttaaaaccatattttgacctgttccaattgattctacttaagcttgtaaaagcttagatcctaaacatttgaatgataagaagaaacaaaaactaagagaagccattaatgagattacttgaagtaaacccaagaatggtttgatttatgcaacaacaaaacttgtaaggccttagaattgatccaataagaaaccggttactagaatattgccattcagcatctttaccttgattttctccaacaagattttctccactcatctagtgatggttttgcttatactttataaggagaagaagaagagactccacacataaaaatcctaataaatggggaccaggttatgatggttttggatccataagactccaaaaactgcctttgccttcaaggtaaacactacactccataaatttgacacttccaattctataatatatgtaatgcgtggagttatttgttacatagataaatcgtttgaacatttttttttagggcgtcaatatcactaatcaacattccttttagaatacaaaaattttctctagaaaaatatagcctatttattactctatcatctcaacatggaaaaaagtaagcaaatcttgagattgattattgaatgtccattcataaatgtatatgcatatataaggttttcatttaattcaacatggcaatgtttgtttgtatacatatggtaaaacgagtttaaaggagtctatagaagaaagtgaggttgttcttggtcaatactcctattttctctctaagtaactgttcttagctcttttttctctatagaattagagacaaatctctttttttttttaccttatttttgtttatgtttctatcttgttcaataaatcttctaacattatgattcacatttgacattccttaacaaaaaatccactatgaccatctaaagaggatttgattttgcctcttttttgtttctgtctcagtctctatcttagataaagattcagtctttgcactcaagaatg

SEQ ID NO: 19721 - DNA, 3000 bp, Unknown; identical to SEQ ID NO: 19720
  misc_feature (1)..( 3000): 2750-1469P.txt file - cDNA_ID_1823076; gDNA_ID_2926149; Annot_ID_139225

SEQ ID NO: 19722 - DNA, 3000 bp, Unknown; identical to SEQ ID NO: 19720
  misc_feature (1)..( 3000): 2750-1469P.txt file - cDNA_ID_1823076; gDNA_ID_1620685; Annot_ID_48434

SEQ ID NO: 19723 - DNA, 3000 bp, Unknown; identical to SEQ ID NO: 4148
  misc_feature (1)..( 3000): 2750-1469P.txt file - cDNA_ID_1823084; gDNA_ID_1620686; Annot_ID_48465

SEQ ID NO: 19724 - DNA, 3000 bp, Unknown; identical to SEQ ID NO: 4148
  misc_feature (1)..( 3000): 2750-1469P.txt file - cDNA_ID_1823084; gDNA_ID_2926202; Annot_ID_141560

SEQ ID NO: 19725 - DNA, 3000 bp, Unknown; identical to SEQ ID NO: 4135
  misc_feature (1)..( 3000): 2750-1469P.txt file - cDNA_ID_1823104; gDNA_ID_1620686; Annot_ID_48456

SEQ ID NO: 19726 - DNA, 3000 bp, Unknown; identical to SEQ ID NO: 4135
  misc_feature (1)..( 3000): 2750-1469P.txt file - cDNA_ID_1823104; gDNA_ID_2926202; Annot_ID_141551

SEQ ID NO: 19727 - DNA, 3000 bp, Unknown; identical to SEQ ID NO: 4134
  misc_feature (1)..( 3000): 2750-1469P.txt file - cDNA_ID_1823108; gDNA_ID_1620686; Annot_ID_48455

SEQ ID NO: 19728 - DNA, 3000 bp, Unknown; identical to SEQ ID NO: 4134
  misc_feature (1)..( 3000): 2750-1469P.txt file - cDNA_ID_1823108; gDNA_ID_1620686; Annot_ID_164613

SEQ ID NO: 19729 - DNA, 3000 bp, Unknown; identical to SEQ ID NO: 4134
  misc_feature (1)..( 3000): 2750-1469P.txt file - cDNA_ID_1823108; gDNA_ID_2926202; Annot_ID_141550

SEQ ID NO: 19730 - DNA, 3000 bp, Unknown; identical to SEQ ID NO: 4134
  misc_feature (1)..( 3000): 2750-1469P.txt file - cDNA_ID_1823108; gDNA_ID_2926202; Annot_ID_201918

SEQ ID NO: 19731 - DNA, 3000 bp, Unknown; identical to SEQ ID NO: 3023
  misc_feature (1)..( 3000): 2750-1469P.txt file - cDNA_ID_1823127; gDNA_ID_1620621; Annot_ID_47029

SEQ ID NO: 19732 - DNA, 3003 bp, Unknown
  misc_feature (1)..( 3003): 2750-1469P.txt file - cDNA_ID_1823127; gDNA_ID_1620686; Annot_ID_48449
catctgaagaagctcttgtaatcggtttagcaacacgaggagtagcagcagagacggttcgagccgtggttaccacccttggaacagacggtttctgggcggcgcgtaggttaaggtccagtgaagacgcgcttctcattatcattgttagttcttgtggggaatatttcagtggaggaagagaagagagatgaaaagatatttagactgcaaaaatatcatggagtttccggttcttgtcaagccccacactattagtcaatattatcaaattgaccccaaagttttatcatttttggttacacccttgcatcattacatgttcattcaaaacgttatcgtaatacaagaatagtaagttaatctctaactttagatacgagaacgaaactaaaagctagttagcaaataaaacattttgaaagtatttgcattatcaggccaaaaacataagtagccttttctgtaaattctacgactatcttaactagatatcatttttggggattgttcccttatttatatatatcaaatcttatcggaaaacaattgttataggcttcaggaccaccataatcgaatacccctaaagaaaatatttcaatttgattggctacggaaagacgtaagtaactggatcaaagaatttgattctgtcccacaaataagttactttttgcattcttgaacttatttccacggtcatgagtcatgaccaaaccaagacatttggatttggatatatcgaataattttgctagaattgatgagaaatgactgacaagctttgatagtatatttaatgactaattgctgatgattttttacaatgacctaacaataacggaataactatggaagttttattattcaagataaaaccagttaataagtgttcacgatacaaaaaatcgattttcatcatcagtagtataaatgtggtataactaaaaaaataaagaaattgaccataaggtgatccaaatttcctaatttcatttataaaagggcaataaatatacactaaaaatgatatggaacttgaaaaaagcaattaaactgtgtttttctgctttctttatatagtataaaaatatttttttaatgaatcatatgtacaagccttcttcctcccaaacatcaacaaggaaatgcaccatctcctgtaccaatatcatcatcaatttaaaaaaaactttcctagcaacaatgatatatactagattcaaatcctgatatgaaaatgttctaagggggataaagaatcttctgctgtaagttaattaaaattaagagttatgattagcagaaaacaactaattaaccaaatcaaatcaccttaagaggtattggttgaggaaaaagcttgtttgtgctcaataagctatcatacgtcgagttccagctgaaatcatatgaattcaaagtttcattttaacattgacgaattcagtagaccaatcctatataaacataaaaatagttcgttcaatattcgtaactgtttgtggttgtcaccttattgcaggttctggaactagacattgttgtctggttaagcattcacgccattgttgtctcgtgtggttccacaaaataagtccttttatggaaggaaatgaataagtagtagtgtatcttttagtgtatagaataactgaatgagtaataaatactgcttgcttcataacataagtttttggcatccaaaacaacctaggccttagaagttagaacattcaaaagttaccatggtttacaaattcggtagagttgcttgtgctgcattggggatcaaaaggcgggtttgaagattgggactgaatcgttatattgtggtccatatcacacgtacttgtgctccagaagtcatctgatgaagcactatctttcttcactatctttccttggattttgagtccctttgatggctcatcgacttccacaactaaacgcctttctctgttgcagcatccgaaacagtttatgctctgaaagattgaacattatgtcaatcatttgttactatggtctaatatgtttgatctacttggaaagaaatcaatttggttctccgggtcgctcacattgatgagagttttgcaatttgatcgtagagattccattagccaaaaagggagagtttggaagtaagctgccgggaattggaagaaagagcaacaacgcttcttactaaattgtgttcgtaattttagcaagaatgaataacaagaacacatagctagctaatacatgacaggacaaaagcacaatgaacatgaaagagaattaaggaaactcaaaaaagattagcaaggaagtgtagtaatatgcctcatatgacaagcaaacatatgcatttaagcacaaaaggaatccatatgttataacttacaagcaagtaaggcatattatgccgcataattacatattttaccttgatttagtacaaagtctgtctctgaactgaagcacatatatacatccacatgatttaatagaatcttgaaaagaattcaaaagaaagaaaacaaaagtttaaacaccttccaacaaagggtattgttaaaaacactcgatcattattacgttgattttatatttcttctcttcttcacgttatttacagtttttttttcatgtaaaaatgatcttttcgtttgattcctatcgtaattgtaagtaaacaaaataaattttagtattattttaagatgagacttatatagatatgaatctatgtgaattattaaatttaatgataataaataaccaaaaactttaataaaataaactgttacatattgtaaaaaaaaagatttttataaatgtttatattcaaagagagaatctttattgagtacaaaaggaggaatatatgtgatagatctaattacataatctactttacataaatagaagaagatatcgtggagtgattgatatgtgattgatctagtcagatatcatgattgatccttaacaacttatatagtagttatg

SEQ ID NO: 19733 - DNA, 3003 bp, Unknown; identical to SEQ ID NO: 19732
  misc_feature (1)..( 3003): 2750-1469P.txt file - cDNA_ID_1823127; gDNA_ID_2926202; Annot_ID_141544

SEQ ID NO: 19734 - DNA, 3003 bp, Unknown
  misc_feature (1)..( 3003): 2750-1469P.txt file - cDNA_ID_1823131; gDNA_ID_1620686; Annot_ID_48447
ttatgaaaacattattaggatatatcagttttatgaaaaaaggttttccaattgttaatcccaataataaatcatttaaaaaaatttagaaagaaaatgctgagttagaaacaaaaggaaaaggaagcacaaatggagtaaaaatgtatgaaaataaaaagataagataatgaaattttgggattagatagagatgatggagggagaaagttttgagaagcagcaagaaaggaaaggtgtcactgttgtacttggtacctctatcttaccctaatcgctggaccaacttgtctcttaataaaagtggtttttgtgtctaatctgactttgcttactctctaatcactctatctctctcagtgctaatcaagataatcataccttttttagctgttaccacttttctagtaaaggaaattgtagttacttcaattatataaatttcaatagaaaacccatcaaacttaactagttgggaacatgcatggtaggatacttattttgtctaatgctttgtattttacttatattttacggtttattacatatggatacaatattttataattcaaatcaatgatggatagtattaatatttataacaagttcatatacacattcatgtacagttatggtgttatcacacaaccgaactgagtagtttattgacttgtaatagtgtcgctactttacctttttccaaaaataatgcatgtgtgaggagttgtcgacgatgatgaaaaaatgacttatgatattcttacgaaataaatctcactaaaatttgaggtttttttttttttttttgtcgtaaaatttgaggtattaacccaacatatttggatgatgcaaataaaaactttgaaagtaacaacgttaaatagcataagacattcgttttttcactaagcaaaacagtcgtgttgtacaatttaaggtaacaaaaccgtaaaaactgaaacacatatcaagagattatttgacattttcgaactgtgttacgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttcccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaaatg

SEQ ID NO: 19735 - DNA, 3003 bp, Unknown; identical to SEQ ID NO: 19734
  misc_feature (1)..( 3003): 2750-1469P.txt file - cDNA_ID_1823131; gDNA_ID_2926202; Annot_ID_141542

SEQ ID NO: 19736 - DNA, 3000 bp, Unknown; identical to SEQ ID NO: 3028
  misc_feature (1)..( 3000): 2750-1469P.txt file - cDNA_ID_1823138; gDNA_ID_1620621; Annot_ID_47033

SEQ ID NO: 19737 - DNA, 263 bp, Unknown; identical to SEQ ID NO: 4129
  misc_feature (1)..( 263): 2750-1469P.txt file - cDNA_ID_1823138; gDNA_ID_1620686; Annot_ID_48445

SEQ ID NO: 19738 - DNA, 3003 bp, Unknown
  misc_feature (1)..( 3003): 2750-1469P.txt file - cDNA_ID_1823138; gDNA_ID_2926202; Annot_ID_141540
tttatagatcatttttgcttgagaattgaagttttcattttgaaacaactctacttaagtatcttattaatgaatacgtaagaacttacaacttcaatgtttcaaaatagatttaaatatataaggaatagataatgtttttgtataattcagataagttctcgaaggaatatatatatatcaagatgtatttgaaaaaaaaaattattaaaaagtcccacatatatgtatatatatatatatagatatactgaaaatcattgagacaaaaaacattcaaaatcagtagagcttataggttataagtaaaatgacttatattattataaagaaaaagacttatagaacaaggtgagaacgtagttacatgtagtatatatatagacaatggacatacaaataaatgtgtaaatattgtgtaatgtacttataaatattggaagatgcatgtttgaggaagttgcacttaaggtttagggacgttcgtagtgagactgagacctcttgcgctgtcactgtttaggccacgacgaatcagtctgatccgttactattgccttgctgtttactaatattctttattatttataattatttaattgtttttttttaatcgtttaatgctttcacagttttattttaattataatatggaatacacttggcgattcgccaactaattcctgaataatttataattgaagatttgaatgggcgtagatgattgcgggtcattaataccaagttaactcccaactacatttttttacatttgaacaatcaatatcaattattttaaattaaactatataagcatacccctccaaataagaacctatttatgatttattgtataaaaacacaacaatatctttaagaaacagttttttttttttttgttgtcaaagtagaacatgtagttttgtactctttgttgcatataataataaaccataatatagtttgagggaagagctgaaagctaaagatgaaatgtagtttagattagtaatgatctttaagaaatagttaatgtttgaaggaaagagctgaatcttataagaaattagcatatatcatttctagattcttattctataatctatattgtatttttgtgacaaaataaaataaaacactaccagtacaatatacttgaataccggtatctatatgtataaaacacggaaaaacaagacgtaaagtggtttagcacatttgtgttaataacgttggccgttgaaaaagtttcgatctctcctaagaagatttacacataaaagtcaaaccaaacccacacgtcggtcgtgaaaaagcagtaatttggtccatttcatcaaccaggggtacttttgggatttgagtattatctccgggaaagaaagtacacgggggatacgtccaagtgccagctggcatccgtacttcgtcttcccaaaataccttaacaatcaaacacctctttctttcacacttccccacgttcctttttttttattaatatattttctccttaatctctattttcaagtgccctaatctttatagtatttgtaatctgattatttttttcgccaattaacgtgggaaagtaagttttgttttggtttataacggggaaatgtaaggttaggtattattatgttgacaaaaatttaaaggtaggaactattttccttttcttacggcaaaggtggaagaaactaaagaattagaggaagcagttctgtattgaatcatcaaccgtcaaagtagacacaataccaaaccaaatatattttcacgtttgcttatccatctttgaattccacctgaatcaaaaagaaagaaagaagagttctctaaatttcgacatttcatgataagataaacacaaatttaagaaaaaaaatagttggatgcttcaattggtattcctctaacgggcccttcatttaaagcacactagataacagagtaatagttttccttttccacatgtttcatttattaccatctatataaattatattttcaggtggaaaataaatccactatctctctaccctattttagattcaactaatggcttttactagtaatgataactcaatcggtcattttggttgcacaatatctaacaccaaccaacccatattctgatttcattagacactagataacaatttttgtttagttttcaaccattacccatatttaagaatacaagaaaaatattaactaatcttaaattaatttgtttgccttaataaattattatgcacatatttgtatgatctcaacattttatgcaatctgcaatattgatcaatttagtagatcggtcgtcttcgtctttttttctttgaaaagtcaaaagtcaaaagggtttggaaaatttaagaacatgtttggttgaaaagagaaaagactcaagtggtcggatctgtccaaaagttttgtgacggtcacaagagggaaagataaaaaggaaacggatttgaaggaaacggctcagagagatttaagacactcgcagcatctctctacttctctctctctctgtttcaacccctcttgtcgtctatctccatcaaaaagaccaaaatcaaacatcattgaatgttagacagagaggcaaaaactaatcaaagtgtttctaatccctgaaaataagcccacttcttctattttcctcatttcagtttctgggttttaatcgatctccccctttctcacccttccgtctgaattccggtctgcaatcgtcggaaagttttggactttacaccaacgccaaagcgagttcttgtttctctgtttgcttctctaggaccaatcagtttccatttacagatgcgtactattcacctgtcagagctctgagatttgtctttttgcatctctctgaatatttctcttttctcagatccattgacctcatccacatacataaagtttaggtatttttaaaagggttcaattctggggtttaccggaatttcatcatctttgaagaccatg

SEQ ID NO: 19739 - DNA, 52 bp, Unknown; identical to SEQ ID NO: 4163
  misc_feature (1)..( 52): 2750-1469P.txt file - cDNA_ID_1823142; gDNA_ID_1620687; Annot_ID_48495

SEQ ID NO: 19740 - DNA, 3000 bp, Unknown
  misc_feature (1)..( 3000): 2750-1469P.txt file - cDNA_ID_1823142; gDNA_ID_2926210; Annot_ID_141925
gtcgagggaggcactatgatcgtgatgattacagagaccgtaggtcaccaagacgcgactattcacctcgtgatgaaagaaggtctagaagagatcggtcttactctcctcatggaagaagcccagagagaagatcagagagaaggtctgagaggtcagagagaaggtatgaaccccgtggctcgagatgacctgttttcatccttttgacaaaggattcaaaaacttctctgttgatttaggttgtgtaattgatcatccttaaaatagcacaaagattctgtcaggcaacgctttgggtttcatttattttctgttgttaacgtgttattctgtcggaactctctgaagtgaaaactaaaaactgtaatagcttctctgttatgtctctactctacttgtttttgaatgaatcagaatatcttatgtgattagaatctttagattgttcgcaattttttgttaaacaaaaaggtggagataccaaattaaagcttgaaagttgaaacttaactaaaaacaaaaccccaagttgtgaccagagacaaaaataatcaatcgtatatacttgtttaattatcgaatactaacacaaacctcatcaagaattggcgtatttgtgccaacaaagcaacataagaatacatcttctagctatataaaacctagaacgtctctccttcaccatggctaaacatcctttattcctcctctccattgattctctgcaacattcttcttcccttttcctctttctcctcatctttgtcgccgatgagcattgccccataattgttctcttctctttgattacttcgtttcttcacacttttacgttattgctctttttgtgctctacggagagatgatttttcgttataaaagacaaatggaagaagaagaagaagaagcaatattaaagggaccaaatgtgaaaagagtggagaggaaaaataaaatgaaaaaagactataaatagaggagtggtggagcaatgatgatgcgatgacgttcaacatcattaagttctttcatttatttacgtattcgtaaagaaaatatattatttcattttgcatatgtacttacgcgattaaacaattccacattactacgctttatcattgttacttaaatcgtttattagtggaataattgtctttgtgtctaataccataaaagatagtactaaagtcttcatatgactagatcatcccttccgttttttaacgttaattcgtatgttacatttcaaatcatttattgtggcttattaaagatatactataatgtaaggatcggagaactaatggtgatcatgtaatgaaagacaaaacattgtcacatatattgtaattatttttggttttcgttattaattaattgttagtatcttccggattttgattcataaaccaaccaaaaacgcgtctcaggtggttttagcgtacccgacgttgcaactggcttatctttttcctacacgtgtcttcctctggttggtattatatcatacgtgtaaaatggacttttaccttaattaaccgcatcttatggtcatcaattcatttcttaagctacttttttaatttatttgtatgacttttcttatcgttacttatttgattaaacctttcttacgccatttttttttctcgacaagtatgttgcatgaattcatattggagaaaaattaaagatcaaataggattgaaattgtttggtaaaccgcatccaaaaccgcaccgcaacagtgctgtaacagtatcaaaatctctacatatacatatgtatctatgtattttcgttactatttgaaccgcactgcactttttccgcaccgcaaaatgcagtcaccattcggaccctaagtttagttataagaagggcttcttcgtaaacgcaaaagcaacgtacgtcagcatgaactggtggaagagaataaagtatctggaagaagagaaggcagtagtgaccaatcattggtacttgattggtttacgccacgtcatcacactttcctttcacagctgtataatattcccctcttcttgttttttcttgacaaaaagaataaaaatcatttttttcattttcttatttttatttcggctgatcatttttccagtttctggatacattttatgattttaattaccgaaccagatatgggatatggttataagcgtcgtcatatggatattgttgtcgccattttcattttgtctttaactttgcgaacgttgcccacttgccactttatttacttgtgttaaagtgtgtaaaataccaacaccaagcaaatatgggccacaaggcccgacaaaaatgatctgttgcgttaggattgaaatttgaaaggcctattatcatttaggctcactcgtacctcgtacgtattgctattgcctattggttgtaacaagatcaacttttatgtaattaccaatattaaacttatagtgttatacaacaaatagtgaaataaaaacaaacatgtccattaatatgtcatcatatttgtatcataagtagcaaaacataaaaaaaaatatatataaaaaagtcatcaccatccaccatcatctccttttctttttgcttcataaacatgaaaaccaccatacatttatctcgaagccaaaaaagcaaaactgtccattatccatttaaagcattacaataactaaaaaaataagagtattctcgtgacccacactcatatggaccctacataatgacgtggatgagtcctacgtgttacacaacgaaacgttcatgtcctccctggctttcaacccaaactcatacattacaccctctctctctcttctcttcaatttccgtcttctcactctctaatcttttcgcctttagttgaatctctgggatcattctacctttttgtggatttaggatcgaagaagagatcactcctactgttgaattctggttttacttgagagagtttttcaattctgatctgctgttttgcgaatg

SEQ ID NO: 19741 - DNA, 3003 bp, Unknown
  misc_feature (1)..( 3003): 2750-1469P.txt file - cDNA_ID_1823154; gDNA_ID_1620687; Annot_ID_48490
gtgctttagttagagtgatgcaagagacgagtgtaatgacttgtttcgtcttacgctcggtcttctcgttcttgtcgtcgcctaaagggttaaagactaagaatcatcatcaccacaaaggttgggggattgttatgaagcttgtgaagaaaggaatagaacatcatcaccaggagaaaagagattacgagacgggattttcttgtctcgtgcttgaagctatggaatctgagcttgggaagctcgttgtgatgatgacaagggaagatcaagaagaagagaaaaagattagtgaagaagtatctgagagggttcaatgtgcattggttagatccgaaggtgtagaggcagccatggaagagcttgaagagggacttgaaggattgttcaaggtaatgatacaagctagagtctctcttcttaacatcctctccacttaaaatggatcagattcgaatttcttggtctggattggaaataagttagttgctacttgaccagtcgattggttttaaaatcttggtttggtttttgtttgtttgttcttgtatgttgtgagagagagtttaaacatgcgtccatgttttagaggatgtgtgtttgttgtaagtgtgtaacccgttcaggtgtgaaaaactcttgtaaagttttatgtacgtaagcatctttattgcacaaataaaagaggtgtcttttaacaatattttaaaaaatttaaacaacaaaatattaatagttaaatatgaaaggtctttaattttaagacatctttttcaaaaatgtttccacaaagacacttaagacacagtgtctaaaatttaaggacacacaaacattataatgttatatacttttatatatattaattttattcgtgggaagaccctctctaatgatgtgggatggagatgacctaaatatctattattttaccacgtagaacgataaatttaaggagagaaagacgaaatgcaaaagcactaactttaatgtttagaataggataaattactgaatagtattattttttcgtaagaaaagcaatttagctatatagcatagcgttgaagtaaataattaatcaaatgtcacaattttctcaaaatgaaaaaccaaaaagaaatgggctaaaattaaagaggcaaaagtaatcatattaaaatgtcatccaaaaattacataaacaaacaaaatcatccattgatatcgagaatgtcatgaattttgctggtagacttttgacaaacctttcttagaattgataatgacaggaacttttgttaaatgacccaacttaacattttattttcttattttccttagaaaattagtcgataaatctttcactttcttttgaaataatgaaccattaaaaatagaattcagtggctaaaaatgggattgagagtgagcgccacatacggtggcagtacttcgaaagaatttatttgtcttagtttgattcacacaattctcacttaagtaggaaaccatattaaacactagtacttttacaatttagttggaggcgttaggacaaacgcaataacagcctgtaccaaaacataattctttgcattttggcgtacaaaaactaagctcattttgcttaatcgatagtggagcttcatgatgcacagatgcttcactagtggttagagattgaagattaggacaaacgcaataacaacttgtagcaaaacataactctttgcattctggcgtacaaaaaccaactccattttgtttaaccaatattgaagctttaagattcagagaagttttttcagataagagacgtttcgcctcagcaatctgaactgtcacggataccatcactacaagatataaatgtagtaaacattagtaacacaatacaattctttataaccatatcattatactacaaaaacattaattttaccagtaaaagctaaaaggatgatgaaagcagacttggatgaaaattttcccatcgtcgtagaaagattatgtttcttcttgataacttttttagacttactagaaagagttggtgaagaaaacgatgtgatatagacaatgttgtataacgttttttataggacagagaaagtgtactaatttaggaagattaatatcaaattgttgctttgtggtgaaaattaaaatgatatcgataatgagataagataagatcaaatctcctaatatggtcgacaatccaattgacaattgttacctaataagatttctactattaatgagaagatcttcaaattattcgctgtattgataaaagtttttaaaaagttagtttgactcaaaagaagcccattaccaaagcccatctaagcccattatgtaatcaatcaacaagccacggtgttgcttaggatgctgctcgttgggtttttggcaacgtgtgtaagatacaacggctatattttgacatggtccaagtccagctatcataagtcggtgtgttcttgtgggacctctaaaagagcgttactttcctaatttcagcggaccgttacatacacactcgcacacactagccttcgtcttcttctacatctctttcttcttctgtgtcagagacgctgtggtgaaaagaaaatgacggcggccgaagtagcttctgcgcagaccaagaagctcatgaagtttagtctttctctcttccgtcgtggctttaactcctctaaatggtactcaattttatttgatttgatgcttcttagattcctaaattcactcaatctgctacactgcgaagaaaaatcttgtattgaatgttttttccgtgtttgattttgggaagttggaaaaagttaggtttttttagtgtgttgatgcttcttagttctgggtattctcagtttcttaattttgtagaaaaaaacaaaaactttgatctgtgtttgagaaatttccgatctgggcttttctaagatgtaagtatctgattaaagtctgtttttttttcaatcggcaaaaagcaaaacggcggcgaagatg

SEQ ID NO: 19742 - DNA, 3003 bp, Unknown; identical to SEQ ID NO: 19741
  misc_feature (1)..( 3003): 2750-1469P.txt file - cDNA_ID_1823154; gDNA_ID_2926209; Annot_ID_141920

SEQ ID NO: 19743 - DNA, 3003 bp, Unknown
  misc_feature (1)..( 3003): 2750-1469P.txt file - cDNA_ID_1823186; gDNA_ID_1620687; Annot_ID_48479
ggtatgaaatgattttagagtctttattgtttcattctctttgaattaattcttgaaaggttttgtgtataatactgtttcttttgtaattctagataaatattttcattctatatatatttttttaaagtctatgtttacagagttgatattggtaaaaagtttgagaaagtttcatacaaaaagaggataatgatgtcgtttttcaaagattggtgaacatttgatggctctgagaagaatattttattgccaattgctattttcagatttaattatagtgggatttggacaaagtattatcttcatttcaatcatttagatcctgacaaaggtttccttttatgatcttacacattcatttttcctctgcattatttgcatgcactggaagttgtatgttttttgtttactattcattttgatgttgaatatttatataaatttatttgtactttttcacattgttgcagattaaaatggtgttaagaaataaaagttaatattaggtcctttaacaagatcttccttttcttcattgttgcaaaacattactaattcaaagaatcaacataatgtgttagataaatatatcaaatatgaaatatgaaaataataactatactatgtgttatagtaaattattaaatagtatgaaaaaatctttcacttgggtttgtcctcttcctcttcatcttttggtggagatttattaagatcgaacttggcaatacatccagattcagtcgcttcctctacttgctccacaggttccacattcaaatcaatacctgaacctctcccaccttcagatcctggcgcatcaccaccaccactgccagaaaaatcaccggaacttcttcctcctaccgctacaccaccagaacttcctcctccgacagtggcaatagtaaaagcagatcttagcccgggaatcacaaacctttcagcccccgcagagaatgtaggaggaggaagaaacccttgatagtttctatctctatgagccctcatatgcccaaacactgccttccacgaaccgaaacctcttccacagatatgacaaaccggtggtcctttcggtggatgagtcaattcctttgctttcttcttcggctttttcgcttctccttcacccaaaccatccccttcgtcatcggtttgcgtagatatccttggtctactctttttcttcccaccactcccacttccctcattcattcctttcataaccgcttcctctgccgcagccaaaatcaaccccgccgcaagaaccgcttgctcattcaaacgcgctttttctgcatcttcctcaacgacactactactctctccaaatattctactgctgatattcaaagcagggaggccgagaacaatttctctcatattggtttcttcatcgctccattgctcatcagattcctctttctcttcctcagtaacatccactttcgttttctctgggttcggattactcatactattttcgcactttagtctagggattgatgtttcaaaacgacattgaattagcccttatataaagttttctctgaaccatggcggttatgacagttaattcctctcccgccttttcgtttgaagatttgcatccgtcgtttgtgattggtccgtcctaaactctgatattacgtaaatttgggcttaatatcgtataaagcccattactagcccataagttattcgtacttggtaggttggttcaagagtttttcttgttttctgtttgtaatcgtttctcgtgcgtttttggtcatcgagattgcaagagtcgttgcaactgcactaatactattatgcatgtgacatccgacaatgacgtgacttgtaaacttttgttttgacatattttttctttatttattattacaataacattatcattttttttttttgggtggaaacattatcatttttattagccattctttatttattctatatgtttttactatttaaaatttaaacattgatgtataccggtaaacatagttttcaatgtcagaaggaagctcttgaagctatgtaataaatcacaaatacaacaaattgcaacaccaaaaaaaactaatgtaaccattgatgtgtgatatatgatatagcgaagccgcaactgtcttaaatattattttgaataatatctacacactagactctaactaaacgtttaacagttttctaaaaatgcagatataaaaagttatctaaaatatttcacatatttgaataagaaattagaaacacaatcaccttttgaccattctaaggaaattcaattacaataactatgaccagaatcatctagcctaatttttgatattctctaaattaaatatttttaaaaagcttgaccaaaaaaaaagaaatggcaagaacacttactacagagtcagcataattctcggtaacaataattcttaggaaagagagcaattcttagctctgtagtaaaacacagattaataagctaagattaagattaaagaatcaatatgttgactttaagatcttagagccgcgccttacggaggctctggctagtggtaacgagccttctttgtctgaaaaaggcaacaaaaaaaacacaaaaaaggaataataaatttgaaatgagaaagagagagccaccacacacaccacatggccaaaaaagttaccgttgggtttagacagacttagaaacaaatcgtttccttcatgatccaacggtcatcttaatcacctagccgttgctatttccttcaataataaaaaaaaataaaataaaaaaaggtagcaactttaattttaattgatttgatttaatttctctctctcgcttatttcatccccttctctgactcctactgattcattcaattgcatcagacgtatacacagagtcacagagagaagagagatccttcttcgtttgatgctcttcttcttcttctagattcttctccaggagcactatcaaatcgagtaaaataaacaatg

SEQ ID NO: 19744 - DNA, 3003 bp, Unknown; identical to SEQ ID NO: 19743
  misc_feature (1)..( 3003): 2750-1469P.txt file - cDNA_ID_1823186; gDNA_ID_1620687; Annot_ID_164653

SEQ ID NO: 19745 - DNA, 3003 bp, Unknown; identical to SEQ ID NO: 19743
  misc_feature (1)..( 3003): 2750-1469P.txt file - cDNA_ID_1823186; gDNA_ID_2926209; Annot_ID_141910

SEQ ID NO: 19746 - DNA, 3003 bp, Unknown; identical to SEQ ID NO: 19743
  misc_feature (1)..( 3003): 2750-1469P.txt file - cDNA_ID_1823186; gDNA_ID_2926209; Annot_ID_202493

SEQ ID NO: 19747 - DNA, 3003 bp, Unknown
  misc_feature (1)..( 3003): 2750-1469P.txt file - cDNA_ID_1823222; gDNA_ID_1971819; Annot_ID_58295
cttcttgtgaatctgtaatgttccttttcgttctttctcagtcagctggaaaatgaagcgaagcaaatgatgcagaccagcctatttgtagccagtgttcttggttttggacctctttcttctttttctttttgtttctacacataaattttattttaggtttgtcttgtgacattactcgcagcagtcgcagcctttgtacaaaaactaaacaaaaagcctttttgggatattgtagtacccttttgtcgttgtctcttctttgttttacatgcatctctggacaatgtagatattgagagtaaatcagaagtcaacgttcgtgtattaatttttaacatttctatttcagtgaacatactctttttaaagcttactcttattaccaagtagcaacacaacttggtcaaagactcaaaagtacatgaaatcatcatacaatccaacacttgagaacaagtggcacatacacagaaactaatatgggacgttattgggcaagtttcttatgacattactcttcactccgatcttggtacgcattgtctcgcctctcttgctcatctccttgcgcactttcatcctcaaagtctcctctttcgacggtactgtcttcagacccaggctcttgtacctgagaatttaccatttgttggaataaccttagtttaccttgccgattatctgattggatagactcggatgattaacgggtttggagaaaacaaaccttgaagataaagaggcaattatctggttgctgtcttgagaagttgggcgtggcttctgtctgtagtaacgcatgaattcacgggacccgagagttttagacgttgttgtgttctcggacttctccgtgatcaagagctcagaaccaccaacgagttctacagtattgtctgtttcaccagatacaacaatttgctttccagcttcatcaacatagctgctcaattcatatattccaaagaaaggtgcggattaagatttggcatagaacgaggaatacaggcgagaacaagaataatcagagatagaagagagttgaaacctgctgctgtagtcataaaactcttctagctcagcatcttcttcatcatcaccatcaccataatgcagtttgcaatgactctttgcttccatatgttttcttacagcttctaagctgctgaatggacggcacagctcattgcagtacagacacatgaagtctctcttgacctaaatgatgagcaatgtataagtaaacaggagtaagaatttcaaagcttgacaacaacgaacactgaatggtaaattgatgagtccaaaccttaagaccaaggtaagtgagaagcccttcaggatccttgagatactcaatatcgggaataaagaaaccatgatgcttatgcatgtgaagcatacagctctctaaggtcttatgttttttgtcacacatcaaacagcaggttggatccagctcatacttatctgcatcaccatcatcatccatatcttcagcagatccagactcattcacattcaacttagacaaagaatcagaggcttcttcagcagccaattcctcgtcagaatcaacctccacccattcatcttcactatcatcatcaatggaacccctgtgttgaacacggcgaggaagttgcctgataatcgctatatcctcctctccgttgattgatgtcccttgtgaaacccgcaaaacatggctacgcgactgaagatgctgctcatgagccttggaactcctgtaacctttagcacagattgcacaagtataaagcataggtgcttcatttgatttattcttctcctgagcaagagcagattgtctagcctcaaacaaggcttctgtaactccaggaactccagccacctaacataaaaaattacagaaatacaaagattcaaatgcctagaagtaaccaaatctatgattattgaaatccttgttccttagtagaataagcttcaaaacaaattttcatataaactctacgattccataaccttaactaaacaatttcgatagcaaaatggaaaagctgtttctcagaaactttcatctcatcaccgacgcaagattttcccgagaaacagataggcttgagttcaaattcgatagagaaagcagaagaaatgaaaccttgcgcttgagattgtagcggtgccaatcggatttgtaatgaaggttacgttcttcttcgtccttgaactccatgttacacgcgttacatgttaaaccaggcatcttctctccttcaatatcgatcgattctagaaatggaaactggagaagaaaagaaaatcagagaaaagatagttgggaggataagatttgttgttgatatgtgtagagcaacgacggctcgtaaatggatcggcgatcgtgtttgtctctaaaaaagcgtcgattgatgatgattgattgccatcaaaatgaaaaggaaggcgccccgcccattttagatccgatcgggttggaactgacccgttcctgacccgatacaagagtagcccatttggcccattcttttagcctttttgtaacactgacacagttgacgaattaagtattactgtatgagtaaccaaaaaacatttttctaatattgtttttaaaataactacttacaacttgattaattacttcgtttaatcatgtaacttttttttcttccaaattctaatctctctattaaattactgcatttataagatctaaacatcatgtgatatgttcaaaatatgaaaagagaagaatataatacatgattttactacgattaattttttttaatcgcaatgttttgtttttgcctaattttattagtggaagaaattttaaccgcaggcctgtaatttaggaaactaactattcacccccaattaaaaaaaaaaacaagaagacgacaaataacgagaaattaccaatttttcctcaacactttcattatttcctacaacgaacttctccctcctcctctcactttcaccatg

SEQ ID NO: 19748 - DNA, 3003 bp, Unknown; identical to SEQ ID NO: 19747
  misc_feature (1)..( 3003): 2750-1469P.txt file - cDNA_ID_1823222; gDNA_ID_2926200; Annot_ID_141454

SEQ ID NO: 19749 - DNA, 3000 bp, Unknown; identical to SEQ ID NO: 8585
  misc_feature (1)..( 3000): 2750-1469P.txt file - cDNA_ID_1823226; gDNA_ID_1971819; Annot_ID_58294

SEQ ID NO: 19750 - DNA, 3000 bp, Unknown; identical to SEQ ID NO: 8585
  misc_feature (1)..( 3000): 2750-1469P.txt file - cDNA_ID_1823226; gDNA_ID_2926200; Annot_ID_141453

SEQ ID NO: 19751 - DNA, 3003 bp, Unknown
  misc_feature (1)..( 3003): 2750-1469P.txt file - cDNA_ID_1823237; gDNA_ID_1971819; Annot_ID_58291
ggatgaggaggaaaattctcgtccatcttccaagcagcgaggttgtgtcttcgtacggatcacttgagaagatcttgaagaatcttgggtgggagaggtactacagtggagacaataccgatcatctgctccagttccacaagagaacttcgatcgatctcatctctctccctcgtgacttctccaagtttaactctattcacatgtatgatatcgtcgtcaagaaccctaacgtcttccatgtccgtgacatgtagtagtcaatcatccaaaacaatggttcaatatcattctccgatcatcgccgctggtgatatatctatcatgtatatatatatgcaggtttttattttgtcgttgggtgtttttgtttttggtttattttgtttttaatgcatttaatgtacgtgttttccgttcgacgtcgatcgattggggtgggttcaagctagagccattctaataacttttatcattttgtgattttaatgaaattgtatcatgttgtcaagttctcttattatggagtggatcaaaaaatatatacagtacatcaaatttcgaatgttatatgatgaaatatcataatttggtctatgatttgcatttaaataatatgatgcgtggaatttatgtaaataatttaatcaaatatactcatggaatgcaaatatacctaacatgtgaagaaaatttgttctgtcaaaaattactattatatacagcttaattagcaatttaaacaaaaactactatatatacaagggccgatagattatacaaattttcatgaaaataaaaaataaatgtgttgtttttaaaaccccaataattatcacaaataaaaactacagttgcgtttttgtattttttcaaacaacagtctactagacgtaatttttttgataataatacataacttcaattgattgatcatccatcacatatttgagtatcgatgaagtaacatgggagattaataagttagaaactttaaagtcataatcatattatctaatcgtttaagtttttttttttttgaaaccgtctggctaaaaaaacagatatgtatacaaattaaaaccatatagatagatagatatagggtaaagatactggaatacaaatgatcaattttcaagtacgaccaaaatctaaagaaggaaagtcaaaaggtgtccaattagagaagggcccccaaatgtttgggaaagacaacggataaaatgatgggcgcacgtgacattcgctacttttttacccaactttcacacgtgtcgattccctattgctcattttcccactttgtcatagattcatatgatgggcgcacgtgacacataaaatactttttaagacgcaatgtgtgggcacgtgtcgattccccattgcccattacccccacttcgtcacttccttatcgatgtcgaacaaaactttctttttcccaaataaattcgcaccatattcgggacctctttttttttttttttttttgggattttattatatagtttgtatgattttggttttctttttcttttactcgcattatgggtctaagattctggagtgcttgatttctcaagtaatatgcaggtttaatttctgcccaaagattttcagatatccgatagtccaaaatcgtttatattggtttactaagttttctttaaacattcgatattagtaaagagacgtgactaagattttggctatatcaatagaaaatgaaaaagaagttttgggcctataaacgctgactatacacacatgcttctattagagtggttcttattgtaaattggagtatcaaactatgtagattgtgtctgtcgaagctcgcaagggttagaaaaatgattgtctcgtccagataaaagcattttcttacacaagacacgaaaatgtttgcgatcaaaacttcaaatgattaagcattttataatttaatttggataacggatacatttttccaggcaaaggtaacgattatgtttggaaaatctgaatcaagatgacatcatcgtgaacataattacattttaagacggagcagaacaacgagacaaactacgaatacattgaaaaaacatatgcagatcctgctgatttatgacaagaaattaactagtttttataatcacacatggaagtactatgactactacttctacatcatttttatagtaaaagtaggagatcaaattacatgagatggtaatggatcaaagcttaccaagttaacatgcatgaagtgatttatacgtgctattgagtatcagccatactcccgtttaaagtccagtaagctacctagcgttttatgcctcaattttgtgaaagttttatggcgtgatacttctacataatacgatgcaaaagagaattaacaatgtttgtgataaagtgtagctctagccatgaagaaaaactcatgaatggaagcaaagtaaagaagtcctgctaagtaatcgtttttttaggacaagagattcattaccatctcatgtcgccacccacactttgtaattgtagtggatcggatggtataacaactaagaatacgaacctatatataaaacgtatgttttcattagtgtattgttataaaacttatacatagatttgagtattcaattaccacacgaatatgtattgtttagttgcgaacaacgttgcacctttcgtggccacacaagactttccccgatcgcagcttcttctctgcttggcgccaaatactatcacgtatcttaacaaaccaacaaaaaaaaactgcgggatgtagaaagaaacaacaaaaagttttgggtcgatttgctacagaattacatttattgtggtctttttgaagataaagttcttttagttcttgtggttggtagtcaatttatttcattttcggaaattaatatttattttagttttttcgtccaacgtaaacgtatccactctttcgcttcttctttcttctgatcatcctcccgtagctgattcatg

SEQ ID NO: 19752 - DNA, 3003 bp, Unknown; identical to SEQ ID NO: 19751
  misc_feature (1)..( 3003): 2750-1469P.txt file - cDNA_ID_1823237; gDNA_ID_2926199; Annot_ID_141450

SEQ ID NO: 19753 - DNA, 3003 bp, Unknown
  misc_feature (1)..( 3003): 2750-1469P.txt file - cDNA_ID_1823245; gDNA_ID_1971819; Annot_ID_58288
tacccacggcttaaaaaagtctttacacagagacttgaggttcaatataaccaattctttagacaaaagattggattgggttatgtttggtggatggtaaatggtacccacggcttcaaactttagtctttagattgagacttgagactgaacattgatccttcttggtaccctcggcttgaaaatatctagacatatggatcatgttcggtttcttgtttcactttttagacaatgatcaagttactcacggcttaaaacagtctttagacagagacatggggttcgaagtaaccaatcctttaaacaaaaaattggattgggttatgtttggtggaaagaagatggtacccacggcttccaacttagtctttagactgagactagagactgaacattgatccttcttggtaccctcggcttgaaaatatctagacatatggatcatgttcggtttcttgtgtcagtttttagacaaaaatcatattacccacggcttaaaaaagtctttacacagagacttgaggttcaaaataaccaattctttagacaaaagattggattggcttatgtttggtggaaggaagatggtacccacggcttcaaactttggtattaagattaagacttgagagtgaacattgatccttcttgttagccacgactttaaaatctctagacatatggatcatgttcggtttcttgtttcagtctttagacaaagatcaagttacccacggcttaagaaagtcttaagacagagacttgaggttcgaagtaaccaatcctttagacaaaagattggattgggttatgtttggtgcacggaaaatggtacccacggcttcaaacttagtctgagacttgagattcgacattgatccttcttggtacacacggcttgaaaatcactagacaaatggatcatgttcagtttcttgtttcaatctttagataaagaaacactcacggcttaaaacattataagtcattagacagagacttataattttaaacaatggaaatttggataataaacttacaagacgatgttaaactaaccggattttggatcccatcattgatcgttagcgattccaaaaattcagcttgtcttcccatcgttaagtagatttataatacaagtttctgttgatccttcttggtaccctcgacttgaaactcactacacatatggatcatgttcggtgtcttgtttcaatctttagacaaaagaatacccacggcttaaaacattatgtctttagacagagactcgaggttcgaaagtaaccaatcttttgtcaaaaagattggatttggttatgtttggtgcaaggaaaatggtacccacggctttaaactttagtctttcgagtgaactgaaacttgagattccaacattgattcttttggtacccacggcttgaatatctttagacatatggatcatgttcggtctcttgtgtcagtctttagacaaagatcaagttacccacggcttaaaatagtcagagacttgaggttcgaagtaaccaatcctttagacaaaagattggattggattggcttatgttttggttgatgaaaaatggtacccacgacttcaaactttagattgagacttgagattagaacattgatccttctttggtacccacagttcaaaaatctctagacatatggatcatgttcggtttcttgtttcagtgtttagacagagttggataataatggacgatgttgggttatgtttggataataaatttacaagaccagattttaaacaatggaaatttggataataaatttacaagacgatgttgaataaccggttttggatcccgtcattgatagttagcgattccacaaattcaacttgtttttacatcgttatgtagatttagaatacaagtttgtgttgaaaaaaaatatatacaagtttcttatttttttagaaaagattcccaaatttttccatacgtttagcatgctaccaaccttgtaagagggttcgtcgttgtgtgagattagtgtaatttgttatgggatcaggatcaaccaatcaagatttcaccaacttgctaatatgtgaaagacagacaaatagagtaacagtgaagactgaagatgatggttgtgatgtgatgaacaagttctaaaatatttaggtccaaaagatcttcccatggagcttggttgtgaaagtgctaactgagatttctccaacatgcacacattgttgcaaaagcttccccctgcattttattatacaaacaaacaaacaaaaatgtcaccataatggatgaatgtttgttcaccatgagtatgcgacttattaacatattacattttagcattactacatccaaatacttcaactatcatcatatattggaaatttggattgatggcttgagtcataaaaacctacaaaaggattggacgatacttttagtaaaatctcttaaaattgtccgcagtgaccaaaatgctaaaaagctagaaggatatacagacttttatcttactttatgtatcagaaaatcaatatttcttaataaatatgataaagtgtttcagtttattttgagtttagaaaaagccaaatgaattggaatcaaaataatgtaggtaaaaaagagaagtggaattaaaataaaatcattctatccaatcaaaacggtaagtagttgtgcgttttagaggcaaaacaccacagcgtttcgaagcacgtggatgtgtcgtgtgatacagcagtagcgcactattgggcattgagaatacataatcataacccctgcaatctaacggtcaaccttttaataacccttgtaggttaaatctctaccgtttattcgaattacttttccaaggtaagaaaaaagcaaacacaaaagggaatatcaaacaacaaaaaagtaagaaagagcggtaagacagagacggagaagaaggagaagaagattgttaagacgaaaccctgttgctgtccgtacaatg

SEQ ID NO: 19754 - DNA, 3003 bp, Unknown; identical to SEQ ID NO: 19753
  misc_feature (1)..( 3003): 2750-1469P.txt file - cDNA_ID_1823245; gDNA_ID_2926199; Annot_ID_141447

SEQ ID NO: 19755 - DNA, 3003 bp, Unknown; identical to SEQ ID NO: 16662
  misc_feature (1)..( 3003): 2750-1469P.txt file - cDNA_ID_1823252; gDNA_ID_1971819; Annot_ID_58286

SEQ ID NO: 19756 - DNA, 3003 bp, Unknown; identical to SEQ ID NO: 16662
  misc_feature (1)..( 3003): 2750-1469P.txt file - cDNA_ID_1823252; gDNA_ID_2926199; Annot_ID_141445

SEQ ID NO: 19757 - DNA, 3003 bp, Unknown
  misc_feature (1)..( 3003): 2750-1469P.txt file - cDNA_ID_1823257; gDNA_ID_1971819; Annot_ID_58283
aaatcaggtcttttttttaataataataacaaagtaagtttgttttctgagtagagaagtgtaatctttgtgtgtttcgaactttgttgtcttgtgtgttgtcctaacgagtgcctacttgtgcaccttttgaagaagattaaagctaaaacaaagtttataaactaacgtaagatcgaacaacatacgtcacatttcaacaaaatgcaaaaccttagagaaaacttgataacattcctaattccttcaccgtgggagcaaataactgaaatgtgtatcgagcttgtatttggaagatccatggacaagtaggtattgggcttgtatttggaagggccatgaggacaaatatgtattgggcttttatttggaaggtccatgaggacaaatagatattgggctttcacgttttttatctgtcgcctaacaaaacaaaaaaaaaaagtaaaaccaaaaaaaagaaaggagagaggccgacttggggtataagccagagttcttcttctttttcaagcttcttcttctcatcagtcatcaccggaatctaatttatactcgcaaaactcagcgattcgtttcgtttctgacaagtttccaattctacagcaatggatctcaatctcgatgcacctcactccatgggaacgaccatcatcggcgtcacttacaatggaggtgtcgtcctcggagccgactcacgtaccagcaccggtgagatttccccccttctctacttttctagggttttagttcctcttcgttgggtttgtatttgagttttgttttcgtttcaatcggaacaaagaataatcctaatcgattgttctatttgggtaatttagagaaagctgttaaatttgggatctgttgtaaattactcgcgcaggtatgtacgtagcgaatcgagcttctgataagattacacaactgacagataatgtctacgtctgccgctctggatcggtaataatctctcttagggatttcatttttgtttttgtttgacctgttctgctgtggaaactgtttagcttgctagacttcttattgaatctcttttgcttactgggtttcttactcgaatgtttgttgttcttgatttacttgcaaatgggatattgattacaacaagctctcttcttgttccttttgcaggctgctgattctcaagttgtatctgactatgtccgctacttccttcaccagcatacgtgagtgtcttgattgacgaagctgcatgacttgatacttatgctatcttatatatccggatgatttaataattcgttttcttatgatttgcagaattcagcatggacaacccgcaactgttaaggtttctgccaaccttatcaggatgctcgcatataataacaaggtacaagtttgcttttaagcttgccgtttggtttggttgttttaccagcaatttagactaagagtagtgaggaatgtggatgttgttccattttcttgtagagaaaacatacccatactcgactcaatcacggataacttttgtttggaagtttgaccctgggaaatatgacagtttgcttatgtttttattgctttattatgactaaagctgaaaattttggggcatagagattgatgttacatgtcaaacctaggatgctagtatttatgaatctcttgttgttcgtagtgttactgttatggttgttctctagtctaaagtacgaacactattaatggaaatgtagaaagtctctgttgtaatgctactgtatgtagtgctcaagaagtatctcagttttctatactccaaatcatatccagtttgttattgtatggtgattccttgttttgattacatggattgttaactgaaacattgtatgtctttgttgagcagaacatgctccaaactggtctcatcgttggaggatgggataaatatgagggtgggaagatctacgggatcccactcggtggaactgtagtcgagcaaccgtttgccattggaggtaaaaactatattgttatgagtcttatgatatttaggttttaacaaagatgtattcgattaattggtctttgctatttactaacttgaatggtccctttgcttctgttaacaactaatggaattgtgtgtgtttgtgtaggctctggttcgagctatctctacgggttcttcgaccaggcttggaaagataacatgaccaaagaagaagcagaggtaacgcggttcacatcactgtatctgcatatgcaaaaatctcacaaaccccatttgtataactggtcgttgctattgtatttacgcttgtgtatttatattgcagcaacttgttgtgaaggcggtttcactagccatcgcccgtgatggagccagtggtggtgtcgtacggactgtcatagtaagatctttctctgaccagaagctcgctgaagcgaaacttatgtaacctccttaatggtacttaattggcaaactgtttttgatgtttttgaacagatcaactcagagggagtgacgagaaacttttaccctggagataagttgcagctttggcacgaagaattggagccccaaaactcactcttagacattctgaacgctgctggtcctgaaccaatggccatgtgatctgcaaacaacgatcattatcttactctgttgggcaaacattttagatatttcattacagtttccagtgtctttaagactttaaactctgtttgaggttctgttgtaatgaatgacccgatctttctgttttaaacggatatcgtgtttcttatggctatggttttaattcctctgttctcgaatcgatccagtagaaatgttagccatcttctccgaaattgattttcagttcttttttagtgaccaagagtttatggtgaaaaaacatcgttcaaaatagtaatcacaaccttttatatgcttgacacgtggcgggacaagggacacttgaacttctactcagtcgcaggaactggacggagtaggagagacaaagaaggatg

SEQ ID NO: 19758 - DNA, 3003 bp, Unknown; identical to SEQ ID NO: 19757
  misc_feature (1)..( 3003): 2750-1469P.txt file - cDNA_ID_1823257; gDNA_ID_1971819; Annot_ID_176077

SEQ ID NO: 19759 - DNA, 3003 bp, Unknown; identical to SEQ ID NO: 19757
  misc_feature (1)..( 3003): 2750-1469P.txt file - cDNA_ID_1823257; gDNA_ID_2926199; Annot_ID_141442

SEQ ID NO: 19760 - DNA, 3003 bp, Unknown; identical to SEQ ID NO: 19757
  misc_feature (1)..( 3003): 2750-1469P.txt file - cDNA_ID_1823257; gDNA_ID_2926199; Annot_ID_201729

SEQ ID NO: 19761 - DNA, 3003 bp, Unknown
  misc_feature (1)..( 3003): 2750-1469P.txt file - cDNA_ID_1823261; gDNA_ID_1971819; Annot_ID_58281
aagagcaatataatcatagtgtagctcacggtagcaaagtgttctacatatatttcaactataactacaccgacaattttcgtcattctgtatcttgaagaagtgaataagtctgtctatgcactatttgttcttaagattccttaaaggcctagtttcatttagtaatggggcaagaaaaggatagtgtatagtgtacctaattcagcagagagatcaacaacgtcttgcgcttcagggtcactatcagattcagtcccagctttttcatcttggatcatcacaaccgcattgatggcttcaaaaagctcgatatcgatatcccccgggagattaagtaacttcctcttgtcactactcagggaccaataggaacgaccagtgcctcggtactgagattcccacttcttgatctgattgtaatcagacatcaaagaatcccatttcctcctgcattggtttagatttctgctaacatccaaagcgttgcagttctctgtgatcattgtccatttctggaagctagataaagcattcgaacaatcggcttcaaccgcagcgatctcattcacgaggactagacaatctttgactgcccattctggagcaacttgagaccgtgttctccgtgaacctgaagttccttcctccatccaaaaaggcttaaactgcaatttggtttaccaacctcgttaatatcatcatcatcagtaaagacattacaacataactgtgatttgaaactctaataaaacctattgtcaatgaacaataaccaaagaggtgcatcttcatgtttctgagttttgtataaatctgagaatggtaagcgatattgaaattcaggaactaaagtacacagataaactccacaaaaaatgcagctagatttttcaacattgaagaataataactcggtaccaaacaaatcagatacaaaattcaaacaagaatccagacgaacacgactggagaattccaaactggagaaagaagaaagaagaaagaagacaactttgagcataaaaaattaccagatcgccggaaactgcttctggaaaacgacacgtcgacgccaggcaagtcactttgaagtttgctccaagacgatgaggaaccgagtgaagccgaagcaaattttattgatgttatctgtcaacaggcccaaacgtttttttattgaattcggcccaaacctattttttttgtttaaatggcccaaactataattagatattgattttgaagagaaaaataatttgttgttctttgtcaaattaatagtataaatttttagacaaaaatctttactatgagtcaagcgaacccactttaacatgtagtattttactgaacatttccaaattacaagacctcatcatccaatatagaatacactcactcgcctgatgagtgatccaatcctcaaaaagcatagtaacaattataataatgcatttattccaatttgatatttgaaataaacaaagatatttttgtggagattcatctagtttttgctttctagaaatattttttatggtataattcgagaagaagcgattagtcgtgggaaacatttgatagtttagtcttatttttatgtaccagtgacgtcggtgatggcaatgtatgtatatggctttgtgtaacaaatacattctgacgtttgtgtttttgtgactgtgtctttgtttgcctcaaaattcaaattttaacactttttaaataagccaataaaaaaaaaaaggaaaacacttttttgtctttagctaccaaggtagacaaattatttgaaacttggaatattttaggaatgtgtttggcttcaaaaatagtgagatgaacaaataaattctagattttggatatatgagtttccataagaaacaaaacaaatatttcaatttatgaattagattaaaaatttcttaacatgagataccttgtttagagaacaaagatatttcttttagaaacaagcgtcttcaccggccagtcacgtgacgaatggaaaacggaacagacaaaaaatctgcagaacacaaaaaaaaaaaaaaaacatgcgtggcatgaacaatacggttcggtctccatctctctctctataaatgctcttcttcccacacatcgcctcctcctcattaagatacatctcgagaagcagagcagagagaaagagattccgagagagagagagaaggagggagagaaggagcttagtggtctcattaccattaccagctccatacgaaccgaaacgacgccgttcgctcaacccttttctctgcaatctctcttcctcccacgagtttctcagcttttctcggatcatctaattaagagaggagatcttgtctcacggtgggattgatttttctcttcacgaagatcgtgttccagggtaaagttttgatttttattcatcttactcattttggttaaagtagcttctgttctcagcgattttctctgtctcgtgtttatgtttattgtagttcaggaaatgttcttactgttctgtttgattatatgattattgcaccaaatctggctagaaaaagtcaatacctttttcccttctttctagaatttgggaacactgtttactagatttttgtctttgttccaaaagtttgttcattcatgtcatttacgggttataactgcaccaccattgctatggaacgcataacctacctagaaaatcttccttgcttttcaaaataaagaaagggagaagatttgattcttttatgaactctgagctgtcctgaagagaacccaatatttgagcttatctgtttacatttaaagaggaagtgacaatagaaacgctggtccatcgtgatttgtcttacttgtttagctcttgtcttgtctttactacatggtgcctttttctggcatttaccatccacaaaatcatgatttgtgtctaaatcttagattttgtctttttttttgtgtgtgtgtatgtacagcaattaactgcagaaaatg

SEQ ID NO: 19762 - DNA, 3003 bp, Unknown; identical to SEQ ID NO: 19761
  misc_feature (1)..( 3003): 2750-1469P.txt file - cDNA_ID_1823261; gDNA_ID_2926199; Annot_ID_141440

SEQ ID NO: 19763 - DNA, 3000 bp, Unknown; identical to SEQ ID NO: 8576
  misc_feature (1)..( 3000): 2750-1469P.txt file - cDNA_ID_1823269; gDNA_ID_1971819; Annot_ID_58279

SEQ ID NO: 19764 - DNA, 3000 bp, Unknown; identical to SEQ ID NO: 8576
  misc_feature (1)..( 3000): 2750-1469P.txt file - cDNA_ID_1823269; gDNA_ID_2926199; Annot_ID_141438

SEQ ID NO: 19765 - DNA, 3000 bp, Unknown; identical to SEQ ID NO: 8567
  misc_feature (1)..( 3000): 2750-1469P.txt file - cDNA_ID_1823275; gDNA_ID_1971819; Annot_ID_58277

SEQ ID NO: 19766 - DNA, 3000 bp, Unknown; identical to SEQ ID NO: 8567
  misc_feature (1)..( 3000): 2750-1469P.txt file - cDNA_ID_1823275; gDNA_ID_2926199; Annot_ID_141436

SEQ ID NO: 19767 - DNA, 3003 bp, Unknown
  misc_feature (1)..( 3003): 2750-1469P.txt file - cDNA_ID_1823290; gDNA_ID_1971819; Annot_ID_58273
aaacagactgaactagccattaaaagatgagaactggagaatctcatctggttgtagctcttgcactcatggatgtgtgataattcgtacttctgtgtttcctgtaagatgtataaacatcatcgtactgagttggttcgttgggatcagctgttgccccaagtcccaatctcccagatccactctttttatcggtgcttccatccgcatatgttcctgtctcggggtccacctgtagattgggaggtggaggaatgcaggcacctcctttccgctgtggactatcccgctcataattatcatagtcgtcctgtgattcagatcccatgggaccttcacttgggttgacctcacctatctctttgaagaacttagatactctctcgagtacttcagattgaggcgtatcagaaggtggtatgaccgttgggatatcaagagggctcaatggagagtaaggcacaccactaccaatctgcatctttctgaccatcccagggatcaaaccaggaggaaagagaggataaggaggcggcttctcaccagcaggtggttgggttggtggtggaacagaagcgttaagcggtatggaaccgggaaaggcaccaggaggcatcacatttgggataaattgttgggttgcgaccggattagtcagatgctctaaattcattgtgctagagacattactgtttggtggctgttgcagcattcctgtaagttcataaagataaaaagttgttggtatattgtcaagtctaaaccgaattcttcttatacataggtggagttatagtttctgtctttctcacggaagagcaggagtacctggacgttgtaaggcatgtgctgctataatgggagaatgagaaaaggtatttgcaggtggtccacttttcatctctttctcaagagaggagatggtgtcttgatcaaaaacctccttagaagcccaaaactgcaaaatcttctccaaacgtgactggttttcttccttgttttgtggaaagtggtaaatcctccccagcatggaacccaaaataggtctgaaagcaagagcttcattgtcaaactcgtgcaagtttgtccttcgttgtaaactgtatttaaggaagcaataaacatgagaaaatattagggcagaagaatctaatgttgcaacccaaaattttgaaagcacagactgagactcctaataatatagaatgaacgaaaaactagtctatgccgaagtcctctagaatgatgtaaagagcgatcagggatgaagtttagatacctgtcgaagagaatgtcattagctagataaactatgtgcatctgcctatcagaatcatccattgcaaagaccctgtctctaagtgcctctgctaaagctggtgcaaagggagatctctgcatgaaccaaatcttagcacttttaatagactctttcgtgccattaaggttgcccaagacaccatttagttccattgcaacatcagcagggagtggaccagaaagacctcggaacgcatgagttgactgatcaaaatcaggacgagcatggggcgcaaaaggatgaggctgcggaagatgctgttggagctggtggtggtcatggaatggtgggaaaggaggttggcggattggtggcacagccaatgcaccaggtacattgttcattgaaggactcatcatgggatttggcggatgatgtatcataggcattgaagatgacgggaatggaggatcaaagggtcctccagggggatgcatagagagaaagtgcttatagcggtaataaccatgaccttcacccccaaacagaaacgcataatcaggattatccttctgtctatctcgcatcatagcctcaaactcaggaccgttcttaaccgaatactcaacaagcttatcaatccgtttctgcagctctggatcagctggaggaggaggaggaggagcagaatcatacggtccagggaatggcggaggaaggtgatgtggaggtaagtgaggaaggaaagcctgaggttgctgttgaccaaacatctgtgggtgaggaggatgaggaagatgctgcggttgctgctgctgatgcataggatgctggtaagggaactgctgcatagaaggatgaggaggaatgaaaccagaagcattcattggtgatggatactgaggatgttgcggatgaaatccgaattgtggttgttgttgctgttgaaagttaggaccttgttgctgctgttgctgagcataaggtaacccagaagaagcagcataatcgtgctgtcttcgatccatgtatataaactctgtaacacttgtgttgtatagattcagctaagtgttcctgagaagattgtaaaaacaaaagctttcgaaattgggccatataattcaatacgagagaagtaattcccagaaggtaatcaatatctacgcaaagagaaacaccgaaactatacacagtgtaaattgaagagtttaacaaaaaagcgacatcgcttaagaatctgactacacgaccctaacagcaagaaaatcgagagagcgagacacaatacctagttcaatcacttactaacaaagaagaacgcaactttctgagaagaaaatagttgaatcggatggagcagaagctaaacgcacctgaagaagaaggactgaaggagagacctttactctgctgctaggatccggaagttttaattgggccacgaaaaaccgacccaaaagttttaattgggccacgaaaacccgacccgaaatctattttgactaataagagttgaccgggtaatttggcggatctacttgatcctgatttatacccgacccgagttagaaggcactaagcagataaaccccagagactgagtaaacccttaagaatttctttaccagacatctccgccattaacaagatctctcttcttctactcgatttatgataagctacggattcactcgtcggatgatttgaaagtttctgaatcaaacagagtattctcaatg

SEQ ID NO: 19768 - DNA, 3003 bp, Unknown; identical to SEQ ID NO: 19767
  misc_feature (1)..( 3003): 2750-1469P.txt file - cDNA_ID_1823290; gDNA_ID_2926199; Annot_ID_141432

SEQ ID NO: 19769 - DNA, 3000 bp, Unknown; identical to SEQ ID NO: 8565
  misc_feature (1)..( 3000): 2750-1469P.txt file - cDNA_ID_1823294; gDNA_ID_1971819; Annot_ID_58272

SEQ ID NO: 19770 - DNA, 3000 bp, Unknown; identical to SEQ ID NO: 8565
  misc_feature (1)..( 3000): 2750-1469P.txt file - cDNA_ID_1823294; gDNA_ID_1971819; Annot_ID_176068

SEQ ID NO: 19771 - DNA, 3000 bp, Unknown; identical to SEQ ID NO: 8565
  misc_feature (1)..( 3000): 2750-1469P.txt file - cDNA_ID_1823294; gDNA_ID_2926199; Annot_ID_141431

SEQ ID NO: 19772 - DNA, 3000 bp, Unknown; identical to SEQ ID NO: 8565
  misc_feature (1)..( 3000): 2750-1469P.txt file - cDNA_ID_1823294; gDNA_ID_2926199; Annot_ID_201720

SEQ ID NO: 19773 - DNA, 3000 bp, Unknown; identical to SEQ ID NO: 4186
  misc_feature (1)..( 3000): 2750-1469P.txt file - cDNA_ID_1823302; gDNA_ID_1620689; Annot_ID_48547

SEQ ID NO: 19774 - DNA, 3000 bp, Unknown; identical to SEQ ID NO: 4186
  misc_feature (1)..( 3000): 2750-1469P.txt file - cDNA_ID_1823302; gDNA_ID_1620724; Annot_ID_165885

SEQ ID NO: 19775 - DNA, 3000 bp, Unknown; identical to SEQ ID NO: 4186
  misc_feature (1)..( 3000): 2750-1469P.txt file - cDNA_ID_1823302; gDNA_ID_1620689; Annot_ID_164723

SEQ ID NO: 19776 - DNA, 3000 bp, Unknown; identical to SEQ ID NO: 4186
  misc_feature (1)..( 3000): 2750-1469P.txt file - cDNA_ID_1823302; gDNA_ID_2926184; Annot_ID_140692

SEQ ID NO: 19777 - DNA, 3000 bp, Unknown; identical to SEQ ID NO: 4186
  misc_feature (1)..( 3000): 2750-1469P.txt file - cDNA_ID_1823302; gDNA_ID_2926184; Annot_ID_200473

SEQ ID NO: 19778 - DNA, 3000 bp, Unknown; identical to SEQ ID NO: 4191
  misc_feature (1)..( 3000): 2750-1469P.txt file - cDNA_ID_1823332; gDNA_ID_1620689; Annot_ID_48536

SEQ ID NO: 19779 - DNA, 3000 bp, Unknown; identical to SEQ ID NO: 4191
  misc_feature (1)..( 3000): 2750-1469P.txt file - cDNA_ID_1823332; gDNA_ID_1620689; Annot_ID_164701

SEQ ID NO: 19780 - skipped

SEQ ID NO: 19781 - DNA, 3000 bp, Unknown; identical to SEQ ID NO: 4191
  misc_feature (1)..( 3000): 2750-1469P.txt file - cDNA_ID_1823332; gDNA_ID_2926184; Annot_ID_200460

SEQ ID NO: 19782 - DNA, 3000 bp, Unknown; identical to SEQ ID NO: 4180
  misc_feature (1)..( 3000): 2750-1469P.txt file - cDNA_ID_1823340; gDNA_ID_1620689; Annot_ID_48530

SEQ ID NO: 19783 - DNA, 3000 bp, Unknown; identical to SEQ ID NO: 4180
  misc_feature (1)..( 3000): 2750-1469P.txt file - cDNA_ID_1823340; gDNA_ID_2926182; Annot_ID_140630

SEQ ID NO: 19784 - DNA, 3000 bp, Unknown
  misc_feature (1)..( 3000): 2750-1469P.txt file - cDNA_ID_1823356; gDNA_ID_1620689; Annot_ID_48520
cgtatattaatagaacgatattgtcatattgatgatctcacaagaatacaaatagaaccgacttctttgaattcttcttctaacgtgtgaaataagcatacgtgcggtgtgtgtaaatacgcagtcacatatatgtccatcatggacgacgctccatatacatagcatttccaaattcaattaccgagaggtaacaccaaataaatcatacgatatcataaatatatatggaaatgaatttagatttgcaagagtgatcaaatcacaagcaacaaataatgaaatctaacgatcttatatatacgatgatatatatgatgtacaatgatgtgattactatattattaatttctgataagaatagatttgattaaatatggtatcacttaatatatgattaccgaaattttaaataatgaatttaatttcaacaagctacatccgaattatattcgtgacatcatgcgtagggttccacttgcactagttaatttgtatatattgttcgtatacgtatataaagttataaacaactcttatattatatgtacatgtaccgttaagcatgggatcactatatatagattgaccatttcaattttatctttctaataattggtccatattcaacaataaaaataagaacaaaaatgaaaccatgcatataccatctgcggtgaaaagtaacaaacatacactaaaaagaatccgtgatagattaatgctgcacttgttgttgttatggcatctcgtaataagttaaccaaacaagttttttccctgttagttttatcagtataaaggaattgtgtgtttacaactgaatacgttctcatattaatataggttggtccctttaattttgaaataattttaagttataacttctaaccaacaataaaaattgaaaacataaattatcacagcaacaagggatatctttattacatctttttattttcttatttttgaagaattaaacagtcatcactaatgaatttcctctgaagtcttaaggcaactctgatccgaaggtacaaataaactgttgaaattcaaattctaatactttagtatacacatatgttgagtaacttgatataattttggtattaacttttaattaaagttagttccgtacaaaggaatgctgtgtcgtacgtctcgatgcacgaattcatttttgtatataacgtggtgataagatgacattatcatactcaatataatttttggtcgactagagttattgttgtttatatacagattattgattttgattattcaatactaaagtctaaagccaataaaattatcgttattcatcttctgttaaattgctttggatttgaatatttgatgtgacatgtctccgtacgcgttttcgtgtcattactaattaatggattatatatttgttaaccaaattattgagggtaagagaaaataaactattgaaactttttttggttaaataacgtacaatatacggaaaggattgcataattacgatactaacagaaactactaatatttaaaaatatttgtgaccactcaatttaacttttacaactaaatttgctttaaacgatatgaccaagaatatgaacttactaaaccatcataaactgataaaatcgttggcgttttgattcgacctatacacttatgtcgatttcggttgtaaaaagtgattattacaagaaaatttgatgtaatggaaactaaatgaatcatagtggtagtggcagatgggttgccaactggtgatggtgaaagcggcaatagatcaatggatcaatgatattatcataaatattgttaaaataaaattcctgttttttggttaaatacatagattaaatgcccaaaaaatgaaattaatgatgtgaacaaaatgaaatgatacgatgagttgatatgaagtgtataaaacgataacctttcaaaatctggtccataatctcaagttctcaattaaccacttgtgtgtataggttgtgccctaaatattgtgcccatcccctattaacaatggcgtttgcatgcctaagttaattgggctgcttaaagactttgagaacacggtaatatagccacaccagttgtctgcattggaagccaaattatcaaaaaaaattcgcctaaactaactgactcttcaaactatccaagtgttgtcagaaacttttattccaatacattgttaaattttggcatataatattgaaatcctcgagatctcgaaagaatgtagtaatttagagagttgaatcatgctaattattgataagaaaataatcttaactcctagtgacatatataaatatgattcatgagacagattcactaatggcttcctctttctttgtaatgcctcgaactgtccatataaacctatgagtttgctatgcaattgcaagcattttgatccaaaggccgccaaaacgtcttaatgttttctcacacacattcagacgttttgacggcctcatgtgtcacatcaccaactatattggttatacaatgttctaagagatttagagaattgtgttgaagtgatataaatttagaacttgttgccaaatgagcaaatcgaaaaatgaagaactatgacgagttttaaagtattccggcaaagtctaaccactctttatgacttctcagtgatcttagctcctttagggaagttagcatgatcataatctcaaaataattggctaaacctcaaccaaccggtccataaaacggatgaatcgatttttcgtctcaaaggtaaccttgaatctaaccaaataaaatcaaaccaatctcccaaaagccgacataagagaagcaaaacccaaggatcaaaccaggtaaaaatgagaattagacaggataaattaaaccggatgatttcccggtttattctgtccactggtttatttagttgaatttcttcgtcaacgtcattcttcttccttaaaccctaatcaaaaatctcttcttcgagctatg

SEQ ID NO: 19785 - DNA, 3003 bp, Unknown
  misc_feature (1)..( 3003): 2750-1469P.txt file - cDNA_ID_1823360; gDNA_ID_1971816; Annot_ID_58244
ataacgcttagtaaacagctcggaattggatgaggtcggtctctattgaaagataagcctcggggctcagttgacacttagatcgcctcgtgatgccttttagatcgccgggaatttgattccgaggtcaacagatcggatatagctcgatctgtattttatcagtcttctgcagataaacggcagtatctccgagaaaacagaccctaacgaagtgagctggggcttgttaaaaagaggagcctcagcctatgcaatgtgcttttcaagatcatcactaagacgatggtagagcgtctgaaacctttaatgacaaatctgattggtccggctcaagctagttttatccccgggagagtaagtacggataatatagtgttcgttcaagaagcagtccattccatgagaagaaaaaaaggggtaaagggctggatgcttttgaagttggatttggagaaggcttatgataggatccgatgggattatctggaggatacacttatttctgcggggttccccgaagtttgggtaagatggataatgtgctgtgtgtcgggcccggagatgagtttgttgtggaatggagagagaacagactccttcaagccgttacaaggtcgacattcgagccgtgctggtccgtcactggagcaacttgagaggtttgcctcgaaaaaccaagctgatctggagacatgttcaggtcttcatccccaagctcgatgacgttcaaagcattgacttcgtcggacgcccttttggttaactccttaaggctgctgagttcggatgccgcaatcttcgcgcctctctgcatcagaatacctactatctcctcagcacctttggcctgattctcagcatccacctttggcccgacgaggtcctcttgctccttgagataagcctttactctatcaagacgagcttgggctttctttgtagtacgggcgaccttagaagctcgatcattccgcagtctgttgcactcccgctccccgtgctccttcgcagcaaccaacgcgacttgaagatcgctgatctctttctgaagagcagcttccggagatcgcccggagcacgtttggtgcaaggagggttgctcctgaagtgggtcgtgcggatgcttctaaacgaccgcgggtaagcgaccatagatggggctttcgttacgacgatatggctgctccctttacttctaattctgttgcttgtgctgagcttcttcgtgaaattggtcgtggctcgggtattccttcgatgcccttagacttgaaggaggagaaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacagatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatgaaaaaacacacacaccaaaaatatcagatatctcaaacaatg

SEQ ID NO: 19786 - DNA, 3003 bp, Unknown
  misc_feature (1)..( 3003): 2750-1469P.txt file - cDNA_ID_1823360; gDNA_ID_1971816; Annot_ID_58245
tgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttctgtcaaatcttaaatatgtgggcaatgatcctgatactttatataaatgattgaattgagacaaaactgatagacattaaaggctagttaaaaaatactgattaaacaatgcaatattgttcttgatatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactaacagcaacaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacagatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatgaaaaaacacacacaccaaaaatatcagatatctcaaacaatg

SEQ ID NO: 19787 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58246

SEQ ID NO: 19788 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58247

SEQ ID NO: 19789 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58248

SEQ ID NO: 19790 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58249

SEQ ID NO: 19791 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58250

SEQ ID NO: 19792 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58251

SEQ ID NO: 19793 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58252

SEQ ID NO: 19794 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58253

SEQ ID NO: 19795 - DNA, 3003 bp, Unknown
  misc_feature (1)..( 3003): 2750-1469P.txt file - cDNA_ID_1823360; gDNA_ID_1971816; Annot_ID_58254
ggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacagatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttgggaaatttactagagtaacccatattttatacataatgacccaaaaggaatgctaaaaatatgagttatttgagtaataattatacctaaattatccttgttttcctttgcagagaaaaacaatattacagaaatgccattactatttaattccagcaaggcaataaaaccacatttatttacgaaaatgccatcgtcgtttttggtaaatctgtggctcttgttgcgacggatttgttatcgatcacagatttgttggtcaaccacagattttttacaacagacttgttttgtaccacagactttactttgttatgttacgccagattttttttttttcgcagattttttaaccgtgactgatttgtttcatatagtctccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacatagtgataacagatttgtttttagtgatgacagttttgtttttcagtgtcaaagcataacagatttactcatgtcaatgttatggccgatttgtttatgactagaataacctttttagtaataacagactttttatggcagatttatttttaaaatttcgaaattttttgttatatgagatttattagctagccctcaattaaattatttccggtctgattgtatgttaaatccggtttgactgaattttttttttttttgaaaaagaaataacgttacgacagacttttattaatgtcggcagatttttacataatattgtcatatttgaattttaatgaattttattagtcatgataaattctccaagggttttcataaccgttttttttcttcttctattcctaccatcaaatcaattatttgtgaattgatacatgtcaaaatattattggtaagctaaaacaagtcaatttatcaaaattaaattgtttttctttagtatttttaaaatcaaaaacgaaatatgtgaagaagattcttctttatctaaattttgttcaaaattattcttttaaaaaaagtttgttctcacgttaactggattttcgtttttgttttaattatataatataggttttggttttcttttttatccacgatttcttttttgattttataattctgttgaaaaataatttggttttgctgatttgtcaaaattttattggtggagtgacttgtgttttaaaatataaaagatttgttttattttttattttttgttttaatttgattacaattaatcattaaggttatttcgtctttttaccaaagatatgggttactacagtttttgaaaccaaacgtgtgtcatttaagttatttatgttaagagttgagtcaatctaagcaaatcttactttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatgaaaaaacacacacaccaaaaatatcagatatctcaaacaatg

SEQ ID NO: 19796 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58255

SEQ ID NO: 19797 - DNA, 3003 bp, Unknown; identical to SEQ ID NO: 19786
  misc_feature (1)..( 3003): 2750-1469P.txt file - cDNA_ID_1823360; gDNA_ID_1971816; Annot_ID_58256

SEQ ID NO: 19798 - DNA, 3003 bp, Unknown
  misc_feature (1)..( 3003): 2750-1469P.txt file - cDNA_ID_1823360; gDNA_ID_1971816; Annot_ID_175991
tttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatgaaaaaacacacacaccaaaaatatcagatatctcaaacaatgtcttcagtttttggatctgtccatatcttggccatgatagccatacaactcctccttacacacagtgtttcatctctgaaccttaccaatgcgtatctgcaccacaaatgcagcaacactcaaggaaaatataagcaggggagcgcgttcgagaaaaatctcaacttagtcctcagtaccatcacctcgattggaaattttcgtgacggtttccgctacaccgaagaaggtgaggatcccaataacgtctttgtcatgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttctgtcaaatcttaaatatgtgggcaatgatcctgatactttatataaatgattgaattgagacaaaactgatagacattaaaggctagttaaaaaatactgattaaacaatgcaatattgttcttgatatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactaacagcaacaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatg

SEQ ID NO: 19799 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_175993

SEQ ID NO: 19800 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_175995

SEQ ID NO: 19801 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_175997

SEQ ID NO: 19802 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_175999

SEQ ID NO: 19803 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_176001

SEQ ID NO: 19804 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_176003

SEQ ID NO: 19805 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_176005

SEQ ID NO: 19806 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_176007

SEQ ID NO: 19807 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_176009

SEQ ID NO: 19808 - DNA, 3003 bp, Unknown
  misc_feature (1)..( 3003): 2750-1469P.txt file - cDNA_ID_1823360; gDNA_ID_1971816; Annot_ID_176011
tctcacgttaactggattttcgtttttgttttaattatataatataggttttggttttcttttttatccacgatttcttttttgattttataattctgttgaaaaataatttggttttgctgatttgtcaaaattttattggtggagtgacttgtgttttaaaatataaaagatttgttttattttttattttttgttttaatttgattacaattaatcattaaggttatttcgtctttttaccaaagatatgggttactacagtttttgaaaccaaacgtgtgtcatttaagttatttatgttaagagttgagtcaatctaagcaaatcttactttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatgaaaaaacacacacaccaaaaatatcagatatctcaaacaatgtcttcagtttttggatctgtccatatcttggccatgatagccatacaactcctccttacacacagtgtttcatctctgaaccttaccaatgcgtatctgcaccacaaatgcagcaacactcaaggaaaatataagcaggggagcgcgttcgagaaaaatctcaacttagtcctcagtaccatcacctcgattggaaattttcgtgacggtttccgctacaccgaagaaggtgaggatcccaataacgtctttgtcatgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttctgtcaaatcttaaatatgtgggcaatgatcctgatactttatataaatgattgaattgagacaaaactgatagacattaaaggctagttaaaaaatactgattaaacaatgcaatattgttcttgatatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactaacagcaacaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatg

SEQ ID NO: 19809 - DNA, 3003 bp, Unknown; identical to SEQ ID NO: 19798
  misc_feature (1)..( 3003): 2750-1469P.txt file - cDNA_ID_1823360; gDNA_ID_1971816; Annot_ID_176013

SEQ ID NO: 19810 - DNA, 3003 bp, Unknown; identical to SEQ ID NO: 19785
  misc_feature (1)..( 3003): 2750-1469P.txt file - cDNA_ID_1823360; gDNA_ID_2926176; Annot_ID_140331

SEQ ID NO: 19811 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140332

SEQ ID NO: 19812 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140333

SEQ ID NO: 19813 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140334

SEQ ID NO: 19814 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140335

SEQ ID NO: 19815 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140336

SEQ ID NO: 19816 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140337

SEQ ID NO: 19817 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140338

SEQ ID NO: 19818 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140339

SEQ ID NO: 19819 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140340

SEQ ID NO: 19820 - DNA, 3003 bp, Unknown; identical to SEQ ID NO: 19795
  misc_feature (1)..( 3003): 2750-1469P.txt file - cDNA_ID_1823360; gDNA_ID_2926176; Annot_ID_140341

SEQ ID NO: 19821 - DNA, 3003 bp, Unknown; identical to SEQ ID NO: 19786
  misc_feature (1)..( 3003): 2750-1469P.txt file - cDNA_ID_1823360; gDNA_ID_2926176; Annot_ID_140342

SEQ ID NO: 19822 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199850

SEQ ID NO: 19823 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199852

SEQ ID NO: 19824 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199854

SEQ ID NO: 19825 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199856

SEQ ID NO: 19826 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199858

SEQ ID NO: 19827 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199860

SEQ ID NO: 19828 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199862

SEQ ID NO: 19829 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199864

SEQ ID NO: 19830 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199866

SEQ ID NO: 19831 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199868

SEQ ID NO: 19832 - DNA, 3003 bp, Unknown; identical to SEQ ID NO: 19808
  misc_feature (1)..( 3003): 2750-1469P.txt file - cDNA_ID_1823360; gDNA_ID_2926176; Annot_ID_199870

SEQ ID NO: 19833 - DNA, 3003 bp, Unknown; identical to SEQ ID NO: 19798
  misc_feature (1)..( 3003): 2750-1469P.txt file - cDNA_ID_1823360; gDNA_ID_2926176; Annot_ID_199872

SEQ ID NO: 19834 - DNA, 3003 bp, Unknown
  misc_feature (1)..( 3003): 2750-1469P.txt file - cDNA_ID_1823372; gDNA_ID_1620621; Annot_ID_47041
ttatttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatgaccggtctagtttcagtcttgttcgcgagcgtcgagagaaatcgagaggaaaccctaatttggcgagtggaggagcaagatgatgaggaacattggatctgcgtgtgcgaaggtaataggaaatatcggaattgattctcatgtttcaacggaggttttgttgcgtctcttatcttcctcaaaatatcctcaggaaccttccatatcgtaaaaacaacacaatgtaattagtgaaacaacaactagaaatagaatcatgtacatttatgaatcttaaagaaacagaacgtaccgcaaaagctgaccggagagttctatcgtcgaaacccaataaaaggtctctaacactcgagtaggctccaagacatggatcgtttaaacacttccccacattaaagattgcgtaaaccctaagtttctcgtttctatcgatgattaataagaaacgttgatctgtgttgcgatggatgaattacagcttggacgcggagggagatcgtatacggctggtagatgtgaagattcatcactgatgaggagcaagaagagtgaaggcactgcgtcatttgctgtttttactgtgctaatggctggctttgcgggacatttttggtacagaggaaaaggttaatttttcgtttacaaaattagaagatcacggttgctgtttgtatcttcttcctctcacaatcctttgttttatatatacacatatatgccagctactctagaacgcttagccctctccagagctattgatgaaaagagtaaaaagattcgtcttcttaaacgagaagtggaggcgatcgaactaaaggtaagaacactcttcgtttactagcccattagtaattctcctttgaaactgtacattttagcttttgggtaacacaaatctttgacgatgaagacaaattttggaaaacaaaatgtaattcgtttctcttcgtctcaggttcgctgaatatgtgatgagatcaaggagatcaagatcagtttgaagtcagaatatatatatatctttgttatctcgttgtgtacaattaattctctataaccaagtatggttttaagttttgttacttaaaaaagtgataataattatcattacgtgttggctgctccacatcttacatgcttgtgaatggttaaaaaaaatgatcactttgtactgaacctcgctttactgtcatctggctccaaagggtttctcattctcaatcttaagccctctaactttcttcccattgataacgacaaggccatcctcggggatgttgggatcccattattgcacagacaacaggtgacaacaagagcacatagaactcgaattcgaactacaattaggtaacaagtgagttagcaaagatacagatcataacccaatattcgaattacaagcttttggtgatcaattctgttggtgcaggaattagcacctccgacaataccaatttaaaccaaggaataacgtgaataaaatcgagaattcgattgaaccggggaatcccggctagcccgttaatgggcctaagtcatgagctcgtcagaagatttgggtcgacaatcgagatcgccataggcggcttctcaggtcgtgtaaagggaaaacttccatttaaggaggatctcatgaagaatggaagtaatgaagatttagacctaggataattagaagtttatcatattttgatacgttcaacccattgtataaatagggggggtcaaagtccccaaggatcatctttaaccgaatacaagagactacaattatagagcaaaccccagctttttattcaagcaactttgttctctccctttgattatttgtgagctaagagaggagtgaatttgtctaaatcccttagtacaaattcattgtttgattacagaatcaacaattggcgcgccaggtaggggggaatataaacaaattttctctaccctcctttaatcaaagcaagcatg

SEQ ID NO: 19835 - DNA, 3000 bp, Unknown
  misc_feature (1)..( 3000): 2750-1469P.txt file - cDNA_ID_1823372; gDNA_ID_2926201; Annot_ID_141532
tttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatgaccggtctagtttcagtcttgttcgcgagcgtcgagagaaatcgagaggaaaccctaatttggcgagtggaggagcaagatgatgaggaacattggatctgcgtgtgcgaaggtaataggaaatatcggaattgattctcatgtttcaacggaggttttgttgcgtctcttatcttcctcaaaatatcctcaggaaccttccatatcgtaaaaacaacacaatgtaattagtgaaacaacaactagaaatagaatcatgtacatttatgaatcttaaagaaacagaacgtaccgcaaaagctgaccggagagttctatcgtcgaaacccaataaaaggtctctaacactcgagtaggctccaagacatggatcgtttaaacacttccccacattaaagattgcgtaaaccctaagtttctcgtttctatcgatgattaataagaaacgttgatctgtgttgcgatggatgaattacagcttggacgcggagggagatcgtatacggctggtagatgtgaagattcatcactgatgaggagcaagaagagtgaaggcactgcgtcatttgctgtttttactgtgctaatggctggctttgcgggacatttttggtacagaggaaaaggttaatttttcgtttacaaaattagaagatcacggttgctgtttgtatcttcttcctctcacaatcctttgttttatatatacacatatatgccagctactctagaacgcttagccctctccagagctattgatgaaaagagtaaaaagattcgtcttcttaaacgagaagtggaggcgatcgaactaaaggtaagaacactcttcgtttactagcccattagtaattctcctttgaaactgtacattttagcttttgggtaacacaaatctttgacgatgaagacaaattttggaaaacaaaatgtaattcgtttctcttcgtctcaggttcgctgaatatgtgatgagatcaaggagatcaagatcagtttgaagtcagaatatatatatatctttgttatctcgttgtgtacaattaattctctataaccaagtatggttttaagttttgttacttaaaaaagtgataataattatcattacgtgttggctgctccacatcttacatgcttgtgaatggttaaaaaaaatgatcactttgtactgaacctcgctttactgtcatctggctccaaagggtttctcattctcaatcttaagccctctaactttcttcccattgataacgacaaggccatcctcggggatgttgggatcccattattgcacagacaacaggtgacaacaagagcacatagaactcgaattcgaactacaattaggtaacaagtgagttagcaaagatacagatcataacccaatattcgaattacaagcttttggtgatcaattctgttggtgcaggaattagcacctccgacaataccaatttaaaccaaggaataacgtgaataaaatcgagaattcgattgaaccggggaatcccggctagcccgttaatgggcctaagtcatgagctcgtcagaagatttgggtcgacaatcgagatcgccataggcggcttctcaggtcgtgtaaagggaaaacttccatttaaggaggatctcatgaagaatggaagtaatgaagatttagacctaggataattagaagtttatcatattttgatacgttcaacccattgtataaatagggggggtcaaagtccccaaggatcatctttaaccgaatacaagagactacaattatagagcaaaccccagctttttattcaagcaactttgttctctccctttgattatttgtgagctaagagaggagtgaatttgtctaaatcccttagtacaaattcattgtttgattacagaatcaacaattggcgcgccaggtaggggggaatataaacaaattttctctaccctcctttaatcaaagcaagcatg

SEQ ID NO: 19836 - DNA, 3000 bp, Unknown
  misc_feature (1)..( 3000): 2750-1469P.txt file - cDNA_ID_1823398; gDNA_ID_1971816; Annot_ID_58232
cggtatattcgttgtacaagctgcaggaaacacaggtccttctcctaagagcatgtcctccttcagtccatggattttcactgttggtgctgcttctcacgatcgagactactctaactcgatagtcctaggcaacaatgtatctattccaggcgtaggacttgcacgtaagtcttaattcagtttcaaaccatcagctagtttttgcttatctgtaatttctgttttgttttcttctagttcgtacagatgaaggcaagaagtacacaatgatctctgctcttgatgcgttgaagaacaaaagttcagtagtagacaaagacatgtatgtaggtgaatgccaagactatggcagcttcgataaagatgttatccgtgggaatctactgatatgtagctactctatccgtttcgtcctcgggctttccactattaaacaagctttagctgttgccaagaatctatctgcaaagggtgttgtgttctacatggacccttatgttcttggttttcagattaatcctacaccgatggacatgcccgggatcataattccatccgcagaagattccaaggtgagaatataactagaaacatatcacttcttttcttgattcttcttgaagagcaatctaataacgacatgttaattcatatataggttttactcaagtactataactcttctcttgtaagagatggaacaaccaaggagattgttagatttggagcagttgcagccattgcaggtggacaaaatgctaacttcagtaacagagctcctaagattatgtactactcagcaagaggacctgatccacaagacagcctttttaacgacgccgacattttgaaaccaaatcttgtagctcctggaaattccatttggggcgcttggagttccgctgccactgaatccactgagtttgaaggtatacaaagcatgacattgatatagttgatgacattcccatttaaactgttgtgttccttttgctcattttaggagaaagttttgcgatgatgtctggtacgagtatggctgctcctcatgtagctggtgtggctgcattggtcaagcagaaattcagaaagtttagtccttcagctattgcatctgcactttcaacaacctctgttctatttgacaataaaggcgaggcgataatggctcaacgtgcttatgctaatcctgatcaaaccatatctcctgctaccccatttgatatggggaatggctttgtgaatgcaaccgcagctttggatcctggcctaatctttgatactagtgagttaaacacttaacataaccttggcagttttctacattttcaaattaccaaatgtagacaccattttaacggtctttctatgcaggttttgaagactatatgtcatttctttgtggcatcaatggatcagctccagtggtattcaactacaccggcacaaattgcttgcggaacaatgcaacaatcagcggatctgaccttaatttgccatccatcactgtatcgaagcttaacaacactcgaacggtccaaagactaatgacaaacattgctggaaatgagacctatactgtcagtttgattactccttttgatgttttgataaatgtatctcctactcaattctctatagccagtggagagacaaagctacttagtgtaatcctcacagcaaagaggaacagctctatttctagttttggagggatcaagctgctaggaaacgcgggacacattgttcgtattccggtgtctgtcacagtgaaaatcgcctcgaaacaatgaagctggtaatatatacacagagcttggtagataagagaaactgtattcatttcatttttccatgtaaatgtcacatagcatttataatacatggtacattttatttgatacaatatgtaaaactagaggaaagattccacagtcattaaaacacaataaggttctagtagaaaacatattgattcattacgcattgcctccatctctgtttcctttgcttggcgcagaaggcaccttctcggtttcctcttcctcagcagcagcagctccagaagacggtgttgaagttacaggaacggaaggattcgtaggtgtacccattgggaaaggagcatacttgtggaaaggccatccctggaatggtagtctatacctgaaaaaaccggctattgcagactttgttgcaggctcatcaatatgtgtcatggaggatgatgaatcaaccttcgggaattcagaaaaaagcattgccggagaatgaacatgttctttcccatgcttcttccctattgctgctgatgctgctgcgagtttcgggctgcgagagcagagcacaagtggggaactgacgaatgtgagaaagattagacagagataaactcttgaaattgacattgtagctgattttggagtgtttaacaagagatggttcttctttttgttttgaagttgtttgtttgttcgatgatgtttggagtcaaatggtgttgtaatttatagagtggagattgtagagtttggagaatgtgtaggagattcaacgttggatttctacttcttacctaaaatcatagtttcagaatcatgcttattgtcatgagcttgacttgtgaagatgaaccagaacatgcttattagtataacgtttgtatttttatatagaaagttgttaactttcatctaaattatgagaattagaatctcacaaagaacagaatcgtggaaatggtgtaatttgaaacataacaaaagtatggtttggtttgtttgaataagaatgtttcaaggagttaaaataaaatatttgattttattatatatctggaagataaagtccaataatttcaataataaaattaactaaaaatagaagatttgcaaattcctttgatcagatagtgaaaacgattctctctatattgccgatcgatctccaagtttgctaaatcgccgggaactttactgaaatttggagctagtcatg

SEQ ID NO: 19837 - DNA, 3000 bp, Unknown; identical to SEQ ID NO: 19836
  misc_feature (1)..( 3000): 2750-1469P.txt file - cDNA_ID_1823398; gDNA_ID_2926176; Annot_ID_140319

SEQ ID NO: 19838 - DNA, 3003 bp, Unknown
  misc_feature (1)..( 3003): 2750-1469P.txt file - cDNA_ID_1823402; gDNA_ID_1971816; Annot_ID_58231
aataatttggcattcttttgctccatggaacttgaccttctcttctgtttgttgacttctaaaactccatcggcccttgtggcattgttaatgtatgtatgaatataatctgatacaccaaccaatcattaagatttgggtttgaaatctgtctcttccgtggatgagatatgctacatgtcacaagaactggtcttagctttggtagataagacttgtcttagagcaagtcttgaaatctggaaatctattttgcagtaatcttgtcacaacaaccataacctaatcagtcagtaccctccaagaacattaaagttagatgatccgacaaaacctctcaacaagaccaaactctttccatataaatactctttaacactgacacaaagtttcatcactttctcttgatcactcactgcatcaacaatggccagagagaagattgtggtggctggtggtaccacaaagagctggaaactactcttggggctgagaatatttgcattcatggctactttagctgcagccattgtaatgtcactaaacaaagagacaaagaccttggttgtggccaccattggtactgttcctattaaagccactttaaccgctaagtttcagcacacaccggcttttgtgtaagcgagtaaaaccctatacgaaatcgattcgatacatattgaaagcaaaatgtttttgagttattaacattgattcttggttttacaggttctttgttatagctaatgtaatggtgagcttccacaacttgttgatgattgtggttcagattttcagccggaaactggagtacaaaggtcttcgtctcctctctatcgccattcttgacatggtataaacattggttttcaaatcaatttactggtttgatttcaattgaattagtttgaacgtttggaaaaaaagctaaacggtttcttgataatctaaaaaaacgttggaaaaaaagctaaacgcaacactagtatctgcggctgcaaacgcggcggtgttcgtggcagagctagggaagaacggaaacaagcacgccaagtggaacaaagtctgcgacaggttcaccacttactgtgatcacggcgcaggagcaatcatcgcagcattcgccggagtcattctaatgctcctcgtgtccgccgtctctatttcccgcctcttaatcaattctaaaaacttctccaccaccgccaccacaacctccgtcgtctaaaacatcgtggccaaaaattcagcaacatgtgtgtgaccattttatagatgttgtggcttactttgtgtgtttgtctctcaagtcactagcaaattgtgtaatgcactcctttgttctatcactttcacatttgtattcaagttttcatttctctcttatctttttatataattctaaaatgacaaaaaaaaattcacaaagtatatagtacattgaaacaatgagaaaaatctacaatagatgattagataagaccaattcaagataatttataccttttatttctcaactacttcttctatttatggaaatataattctaatcaattgttagttttttacattaaaatgaattatatcaaccgactaaaaaacaaatcagtattagttctatcgcattgtagttcccatacaacttaatttttgtgttgtaaataatgatcctactgtctctaataaatgtgaatcaataatcataactattgaaatccttttctttttggttagtaaaaatgaagtgtaaatagtataactgtttaatttagttcagatatacaaatcaacaaaactacttaatttgaagattaattcagtttttttttttttttaattttctgtttataaaactactgaattttatttggtataaatggattgaagattttattacaaaacaaaatcacatttggcggcttcttctttttatgttctaaacccttttcttagatcggactccaagaaatctacttgctttaatcgttaacctaataaattcttctctaagttttttttttcttaactcatcaaagaaggaaagaaaaaaaaaaacctctttcacagatatttaaccaaaaggttttagatttatactatacgttacaaataaaattcgagagtcaaattcaatcttgggaaaagcttttgttccgaatcttggccccttcacgaaggtacacttatcatctcactctctatttccagacacaaatctatatgcgttctgggtttttttagggtttcgaaaacggcactgcatttcatcaagtaagggtttgttttttatttaacagatctttgttcttccttaggtcacgggttaaaagtatcgatctttgtgaacttaatctcactgtaaatggatcagcttgcatctctagcagagtctgtggctatggaggtttctcatctttatccttttgcttctttgatttgtgttttttgctttctcctccatttgtaacctctaatttgcatgtttgctagattcaattagcactgttgcagtttctgaatgtggaattgtgtttatttcttgcaggaagattctgagaaacaatcgattaaaggagagagtagtcttgaacctgactctactccttctagtcctaaagtaagttaattgggtttctagcaaagtattggttgggtaaagaggttgatggcttatctatgtgctaaacccgtttgagtctgaaaatccaatcaattctagttttaattaagttcgtggcttttgcttatcagtatcttccttcaaagatctcatctttctgagagtcgttcttattgtatttgttttagattaagcaaaatctatttacttgggtcttaagaatttagcaatctcatctggatcttattagattgtttgttgtgttagctatctgattgtccaagagcagatgaatctgattcatgaatgatatcgttttgttgcgtatttgaagataactgctaggtggaatccatcagaagcttgcaggcctttggttgatg

SEQ ID NO: 19839 - DNA, 3003 bp, Unknown; identical to SEQ ID NO: 19838
  misc_feature (1)..( 3003): 2750-1469P.txt file - cDNA_ID_1823402; gDNA_ID_2926176; Annot_ID_140318

SEQ ID NO: 19840 - DNA, 684 bp, Unknown; identical to SEQ ID NO: 4248
  misc_feature (1)..( 684): 2750-1469P.txt file - cDNA_ID_1823409; gDNA_ID_1620691; Annot_ID_48619

SEQ ID NO: 19841 - DNA, 3000 bp, Unknown
  misc_feature (1)..( 3000): 2750-1469P.txt file - cDNA_ID_1823409; gDNA_ID_2926159; Annot_ID_139655
aatttctttagaaatcttcccagcctctgtcccagaaataaaacttgcgtttttcgcctttttccccattacttcaagcctcacctgtaacaaaacaacaaagtacacacctttaaagccaattcaatgtatactaaagttatcaatcaagaaactttaccttagtgcttgctcctttaggccaaccaatacctaaattgttactactattagtcgaaagaagatcataaatctcctcattataaacctcaagaacagtaacttgaacaaaagtaacaccatcttgatcagaatctcccaatatatctctcaaagaacgatacacaatcccaggctctttcccacaaccaaacatagtatgactctttccagcaccagtaggtccatacatcataatcgtgcatttattcccaactttcactcctttaatcctctcttctataaacttcttgtagaactcttcaagaccttcttgctccgagaaagaaacaccgtcgagtgtgaagtctctgtacccaacatcagctctgactcgtaccgtttgattatctgtgttgacttgtaagatcgaaggtgatttctctttccggtcagggtaatctcggatccggccgattacttcaactggatgctccggtggagatggatctttagatccgtctgggtttggggtttttgagtggaaattgagacgttgttttgtttgtggagttctgattaaggtgtattgagtttgatttgatcttgaagaagatggtgtcggtgccattgttgaagaagtttcgaaagagtgaaattgaaattgagattcagagagcgttagagagagagaaaataaaaaaggggattagggtttgtgagtgattcacgaggtttgaagtttgaaacaaagaaacaaacataaccgttgtgttgtatctctaaacggctagtttttgtccacgggccactgattattaacaatttttattttcggcaactagaatatatttactttcttttaaaaaagggaagtgagatgggcctgactttttgattaagttaatgggctttttgtgtttatagaggcccaatgtttgtagtattagggttttctcaaatgtctctcttataagctctgttactttaggtttttattaaaggttttgcggcagtggaagacgacggcacgagcttcaccgaagagcgaaaatggtgactctcttctctttctttatttctgctaaatttctccttggttactattgaagaacgagattattgattatagatctgctgtgtgatttttcttcttctttaagttgtttatttctgattttgcatcttaaatcgagaattattagagtctaattgtgatttttagaatctgttatgttgcattctgtgttgtaaattcgaagattcagttcacttcgtctctgtgaagagttttagctccaatctaccagagattcaaaatgatatagtgttatgtatcttcatttgtgttgctgcaattctgttctgatttttaggagaattaagaaggatttgtacttcagggacttgtaggattcacaaaatggttatcaatattgactagttgagtagtcagatcgtatggtagcaattaattctgaatgatttaggagaagcaggaaattttattaacaagttttagggtttgttctgaagggcgtatttagattcacttctatgatcgtaattaattctgtatgctgttgaaactgtatcttgtggtagttttaaacttggttttctgtaggtgaacattccgaaaactaagaacacttactgcaagaacaaggagtgcaagaagcataccttgcacaaggtgacgcagtataagaaaggtaaagatagccttgctgcccaaggaaagcgtcgttatgatcgtaaacaatctggttatggaggtcagaccaagcccgtcttccacaagaaggtatactcgcttttccttgtcttgatctctaattactgtcttctatgtgagaaccaatttaggatttcagaattgactctgtgaaatatgtcttataggaatgatttgttaattggaccttgctcattatttgtctttctttggaacaggctaagacaactaagaagattgtgctgaggcttcaatgccaaagctgcaagcatttctcgcaacgcccgattaaggtaatgtctgcgacattctttacctttgttaatcactctttagtctcagttctgtttcttacactttgtgtgtggtttttgcagaggtgcaagcactttgagatcggtggagacaagaagggaaagggaacatctctcttttaagttgttgtttcatctatctacttttttttgttttgtttggtacctgtcctgcttcaatactgtgatatactttgaatctaccagaaatggtcctggtttttaatttaaataggacttggtcttatggatgtcttttaatttggttaaccaatctttcttcattaggctgcccttgagtattctctataacttgcgacaaagtagacataacactctttaagttctaaaaaccactttctattttcggatctcgaaaaatcatttatcgttttgtgctgcaaatcagtgttatatatgagcttggcaaattaaaatgacatatacgtatagaaatgaattgataatactaaatattatttgttttcttcttttaacttcagccatactaactttcactaaatttcttaagagcatacagaagtttctcctcggtatattggtggttctatattccccgcaacgtgaatggaaaatgaaggttctattttggctatatgataatcatgccattagctgacccgaaactaatgtgttacaataaaaccaaattatataaatagaagaacatgtttcctggctccttattgcacaaaagagaacatgaacaactctttttatattaccatgatagtcctatgtgttttggcctttgtgttagttttaattgagagctgtgcgggcaaaatg

SEQ ID NO: 19842 - DNA, 3003 bp, Unknown
  misc_feature (1)..( 3003): 2750-1469P.txt file - cDNA_ID_1823413; gDNA_ID_1620691; Annot_ID_48618
cgtttgccatgttgtagatcatttagacacaggagagtcagctaaatagacaacaaacccgaccaaagaatatttcattcggttcttagcaactattctcctctccactggtaaagaaaaaggggctcacaagataagtaaatcctcaattgcttacaaaattcagttctatagtaaacacttccatacagtttcatgcaacactggaaatgaaaacgctcttattaagtagttcaacaaatgaaagacttaaaggaaccttgtgacagcacccattgaacgaccccataagccaatcagggagacattcccatccgtgcgcaaatactcaaccacagccttcagatcatctttctgcaaccaccaacgtcacgtttaacagtaataaaagaagtgactgctctcacaattcaggattatgacttatgaaggcagcgactgtgagggaaggaaaaatcattgacaacctaatcaaggacactcaaaggcacctaagtctaccatgaaatagagcatcaaaaactctaaatcatttggaaatctttcttcagaaagataacaataccttcatagaccaaatgaagcatcataggtgtattggttatagtgggatagaattccaataaaccacgagacattcaatctaacaaatatcaatcgagaagcagatatattgacttaagacagcttgtttactccaaacaacgataagtttaggccataacagctgaagggaagaagaggaatattttgagaaaagatcaaaggaggacatacttcgttccaacccaaagtgacatgctccccgccagagagaccggatcccgaaaagtcaagcgtgaaaatcgtgatgtttgaaggaagtaatacgatcgcagcttcactggcatcagctctacatccactgaataagaatgaatccattaatgaatagtatactaaaagaaacattaagctattatgataattggaaaactttagtaatgttggcaaccatatcagttgtttcatttcaatgcatggttgtcatagtatcctaccagctattgcatcgattgaaggatgagttaactagtttatttcaccagtacagctcaaatcacgttttattaaaataaaagttacgattacctgttgccatggcagtatattacacaaggtagaggcctatcttcaggacgctcaactggcatgtaatgactacactgaaggatatctcctctgatgtttttaacctgtcacaatataagttcttctatagtcttaggtgaacaaagcacaactaaaaccttgagatcctaaaggcagtccaaggctggaaaataaggaactcacgctgatcaacagtgaacaactgatgaaatctacattgacattgaatcacaacatgtttgcttggattctctagtcaggagttcacaacaacaacagaagaaaaaaagctttacctctaaatctttcctctggtaccatctccctttaagcaagaactcttgttccaagagatcatgttctggattgtattcagctctacatcaaaacaccagttatattcaaccgtagatgaaacaaactaattaaaacaaattggatttgaaagaggaacagggttttcttgaggaaatgcaaccctaaatcctagtatatattacttcatctatataaaaatccaaaatcaactcaagaacaagaaccaaaatttcaaaactcaaatctaaaaatctaaactttgtgtgaaacccaattctacaacctagtaaagagaaatagaaagatgaaactgaaaactaaattccagaatcagtaagtaatttttttcaattttctgagagaatcatcaccttggaggtcgaatgacgaagttaacaagctgctccattagaaaaaaatcaaacaaatcaccttcttcttcttctcattcttccatatttctcacaaatagtcaaaaatcgaataaaacctaaccaacgaaagagattcagatagaacaagaaatgtaactaaaaaaaccctaaatcaaaagatcgagctgttccagaagaaagacagtgagatcgaagaaagaaaaacacagagaaagagaagaaaataaagcaaagtaatagaaaaacggctttttcgttgttgaagcctgaaactgtttttatatttaaaaatatataaacaaactttataaattagccccacatttttgccgctttttacatttaacgtcttcacatttcattatggaaattaattaattggtattgtcatgtataatcattaatcattattactaattccaaagttttttcagtgaaagctgacattgaccaaagtctcttaaaaaatttcgaaaaaaaactcaaaaattcaattaaggttttttagtggagatcgtgcacgttaattgtcgtttataggctattgttttaattattttaaaatatatacgaggtaattaagagattaattaaacttaaacatatgaggttaattattacaagtactaataaagctgtaatgtggagtttggaattttcgacaacaaagtgcacatctggcacagagattgtcacagcacgaaagatttttttgtcgttcttgtaggatttgctggcacgtgtggaatagaaaacacacgagtgaaaccatcgtcggtctttgtagcccattatttatacttctattgggctggacttaagcccataagtaagcatctctgttacaagaaaacgggaaacagatctgaaccgttaataatattagaaaggatctagaccgttgatttatttatctgctgacagattcgtaccttcgcgaatatcaataccaaaccaatagaaatattcgttcgctgtcttcttcctcttcctcctctcaaatcggctacagccattggaaaagctaaagccttttcgtaatttctggaagtttctgcagtcggttttcacggtttcgtagattgaggtggatttgtgattctgggtcagaagtaagatagtggaatataaattcatg

SEQ ID NO: 19843 - DNA, 3003 bp, Unknown; identical to SEQ ID NO: 19842
  misc_feature (1)..( 3003): 2750-1469P.txt file - cDNA_ID_1823413; gDNA_ID_2926159; Annot_ID_139654

SEQ ID NO: 19844 - DNA, 3000 bp, Unknown; identical to SEQ ID NO: 4219
  misc_feature (1)..( 3000): 2750-1469P.txt file - cDNA_ID_1823437; gDNA_ID_1620691; Annot_ID_48612

SEQ ID NO: 19845 - DNA, 3000 bp, Unknown; identical to SEQ ID NO: 4219
  misc_feature (1)..( 3000): 2750-1469P.txt file - cDNA_ID_1823437; gDNA_ID_2926159; Annot_ID_139648

SEQ ID NO: 19846 - DNA, 3003 bp, Unknown
  misc_feature (1)..( 3003): 2750-1469P.txt file - cDNA_ID_1823441; gDNA_ID_1620691; Annot_ID_48610
ttcttcctgacgtctaaattagatggagatacttcatatcctcaaacattcatcagttctttgattactattaaatgtcaaaatctataattagcttgaattgatcaatacaaataaatacatgcatcatagttactaacctcacttttttactcaattacatcatactttgttttacattcaacaagtgtgtgcacattaatccaattttatcaaaccaaatacatggcgccactaactaatagttcaaccactgttttcatcagatagtttaaaagtttaattacttgaagcagtaatattataacagctgactagcaagtaagaatatgcgataagtttattctctcaccatttaagggtgctggtaggacatctgggaagtcaaatctactaaattctccaggtttacttggcatagcaaaaatcatggagtgttccttccactgcaaccgatcattgatcccaagttctccaaataaattctgcacattcggataagcaccgacttccaacaagaacatgaagagagtatcagtaacgaaaagtaataacagggaaaacaagatacaatataatttaaccagtgttttgcaactttcttcaaattgatggtagagctgataagatatatgtaacaaatatattgggggagcaacagagagggtatgagttttggacttacagaaaatatgtaaaccagtctcataccagtccccatcttcatccttccatgcagctatctggaggaagacaaatatcacatcataaatatcgctctccaataagataggtaaattgttaaaacggaacaaacaagaacctaacctaagaaccagagaacacaataacaacttaacaaaatatatatccaaaagatatcttccagtaaactactctatatttgattcacattaagcctagaaactggaaagggttgtgcggtgtgtagcacaagactgaagacattagaacataataaaaaacaaattgggcagtacaagactaatacaacaaacaggacagatacattgggtacctaggagctgtaacactctaaacactagttataccttgtagtctcacaaacataattggtacagcctttgggaatcagcaaatcatataagaatgagaaatgcaaacaacaataagtaattcggaaagtgagaccaatcaaagtacctttccaccaagaacatctcttgcttcaagcaacagaggtttgtggcctgcatcagccaggtactttgcagttgacaatccagccaatcctgcaattatttgagagccaaaagaacttcatcacatgaacattaattccatcagatcccaaacaaagcagtaagaaatgaagttgtagacataccagcaccagcaattacaactttcaaaggcttagcaggacgaggagcactacggaaggatgcagataaactagcagcttccaagaaattgacagtgttctctagctctggccttggaatatccacacaaactacctgcaatttcctctctttaatcaaaattacacttatacactagatgaaatttcgagaactccaagttaaaaaccagaaaggtagatacctgcaaaggaccagcagtactcctcctccttgttcttgtcttaagcgcttgagaagtgggaaccctaaagctatgtcccattagttcacaacctccagatgaaagtgcctccaaaaacccgttttgataaggcaaattcgccgcagaaacattcccaaacacaaccattttctccaacttaactcacaactgcttcaatgaatctaaaaattgaagctataaaagaattagaattacaaaacacacaaaaagtaagaaaattgagtatcttaggtgaaaccggtggaagcaaatcagacaaaagtttgtatctttaacacataattgaaaagaagaagaacaaaaaaaaacggacttgaattaaaggggctatagtagttgtttagtatcttatcttttacctagcgagtaatcgtgaagtagagaaacaggagacgcagcgaaggaggaggctagtggaagtagccgataacaaaatggagtattcgagtgcccatatggtcttgtttggttttcagaccaagctcttttgttgcttacgaaacatgtagatggattaaataccacacaaattaaaattttgatttacgaattgatgaccatatgattcttttccttatttggttaattgagtagagagagaccatgcatctcaacgtaatttggtttaggggaaaaagaaattgacctctcagctaatatgtttttgcccaccaaagtaactacgacaaaataaaaataaataattttggtggagttggtgtcaaatagatatgaattctgtgttatcttattcgttataatcatgatcttccttctcgtgattcccaagtataccctaacccaccttatatttaacggagccatccgaatccgatcgaaactttgtggaatacacacatttgtacaaccagtggcttgtttattcggtgagagagtggtgatatctcaagttctgttatatgctccaacgcatcaacttctgttcccattgcatttcctccaaatctcttctcgggtcggttcggtttggatatccgattccgcttagtttgcccacataatttagcccaggaattgggtccattgtctgatgacgaagtatgttttagaatctaaaactagtggacttaaacaaagcccaatcataataagttgtgtaacaaattttaaatataaaaaccaaatactcctcctccttgcattttctcttttttgacttttcctttgctttgacttgtcagtcttctcttccccttttctcttcttttttttttttgatcaaacaaatcaatctcacacctcttcttcttcttcttcttcttcttcttcttcaacctcttaaatctcaaaatctcaatcatcaagcttctccttcttcttcttctttccatcttcgcttcaacaacaatg

SEQ ID NO: 19847 - DNA, 3003 bp, Unknown; identical to SEQ ID NO: 19846
  misc_feature (1)..( 3003): 2750-1469P.txt file - cDNA_ID_1823441; gDNA_ID_2926159; Annot_ID_139646

SEQ ID NO: 19848 - DNA, 3000 bp, Unknown; identical to SEQ ID NO: 4233
  misc_feature (1)..( 3000): 2750-1469P.txt file - cDNA_ID_1823443; gDNA_ID_1620691; Annot_ID_48609

SEQ ID NO: 19849 - DNA, 3000 bp, Unknown; identical to SEQ ID NO: 4233
  misc_feature (1)..( 3000): 2750-1469P.txt file - cDNA_ID_1823443; gDNA_ID_2926159; Annot_ID_139645

SEQ ID NO: 19850 - DNA, 3000 bp, Unknown; identical to SEQ ID NO: 4221
  misc_feature (1)..( 3000): 2750-1469P.txt file - cDNA_ID_1823447; gDNA_ID_1620691; Annot_ID_48608

SEQ ID NO: 19851 - DNA, 3000 bp, Unknown; identical to SEQ ID NO: 4221
  misc_feature (1)..( 3000): 2750-1469P.txt file - cDNA_ID_1823447; gDNA_ID_2926159; Annot_ID_139644

SEQ ID NO: 19852 - DNA, 3000 bp, Unknown; identical to SEQ ID NO: 4231
  misc_feature (1)..( 3000): 2750-1469P.txt file - cDNA_ID_1823451; gDNA_ID_1620691; Annot_ID_48607

SEQ ID NO: 19853 - DNA, 3000 bp, Unknown; identical to SEQ ID NO: 4231
  misc_feature (1)..( 3000): 2750-1469P.txt file - cDNA_ID_1823451; gDNA_ID_2926159; Annot_ID_139643

SEQ ID NO: 19854 - DNA, 3000 bp, Unknown; identical to SEQ ID NO: 4223
  misc_feature (1)..( 3000): 2750-1469P.txt file - cDNA_ID_1823467; gDNA_ID_1620691; Annot_ID_48603

SEQ ID NO: 19855 - DNA, 3000 bp, Unknown; identical to SEQ ID NO: 4223
  misc_feature (1)..( 3000): 2750-1469P.txt file - cDNA_ID_1823467; gDNA_ID_2926159; Annot_ID_139639

SEQ ID NO: 19856 - DNA, 3003 bp, Unknown
  misc_feature (1)..( 3003): 2750-1469P.txt file - cDNA_ID_1823471; gDNA_ID_1620691; Annot_ID_48602
acgagttcttaaacaaatttgttataaataaatttaatatataagtaccattaaatatgttaagtaacatattaatgatattaataaaccattttaatattgcataaagttttacaaccattgtcatcatatcctctttttctataggtgttactagctctcatctcaaggtctccaccatactctttaattaaccggctattatttattttaatagtaacacatttgttcaaaataacactagatgttttacggatggtgattttaagatgtttagatatttataacagaaagtcaggtcgatccaacattctttcatgccctacacaaataaacatattatggcctgtaatttttgtttttacaaattcacaaatcatagtaataaagaaaagatcatactaaaccttaaataataaaacagtttttaaattcattagcagtttgtaaaaagagaaaaaagaaaagaaaaaattatatccatttttttttggtaagggataggggacaaagtcccttaccgtttgttaagaaaacttaaaagaaattagaaaggaacgattcaagttttagttataaaaaaacttcaaaaaaatatatcatttaaatatagctctagttacatttttacctgtaaaatcactcatcaattagtcaagtttttcacacaaaaatcattcgatcatgtctagttgcctacaaacaagtaaaccaaaaatcgcatgccctttacctacgaatgactaatataatttaaaattgcaaactaattagatttaaagcaaagttgcaaaattaaagtccagacacaaaacctagagagacttcagactttttctttagtaatcaaactcgattttgcaagtttagtattttacgttttttaaaaccaaatttttaccaaacaaaattcattaactagacgtaaatttagctaaaaaccacaaaatataatgaaaggaagctaaaaaaaaatatatatatatatataatgaaagcctatattattttttattttatcataaaaggcttataaaagttttttgtaaaacatgttctattaactttgatgtcctaagccataacttctcttgattttgtggtgggccagacctaaaacattaaaaatatgatattatatataaaaatatgatatcagaaaaataaaactattaatttgtaaacaaaacttaactgacattttactttctttcatataatatatgaacgtttttaactatgtacatgaaaataaaacataacttaaaattagaaaactacattaaaacgagatctatataatttttggccgtcgaaacgatcgtctaaacgttatccagagaacctagatgaccgtctagactgtttttaagaacatatgacaatgttttataaacataagtatatttgtcataatgtttaacataatagttttgaaaagagagaacaaagtgcaacactgttgttatataatacaattttttattaactattgaaaatatgagatttccatgggatattgcacaaaagctaaattgcaattcataagattaataaaaatctttatgtacaatgtatcacaccatttctgtcagttttaaaatattagttttagaaaataaatgaggatctaatacttttttttttctttttcataatgagtcaattttattgttatggaggatcaaatctcagtgttaaaaaagggtaacaattcataatattaattaaaatctttcagtaaaatgtatcacaccatttttgtcagctctaaaatgttagttttagaaaataaatgagaatacgatttttttttttttgtctttttgataatgagtcaactttatgtttatgaaagatagaatttcaatgttataaaggggtaacaatttataagattaattaaaaaaattatctacaatgtatcacaccatatctgctagctcgaaaatgacagttttagaaaataaatgagaatagaatatcatttttcttctttttcatagtggatcaactttatgtttatggaggataaaatctcaatgttaaaaaggggtaacaaatcataagattaattaatatgtttatatacaatgtatcacaccatttctgccagatctaaaatgacagttttggaaaataatgaaaatataatatcattttttgtctttttcataatgagtcaactttatgtttatagaacataaaatctcaatgtgaaaaagggtaagaaaatcttctatataaattggtcaaactttctttcaattcaaatcattattttttattaataaatgaaaatataatattttttcaaaatgagtccactttatgtttatggaggatataatctcattgtttaaaagggtaaaaaatctcttctatataaatttggtcaaagtttatttcaatcttcaacaaaaatctttatttttctatgatttaatggaaatatgggatttatgatattctctaaaagctaagtttcaactaatataaaaataaaaaagctaaattacagctcatcacattaaatgaaattgtaatggacagtgtatcacaagatttttgccagtcttaaacgttctaaaatttcaggcgttttttttgttctatttataaatatcaaagttttagcttcataatccattcatagtcctctgctcttgttttactactcttactaaaagtttttttaaaaaagaaaagtcttagctactagcttgctccatttataatcccttcactcaactttcttgttttactactctcactaaacgtaagtttttctgtatcatttatctaaattttattgtcaatatcaaactagatttgaaggatttcaattgaaagtcttatgatatttaattgttacgtcgatataatctatgtgatgtagaaacactcatttggagtggtttaattacatatattgcaaattacttatttaaagtgcatgctaatgatttagataattttgtttcaaaattaggtcttttcatg

SEQ ID NO: 19857 - DNA, 3003 bp, Unknown; identical to SEQ ID NO: 19856
  misc_feature (1)..( 3003): 2750-1469P.txt file - cDNA_ID_1823471; gDNA_ID_2926159; Annot_ID_139638

SEQ ID NO: 19858 - DNA, 3003 bp, Unknown
  misc_feature (1)..( 3003): 2750-1469P.txt file - cDNA_ID_1823487; gDNA_ID_1620691; Annot_ID_48597
aactttataatccaattccaaaaacccaaaagcgagattacaattgttaaagataacaaaacagaggctagaatttgatctcgcctttgactcgcagtgaacccgaaatcgccggaatgatggaattcgaacactttcgtgacccgaaatcaatctgaacccaaaatcaggaaactgacgagaaggagaaccgtaagagagtagtgtagaaggtcccaaagaagaagtcgaagccatcgttgaggaagaggcgatgaagaaggaataatcaggtttcagacgaatttgcatttgcagataagatgaagatgaggactgtctttatagaagaaatggaacagagagagaatgagatctcgaagcaaacgtagtaaccatgtcgttgtcttgattttgatcttcactggttccagaagaagctcaccggaggagatttttttatatatacattcaattaaaaaatttatgtgttttaatttattattattatttttttgtctttttgctcataatctcgtacgaaaactttagtgttactcaatggaatcacatgagaatatacgacatttggtgctgatgatccaattatggtctttacattaattcttagctaatttgggtttgtgtttatgtcagaaaatctaaaaattcttaaaattattaaagttcttgatttttttgcagctttagggcaaagtaaatctcccacccatttacgtttttgtagctgttacagtttgtgatagataattttgttgttgattagagaatgtaataataatcagctttgtaagggaaaaaaattactatttattaattatttgaattttttttctcaacatagcgaaacttgaagcagaaaaggtataataaaaaaaagataaggaacaatattgagttatacgaataatccagctttaatcatgtgtcttcttcctcaagtcctcctcacagagtaacgctcggaaacttgcaacgatcatttcctgtaaaaaatctttgttagtgactatacgaaaaggttattttggtctaaatttggaaactacaaagaatggctcaccagggttggttgttgtctcatgagccaatccattgaagaaacattgaatgctttggttacgaaactgagcccagtacgaattaagcgcgtagcttgcatgccaataaatggagactggttcgtaacattctctcccaggagctaaagctgcacaagtggtgttgctttgggcacaagccatcctcaatgtttcttcaagctcagtctcgttggctccttcgactggtacgcaccacacttgacctttgtaaggaacgttgttcgtcggtttaggtaacgggttgaaaccggttaagggtgtttgaccggtgaaatctacgtcgtagattggtgaaccgtcgggatgcaagattccccaatgtctctgtgtccccgaaccggatttctggttttcgttgaataaggagaaaacaaatgtcggtattggtaaaccgggtcttgatggtgtaccgattggaggacttgcgctcatcttcttgatcagattacggttataggtagctgcgttgagaatgttggctccggtttcgtcgatgtcaccgaaattaggccatccggtttcagagatcgcgaggcgcatatgtggataaccgagtttggtcatggcgaagagaaccgaatccaacatttggtctagaagattacggtaaaccaaaccggtttgaggatcggtataggttgagtgtccttggaacagagcaaaatccaaactggtgttcatggggtttcttgaccaacggaagtaaggatgaacattaaggaagaagtaagagtttgttccgttgagaaacttcagcaacggtaacatcaccggtccggtgatttcttcccggaatgttccgttcgatggaggaaacgacgaccggagagaatccatagctagaggtgtcccaactttgatgttgtgaatcccatgtaatctgagtgagttaacgattttgcgcatcgccggtacaagattcacagagacattcccagaattgtagctgaggatttcgtttccgacaaggacaaaacggatttgtgtttgtggatagtaagggaggatgttagttctgacccattcgtcagctatggtttggttagagctgagggcggtgatttggtggttagggacggttatggtgacgtagagattggtttgagagaggagtgtgagactctctggatcggcgtcatagagcttgacatgaccagctttgatagatttgatgaagttgatggattgatatggagatgggaggttgtttcctcttcttccatagttgataccaatcttgctagccaaatctagcattgttttcctctgcatgtacctgtgcccttggaaccgagttgcggaacaacatgaacctgtaaaaccaagaaaaccatgttcaatatgggagattacgtaaagaaaatgtaaacatgatgcattattaagatgacttacttgaaaagacaaggatggtgaagaggaagaaagcaagaagagacatgtctttgtgtttgtgtctggtttggtttgcaatgtgttggtgatgatcagaatgtgattttaagatggaatggtgtggcattggagatgaggtttataagtaagagtatggtgtagtgtaggtttattgagtcatgcaagaaaagctttgttttggcttttgattttctttttgaaactctcatagttcttttgtgctatgattttaaaaggattgttggttggatggttcaaattgaaccaagaaacactttccccaatattgttaattttgcaaatacatttctgattgtagattgagagattatacatcaataatgagtttagtagactaatggactaaaatgtatgtttcgatgataacaatttatgtagaatttaaaagaactgtatactatatagtattttaatttatcttccgtgcacgaaccaaaacttcagtaccacactgatacacatg

SEQ ID NO: 19859 - DNA, 3003 bp, Unknown; identical to SEQ ID NO: 19858
  misc_feature (1)..( 3003): 2750-1469P.txt file - cDNA_ID_1823487; gDNA_ID_2926159; Annot_ID_139633

SEQ ID NO: 19860 - DNA, 3000 bp, Unknown; identical to SEQ ID NO: 4213
  misc_feature (1)..( 3000): 2750-1469P.txt file - cDNA_ID_1823491; gDNA_ID_1620691; Annot_ID_48596

SEQ ID NO: 19861 - DNA, 3000 bp, Unknown; identical to SEQ ID NO: 4213
  misc_feature (1)..( 3000): 2750-1469P.txt file - cDNA_ID_1823491; gDNA_ID_1620691; Annot_ID_164773

SEQ ID NO: 19862 - DNA, 3000 bp, Unknown; identical to SEQ ID NO: 4213
  misc_feature (1)..( 3000): 2750-1469P.txt file - cDNA_ID_1823491; gDNA_ID_2926159; Annot_ID_139632

SEQ ID NO: 19863 - DNA, 3000 bp, Unknown; identical to SEQ ID NO: 4213
  misc_feature (1)..( 3000): 2750-1469P.txt file - cDNA_ID_1823491; gDNA_ID_2926159; Annot_ID_198621

SEQ ID NO: 19864 - DNA, 3000 bp, Unknown; identical to SEQ ID NO: 4212
  misc_feature (1)..( 3000): 2750-1469P.txt file - cDNA_ID_1823495; gDNA_ID_1620691; Annot_ID_48595

SEQ ID NO: 19865 - DNA, 3000 bp, Unknown; identical to SEQ ID NO: 4212
  misc_feature (1)..( 3000): 2750-1469P.txt file - cDNA_ID_1823495; gDNA_ID_2926159; Annot_ID_139631

SEQ ID NO: 19866 - DNA, 3000 bp, Unknown; identical to SEQ ID NO: 4211
  misc_feature (1)..( 3000): 2750-1469P.txt file - cDNA_ID_1823503; gDNA_ID_1620691; Annot_ID_48592

SEQ ID NO: 19867 - DNA, 3000 bp, Unknown; identical to SEQ ID NO: 4211
  misc_feature (1)..( 3000): 2750-1469P.txt file - cDNA_ID_1823503; gDNA_ID_2926158; Annot_ID_139628

SEQ ID NO: 19868 - DNA, 3003 bp, Unknown
  misc_feature (1)..( 3003): 2750-1469P.txt file - cDNA_ID_1823507; gDNA_ID_1620691; Annot_ID_48588
gtcatcctcaacaccttctcaagcgtctcacgcatgttccaagttatactgatggaaaatgttgtttgtgtggaagcaaacttcataacttgttttatcactgttctatttgcaattttagcgtggatgtcaactgtgaaaaaaatccaccctctttcactctttttcaccctaaagctcatgagcataagctcactcttatgccgcaacgaagttttgtatgcagcgcttgtggaatggatgacgatccaaatccttacgtatgtcctcagtgtaatttcatgattcacagaagttgtattgatataccacgcgttattaagatctatcgtcatgatcaccatatttgttacaataactttcttgacgctggagattggaaatgtggaatatgtcataaaaagataaactggacatgtggggcttattcttgttcggaatgtccagatcttgtcatgcacttgagatgtgccacaagattcgggatatggaatgggattgaacttgaaggcatatcaaaaaatactctaaaagtcaaatcatacgaggagatcgaagaaggggtaataaagcattttagtcacgaccatactttaaagtttaaagaagggagtgatggtaacggtgaatgcatacagtgcacaatatgcacttatcccatattttctaatccattttatagttgcatggagtgtgatgatttcatccttcataaaaaatgtgtggatctcccaaaaaagaaaatagattctttctacaagatgtcgacctcgctaatcacaaattatcagggtaatgcagaaaacatttgcaatgcttgtcaaaacatctatcaaggtttttcttacttaagtgatgatggaaacactttattggatgtgcgatgtggttctatttccgagccttttttccatgaaagtcatcctcattcgttatacgtcagctacttaacaggcggccgattttgtaatgcttgtagagaaaaagcaacaatggttttgagttgtgaggaatgtgaatttgttttagacattaaatgctctactctgccaaacattgttaaacacgaaaatgataaagatcatttgttgtctctatgttatggagaaaacaaatgtgagcaatgctggtgcgagatgtgtgaggagacaataaatccaaagaaatggttttattcatgtgatcattgtggcattgcttttcacatcagatgcacacttggagacttcatatggtttaaaccggaaaaaaaatctgaatcatccaccaattgtgtgattcttaataatcgtgcaagtcggccattttgttattcttgtaattctcgctgtaaatacccatccatcttgtttttctatgggaaaacattgtgttctttgcaatgtttccaacaaaaagtttatgcaatcctggcataaatcttatttattttctcaaatattttatgataaaaaacaaattagattatgtgttgcatgttaatactatatatattttaagcatcaagtatattaaaaaaaaatttatgtgcaatttggaattcaattcgatttaggttggatttctttttatttctttgttatacttttggtttagaaataatagtattcaaaacaaaatataatatactttaagtttcgatatgtattcaaatctaatcaaatactaaattttataccacgtcgtgcacatgatgattttcttttgaaacaatttgtgaattttgataagggtttattggtaacgagtgtttacttgttgctgtaagaactttttttttgttttttccacaaaagttggattttattgaactgaaccaatcaatatgggctaatataaacaaaagccgtataactataattttacaagaattaattaaagcccaacatgagcctaaacataaccctaatgaagaggaaaatacaaaaagcctccatcactaacacgtgtttcaattagaacaaacagagagcttccatcacagaccgactttaaccttgccgttcaccaccgattccggtgacaagagtcatcgtcgatattaatttgttcagtaaattttgtggtttttcaccgtttaacaaaatcggagcccataagaggataacagctaaagggaattgatagtatgcttcagttcttctacttcttctctttaattaaaattgcaaatcactgggataattaaaaaacctttcccaattaaaaaaccaaacactcaaaagataaatcagtgaaaacaattgattagtgaaatttactaaattgcaatcaccaatgagaaatcccatgaaattatttaaagcaaacaaatatggaagccgactaaaagatgttaacgaaaccatctatgtcagttgataagctggacatcactgcgtgggaagccaatagattccagacggaagccgaccaaagatgttaaagaaaccatccatgtcagaagagaagccggaaatcacggctgaggaagccagttgattccggacggaagccaactatcttggctaacagagtcataagatgctggataaaagcccgagtcatacgagacggcgatttactgaaaaattcagtcggtagaaacagagttcatctctgtaaaagatatgtaggaaaaaagagagaactttttgttttgctgtaaagaactttggatgcaaatgtttttactatttgtgaaactattattttatatttatagccaaatttaattttttaactaaacaaaaattatgccgtccatatagtatcctgtaaattaagttttagattattaattttgttaattattgataaaaaaaactcaaataatgtcatattttctcttaattcaaaagttaattgtgtataatttgattggttcccccaaaagaaaaattgattggtttagtgaaccgataaatccaatctcgtaccgaccggttcaatgggttttgtatttgctcctctgtgctctggcctctacactttggatagctgccgccgaagttttgtgcaatg

SEQ ID NO: 19869 - DNA, 3003 bp, Unknown; identical to SEQ ID NO: 19868
  misc_feature (1)..( 3003): 2750-1469P.txt file - cDNA_ID_1823507; gDNA_ID_2926158; Annot_ID_139624

SEQ ID NO: 19870 - DNA, 3000 bp, Unknown; identical to SEQ ID NO: 4207
  misc_feature (1)..( 3000): 2750-1469P.txt file - cDNA_ID_1823517; gDNA_ID_1620691; Annot_ID_48585

SEQ ID NO: 19871 - DNA, 3000 bp, Unknown; identical to SEQ ID NO: 4207
  misc_feature (1)..( 3000): 2750-1469P.txt file - cDNA_ID_1823517; gDNA_ID_2926158; Annot_ID_139621

SEQ ID NO: 19872 - DNA, 3000 bp, Unknown
  misc_feature (1)..( 3000): 2750-1469P.txt file - cDNA_ID_1823525; gDNA_ID_1620691; Annot_ID_48583
cagtaaattacaacatttgtttaggcactttttcggttgatacacctagtcttgtttacttctgtttcactgagtatgttgctatagactaccctgtagttataatgcaaaacttatttgaggctagaatcagccttttggtaactcaagatcaaatcgagcgagcaagagcgccaaatatcgattgggtggaggatgatgttgttctccgactagttaatatggagaagctcataaaaggcatacgtaatgttcagtatatgtacttgtctccgaatactctcgaggtcagttagcgttaaagtcatgttttgagacatgtaatggcaaaaagtctaatagtgttttgtcttgttttcaggttctttctctgtgttgtgaatcgatgccagtgttcaacaatctcaaatcgttaactcttaagagtcacaagagtcgaggatggcaagcaatgccagttcttctaaggaactgtccacatctagaaactctagtccttgaggtatagttacaagtcatttttgccaaacgtgtacagacaagttttgaactgaataccttaactgtctcctttatgctttcagggtatcttgcaccatgtcacagataaatgtgggtatgcttgtgactgtgtttcccgagaagaaaaaggttgttcactcacatcttgtccagtaaaagtgttagagattaaagggtttcgaggaacgataaaagagatgcacatgataaagcatttcgtgaactattttccttgtttgatggaaacaaatatttatattgaagagagtggtcctccaaagctcagagtcccccaagtgtgtgaatttatcgcggagatgatggaacactacggaaaatcatccagtttcaatgtccagctcctagtgggtggttacttgtataagaagtggactgcacaatgaagtctttaaagaacaaaagtttctcatagttatgccaaagtctcttttaacctgttttaaactaaaccaatcgggaaactgtagtttcttttcgtcttcttcaatttccaatgtttacagtcatttactattgatcgccatcaattttctttgagttgttcatcgttaaagctaaatggacaaaagtacagcagaagcctaacttaaagcttactaccgcaaaacttaacatgttcaagaaaccaaacgaagtttactatggcttgtctagattttgctctctggagttggatgttctctgcaaatggaaacctcctggtttcatatacgaaaacaagccttcatatcttgaaaatagattgcagctgtataatgtgactcaagctttgtcgagcatagttttatagttgtgatgtaaaaaaggtgtactagctagggcacattgatgagtcttcaaggaagaaaacttactcatagttttgttcggaagctaaattttagttatgatttcatttataaattataatatataaactctcttcttctttttttcaaattaaaagctttccagtagccaaaatatagtagcatatttgatgctgatttctaataactgtaaataaaatttacataaatactttttgaagatatcaaattatttatacataattccactagatataattagatgataaaataaaatataatgtgattacttataaatataattaaatccgattacaaaaacatattttgaatttattctagagaaatattatttttgtaaataattaattgaatttataataacaatatacttaatctaatcacaactataaaatgaagtgcttgtcggaattttgttgtatgaagtgcatttggatttcatattcatgtatcattttattctgataatagagaatacataaaatgaggaattaattagtaatgactacattggtatcaccggatatggaagactcttgagattccaaacctgtaggatggcagcaacaccgaccgatcgtttggtgaacatatttttgacaaaaccctcctttgctgaatcctttaaatctacaaagttcgttgtatgtcatatcgtttgtacattttgatcccgctatacagggtatgacttcgactgcataaacaaacacattagcaagatattgtaagtaccaaaatgatcaattcctagttttatgaatttgtattatagtgcatgcatgtttatgtttctgattccagggaattttgattatttattttgactccggcaaaatatgtgttacctgaaattattgatggaaggatgagagcaaacaccatcaacaaaactaagagaaaatatgaaaacttctgagtggccattgtttatgttgctagagaatacaacaaaagtttgttagaatattcttgagaaaccaaaaaaaaactgtagaaaagtacactgatagtaagaatattagattttacaaaaatctgaaagatgttattgactctctttgagattcaagtggtttcctttcaacatttcttatgaaattatacaacccaatttacctttctttttgatatattttgatgttgggaattgactgtttatgttttggctatggtttttctatactatggcttatatttattattatttctttctcttatttggttatttaaacaatgatgatttggtcaaaggggttgttattaatttatgctcaggttcatgattatgattaaatagttttgttgaccaccattttatctgaaggggttataattttttttcctgtttagataaatagttaagctgactacaattgtataagacttgcttctaaacgttgatagaatctactttaattgtttcgcaaaccggccggtttaaattgagtggccgatctaaatccgaacacttaaaccaaaacctaaatccggtttaagttgactgtacatttgtcacctcttcttcttcaccaactaaccccatttctgcttcttcttctgcttagagacagagaaatagagagagatcgcgtcggcacaatctgcaatttccaacatcgacatg

SEQ ID NO: 19873 - DNA, 3000 bp, Unknown; identical to SEQ ID NO: 19872
  misc_feature (1)..( 3000): 2750-1469P.txt file - cDNA_ID_1823525; gDNA_ID_2926158; Annot_ID_139619

SEQ ID NO: 19874 - DNA, 1755 bp, Unknown
  misc_feature (1)..( 1755): 2750-1469P.txt file - cDNA_ID_1823529; gDNA_ID_1620691; Annot_ID_48580
aagcttcctccttcacgttattagccactgacagcatcagaaaggttctctagaactctagaacctaagcaaatgtcacaatgctctcgattatcttattactcaccaaagataagctccagttttttgaactagttaaatgtattataattagaacgatgtgagacttttgcttcaaggtcgttgagtgtgagaaatggttttctttgatgttacctggtaaagatgccatgaagcataagcatccgttgttgtttatgctcctttgacctcccaattcaagcctaattctgtttggcttcaggagctgcaaagtaacagtttttaaagcgaaatataaccacattcccaaagttctaaatagaaagaaaaaaacaagctttgaaatcaacaagataaggtggataatgggtacctctttgcaatcaagtgtctcagttagcgaggcacggccccatttttctgaatcaaggtttttgtgggctaaacgtaaaagatcttcgacatctttgatggatacaccattgtcatggaaaagcttaacaaagtcacagtcaattcaaacaccacatataagaactaagttaagtatgagcatatccatacttaactacagaataatattgtccaacatgaactttgatcacttcaaaaccttaacaagtcaatagtcaatgtatagatttcttagctacagaatcagtagctaagtatggatatgctcatatactaggttgttgtatcagaattgtaaaatttcttggcctggtttataaagtggtatgtgtttaaaagaaaaataaaagaagtaaaatgttatattcaagattcatggggcacattgtgaccagtaaaggactcgataaactcaacaattttgagggctttgggtgtggtcaaccgagtgaaactgtgcaaggaagcacgctcatgcaacttgaagttttaatgtatgtcttgttcgttttgtaattttaaatctctgttggctgcggtgtggtgtgtctccgtttagatgcagttttggttccggtgtgtcatgatgtagtgctaacctttaaccttctttataatcaggatatgtagcaatgctcctccattagctctaactcaccaaagacaaactttgtgcagccagttccacgtaaaaagtggggtttgtttgtattattacctgatgatatataatcggttgctgcttatttaacagaggatgcatgggcctcctagtttccgaacctgatgatgttcggtttcaagagctgaaattgaattgtaacagaatgatcaatatagttagaccagttgtcactattgttctgtagactcactatcggccacatatatacaaaggactagattctaagcatcactataaaaaaaccaataaactttcagagggtttctaataaactaaaagatttcaccataacagtggcggctggtgccacagctcacacgcctgtcttcatcaactcaggttccagtttcattctcacacggcatttcaatctctagaacgagggaacacatgcaacaaaagcctcaaagattaacctccaccacacggcaagagaactgcgatgaatagtcaaaggaatattcgattttctgtggaagcgattagtctttacagaagaattttcaagtcaagctttaatttatttcgaaaatatggagacaatccaatgatcaattcgtttcacagaaaataaataaaaaccaatcacagaaaaaacattctacagcaagatg

SEQ ID NO: 19875 - DNA, 3003 bp, Unknown
  misc_feature (1)..( 3003): 2750-1469P.txt file - cDNA_ID_1823529; gDNA_ID_2926158; Annot_ID_139616
caacgctttcacaggccatattccaccatctctatcaaacttgagcaatctccaatcattggatctatctcaaaacagattatccggcagtatcccaggagagctcggggaactcacatttctagcgcggatgaacttctcttacaacaggcttgaaggtccaataccacaaaccactcagattcaaacccaggatagttcttcatttacagggaatcccagtctatgtggtgctcctctcgaagaaccctgcggccgagaagaagatgaagaagcaacgaagcaagaacaagatgaagacaaggaagaggaagatcaagtatttagctggatagcagctgaaataggctatgtacctggtttgttttgtggactcgccatcggccacattctcacttcatataaacttgactggttcatgagaatcttttcctgcttttcttctccgctgataaaatgatcaataataagtgtctcctacttttctcattacctatatctattgtgtcgctgaaaccttcaagatcttgtttctattatatatactccttattttccttctagtatctaccacctcatcttccatctcttgagagatattcttacgtactctacgcttattaggctccatttatggtaactattcggtctatgtggttaaaacttatgattgctttgcttttgactgaggctgactggctgagactctgagagttagtcatactatacttagtagtcatgtcagaaaatattcctctggtgtggcgaacctaaagtcgaaaacatctctattcaaaagtcgaaaacattctacactagtgctttaatgtgttttcagtttcagtttttttgtttccttgttgtgatctaagtcctttctttcaagtgttttgttcctgatttgctttgattcgagcctcttgtgtggagaagtttcctctatttatcagtgtattgtgctttgtgtttctaagatttgttcatgaaagagtttgaaaagagttttctcaagtcttttacatcggtattccaagtttaaatcaacgtactaagaagagcttaccatggagcccattaggttccacagagacttataagccgagagtgagtactgattaaatggactagcaatagcaactagatacaatgttcatatctattttgcaaatcctctaagagatgcatctagtatactagatttatatcatcattttaattactaactcttggggttataggctaatctctaagcttcctccttcacgttattagccactgacagcatcagaaaggttctctagaactctagaacctaagcaaatgtcacaatgctctcgattatcttattactcaccaaagataagctccagttttttgaactagttaaatgtattataattagaacgatgtgagacttttgcttcaaggtcgttgagtgtgagaaatggttttctttgatgttacctggtaaagatgccatgaagcataagcatccgttgttgtttatgctcctttgacctcccaattcaagcctaattctgtttggcttcaggagctgcaaagtaacagtttttaaagcgaaatataaccacattcccaaagttctaaatagaaagaaaaaaacaagctttgaaatcaacaagataaggtggataatgggtacctctttgcaatcaagtgtctcagttagcgaggcacggccccatttttctgaatcaaggtttttgtgggctaaacgtaaaagatcttcgacatctttgatggatacaccattgtcatggaaaagcttaacaaagtcacagtcaattcaaacaccacatataagaactaagttaagtatgagcatatccatacttaactacagaataatattgtccaacatgaactttgatcacttcaaaaccttaacaagtcaatagtcaatgtatagatttcttagctacagaatcagtagctaagtatggatatgctcatatactaggttgttgtatcagaattgtaaaatttcttggcctggtttataaagtggtatgtgtttaaaagaaaaataaaagaagtaaaatgttatattcaagattcatggggcacattgtgaccagtaaaggactcgataaactcaacaattttgagggctttgggtgtggtcaaccgagtgaaactgtgcaaggaagcacgctcatgcaacttgaagttttaatgtatgtcttgttcgttttgtaattttaaatctctgttggctgcggtgtggtgtgtctccgtttagatgcagttttggttccggtgtgtcatgatgtagtgctaacctttaaccttctttataatcaggatatgtagcaatgctcctccattagctctaactcaccaaagacaaactttgtgcagccagttccacgtaaaaagtggggtttgtttgtattattacctgatgatatataatcggttgctgcttatttaacagaggatgcatgggcctcctagtttccgaacctgatgatgttcggtttcaagagctgaaattgaattgtaacagaatgatcaatatagttagaccagttgtcactattgttctgtagactcactatcggccacatatatacaaaggactagattctaagcatcactataaaaaaaccaataaactttcagagggtttctaataaactaaaagatttcaccataacagtggcggctggtgccacagctcacacgcctgtcttcatcaactcaggttccagtttcattctcacacggcatttcaatctctagaacgagggaacacatgcaacaaaagcctcaaagattaacctccaccacacggcaagagaactgcgatgaatagtcaaaggaatattcgattttctgtggaagcgattagtctttacagaagaattttcaagtcaagctttaatttatttcgaaaatatggagacaatccaatgatcaattcgtttcacagaaaataaataaaaaccaatcacagaaaaaacattctacagcaagatg

SEQ ID NO: 19876 - DNA, 3003 bp, Unknown; identical to SEQ ID NO: 19875
  misc_feature (1)..( 3003): 2750-1469P.txt file - cDNA_ID_1823529; gDNA_ID_2926158; Annot_ID_198574

SEQ ID NO: 19877 - DNA, 3003 bp, Unknown
  misc_feature (1)..( 3003): 2750-1469P.txt file - cDNA_ID_1823536; gDNA_ID_1620692; Annot_ID_48622
ctctcagattgctatgcccactttttcttcccttcttagtatcttccaccatttataatggccaacaatactagctcctatttcatttcgaaatttttgaacttttgaatcatcattcaattttgactataatttatgcaaatttattgcaaccactaaaattgttagaaaactcaacacccagtgctagtataaagagattatatatacaagggtttatatttctcttaataactagatattaattaactaatccattctaaattttgtgttaattgcactagctagtaaaacttaagctagcttaaaactcaacctcacgcttgacttgctgctgtgtacttcatagctgacatatagccttagcacttgtggtcggatagctaaaatgttatattaggtttttaccttaagaatatgtaaaattgtattgaaatatttttataacaaattgtagtgaaaaaaaacaacaacaaatttgatggtcgtaaagatatgacctcaattctagaacaaaaataaactaagtggctaaaaagaaaacaaaaatgaatggtcttattctgttgttaatcctctaaatctctaaaacaattaggtctgccaaaaaaaaaaaaaaaaaaaaaaaaaaaacaattaggtctgccattttgataatcctctaaataaatgtgggctcaattcctaccaaaacatgaaataattatgggcttaattgtccgtatggcccagttaccttataacttcccccccccctccccatggcccagttacctttcttattcagctatttcagagtcttttttaaaaaaaataaaaataaattaatttgagtctttgcgctgacttttgcttcctcgtgattttttttttttttttttcctcatgattctttctcttgcgcaaattcttcctccattgttacaggatcaaatttggatgacaattttaaaatcgttgcacataaacgtctcatttccatttatgtttaccatttttctttttttttaaatcaacagataagaattgtagtatgggtactggtagtggtgtgaggtctacgcatatacttgaattgtctcaagtctcaacaataaagagctctggaaccgacattttggtaatgtcagcaacattacatccaatcatattgttatattcatataaatagtattctcagcaacacctatgaaatgtacaactacaaactgattcaagaatactcaataatataacgactgtattcaatattccaaatataattcagcttgtatattaacattttaataaaaaaaaattggacgccactacaaaaataataatcatctttatcactacaatttgttagagactttcttgcgtatcaaattagatatacgaaaattttcaaggcaaacatgtaaggtagggtaatcacaaattattttcctacacaatgaatctagtgaatatatattataaagatgagggttttgttacatgctcaaagatcttggcgaccgcaaattgagaatttcttgttccaggtctggcagctttctgtgtgtttgtagcctagtaggggtcagctcttagaatcgtagttgtgatgaaaacagaattgtcgtagttgtcatgaaaacagaattgactaattaaaaactcttgatagtttcaaattcttttagaaccaacctccaaaaatcatgccgttcgttgattcatttcgttaccgaatttgattttatgcaaggccttggtcttatggacctgagatttaatgttgggcctcacatcaaacgacttttcaagatggattagtaaaaacagaagcacatattttttgctttaagaacttaaattactctgtttttgtatggatctttagaaaacctcaattgttttccaaaagtagcctaaaaagactttaagctcacgaacttaagtcacatggatttttgtaaataattaaacgatttaataaaactaatgaaatgataggaaaatgaccgatatacacaattgatttaaacaattgaattcgagtagttatgattttgataaaatgaaaaaggactgtttgttccctctatgatcctaaaaatgtcataaaaatgaaaaaggaaatatgaatttgataagatttacagcgaacaagacaaattggaaaaaaaggaaagaatgaatatacagatacgttaaaatgaaaaagatatttacgtcaatctattgattattaaaaggttaattttgtcattaaaagcaaaagtgctttgccaaaggcgtgctacgtcacgtaaattatacaacactatgagggctttttggtaattttacaggaataaagctaacctcataatatatcttctgcaattccgtccacccaaaacaactgacatggaaactactttttaagtttgatacaataaaataaatatacttatccggtcaacatttttattctgatgaagtaaaaatattactaaaataacgaaaaacacgttttctccaaatgaaaaaaacgaaatttacactgaaatgtttttttttgtaaaaaaaagatgtacttattcttttagtacattaataaattagaataaaaattttaattgattaaatcgctagttgctattaatcagaagagctgagctacttctaatgcttttttacagagagatgctttcttcttctttctctcgaactttctctctctaaatattttgtttcgttttctctctctctctctatttactttcgttctctctattttttttgtttggtttagcttatttgtgaagtgttaaatcttcttcagtttctggggaaattaggtggggaggtgaaaaagggggaaatataattgaaattgggttctctctgctgtgcaataataatttctgagaggattgtgaagaagcgcttttatgtaagaagatatctcattattagttatttacatgagaatctgacattcttaacaactgtctgtggggttagttttgtccaaagaactatacagagatg

SEQ ID NO: 19878 - DNA, 3003 bp, Unknown; identical to SEQ ID NO: 19877
  misc_feature (1)..( 3003): 2750-1469P.txt file - cDNA_ID_1823536; gDNA_ID_2926202; Annot_ID_141564

SEQ ID NO: 19879 - DNA, 3000 bp, Unknown
  misc_feature (1)..( 3000): 2750-1469P.txt file - cDNA_ID_1823543; gDNA_ID_1620693; Annot_ID_48633
atttgacgacagaggaggtactgtttctaattttccatacctttgctaatcaagtatttatgtccttctctacgccatggtaacgttttatttttctgttggtagattaaaattctatgcgatgatcttcctgtcttggggaagaatgacttcaagcatatcctaaagtaagaacagtattattgactccttcatggatctttttaatctttatgtctcacttgttaatttctaagcttttccaaggatgtggtagagctttgactaaaatgaattcagctattgtagaattagttagctgtaaattggttcggtaaagaacggtttccttagcacttcaagtttttacctatgctgttttgagtgctcaacccgataaagcactgtgtgaaatgggtaaacgggtgtccatgggtgttaggaattggcgtgtgggaaactactggttttgttaagactttagcatttgtcgtcatccatctatgcgtctagaaattatattagttgcttaatggtcattgaactctctattttgtagatggcgaatgcaaatcaggaaagctctgactcctgagaaaaaggaagttgctaaacctgagcctgatgtgggaaaggaagatgaggaaaatgaagatgataaactactcaatgaattggaagagctgacaaacacagttgaccgcaagaagaaacaggcaaagaagattcttgcaaaacgaagggctaaggttatttttaaccttatgataataacctatcaagtctttatgtcttagtcagtggccttagtgatggatcccttagactttatacttccttcactaaattcaatatcttttgccaggacaaggcgcggaaggcgactggtccacagatggatgtacttgaagatggtttcgtcgacaatgaattgttctctcttaatgctatcaaggtacttcatttttgataccatctctgcggaattttgtttattatgatggcattcgaagaagtgtttattactctttcattggttgaagagcattctcctttcaccctgctatcagttcttacaattcaattgtttgaacatatcattatattctgaatgagattgtaaagattttcatttattttctttacagggaaagaaagatctaatggcagttgacaatgatgaagatgataatggcaatgccgttgacagtgagaacgaagaccatggcgaaggagcttcagatgactccaaagacagtgacagagattctgatgaagaacgtcagaagtacgaccgctaaacctatacctttttgtagattatagagtgctgttacaagaacgtcgtatatttctgaagtttgtggagttacttcatcttaatagtctttttaacattacagatacactgaacaaatggaagagatttttgagcaggcatatgagcggtatatggtgaagaaagaaggaagcgcaaagcaaaggaagcgggctaggcaggcccatgctgaaaagctggaggtactatcattttcttaccccaatttcttaggatagaacagatttttggaactaaacacttttttctttttggctttgcaggaaggtgatggagatgaagaaatgaagatcgattacgattcagatatgaatgaagaaaaggatgaggcaaaccctcttgttgtaccacttgatgatggagtggtccaaacaaaggaggaaatatccaaccagtggttcagtcagaatatatttgcagaagccgtggaagaaggagacttgggaaaagatgacagtgaagacgaaatagcaaataagaaaaagagcaaaaatctgtctaaaccagacaagtcaaagcagaaggcttcaaaagcaagtgtgttgtctgatcagagcttgcccaatagctccaagaaggaagatgagtttgaggtagtccctgcaccagccacagattctgactcagattcatcctctgaagatgatgttcataccaaggccgagatactggcatgtgccaaaaaaatgctgaggaagaagcagagagaacagatgcttgatgatgcatataacaaacacatgtttgtagatgaaggtttaccaaaatggtttgtggatgacgagaagcagcacagacaaccaatgaaacctgttacgaaagatgaagttaatgcaatgaaagcacagttcaaagagatcaatgctcgtccagccaagaaggtggcagaggccaaggcacggaagaagcgagctgcccagaaaagattggagaaagtgaggaagaaggcaaacacaatatctgacacagcagatatatcagaccgttcaaaggacaagatgatagacaagctatacaagaaagcagcagagccaagaaagccaaggaaagaactggttgtgtctaagaaaggagttggggttaaagttggtaagggacagaagagagtggataggaggatgaagagtgatgataggaaacgtgggggaggaaagcccggtaggaacgggcagaagggcactggtaaagcaggccagaaaggaaaaaggcctgctgggaaacctcggggaaggaaacccgggtaagacctcaatgtcgaatgaggcgaacaggaagttttgttacgtattttaatttaagttttggcaattcttgacttctggatttacttgtttactctgataatctgtgttcgtggtgtcctaagttaaaacttagtggatctatctatcttgtttatcaaatttaccgtaatcgacaatgttcttgtaccatggaagttcctaatattcacatctggattgagaacagtagtttaataagcttccaatattgaacgatcgatttaaaaaaagttttctaaaaaagaattcaatttttccataaaaagcaaaaacacaaatgagtcaacaacacactttaacgcatttctcaaaattacgttgccaaagtctggtcagagctacaaatcaaatttgacagactgcaatttccaatccaacgactgcgaatgaagtttaatg

SEQ ID NO: 19880 - DNA, 3000 bp, Unknown; identical to SEQ ID NO: 19879
  misc_feature (1)..( 3000): 2750-1469P.txt file - cDNA_ID_1823543; gDNA_ID_2926187; Annot_ID_140858

SEQ ID NO: 19881 - DNA, 3000 bp, Unknown; identical to SEQ ID NO: 4260
  misc_feature (1)..( 3000): 2750-1469P.txt file - cDNA_ID_1823551; gDNA_ID_1620693; Annot_ID_48631

SEQ ID NO: 19882 - DNA, 3000 bp, Unknown; identical to SEQ ID NO: 4260
  misc_feature (1)..( 3000): 2750-1469P.txt file - cDNA_ID_1823551; gDNA_ID_2926187; Annot_ID_140856

SEQ ID NO: 19883 - DNA, 3000 bp, Unknown; identical to SEQ ID NO: 4258
  misc_feature (1)..( 3000): 2750-1469P.txt file - cDNA_ID_1823557; gDNA_ID_1620693; Annot_ID_48628

SEQ ID NO: 19884 - DNA, 3000 bp, Unknown; identical to SEQ ID NO: 4258
  misc_feature (1)..( 3000): 2750-1469P.txt file - cDNA_ID_1823557; gDNA_ID_2926187; Annot_ID_140853

SEQ ID NO: 19885 - DNA, 3000 bp, Unknown; identical to SEQ ID NO: 4256
  misc_feature (1)..( 3000): 2750-1469P.txt file - cDNA_ID_1823561; gDNA_ID_1620693; Annot_ID_48626

SEQ ID NO: 19886 - DNA, 3000 bp, Unknown; identical to SEQ ID NO: 4256
  misc_feature (1)..( 3000): 2750-1469P.txt file - cDNA_ID_1823561; gDNA_ID_2926187; Annot_ID_140851

SEQ ID NO: 19887 - DNA, 3000 bp, Unknown; identical to SEQ ID NO: 4255
  misc_feature (1)..( 3000): 2750-1469P.txt file - cDNA_ID_1823565; gDNA_ID_1620693; Annot_ID_48625

SEQ ID NO: 19888 - DNA, 3000 bp, Unknown; identical to SEQ ID NO: 4255
  misc_feature (1)..( 3000): 2750-1469P.txt file - cDNA_ID_1823565; gDNA_ID_2926187; Annot_ID_140850

SEQ ID NO: 19889 - DNA, 3000 bp, Unknown; identical to SEQ ID NO: 4273
  misc_feature (1)..( 3000): 2750-1469P.txt file - cDNA_ID_1823586; gDNA_ID_1620694; Annot_ID_48644

SEQ ID NO: 19890 - DNA, 3000 bp, Unknown; identical to SEQ ID NO: 4273
  misc_feature (1)..( 3000): 2750-1469P.txt file - cDNA_ID_1823586; gDNA_ID_1620694; Annot_ID_164877

SEQ ID NO: 19891 - DNA, 3000 bp, Unknown; identical to SEQ ID NO: 4273
  misc_feature (1)..( 3000): 2750-1469P.txt file - cDNA_ID_1823586; gDNA_ID_1620699; Annot_ID_164996

SEQ ID NO: 19892 - DNA, 3000 bp, Unknown; identical to SEQ ID NO: 4273
  misc_feature (1)..( 3000): 2750-1469P.txt file - cDNA_ID_1823586; gDNA_ID_2926208; Annot_ID_141854

SEQ ID NO: 19893 - DNA, 3000 bp, Unknown; identical to SEQ ID NO: 4273
  misc_feature (1)..( 3000): 2750-1469P.txt file - cDNA_ID_1823586; gDNA_ID_2926208; Annot_ID_202408

SEQ ID NO: 19894 - DNA, 3003 bp, Unknown
  misc_feature (1)..( 3003): 2750-1469P.txt file - cDNA_ID_1823594; gDNA_ID_1620694; Annot_ID_48642
cttgtcttctcatctcctacactagcaacactttccccacggttagctttaaagttctcttcttttactttgatttcgtgaaattttagcttggtgaagttggttttgttgttgaagcttatgagttggatttagtcacaagtatttgttaggttttcttaaagtcttcttctttctgctaccttagtgaatgtactgatgtgatctttaggatttgagagactcagagattcatgtaccgtagcaatgttgttgatctgtttaatgatcttagaaagagtgttaggtaactttctgtaaggagattttgtagctgatgttttagtggaattttctatgtgacaggattatgtgccaactgtgttcgataatttcagtgccaatgtgattgttgatggcaacactatcaacttgggattgtgggatactgcaggcaagttgttaccttggatttttttgtcttttgaatttcctcctcttccagagagtcatttgtgtttttgacttggtgaaacagggcaagaggactacaatagactaagacctttgagctatcgcggtgcagatgtcttcttacttgcattctcacttgtcagcaaagctagctatgaaaatgtttctaaaaaggtttgatctgtggtcttctcctgaaacttctttcctgttttattcagtttacattcagtgattctgatagaatacatttggtatcttgcttttgattcttagtgggttcctgaactgagacattatgctcctggtgttcccatcatcctcgttggaacaaagcttggttggttttttcttagctcaactcttaatcgcctgattatcgggggttttctgttttggggaactcttctgatattttgatgactgagtctcgtacagatcttcgagatgataagcaattctttgccgagcaccctggtgctgtgcctatctctaccgctcaggtacctttctcattatctttctaaactgaatcctaggtgttaatattctgcatgtttcatattttgatggtatcaaaacagggtgaagaactaaagaagctgattggggcgcctgcttatatcgaatgcagtgcaaaaactcaacaggtattaacctgagagtcaatatctttatctaatctttacctgtctaaaaccgccaattgaatctgctgatgattcctatatctgttatctgttcaacagaatgtgaaagcagtgtttgatgcggctatcaaggtcgttctccagccaccaaaaaacaagaagaagaagaagagaaaatctcagaaaggttgttctatactctgattcaacaagaagaaaggaatcaacaggagaattagagctataagtatttgttttctcctttttcataacttgtttacccaaggaatcaaaaatctgttgtttgtagtctgaaaatgacaaaagttgaagaactagtaacaagtatttgtattcttgtttgcattttgatctgtaaatataccacgaatccttgatttctctgtttcctagattcacaccaattgtcttaaggattatgttccaaacctaaagacaatgagagcttacacgcgcgaaccaatgagaatgagagagcacttgtctttcttggacaatagtatctaaaccagcttatttgaaaccttctgaatgagccagagtgtcttccatacatatcaattccacatagacctaacctgatctttagactataatcttcaatgatttcagaacctcaaaacttttgattttacatttttaatcaaatttatttgatattcattttgcttattgactagacgttttccccttggagataatagaatgattgattttaactctcaccggaaaagacaaaaaaaaggaaaaataaatcattgattaaataaaatttatggtgaataagcttggcttctctttaccaaacatatatgtttgttgatcaatctctttctttgcgttatctgccccttgatttagacccacgtattattcgattcctaaactaattgaaatgattagatatgtgtcatgacgtttagtgaactaatattcacctaatatgtctttcaatcacttaagaatttgcattattcttgtgaaaaacataaattcacatgctgctagtaaaatatgttaacaaatcaattaaacatcagaaaataataactgagatcttcataaagaaagtggaagtttttttaaatatatgaagaagaaaagtgcgtagtgtgcacgggacttagttcatttaattctcgagccattgccgtacggaggaggctgccttcaaggcttaagtcgaggcgtgttcgttacgtttaacccgcaatagccggtggctacacactcacaaatcccctttgactcaccggatatcgacggtttcccgctattttttcccctaactaactttttttccttttcttgtaaaactcttaaaaacaaaactcggtgttgtctctttgtttgctcactccttttctttctctctctcgccgacactttcattctcacttgtgttcgtacgtaatgttcttgatccggtaggtttttatttgattataaactcatttcatttaacaaattgagtccatctctctatgattcacccataagatgatagaagaagatcaacatttacgtctgagataaatcatgtcctttaatgtatatttgtttattttctggtcaatcatcgatctttcttagtcgtagcagttacacaatgctgatggtacatggcggcagattttcgattcttattatttaaagaccaaatttaataatagatgtatgtacaacgagttttggtatcactatcttgtccggtaatgctcattgtttatcttttaaatctacgtcttcttctgcataattgacacaaatcacttgtttcaatggagtttttgtttgtttgatttcctctgttacttatgcagcaaaagaagaaattgagtttaaaggagaagtgtgagaaggaagtttcaggaagatg

SEQ ID NO: 19895 - DNA, 3003 bp, Unknown; identical to SEQ ID NO: 19894
  misc_feature (1)..( 3003): 2750-1469P.txt file - cDNA_ID_1823594; gDNA_ID_2926208; Annot_ID_141852

SEQ ID NO: 19896 - DNA, 3000 bp, Unknown; identical to SEQ ID NO: 4271
  misc_feature (1)..( 3000): 2750-1469P.txt file - cDNA_ID_1823598; gDNA_ID_1620694; Annot_ID_48640

SEQ ID NO: 19897 - DNA, 3000 bp, Unknown; identical to SEQ ID NO: 4271
  misc_feature (1)..( 3000): 2750-1469P.txt file - cDNA_ID_1823598; gDNA_ID_2926208; Annot_ID_141850

SEQ ID NO: 19898 - DNA, 3003 bp, Unknown
  misc_feature (1)..( 3003): 2750-1469P.txt file - cDNA_ID_1823608; gDNA_ID_1620694; Annot_ID_48635
gaaagaccttttttgacataaaaagggtcagatgaaagtagttgcttgagagttttgttatcatgttatgaagcagtgaccagtgagccaaagttgctatattgtattgatattctgttagaatcatattccaaatctacggcaaaaaaaaaaaaaaaaaaaaattcgaaagagttggaaaaaagttctagttacaaatatttctctaattacatctcgggactgataccgactagtgcataccacaaaagaaaatccaatattgtacttaccaatgaaatggaaagtgatagaatgtttacccgctgagttacttcatcaaaaaatggtcgtatacattgcgcgcgcaattacatgcaacatgtctttgaccgtaaatatcacattaaaatagaatgacagtcactttctgatataatatattaatatacaccaaccagcatgactaggatcaaggtgtacaacaattttttttttgaatttatcaaattcacacaaaacatatcgtgtacaactctaacgtacgtttcacatcggctaagccttgtatttctttatttgtagcttgtacggaacatttatagcttgcaacactgacaattttgcagattagttgctttgttctgataaagatggtttaagaatttagttattccgcggtttactttcgtatggaatacagcagataccacaatttaaggtaccaacttggaaagagtcattcggatcatcggatgagacaactattttcatcgaccaagtaaagaatatttcatcgatcggtttagttttgttaaacataattgcagtatatgtgtgttaaccgtcaaaaattagagtgccaataaatctttttttactctaccaattaaaaaaataaaaaaataactggaagtgaagaaaatatcatttgcaaaataaattaaataaaacgtaacgtacgctaatatggaggaggaatttcggaatttcatcagttctttttttgaagcttatcgacaacgcctgacggctttgctggatgaaaatatagctggataacatttatttttaagaagaacaaaaagtgtaataattatgtgttgtatagcgattgtaattcatgttatccttagccgcctccttattattatgtaagcaatattttctttggcaaaatgaagttctaataatctaatccaagaaaattcgtaagttactctatcctgtgatacaaattcagacacgcatgaataaaggagattaaaggttgcatgtatctttaaaaaaccatcatttctttcaacgggttaaaaatgagttattcacaaataattgttttgcattgcataattagattgagttatatatgttattcgattccgtcaggtttacatgatcagatcagcagacaaaagattaaccaaaaaatgaacgtcggtggattacagattgagaaacaaaaatatgttcaacaaagtcgtgttgtatttgacagcttaaaccacttgccagatgtggttaatgataagagcgatgtatatttgatggggccaatccgggattttatacagtaagtgagtgataaggatatgtttctttctatcagctagtgcataaatattgtgggctaaattatcacaaattgtcgaataagtgatatgatttgtgggcgaggttatcacagattcacaatttgcttatcacaaaagatatttttttgtttgttttagaaaaacaaattatttgtatggtatcacaaaaagacatttgtgtatgttaatgttgtaggattccaaaaacgacttcataataataatataatgatcattaacaaagaaaatgtggcaacggttgagaatgaaggacaaaaatatttaataaaataaaaaagataatagcatgtactagtagcaaacaacataaaagaaatgagtaactatcgctttaattaaaagtgggactaaacatgtctctagactattgaaatattcttattgatttgaattttcttattgtaaagataactttgaaattcactctttaattattttcttaacgagtttttggaatggatccgaatgtatatatatatattgatttgtgtttctatttatctaagcttgtggtaactttattggcgatggttaataaaaaacacgttgggtgcgtatatgcaatattcttgatactcgaattcattcctgaacatgagatattaagataaacgacctactacttcgtgattaaaaaacataagttaaaatttaaatgtccgaaggaatcatagttaagtgacagcatttaagttgtctaaaaattgccatttgccactcgcatcaatttgtaattttgcaaagtgcaattttatgtctcaagatttgtttcgcagtaagtaatgaaataacataatcaatgttctaacaaaatatctcacctaccagccacacgagtgtcaatttagtttacatttgaaccagagacctaaaagtttgaactaccaaaataatgattttgccgacaaaataggaaaactaagaaagtagtaatgaatatcagatatctgtttcttcagatcaaagcctactaaggaacgcaaaaatatataactaaacaaaattgcgtaaatttagaaacagtgattaaaagcccatatttgattcaatagtaattgaaaacagcataagataatggcccattagccgttatttaggcccgttatcatatcacaaaacaaaacacgaatcatctacgacgaagacctgaaaaaacacactgcaattgagatcgatttcgactgtaagtgaactttgattgccgcgaagattactcaaatcgccggacacaagtttttcagtgaattccattggcatagaactcgagagaaagagacacagagagagagagagatctaacaagagtcaaagtttctgactttttcgcattctttttgagatcgagttctgtttttgttggcgtgtgagatgaattcttaagaaggaagaagaagaagaaggaaagatg

SEQ ID NO: 19899 - DNA, 3003 bp, Unknown; identical to SEQ ID NO: 19898
  misc_feature (1)..( 3003): 2750-1469P.txt file - cDNA_ID_1823608; gDNA_ID_1620694; Annot_ID_164868

SEQ ID NO: 19900 - DNA, 3003 bp, Unknown
  misc_feature (1)..( 3003): 2750-1469P.txt file - cDNA_ID_1823608; gDNA_ID_1620624; Annot_ID_162452
gaaagaccttttttgacataaaaagggtcagatgaaagtagttgcttgagagttttgttatcatgttatgaagcagtgaccagtgagccaaagttgctatattgtattgatattctgttagaatcatattccaaatctacggcaaaaaaaaaaaaaaaaaaaaattcgaaagagttggaaaaaagttctagttacaaatatttctctaattacatctcgggactgataccgactagtgcataccacaaaagaaaatccaatattgtacttaccaatgaaatggaaagtgatagaatgtttacccgctgagttacttcatcaaaaaatggtcgtatacattgcgcgcgcaattacatgcaacatgtctttgaccgtaaatatcacattaaaatagaatgacagtcactttctgatataatatattaatatacaccaaccagcatgactaggatcaaggtgtacaacaattttttttttgaatttatcaaattcacacaaaacatatcgtgtacaactctaacgtacgtttcacatcggctaagccttgtatttctttatttgtagcttgtacggaacatttatagcttgcaacactgacaattttgcagattagttgctttgttctgataaagatggtttaagaatttagttattccgcggtttactttcgtatggaatacagcagataccacaatttaaggtaccaacttggaaagagtcattcggatcatcggatgagacaactattttcatcgaccaagtaaagaatatttcatcgatcggtttagttttgttaaacataattgcagtatatgtgtgttaaccgtcaaaaattagagtgccaataaatctttttttactctaccaattaaaaaaataaaaaaataactggaagtgaagaaaatatcatttgcaaaataaattaaataaaacgtaacgtacgctaatatggaggaggaatttcggaatttcatcagttctttttttgaagcttatcgacaccgcctgacggctttgctggatgaaaatatagctggataacatttatttttaagaagaacaaaaagtgtaataattatgtgttgtatagcgattgtaattcatgttatccttagccgcctccttattattatgtaagcaatattttctttggcaaaatgaagttctaataatctaatccaagaaaattcgtaagttactctatcctgtgatacaaattcagacacgcatgaataaaggagattaaaggttgcatgtatctttaaaaaaccatcatttctttcaacgggttaaaaatgagttattcacaaataattgttttgcattgcataattagattgagttatatatgttattcgattccgtcaggtttacatgatcagatcagcagacaaaagattaaccaaaaaatgaacgtcggtggattacagattgagaaacaaaaatatgttcaacaaagtcgtgttgtatttgacagcttaaaccacttgccagatgtggttaatgataagagcgatgtatatttgatggggccaatccgggattttatacagtaagtgagtgataaggatatgtttctttctatcagctagtgcataaatattgtgggctaaattatcacaaattgtcgaataagtgatatgatttgtgggcgaggttatcacagattcacaatttgcttatcacaaaagatatttttttgtttgttttagaaaaacaaattatttgtatggtatcacaaaaagacatttgtgtatgttaatgttgtaggattccaaaaacgacttcataataataatataatgatcattaacaaagaaaatgtggcaacggttgagaatgaaggacaaaaatatttaataaaataaaaaagataatagcatgtactagtagcaaacaacataaaagaaatgagtaactatcgctttaattaaaagtgggactaaacatgtctctagactattgaaatattcttattgatttgaattttcttattgtaaagataactttgaaattcactctttaattattttcttaacgagtttttggaatggatccgaatgtatatatatatattgatttgtgtttctatttatctaagcttgtggtaactttattggcgatggttaataaaaaacacgttgggtgcgtatatgcaatattcttgatactcgaattcattcctgaacatgagatattaagataaacgacctactacttcgtgattaaaaaacataagttaaaatttaaatgtccgaaggaatcatagttaagtgacagcatttaagttgtctaaaaattgccatttgccactcgcatcaatttgtaattttgcaaagtgcaattttatgtctcaagatttgtttcgcagtaagtaatgaaataacataatcaatgttctaacaaaatatctcacctaccagccacacgagtgtcaatttagtttacatttgaaccagagacctaaaagtttgaactaccaaaataatgattttgccgacaaaataggaaaactaagaaagtagtaatgaatatcagatatctgtttcttcagatcaaagcctactaaggaacgcaaaaatatataactaaacaaaattgcgtaaatttagaaacagtgattaaaagcccatatttgattcaatagtaattgaaaacagcataagataatggcccattagccgttatttaggcccgttatcatatcacaaaacaaaacacgaatcatctacgacgaagacctgaaaaaacacactgcaattgagatcgatttcgactgtaagtgaactttgattgccgcgaagattactcaaatcgccggacacaagtttttcagtgaattccattggcatagaactcgagagaaagagacacagagagagagagagatctaacaagagtcaaagtttctgactttttcgcattctttttgagatcgagttctgtttttgttggcgtgtgagatgaattcttaagaaggaagaagaagaagaaggaaagatg

SEQ ID NO: 19901 - DNA, 3003 bp, Unknown; identical to SEQ ID NO: 19898
  misc_feature (1)..( 3003): 2750-1469P.txt file - cDNA_ID_1823608; gDNA_ID_2926208; Annot_ID_141845

SEQ ID NO: 19902 - DNA, 3003 bp, Unknown; identical to SEQ ID NO: 19898
  misc_feature (1)..( 3003): 2750-1469P.txt file - cDNA_ID_1823608; gDNA_ID_2926208; Annot_ID_202399

SEQ ID NO: 19903 - DNA, 3000 bp, Unknown; identical to SEQ ID NO: 3817
  misc_feature (1)..( 3000): 2750-1469P.txt file - cDNA_ID_1823625; gDNA_ID_1620695; Annot_ID_48667

SEQ ID NO: 19904 - DNA, 3000 bp, Unknown; identical to SEQ ID NO: 3817
  misc_feature (1)..( 3000): 2750-1469P.txt file - cDNA_ID_1823625; gDNA_ID_1620695; Annot_ID_164921

SEQ ID NO: 19905 - DNA, 3000 bp, Unknown; identical to SEQ ID NO: 3817
  misc_feature (1)..( 3000): 2750-1469P.txt file - cDNA_ID_1823625; gDNA_ID_1620666; Annot_ID_163933

SEQ ID NO: 19906 - DNA, 3000 bp, Unknown; identical to SEQ ID NO: 3817
  misc_feature (1)..( 3000): 2750-1469P.txt file - cDNA_ID_1823625; gDNA_ID_2926190; Annot_ID_141018

SEQ ID NO: 19907 - DNA, 3000 bp, Unknown; identical to SEQ ID NO: 3817
  misc_feature (1)..( 3000): 2750-1469P.txt file - cDNA_ID_1823625; gDNA_ID_2926190; Annot_ID_200991

SEQ ID NO: 19908 - DNA, 3003 bp, Unknown
  misc_feature (1)..( 3003): 2750-1469P.txt file - cDNA_ID_1823629; gDNA_ID_1620695; Annot_ID_48665
gaagtcctgacgtgacatggctcagtcaacgcaaatactactcaacttagagacgtagctggcctgtatctaattgttttaaggcccatatacggcccacgcttccattttcttaagtatgcttttcgtagtggactgaaaccttttcttgtctattttctccaagtcgattccttgatgatcgatcgagatgaacctctatcgaacagaaacttcgtttctagaaattaaataagcctccatgaacaacagttttttcttttttttttcttttggctactagtattcaaaatctttaacatattcgcaaatttgttaataaaatgtatttcactaggaaaatagagattggaatttggaggcgaaaaaacattagtttacaacaatagtagttgaagccaagatccagagttttcctattgattttaagggtccggtttattgtaatttccgactattttttagtggaccaattatttggcaagtaagaagtttttttaaaaatatagaccatatgtgtataatagtgaccggatggcccaaactgacatgtaccaatagaaaatgaagacctaattttggcacatgaacgtaacaggtataagatcatcgttgtctctagcgagagagctctgtaatgcttacacttcaacgtggagactgtaagagatacgtgtaccaagaaacgtgaacgcaaagaaggaaaggaaagaaaaaacgtgtacaaaaagaggcccatgttaatcatcatcccttaggccttcttagcttatgcattgtctctttgctagtctttttctcacaatcgtgtcgatatattttaagggtttttaacgtgtggtttttctgtagggagcattagtagaattattgattggttttattcaaatatagaatatatatatatatatatatatacataaaacatttattgatggatcattgaatgttcatttgttcgttacaacattttcttattcaaattttatcgatccttgaatcaaagactttgacataagcgaaaccattggttacttctctaaattaaaatgaaatggtagtcttctaataaatatatatgtttaacaaacaaattggcataatttgatcgttctaaccaaagataggatttcgaatccaaattggatgggatgactagactattagatatttagatcgatcaccaatcaaacaaaataggcgtgcttttatattcattaagctggtttaaaacaacaaacaatccagcatttttaattttagtggttgaatagttaagttaataaaatcaaagataaacagaaaacaaacagctagtttttcaaattttggcgtttaattttatttggaatatttttttttaataaaacacacaaaaaaaaactcttttgacaaaaattggcatcaatactgcatatcgcatagccccatacatacatgatacatgccacatctcttaaaagatgagaacaagaagggatgtatttgaactattctgacaatattatatatacacacacattttgaatatgaatctctcttcttcaaagttctgacttgttccaaaattcttatccacacaatggaggaaaaaaagaaaaagaaaagccacaataatgagccataaccacaaccacacccactcaccagagactttgtgtatccgtggctctcatcatgacatctcatcttcctttgattcttcacaccaccgtcgatcgccacgtaggatttccccaaatcaaagcattccacataagcacaatcttttatgtggccagagtttaatcaacatttgtttttcttacaatgggttcgtgagagccacaaataaatcaactatacgattaaataaccatatctaacaaaaaaaaaaaacattaaacaattatagtccaagtaaacaaatactcgcctactatgtaccatattagaaagttttttattctcccccaataccgatatattattttgtaatttaaaaattcattgttatcttatcctcgcaagaaacacagatgttttggatcagtttgggaagcgaagaagtatgggagagaagtaaaaaacaaaacaagtggtttataaaaaaagagggaaagataattgaacaaagatacgtggggcccattaaacttgtgttatggtccagacaaatcccaggtgggctcacgtggctacgaagcccattgagaacctgattcgtccacgtaggacgggacagaatctcgctctcctccttccccggctgagatctcgccacgtcatcgactaaataaatctctcccaaaaaaatatctcgaaactgaaccatgagtttgtcgccacgtacaaacggggtttggctttggcccatacgcattaataactggttttcaaaaatcatttaaacttatttatcctaataacgcataattaatgtgttttacttaaactgtaatgattctaagtagaaaatgtgaaacagtattttttatccacaagaaaaaataaaacacaaggataaagctaaaaacaataaagaaaacattactgactcaagtaatttaaataattgcagcagatatagatctgataattatccaaacaaaaatctcaaataaaggttaaagtgataaacccatctctaaagcaaaaagatttttaagttgaaccaatccttaattgattaaatactatacgttattacaaagttaaattgaaatgaaatggatactaaccacagaataaaaaaaaaaggaaggtgctatataaaatagagtcattgtgaaaccaaagaagagaaatagattttttagcagaaggcagaaaaagacgaaactagcctccaaagaattgttgaatcacagaaaactcgccacgaaaaatatcccaaatcctgcaacttgcactttcctattcttcttcttctttccttatctctccaaggaaccaaagcatagacacaaaacgaacaaccacagaaacttgaaagagagaaagagtttgattttgattaaaatg

SEQ ID NO: 19909 - DNA, 3003 bp, Unknown; identical to SEQ ID NO: 19908
  misc_feature (1)..( 3003): 2750-1469P.txt file - cDNA_ID_1823629; gDNA_ID_1620695; Annot_ID_164918

SEQ ID NO: 19910 - DNA, 3003 bp, Unknown; identical to SEQ ID NO: 19908
  misc_feature (1)..( 3003): 2750-1469P.txt file - cDNA_ID_1823629; gDNA_ID_2926190; Annot_ID_141016

SEQ ID NO: 19911 - DNA, 3003 bp, Unknown; identical to SEQ ID NO: 19908
  misc_feature (1)..( 3003): 2750-1469P.txt file - cDNA_ID_1823629; gDNA_ID_2926190; Annot_ID_200989

SEQ ID NO: 19912 - DNA, 3000 bp, Unknown; identical to SEQ ID NO: 4300
  misc_feature (1)..( 3000): 2750-1469P.txt file - cDNA_ID_1823632; gDNA_ID_1620695; Annot_ID_48664

SEQ ID NO: 19913 - DNA, 3000 bp, Unknown; identical to SEQ ID NO: 4300
  misc_feature (1)..( 3000): 2750-1469P.txt file - cDNA_ID_1823632; gDNA_ID_2926190; Annot_ID_141015

SEQ ID NO: 19914 - DNA, 3003 bp, Unknown
  misc_feature (1)..( 3003): 2750-1469P.txt file - cDNA_ID_1823636; gDNA_ID_1620695; Annot_ID_48663
tttttgttttcgcagaaaatctagctccaaattgttgttatagctagctcttcgagaatttttagtcaacgacccaaaacttattaatttatatttctgccccttaacttatttttgatccagtaaaccaccttaattgtaaaagcttgactagatagctcctaattaacatatctccttttattcatggaaagattaagcattataatcaacacatcattgatagtgcttaaggatgatgatttttttgtgtgtgctacaaatcgatattgtgatacagtcatcaccagtctagtttatgaatttttttctttattttatatatgttcaacacatctgatcaaagatataaactgaagtgtaaaaatagtatcaagtactatgattaaaagaattatgtgaatggtaacattaatggaaaaattaagaaaaaggtaacaaatgaatcgaattaaataaaagaggaagggatcccaaatctctccagtgtcaatgccggcgcgtgaagccaaactcctcctcaatgacctccgtgacgagacaccgcgacgcttccatcaaatcagggctaagcctaaacatcaacacacaaaactccatctgattcaacgcaccgtcgcagtcaaaatcaccttctttaatcatacaccggacatcttcatcagtcaaatctcctaaacccagaaccgccgcagcgttacgtcggagactctcgaacgtgatgacacctttctctctgtccatcaaaagctcgaagccgttgcatagctctccgatcagaccttcaccgcctaggtttccggccatggtaggaagaaaatcgtggaaattgggttgtgggttttgttgggttggtcttgtgggtgactttggtgacgccattagagcttatgttgtttaaaaatctgaaatttggttctggttaaggaaggtttgtttttttatcgttgttattgatttgaggaggagaatgaggagtgaatgagaatataaaggaagagaaattgggatttctgagaaggaacatccatggaagccagctaagattaatgagggaaggtcccgtgtctgggaaattgcgattaatctctcagattgttggtatgtggtttcttcgaggaaggtcgcttttaggggtaatatcgtcacttcgtaaagggatgtggaaagctcatagtgtgaaaacggcgagagatggagggtaaaatcgtccgtttatattaagaaatagaaagagtaaagtaatggaaatggaggagttgtttgtttgttcctttgtttatttatgggaaatttccaccactttcatcggcaagtgacttgagtttgtttatttgattgattatcgaaaatatgtttctttctttttctttaaagattaaggtcggctcgacttaaaattactctggaattattcaaatactggttttgcctgatcacacagttttttttagtatagattgtagttactatttcgatttttggagatgggtatgtttaatgatatttactactacaaattacttttgtcaaagttcacgaaatgtgtaattagtttaagttttgttataacttgcttcaaaaatatgtttttatctcagttagttttgaaaaattaaatagctgtggaatgcatcaacttatccatgacattcagttttctagactttcgacttagttgtgcccaaaaaaacaaaaaaaaaagactttcgagttatgacttgcatgcaagttgcaacttcaaacaaacgaaatatcaaaggtttgactaacatttactataacttggtatgtgacatttctatgcatggtatttgattaaatcaaatgttggtgtcccttattcaaagacatcgtcagcaaaactaaatgcagcgacataatattctactacttggtctgcccgttctctaattgcatgtctctattttaatttatatataatcaaaccaaaatcttgcttattggataaccattgtcattatttcatgattcatgtactatttaaccgaaaatcgcagttcaataatgcttattcaatgcattaaaaaaaaaaaaagagtcaagttcaaagaacgaacattaaatcatgattcctggctaatgatatctttggtcttactcttgcctcttaatgagcttgtcttcttaatgctgacaaaccattgtgctcttattaaaacctctcataaataaaatttgctattgaaatattaaatctgttgaatcatgtttatctaagatacagataaaaggtatcgtaacatttaaactgtctcagaattgataataacctattttattgtcacaaaattgaaaataattcatcatatatttgaaagtgtacattatcttcttaatccatgcggctcattttttgttttcttagattacgtggaagctttactaacagataaccatgggccggcccacatgctgaatcagcaacactgatcgtggcggattttaactaagtctggtcgagaaagcccgtcgcaacattttagttttatatgagtcggtcaacaaaatgctaagctgtggattgtttttttgttttgaatattcaatggtttctgtctttctgagcttactttctttagattgagaagctccccactaaactttgtttgatgttttctttatatcttagttaaattgcattatttagttccaattgacaagtaactttgcatctccattgaatcattccaccatttgtcctataaaacacgtataaaactacaaatatataatctctaggcacgttgtggttgacattaagagcaaataatatcacgacgcaagatactggacagcaactcattacaattctcttccatgtctctctcatttacacatattaaactatattccatggaacctaacttaaacaattttctctatatttccagtaattaaacaaataaaataactgactatcatcattgtttatataccaacttcgtttccacgctctctggttccacagaaccggccatg

SEQ ID NO: 19915 - DNA, 3003 bp, Unknown; identical to SEQ ID NO: 19914
  misc_feature (1)..( 3003): 2750-1469P.txt file - cDNA_ID_1823636; gDNA_ID_2926190; Annot_ID_141014

SEQ ID NO: 19916 - DNA, 3000 bp, Unknown; identical to SEQ ID NO: 4289
  misc_feature (1)..( 3000): 2750-1469P.txt file - cDNA_ID_1823640; gDNA_ID_1620695; Annot_ID_48661

SEQ ID NO: 19917 - DNA, 3000 bp, Unknown; identical to SEQ ID NO: 4289
  misc_feature (1)..( 3000): 2750-1469P.txt file - cDNA_ID_1823640; gDNA_ID_2926190; Annot_ID_141012

SEQ ID NO: 19918 - DNA, 3003 bp, Unknown
  misc_feature (1)..( 3003): 2750-1469P.txt file - cDNA_ID_1823644; gDNA_ID_1620695; Annot_ID_48660
aaatatttatgtgtaaaactaattatatgcatggtttcatttttttcattggatgtgaggaaacagaatgatgtcgaggaaagaatttactaatgggataccaattaataaaacaaaaaggattttacttatatttttcatcacggtgctcgtatttttcatgtagttctgaagaaaagagcatgaccatctcttatgatcaagattcaagattgctcaagatgagtgactaattagatttaatataagatttgaggaagaaaaactaattttgaaaacgttaggaaaaaaaaagaaagaagaagctaaaaaccaccggagatgatattaaaagttaatggtcaaaggacttaaatgactgtcggtgtctcccgccgacgccacaggcttccgtatattattattagcacaacagaaactgtgaaagagtgtggagagtacggaatttttttcttttcagaatatcgaattccaaaaacgtcctttgtcaacgttgaatattacacatctgcatccttagtgcacctgctcacacctgattttcggtggagggaacatccgcgtggcatgttgggataatctgtgtgtatgaactaaattcttaaaataaagagaatttgtaatagatgatgaccacaaaagtttcaatatttttggttagtttggatacagtcagaagaattagaggagtaaaaccaggaactgtcaatattttcaagaatgatcatcaaagattcaaaggttttttctattaaaaagttatgtattgtacaaacagagtatacacaattttgtcattttcctacactattactgcttttaatcaatgataatttacctttttcttctcctccataccacaaaaacctaatgtatggaatttacttaaaccacatttataatgttttccaaatatattattaaaaacaaatgttttccaaatgttgtaaagctaaaagatgtgcgacagttgaaactactgatatcgggaaattaaagtacaaattttctatatcaaacataatatacaaccatagagccattagtcaagcaacttaccaaagtatttgactcgtgaatacaaagaagaaattaagagtcttacgctatgtagacgttacgtacatgttaatctgttaggcaccgattttaaaccatatcagattacagcacacatcagccattagattctacataatctcaattcaattatatgtttaataaacaattacctgaagttttgagaattcggtttctctatatatagaaacaccattcttaggtatacttttctagattaatgttcgtaaacaacataacgaagcatgtccaaaacaaaacactaattagcaaaacaaaaatgctaacccatcatcaaatggctattttcacgattagtaagtttcagttacgttctagacactaaacaatatgaataatattttaatatgacaattatctaattaggctggtgagcttatctagagtttcacgttgaatgtgtttaaatacaaatctagaaaaaaagaaagaaagaagctgaaatatccaaaaatatgcgttcacacccaacaaaatgttcaaatctactcaatttaatttacatggatgatgagaaaagcaattcaaaaaaaaaaaaaaaaatcagttcaaaataaacaacgtgaaggcaccaaactagtagaaataaaataaagatcaacaatccgtacacgtgtcaacctatcaagtttggagtccagctgtctggtccccccaatatacacacacctctaaaaacttattctcgcggagatgacactgatttggccaaaataccgcgagaagttaccaatgaacgccgtttttaagagatggttttcaattttttttgtttagcttaggctattaaaaaggtttaaagttggttgccggtgatttgtgggacaacccgtacgtgattactgcggattaaccggatattgccggtttggtagtgctggtcaaccggattataccccgttataaaatccgtgcccctatcgatcgcattccctgttgttatggacggacacaccccttatttaattatcgtattaagtctgattgagatagttaattacttatattctccatgatttagattactgtttcgaataatttagattatgtagtatggaggaatgatttgcgtattttacactgagtattgcatcaaacattattgtggaattcaaattttaaaccctatgtatttaacttaattaaacattaaatcattatgaaaccaatatatatatattttagtaatatatataagttaattactccttatcatctgacgaccaaatgtctcgaatataatctgttgtcatactcgtaccaactacactgcaattataatggatacttgatgaataataacaattcaacaagtgagatttttttcatttgtaaatgcaaacaaagtaacaaactggtggttcattacaaaatcttcacaattatatatatgcttaagtcagctcaattatatgctaagtctaaaatcttcatagcaattatagtcacatggaattctctattaaagtataagaagaaagaaatggtatgaatgaagaatgatatagttagagaagtcattattattagagtagaccatctttatccatccggtacaggttttgaccaatacggaaagagagaaaaagagtcgcaatccttttttttttgttacgaaattaaaattatataattagtgcaatttaaagcacgaatagtaagcgttcacttaattcctcgattaactgattagcatattacgattatacccttcatcttccttattgtgtctctactctctactttcaccttcctttccttccattctcctctatatatatcgaccctttctctttctttcttcctcacacactaaaagcttgcaaaaaccataagcttatctacttactcatctctctcacaaatcattttctcagacttctctctttctcttaaaccatg

SEQ ID NO: 19919 - DNA, 3003 bp, Unknown; identical to SEQ ID NO: 19918
  misc_feature (1)..( 3003): 2750-1469P.txt file - cDNA_ID_1823644; gDNA_ID_1620695; Annot_ID_164912

SEQ ID NO: 19920 - DNA, 3003 bp, Unknown; identical to SEQ ID NO: 19918
  misc_feature (1)..( 3003): 2750-1469P.txt file - cDNA_ID_1823644; gDNA_ID_2926190; Annot_ID_141011

SEQ ID NO: 19921 - DNA, 3003 bp, Unknown; identical to SEQ ID NO: 19918
  misc_feature (1)..( 3003): 2750-1469P.txt file - cDNA_ID_1823644; gDNA_ID_2926190; Annot_ID_200984

SEQ ID NO: 19922 - DNA, 3003 bp, Unknown
  misc_feature (1)..( 3003): 2750-1469P.txt file - cDNA_ID_1823668; gDNA_ID_1971851; Annot_ID_58420
aggctacaggagctccaaacaaccaatgagtcagagaattctacactttcgcaagtcatgaactagattcgaaaaagaaagtttactccaggacattaaattggcaatggcactatttaagaatcccttaattgtatctcaaccaaatgtgacattatttatgtagctgtatattgagaatcataagttttctagcactccacgttatcatttttctgaaatgcatttttttaatggcacaaagtagcaagactttcaagatttgaaatagccatatacctgcggaataatgtttttctccatgacatctttgaaaagaggaggcggtggcaaatctagcccaagcatcagaaacggcatcctggagatttctttgttttcattgccttgatactctttcacaacctccaactcaccctgtaatggttaacaggttacatgagatacagcttttttgtaagaaattatatcaaactgcattatgttgacatttcaaaggacggacacatacctggaagcacttgtggatgatactgctagcgtcctttgaagttctaagatccatgtgcaaagtgttgaggagccacgacataaactctactggatctgattgttggccaatcctaaagcgtttcttgctggctttcatgacagcttgcaagaactcatgtggactcacctgttgatgcaaggtaacttaaattagcgaggtcctcaataggtgagtgcataacaaaaactaaaaaagtgagaggcataaattgagtcagacttgtcctttaaagtttcgagcatgccaaatcttgcgagttagttccccaaaacggtgaccaagaggagacttgcagtgctgataattttcaggaatgaggaagaaattccttagaggagtaactctcatcaacgactggattgtaacattcacaaactctgtcttttgtatgttgttcaaccccacctacatatttacaagcttaacctttaggagacattaatttcaagatcaagtgtaatcaaagagaaaggattaccattcctggaagatagtcggagccatcaagagccctagaccactgcctattcttgtcaagctcgtttacttgtgctctactaaacctgtaaatggatagcaccgaagccttcatacaaaggaactgaaaaatcaaagaaaaattgacaaaacatgaaagaagagtaatatgttcaagctatcatgcaaaaaaatataaatagatggtagatgatacagagaactagtaagaagaaactgattgagataatagtcaaagcaattttgttgttgttaactacgtgcaaaggctcacatgttcacaaatcaatacccaaaatgcagtaagaactatgatgtagttagtcacaagatctaatataccttgggtttaaaacatggcgaatgtcatccaaagaagggtcattgatctcgtaactatcaggaagacaataaaccttctctgtcagaagattgatgtaaacgtggtgtcctgcttccaagctatgtgtataagcatgagacttctggcttcttccttgaaagtacttcccacaaacaagacacgcatacacattcagatttgacaatgagacagagcaaaacctctcgaaatcaaaatccaacacctgaaatcaaccataagatatgagtttaaacgctaatctcaaaccagcaatataatgaacctagcagaagcttaaagatccaccatagattagatacattacaagtaccaaacacaagaaattggtcaatgatatacctgacgattaacagtatcaagataaggacaatcacgacgaacttcaacatggcgtgaatgctttcctctccccttcgaagcatcatcatcatcatcttcgtcgtcatcgacctctacttgagcttctcctttcactttgttaccatttccctctcctttcgcaactacattacaacgagtttgcgatttattctgctggttattatcatcatcgtaagcattagcaaacggcaaaagaggattgttgaaacctagtggtggaggtggcgaatcagaccgttccatcactctcttcctcttcacctctctctcttcctcagaaacaccattcttcacttctctttcacctttcattctcaaaattttccctaagctaaagcttgcttcaaaaaccttagaacacaaaatcccagcgattcacgaagaatcctcaaccaaagaagcaatgaactcttccaaaaaacgccaaatacttcaaatcagaagcgtcgacagtcgcgaatctactcgaacttatctctcgttcccaattttctcgagaaacttcaaaatccgccacaacgcagacgttaaacaaacaacctattaaagcttcaagagccgactcaagtctcacccagattgattaactcggttaaaaggccgaatatttattattgggccacactgttatagcccaataacaatctgttccatttatattacttctgtcagcagtattcagtaattgatctgtattcacgatccgatacttatcgaataaccattaataccctcaagcttctcgaagcaaactataaacgcgtgaaaatctacaaggacgtattcgacattccacgagtaaagagatgagttctgaagttaaagccagctggcgaagaagtaaaaaagcaaatagattagccaaaatacgacaacaccctctacctacaagccatagataccatgactcataagggcaacaccgacatttgtcatcatttgataaatctaaccaaccctgaagggcatattcgtctttccaaatagttataaagagacagagacgaagaaggagagagagaaagagacaagattagagaagaggataagagagagaaagatatagagaatttgttgtctttttttctttttcttttgtggggtatttgtttttttttttctccttaaaaagtttttttttttgtgtgtatgaaaaaaaaagctttgaaattctctctcgacaatg

SEQ ID NO: 19923 - DNA, 3003 bp, Unknown; identical to SEQ ID NO: 19922
  misc_feature (1)..( 3003): 2750-1469P.txt file - cDNA_ID_1823668; gDNA_ID_2926180; Annot_ID_140505

SEQ ID NO: 19924 - DNA, 3000 bp, Unknown; identical to SEQ ID NO: 8687
  misc_feature (1)..( 3000): 2750-1469P.txt file - cDNA_ID_1823672; gDNA_ID_1971851; Annot_ID_58419

SEQ ID NO: 19925 - DNA, 3000 bp, Unknown; identical to SEQ ID NO: 8687
  misc_feature (1)..( 3000): 2750-1469P.txt file - cDNA_ID_1823672; gDNA_ID_2926180; Annot_ID_140504

SEQ ID NO: 19926 - DNA, 3003 bp, Unknown
  misc_feature (1)..( 3003): 2750-1469P.txt file - cDNA_ID_1823676; gDNA_ID_1971851; Annot_ID_58417
tcatcatcctgtactattttttcttcaacctgctatataagaacagatgagaggttcagtatttacttttcgtagtaacaaaagatcacaaagcattctttattcaaattggaggcaattcaacacaatgacaagggaaattatgcaagattgcaaattatagctggcattagaacaaagtctagaaaccacaaattcaagtacgcatgatgctatgataaagtatcagtttttgaaaatcctaccaaaagaaacgcagctaggctccaagtaataagtcaggaatccatgaatgaacaatggagttatcaacagaaacattgatgaagcagataatagtacatgttgaatgctttacctgaatatcttccatcggaacatcattgatgtcaggcttttcctccacttccacttccgctttcttctcgctcgactcctctacagttttgtcctcatcaaccttgtcttcctgctcaaccttattatcctcatcaatcttgtcatcctcctcaatcttatcatcttcctcaatttctgtaatttccttcttctgttcctcaagtactgctatctgcaccattttaatcacacttcacttcaaatgaatcactaataatcaaaactaaactagatatacaaagtttcaaattccaaatttataatccaacacgattcaatgatactgaaaacagcttcttaagcaaagatcatctacttcaaccagtgataaaccttatgattccatcttacaaatcattcccaaatcacagctactaaaaacactaatccagtccagttactccaaggaatcaaaatggcaaaacagagacataagcactccttcaacaatgctcaaaactgaccctttttttgtcaatattaatacggtgattaaatccctaatcactgtaacaatcacctaatcaaacttctagcaaaaaccttatagctcaatccaatgcaacaagaacattgaaccaaaaaccaaaaactaaccggaacgtatttgaatctccgccgtggaggatcttctgccaccgttgccaccgtatcctcgctcggagaattactctcacttttaccatcttcattgccgttaccattctgagacaatggtgcccacttatacagcaacaaatgcgatccattactaccgtcagaattcgaaccaccgttaacgacggaagctgcagcagcggcggaaccggaggagctattattattgtctttcttagaggaaggagagacgtgtacccacttcttcttccacttcctcaccggtccggtgaaaaccgttgccggtccgtaccgtgtcgaggacctacctaaccgtgcaccaactccttccataacgacgaatcgtttatcgttgattcactgatcaaaattcaaatttaaaatcccaccaatctgtttaatgaaactttgttttcaaatttcttaaaagtaaaatttgctctttccaccgaaggaagaactcagatctcagtttttgcgaagcgaccaattttattggtttttgcttcaagtagaagactcttgttgagcaagaaggtttgactattgacacgtgtgtgatagttataggctaatctaattatacttaacaataattgcttttgtttgagaaagagaaagactctgtctaaaccagagggtctcggctaatcgttttgacctagtagcgtcatcatagagagtttagtggaaaagactctgatacccctgaagttctctcctatataaacatcgcttcaacctttcagctacatcatctctttcattacgacgcctaggtttagggttttcaacatcaatttttttgaatcagattagtttttttttttttaaattggggctacattgtaccgagagaagggctcgatttcgatacctttactcttgaatttgccaaaaaaacggctgtagctagattgaataagaagctatctggccggtggtcgcgagagggatttagatctctccggtcgattcatctgcttaccgagtttcttacattttctttttgattttcttaacatcttttgattcgttttattgaatgattggatatagtgaatagggaatagcagattttaaaataccattttcgatagttctttctcgtgtattaaacttagggttcctttccaggcgttctgtgctctcttcatgaacagttgtgtcttattggtacctacatatgtattttttttacattgatcgcatttaaccaaaagtataacagtcgataaagatgaaagtgatttagtatggccctgaataacttatgtgatttaattcgaccaaaaaattgttccattgaattgtcataatgaagattgaattgttttggacctaatcaaaggaataaacatttgtcatttggacctaatcaaaagaaatatatttgaattgaaccaactcaaaggaaaatgttagttttgttttgaccgaaactaatcgttaattgtcgctgtcgcatatgaaacagagtacttgcaaatgaattaagaaaacgagaagcctgggaatgagtttgtgatattggtttgaaatagtagatgtgaacaataaccattttcagctccagaaattagactgaatggacctcttgttgtatattagaattcataaaacaagatatgtatattacccccaaaaattagagaagtgtttgttctcgatgaaacgttagatcttgtaaaccaaactaagtatttagatctggtagagtaaaccttctaatacactgcaatcaagtcccaagcaaacaagatttgaatttgaaaacacaaatttaaaagcgttctcatcttgcaaagctgaaaaatgaaaatccatagtaagggaaaacaatttcagtttatgtactacacaattatatagagttcacacaattgaccattccttaggttggttatacccaatctcaaaagccgccataacctttgcgcattggaatgtgttcaatcgtcaaaagaaaaattagccctgggcatg

SEQ ID NO: 19927 - DNA, 3003 bp, Unknown; identical to SEQ ID NO: 19926
  misc_feature (1)..( 3003): 2750-1469P.txt file - cDNA_ID_1823676; gDNA_ID_2926180; Annot_ID_140502

SEQ ID NO: 19928 - DNA, 3000 bp, Unknown
  misc_feature (1)..( 3000): 2750-1469P.txt file - cDNA_ID_1823680; gDNA_ID_1971851; Annot_ID_58416
gtcttcttctctctcttggtccttttctgaatttcgccaattgaggggtattcccgtcttatcacctgccggaattttggatattgtaaaagaatattaaaattgaaattaaaaacctaagagcggcgcacacttccgtcgacatgggattcggtaaaatttggtgaatcagtaatttctgtttaaggtcatccttctttgttcctgtttttacttaatgtggattaataatataactagaaaactcgtgtaaatccactttactttaatggtttttggtacttattagagtcagagacataaaagttcgcacggatttagggaatgaactttaccaaccaatcatttactatgactagatgtatttaacatgagactgtttcttaacgaaagagaagaaaccatattcagacagttaaccttaactgtacattgttagatagtgatagtactatattcgtttttctttttttttattgatgattactaatgtatattgctaaacaagttatatgtatgaaggattgtttgactattttggggatgattaacaaacattgagcactcttccgagcatgttagatcttcattggtggtacaaagaagaaacacattatgagcaaatgcgtttacagttggaattttcacgaccaagtggcccggtaaaacaatttattggaaaatttgagacttgagtgtttttattagtgaagtaagatgctgtatcatggattataacaaaagcggatggaccttttggacattaagattttttttaggtctgggcataatatccgaacccgaagaatcgaaccgaatccgacccgaaatacccgaacccattctacttcggttccggctaattacccgatcgggttctgttttcaaataaccaagggtatcgggtattacccgaaccgaacgcgatactcgtgggtattttttactacccgaacatatatatacatatgatggtatatatgcattaatagcttgaatttgtgacttgtctaatgatatgagttatggaataagctcaaaataaggtttatttcttgttttatattattctcttaaggaaaaacttgttataattgcggttttttcgggttttatgaatacttttatgtatttttgggtatatttaaataaagtttgggtaagtagtactcaaacccgagatagttttggttacttatgggcaatacccgaattatccggacccgaagtgaacccggatagaacccgacccgaaattgttgatataaccatacgggtccaaaatttcaaaacccgaaaaatccgaacccgaaaggacccgacccgacccgacccgaatacccacatgcccagggctaatttttcttttgacgattgaacacattccaatgcgcaaaggttatggcggcttttgagattgggtataaccaacctaaggaatggtcaattgtgtgaactctatataattgtgtagtacataaactgaaattgttttcccttactatggattttcatttttcagctttgcaagatgagaacgcttttaaatttgtgttttcaaattcaaatcttgtttgcttgggacttgattgcagtgtattagaaggtttactctaccagatctaaatacttagtttggtttacaagatctaacgtttcatcgagaacaaacacttctctaatttttgggggtaatatacatatcttgttttatgaattctaatatacaacaagaggtccattcagtctaatttctggagctgaaaatggttattgttcacatctactatttcaaaccaatatcacaaactcattcccaggcttctcgttttcttaattcatttgcaagtactctgtttcatatgcgacagcgacaattaacgattagtttcggtcaaaacaaaactaacattttcctttgagttggttcaattcaaatatatttcttttgattaggtccaaatgacaaatgtttattcctttgattaggtccaaaacaattcaatcttcattatgacaattcaatggaacaattttttggtcgaattaaatcacataagttattcagggccatactaaatcactttcatctttatcgactgttatacttttggttaaatgcgatcaatgtaaaaaaaatacatatgtaggtaccaataagacacaactgttcatgaagagagcacagaacgcctggaaaggaaccctaagtttaatacacgagaaagaactatcgaaaatggtattttaaaatctgctattccctattcactatatccaatcattcaataaaacgaatcaaaagatgttaagaaaatcaaaaagaaaatgtaagaaactcggtaagcagatgaatcgaccggagagatctaaatccctctcgcgaccaccggccagatagcttcttattcaatctagctacagccgtttttttggcaaattcaagagtaaaggtatcgaaatcgagcccttctctcggtacaatgtagccccaatttaaaaaaaaaaaaactaatctgattcaaaaaaattgatgttgaaaaccctaaacctaggcgtcgtaatgaaagagatgatgtagctgaaaggttgaagcgatgtttatataggagagaacttcaggggtatcagagtcttttccactaaactctctatgatgacgctactaggtcaaaacgattagccgagaccctctggtttagacagagtctttctctttctcaaacaaaagcaattattgttaagtataattagattagcctataactatcacacacgtgtcaatagtcaaaccttcttgctcaacaagagtcttctacttgaagcaaaaaccaataaaattggtcgcttcgcaaaaactgagatctgagttcttccttcggtggaaagagcaaattttacttttaagaaatttgaaaacaaagtttcattaaacagattggtgggattttaaatttgaattttgatcagtgaatcaacgataaacgattcgtcgttatg

SEQ ID NO: 19929 - DNA, 3000 bp, Unknown; identical to SEQ ID NO: 19928
  misc_feature (1)..( 3000): 2750-1469P.txt file - cDNA_ID_1823680; gDNA_ID_1971851; Annot_ID_176404

SEQ ID NO: 19930 - DNA, 3000 bp, Unknown; identical to SEQ ID NO: 19928
  misc_feature (1)..( 3000): 2750-1469P.txt file - cDNA_ID_1823680; gDNA_ID_2926180; Annot_ID_140501

SEQ ID NO: 19931 - DNA, 3000 bp, Unknown; identical to SEQ ID NO: 19928
  misc_feature (1)..( 3000): 2750-1469P.txt file - cDNA_ID_1823680; gDNA_ID_2926180; Annot_ID_200158

SEQ ID NO: 19932 - DNA, 3000 bp, Unknown; identical to SEQ ID NO: 8683
  misc_feature (1)..( 3000): 2750-1469P.txt file - cDNA_ID_1823682; gDNA_ID_1971851; Annot_ID_58414

SEQ ID NO: 19933 - DNA, 3000 bp, Unknown; identical to SEQ ID NO: 8683
  misc_feature (1)..( 3000): 2750-1469P.txt file - cDNA_ID_1823682; gDNA_ID_2926180; Annot_ID_140499

SEQ ID NO: 19934 - DNA, 3000 bp, Unknown; identical to SEQ ID NO: 8682
  misc_feature (1)..( 3000): 2750-1469P.txt file - cDNA_ID_1823686; gDNA_ID_1971851; Annot_ID_58413

SEQ ID NO: 19935 - DNA, 3000 bp, Unknown; identical to SEQ ID NO: 8682
  misc_feature (1)..( 3000): 2750-1469P.txt file - cDNA_ID_1823686; gDNA_ID_2926180; Annot_ID_140498

SEQ ID NO: 19936 - DNA, 3000 bp, Unknown; identical to SEQ ID NO: 8679
  misc_feature (1)..( 3000): 2750-1469P.txt file - cDNA_ID_1823698; gDNA_ID_1971851; Annot_ID_58410

SEQ ID NO: 19937 - DNA, 3000 bp, Unknown; identical to SEQ ID NO: 8679
  misc_feature (1)..( 3000): 2750-1469P.txt file - cDNA_ID_1823698; gDNA_ID_2926180; Annot_ID_140495

SEQ ID NO: 19938 - DNA, 3003 bp, Unknown
  misc_feature (1)..( 3003): 2750-1469P.txt file - cDNA_ID_1823730; gDNA_ID_1971817; Annot_ID_58266
accaaggttttctatatcgttttatggacttgctacatcagttctcagccatattcgactctctagaggcaggcctttcaatcgctaacccggcccgtggctttgttgagcgtgtttttatcggtccttgggttgctaattggttgacgcgtatcaccgctaatgatgcagaagtcgagagctttgcttcgtggccacagtggttagagactaatgggttcaaacccttggaagtgagctttaccaaccgttgtcaagcaaaactccttttgagtttgtttaatgatggatttagagtggaagaattgggccaaaacgggctcgttttgggatggaaatctcggcgtcttgtgtcggcctccttttgggcctcgtgccagacgaatcagtaaattctcgtttttgcattctcgagtacattacataagatagtccctttttttccttttttgatataatggtttatgaagacatcaaattatgtgaatatcgaacgtgtaatttctcaaaaatgacagtttagtttaatatgacaagtaattgagccacgacattgcattgtatgttgaatctttaatcttctatataaattaaaatgagaaactcgacaatcgttttacacaagactatgtttgaatatacgtgttaatatgttgtagtaattttggtagcggaccaagccatacttgggtacaagcggaccaaggccatacttgtagccgcaaacaacataaataatatttttggtcaaagtttcatcattggaattggtaactctcttaattgaagtggtggaactagggttccaaccttcctcttttcataaagcttgtttaatttatttattttatctgcttgcagcctataatagtttaagctgcatagaagcggaaacggaaacgctcggaattgctcgaaatcgtctcagaatcgcgattcctaaaatgatgtgtttggaaacgtggaggaaacggacaattcagcttttgaagcgtcggtggttgagatcgacaatgtctctaccgtaaatcaaagatgaaacaagtcaaaaacatctttttgggcttataattgataaaaatacatcaagttatgtttgggccaaatagctcattttgtaaacaaagtaaaagttaaaacctaatctatatatacattattggagattttgtggccaaaagatcatttgcttatgcatttattacaattccctttgcattaaataatttgtgtctgcattaaatatacaaaatgggctaattatcaatattattatctacatatacatttttgcagtcattttagcaaataaatcctcaagttggaacttatttacaaagaatgccattagcattaatcattatcaattaattaatattcctaattattagtatttctttatctaatatttctccatcaattctaattacttttaaaaatgagaaatcttaggactttattaatatgatactttattaaagataaatattatggttatttaaagtttataaaatatttagagtatttaatgaaaaacgtttagaatatatataataaatacaatctataaaatcaaataaccatttcaaaagatttattttaaaattgatttgaattataaatcttttaataaaaatattattagaacaaaaaataataatgtttaattttaccgaactagattagatggtgggacgagtttagaatactatagtatatggatttttataacaattaaataaccatttgaaagaaaaaaataaattactttgaattatatatttttaaattaaagtattattaaaacaaaaataacaaaaaaaaaaatgtttaatttcactgaacattatagatatgtttaattgtaggacgggtttggtcgatagtaatacgagacggtataccacaggtgaaatctattagatatgtttaattttactgaacgagattagatggtatgacgggtttggattgatagtaatacgaaacgatatagtacggatgaaatcctaaatataacaattaaaatacaattatattatattaaacactaaacaaaacaaacaatattaataaaataaatataatttaaatttaaattatatagttataatctagattttaacttaataaactgtatgttattgtttccatattttttaaacagcaaaaatcaaacatattaattgtatactaaaaaaatagatataagagttgtacatttagaaaatacaaagcattaaatcatatatatctttaatctactaaacaaattaaatttttagtttcttaaaaaatcaccgaatggattaaaaccatatgtatttatttcataacggctaaatacatatactactcttacgacattccagagttcttgtatttttcacaaactatatagtctaaaatcaagtaaaataaattgaattttacataatatagtttatcgtgcttttattagatgcactatacattttaaccgtaatcccaactaacatactaagaaaacacatattataaatatatttgattcggatccttcattaatcttttgctaaaagccaaaaacaaataacgacattaaataatccaatatattccgagatttgcttcgtcaatatttttaagggaatgtgacacgtttacgcacttttagactatcttattcctttgggaatgttacactattaggcacttttagaaaatctttttacgtttgaggcactttccaaggttcaggcacttttccttgtttctggaagataaaaagacaattatatcctttccaaattaaaccataaattgtttaaccagttcgattggttttgttttctgtgttatctaataaaacacacgtgtaatacatgttccttctatttcgtgtcggttgagatcttgagatgagaaagagagttatctcacaattacagcaaataaatggatatttttaaaaaataaataatatatagtgtcgctcttcatctctaaaaccaaattcttatg

SEQ ID NO: 19939 - DNA, 3003 bp, Unknown; identical to SEQ ID NO: 19938
  misc_feature (1)..( 3003): 2750-1469P.txt file - cDNA_ID_1823730; gDNA_ID_2926142; Annot_ID_197544

SEQ ID NO: 19940 - DNA, 3003 bp, Unknown; identical to SEQ ID NO: 19938
  misc_feature (1)..( 3003): 2750-1469P.txt file - cDNA_ID_1823730; gDNA_ID_2926142; Annot_ID_139010

SEQ ID NO: 19941 - DNA, 3003 bp, Unknown; identical to SEQ ID NO: 19938
  misc_feature (1)..( 3003): 2750-1469P.txt file - cDNA_ID_1823730; gDNA_ID_1971817; Annot_ID_176036

SEQ ID NO: 19942 - DNA, 3003 bp, Unknown; identical to SEQ ID NO: 19938
  misc_feature (1)..( 3003): 2750-1469P.txt file - cDNA_ID_1823730; gDNA_ID_1971715; Annot_ID_175172

SEQ ID NO: 19943 - DNA, 3003 bp, Unknown
  misc_feature (1)..( 3003): 2750-1469P.txt file - cDNA_ID_1823758; gDNA_ID_1971817; Annot_ID_58258
caaaattggctcgattaagtcctaaataatatctgatagcacaaacaataaaattagggttaaaaatcagaatcacaaacctagctaaaccttcgagttttggttgtaaaaagctcttaatcttctttgatgtaagagcgtaacctacaataatggatttcttcaccggaaaagcttcgattactaacgaacacggcgacgatgtctcttgctctgtcgtctccatttctcgagttccgttcatggtgatctcttcgttgtccgttagcttcatcttgtggaaaaatcaacgaaacaattttggggattatggaagtggagaatgcgagatcggaggaagaaattttctgggtttgatgcgttcacaacggagtaaaatttgggattggttttaccgggtcgggtttagatccgaattgttttagtcggtgcttgtgatattttgggtgggttatgagagagtagggagaggtctgaaatatttatagcggcgtgagggacatgtgtacacatgtatgtgtctaacggttgttttttttttttttttggtaaagaaacatgttttaattatgagaaatgtatattgcaatttgaacatattcttggaactgcactgttttatttttgtctgagccaagccgatatatagctagttgtgatttgttgttgtttaagaacgtgaatgatctaggttggaattttttaaaatgttagatagatcgatctggtttgagtttggagagtttattgttggtcgggatttgaaatcaatgtattgacaagtttgagagacgattaaattttttagatataattcgcaaaatgaatgttttaggagaaaatcatgtagctaattttctttcaaataatatagttagcaaaaaaacaaattaatatttttgtataattttattaggtaaaataattttttatcaatttatcaaaactcaacaactatttatatgaccaaaacggttgtataaatgatattagtgaatgtttgtgaataaaacttaggtagaatttcattaaaaagaatatatattctatgtataaaaagacttaataaattattttatttcaaaaaagcagatctcacatacttttaaattttaaaattggtaactttcttcaaaattcctcttaaaatagtacgtctttccctttataaacggctaagttactacatcactttaactttgagctttttggtcctccgaatacgtcctcacattcttagtgacttaactagaactcatcttcccaactcatcttcccatgctttcgagaaaactttgttttggctttttgagaattgatgatcttaccatttcttcaaagagtcctataagattctcaacaaaaagccatactacttcaaccattggttctttgatttggagagatgcatgttgtagatgtgtttcttaataccatgatatcttggattcacatagaagtcatcccctcccaactctagatggaagagatcttttgcaactttggaaactcttgtcacaaactactttcgagtattcgagcagttaatgctccggtttcaagaatctaaattacaatttgagtagatgcattatcccttaaggtttaggaagaatacacaaatctcaactagtgagactgtgtggatctctttaacgtattagaaactctacttatgatgttctaaatggcataatatttttcatgaagatgattcttgctccttcaagtgagagtctcatagtgaaggtcgcattactagaaagtccctattgtgcaccgcaaggatttgttcacgaagttatagattagctggactattactctttcccgatttacaatgatacccatatacgtacacattcctcgtgttagagaccatatcttgccccatcaccacccgagccaatcatcccttctagagattatcgatcttaaaacgcagatggtaaactgcctctaaatattggggaagcgtagagacgaatgaattttaaacctcatacttttttgtcttcattctcgaacgaaataacattagatccctaatagtgcttgagatggtgttagggattattcggatgaagattaggagagaaaatcatcatgatgaaacatagctctctcattgggagacttctccacaccctcaaaagagtaaaagtttgataccattaaagcttgtgaaacgaacattaacaaccataatgaaaaaagcagataaaatattttaattttcattgaaaattttgaaaaatatgaaaataattcaatcgagtactatgcatatttttaataatcaagagaatcagctaagatataaagcattaatcaaatgtaatctcatctaataaattatcgaatcaatggtttaattaaagattttcgaaaataaatcaaatctaaatgattacaatctctccttaagatcacatttgaatagtgtttcatattaaatcaatcaacaaacgatgtatagaaaactagttattgttcttaaaattaattacattccttaaagtgacgtgcaaaatttccttattctaaaactgaaattaatgatttgcttaatttaacgagaatattattattaaatacttttaatatatttcattacaaaaaaaaaaaaaaaacttagtgcccatattcgattctcgccacgtcagcaaacaacacctcaacaacggcaccgatttttctgtcctcttcgttcaagtcattccaatattaataaaaaaacgaaattagtaaattaaaatttttaaacgaaaaaaaaaaaaactttggcctctccggtgactcttccttcttctgctaccgaacttttcgcttccttctctgaccaatttttttcaacaacctctcttcttcaacaaattctcttctcaaatcctccaaatcctctctgccatgaacgctactttcttcctcctctccaccaccgtctccaccgtcacaatcaccggattcaacggtctcgatttctcatcttagaaccacatg

SEQ ID NO: 19944 - DNA, 3003 bp, Unknown; identical to SEQ ID NO: 19943
  misc_feature (1)..( 3003): 2750-1469P.txt file - cDNA_ID_1823758; gDNA_ID_2926142; Annot_ID_197536

SEQ ID NO: 19945 - DNA, 3003 bp, Unknown; identical to SEQ ID NO: 19943
  misc_feature (1)..( 3003): 2750-1469P.txt file - cDNA_ID_1823758; gDNA_ID_2926142; Annot_ID_139002

SEQ ID NO: 19946 - DNA, 3003 bp, Unknown
  misc_feature (1)..( 3003): 2750-1469P.txt file - cDNA_ID_1823758; gDNA_ID_1971817; Annot_ID_176026
taaaattagggttaaaaatcagaatcacaaacctagctaaaccttcgagttttggttgtaaaaagctcttaatcttctttgatgtaagagcgtaacctacaataatggatttcttcaccggaaaagcttcgattactaacgaacacggcgacgatgtctcttgctctgtcgtctccatttctcgagttccgttcatggtgatctcttcgttgtccgttagcttcatcttgtggaaaaatcaacgaaacaattttggggattatggaagtggagaatgcgagatcggaggaagaaattttctgggtttgatgcgttcacaacggagtaaaatttgggattggttttaccgggtcgggtttagatccgaattgttttagtcggtgcttgtgatattttgggtgggttatgagagagtagggagaggtctgaaatatttatagcggcgtgagggacatgtgtacacatgtatgtgtctaacggttgttttttttttttttttggtaaagaaacatgttttaattatgagaaatgtatattgcaatttgaacatattcttggaactgcactgttttatttttgtctgagccaagccgatatatagctagttgtgatttgttgttgtttaagaacgtgaatgatctaggttggaattttttaaaatgttagatagatcgatctggtttgagtttggagagtttattgttggtcgggatttgaaatcaatgtattgacaagtttgagagacgattaaattttttagatataattcgcaaaatgaatgttttaggagaaaatcatgtagctaattttctttcaaataatatagttagcaaaaaaacaaattaatatttttgtataattttattaggtaaaataattttttatcaatttatcaaaactcaacaactatttatatgaccaaaacggttgtataaatgatattagtgaatgtttgtgaataaaacttaggtagaatttcattaaaaagaatatatattctatgtataaaaagacttaataaattattttatttcaaaaaagcagatctcacatacttttaaattttaaaattggtaactttcttcaaaattcctcttaaaatagtacgtctttccctttataaacggctaagttactacatcactttaactttgagctttttggtcctccgaatacgtcctcacattcttagtgacttaactagaactcatcttcccaactcatcttcccatgctttcgagaaaactttgttttggctttttgagaattgatgatcttaccatttcttcaaagagtcctataagattctcaacaaaaagccatactacttcaaccattggttctttgatttggagagatgcatgttgtagatgtgtttcttaataccatgatatcttggattcacatagaagtcatcccctcccaactctagatggaagagatcttttgcaactttggaaactcttgtcacaaactactttcgagtattcgagcagttaatgctccggtttcaagaatctaaattacaatttgagtagatgcattatcccttaaggtttaggaagaatacacaaatctcaactagtgagactgtgtggatctctttaacgtattagaaactctacttatgatgttctaaatggcataatatttttcatgaagatgattcttgctccttcaagtgagagtctcatagtgaaggtcgcattactagaaagtccctattgtgcaccgcaaggatttgttcacgaagttatagattagctggactattactctttcccgatttacaatgatacccatatacgtacacattcctcgtgttagagaccatatcttgccccatcaccacccgagccaatcatcccttctagagattatcgatcttaaaacgcagatggtaaactgcctctaaatattggggaagcgtagagacgaatgaattttaaacctcatacttttttgtcttcattctcgaacgaaataacattagatccctaatagtgcttgagatggtgttagggattattcggatgaagattaggagagaaaatcatcatgatgaaacatagctctctcattgggagacttctccacaccctcaaaagagtaaaagtttgataccattaaagcttgtgaaacgaacattaacaaccataatgaaaaaagcagataaaatattttaattttcattgaaaattttgaaaaatatgaaaataattcaatcgagtactatgcatatttttaataatcaagagaatcagctaagatataaagcattaatcaaatgtaatctcatctaataaattatcgaatcaatggtttaattaaagattttcgaaaataaatcaaatctaaatgattacaatctctccttaagatcacatttgaatagtgtttcatattaaatcaatcaacaaacgatgtatagaaaactagttattgttcttaaaattaattacattccttaaagtgacgtgcaaaatttccttattctaaaactgaaattaatgatttgcttaatttaacgagaatattattattaaatacttttaatatatttcattacaaaaaaaaaaaaaaaacttagtgcccatattcgattctcgccacgtcagcaaacaacacctcaacaacggcaccgatttttctgtcctcttcgttcaagtcattccaatattaataaaaaaacgaaattagtaaattaaaatttttaaacgaaaaaaaaaaaaactttggcctctccggtgactcttccttcttctgctaccgaacttttcgcttccttctctgaccaatttttttcaacaacctctcttcttcaacaaattctcttctcaaatcctccaaatcctctctgccatgaacgctactttcttcctcctctccaccaccgtctccaccgtcacaatcaccggattcaacggtctcgatttctcatcttagaaccacatgcatcccttctgttgcgttacaactgtctccgatcactctccttcgatg

SEQ ID NO: 19947 - DNA, 3003 bp, Unknown; identical to SEQ ID NO: 19946
  misc_feature (1)..( 3003): 2750-1469P.txt file - cDNA_ID_1823758; gDNA_ID_1971715; Annot_ID_175164

SEQ ID NO: 19948 - DNA, 3000 bp, Unknown; identical to SEQ ID NO: 8554
  misc_feature (1)..( 3000): 2750-1469P.txt file - cDNA_ID_1823762; gDNA_ID_1971817; Annot_ID_58257

SEQ ID NO: 19949 - DNA, 3000 bp, Unknown; identical to SEQ ID NO: 8554
  misc_feature (1)..( 3000): 2750-1469P.txt file - cDNA_ID_1823762; gDNA_ID_2926142; Annot_ID_139001

SEQ ID NO: 19950 - DNA, 3003 bp, Unknown
  misc_feature (1)..( 3003): 2750-1469P.txt file - cDNA_ID_1823766; gDNA_ID_1620682; Annot_ID_48355
gcggcttcggatccgaattacaggttcgttagaggtggtgagagaagaagctggacggctctcagaatgaattcgccggaaattgggtttggcgcagcagaaaagaacggtggctgttgaagcaatcgccatggctgagatttttctccaatttccaattcccaagttctggtttaattttaaaccggtttgctgttgaaccgtcttttatcattttcacaaacaaaattaaactaatcggtttattaacaaattctggtttttctaattacttcccatctttgaagttgaagagaaaaatataaagacaaaatggagattagtacattaaaaatctcaaattctgtattgaattatttatattacaagaagaattttccaattatttgtagtacatatatatatgtataatcaaaatgtggagtgaaacaaaatcaaaatgttaaaatgtgttactcttttccttagaccagatcaaaacgagagtgaaccccatcaatgacattaccaccgtctgcaaaacaaaacaaaaatctctataatcatcatcaataaaagattatgctatgtcaaaaggatatgagacttacagatatagcaggaggaatccccacaagaggatcttgaaagaacttagtagcaagcgctagagccaaaaggctactctgcattcctgatatattcacaaacacatttctcttctcaaatctttaaaccaaattgtactttcttgataagattttccaataccataaagagttagtaccagtttcataggacaatgttctttgcatggctttagcgtctggagcgtttctaaagacagaaccggtaaggaagtatccagcgaggaaagctgagagatgaaacattgttactagtaacaatatggtggctccaaatggagacatgaccgagtttatgttcaatgcgagtggtgctccaacgcagcaagctgtgtcgagaaccgatagaatcgggagaaatggtcggattgcatttgatacttttgggaacaacctgtaaaagaagaaacaaaaaggagataaaaatggttatacttagagaaacaacttgtggttatttctagttgtaggcttgtagctatatctctcacttgtttagtagcaatcctgcagcgattggtgcgattacaacctgaagaatgctggatatcattccttttacatcaacgggtagtttcttcccaatgagcaggagtgatagcatcggtgtgacaagaaccgcagtagcggttgatagagatgtcatgacgatgctaagaggtgccaatgctggatcagttaggaatgtcgcatagtttgacaactgagctccactaacacatgataccaacatgattccagcacctgagagattgagaaagattggttaatgtgagagataggttaagagtcttgaatgatgagagacagggagcttttaccaattggagttgggagttggaaaagagaaacagcagctaggccaaagatgaaacctaggacaggctttacgagatattgtccaacataaccgaggaggatagcttttggtcttttgaaagcttcaagaaagtctttctcgtttgaattgataccaaccgcaaacatcaaaaaacctaaagcgggcacaaagtacctaaaataacaggagagtaaagaagagctttttagcaaacctcatgtctacaattcaaagtcttagatcaatttgaccttgttccaatgggaagaacctcgacgtaaaccaagtgaaagaaggaggatagataagagctaatattgtactcgccaacactacatgaggaagaattgagtttgctttcttcattctatccactatagaaggcttctcaataacctgcaagccacttactagattcatgttggttctcggaagtaacataaaattcttaacaactgaaatcatcagcaaacgaagaacaaagtagcaaaactgtgatccagggatgatttttagctaatcagattcaaaagtaggataattaacaagtcttcaatagtgcaaaatcacattttgacattaaagatgacacattttgagaagactattcaaacccaacataacatagaatggaaaaggaaagatcccatagcgcacaccttgaatggatcagctccaggatccaaacccatctccgagaaattatcagatgcatatctacgccacaaattcctcgatccgccaactgtgtatatagtaggttgaagaaaaccatgagagaagaaagtgtaaattttgcaggtacccaacaagcataaacgcctgaggatcgatgagagtaagatgaacaaaccttgagagattgggtcgatgcgaagtggagaactcagagaagtgttcgagaagatgttgggcgggaaaacttgaatccgttgactgcgataaacagctcgtggtagaagacgaagtgttgactttaggtgcagggtctctattggagttgtgatcacgctcattttttttctttggactttgtgatctttcagattcttcagaagaagtggcgaaactctgagagttctgggaaatggaagaaagagggagagattcagagaatctgggacccgagaatctgtcgcatcatcaacctaacaaaacccgacccgacccagttagagtttaagtttctggaaatggcccactgggctttaagataatgtatatttcaaattatgattttcttattttaaaactgatatttggaatataatgtgttgtgtagtgagaaagacgcaattaatatacttaagttagggtaataaaaaaatcggtacaagactacaaagcaaagacacaaatcaaggagaaaacttccacaaattgtctctctttctttcctacacaccaatttgttttgtgattctttcgattgcattcttctttttcgaattcccgatcactggattttcccgtttaaccggaaaatccagtggattagattttacccagtgttatctttttggattggattcgatg

SEQ ID NO: 19951 - DNA, 3003 bp, Unknown; identical to SEQ ID NO: 19950
  misc_feature (1)..( 3003): 2750-1469P.txt file - cDNA_ID_1823766; gDNA_ID_1620698; Annot_ID_48733

SEQ ID NO: 19952 - DNA, 3003 bp, Unknown; identical to SEQ ID NO: 19950
  misc_feature (1)..( 3003): 2750-1469P.txt file - cDNA_ID_1823766; gDNA_ID_2926181; Annot_ID_140553

SEQ ID NO: 19953 - DNA, 3000 bp, Unknown; identical to SEQ ID NO: 4309
  misc_feature (1)..( 3000): 2750-1469P.txt file - cDNA_ID_1823785; gDNA_ID_1620698; Annot_ID_48726

SEQ ID NO: 19954 - DNA, 3000 bp, Unknown; identical to SEQ ID NO: 4309
  misc_feature (1)..( 3000): 2750-1469P.txt file - cDNA_ID_1823785; gDNA_ID_1620698; Annot_ID_164968

SEQ ID NO: 19955 - DNA, 3000 bp, Unknown; identical to SEQ ID NO: 4309
  misc_feature (1)..( 3000): 2750-1469P.txt file - cDNA_ID_1823785; gDNA_ID_2926181; Annot_ID_140546

SEQ ID NO: 19956 - DNA, 3000 bp, Unknown; identical to SEQ ID NO: 4309
  misc_feature (1)..( 3000): 2750-1469P.txt file - cDNA_ID_1823785; gDNA_ID_2926181; Annot_ID_200248

SEQ ID NO: 19957 - DNA, 3003 bp, Unknown
  misc_feature (1)..( 3003): 2750-1469P.txt file - cDNA_ID_1823797; gDNA_ID_1620698; Annot_ID_48721
gatgttggttgagatcacagaaagagcgatggcgcattgtgacaagaaagacgttttgatagttggcggtgttgggtgtaacgagcgtttgcaggaaatgatgaggactatgtgctcagaacgtgatggtaagctgtttgcaacagatgaccgttactgcatcgataatggagctatgatcgcttacacaggtctactcgcgtttgttaatggtattgaaacaccgatcgaagactctacctttacacaacgatttcgcacagacgaggttcatgcggtgtggcgagagaaagaagctgtactacttggggataagaaagttgcagcgaattgagtctgtccccatttttgttcatttttcatcaaatttgagattgaatctctctctactcgataaattggtttttgctaagtagttaagacttttaaatgtgttttattagccaaattatatgattgatatcttttggtttgaatgtaataacactttcaaatttcaaagtgagctttgtaaaaagttcaaatgtttcttgtgttgcatttcgctatttgttttattgctttaataaaaatatgatatctcaaagtcgacatttctaccgagaatggtggagagattagtgcattagtcttccttaatcatacaaaaacaactgtgaaaatacagcactactaaaaagtaaaaagtaagaactttttaatgtagaacgtatgagatggttcaattaatcacaagacacttctatggcattgcgtattaaacgaaaagtgagtaaatagaatttatacataatgatctaatcttgatcttgctaataaaaattgtaaaggcaacaacaagttgtcaaaaatttcaatttgacgtagagataaattctatctaataattttgtaaaaacattcgagatatagtgtatcatttttccatcatctagaactcatttgcgtattttcaagtgtaaatcagaaccttgacacataggctacacaaattttggtcgatatttatattacttttgtagcataatgtggatatccttctagagactagagttctagataaaacattcatacatgtaactatgtaagtaagcatgcatactaaatataaaattttcaaaagttttaaaagacatcatatagattcaaaaagacgtgggaaaaaggagaaaatgacaaaagttattagtaaaacaatcaagtaaaaggtcaaagtagttaacgaaaagataaaagtatttcaaaagtcttccttccatcttgaaatgccaaaaaataaaagacgaatgattgaagataaatcaaagttgtctgattgctattgtatacatctttttttttgttaaaactattgtatacatctaaaaaaccttgaagtaatcaagatctgaattatagccgttgataaggttttatgctttcacattgaactcgatcgtcgtcgtcaaatctactagtctcgttttttagttttaacgtgcttaattacttcactaatttgttttttgttatcattttcaccaattttattcattgtgtgaattaagttttgtccacatagtaagattcatcagtataataggacatatgataaaagtttgtatataatcaaagagtatatctaagaatatctaattaagatgaatgtttcagtccacattggattctgcttatagtcaaactgtcttgttcttaaacccaattaggttagaatacatgtaccaacaaatagcatttctataactaatcttttatcaatttactttatagcctacaaataattagaggaaaagaaaagagagttagtggaataattgtcctctaaatctcgatatcatcattaactaaatactatatttagaccatatatactatattttatagtatactatattttatagtatatataatcaactaatcatattagaccactattagaaatatggatctaaaaaaaacattctttaatcagtactattctcatccaaagacttgttttaagagactaaatatgaatatgtgtatgtgtatgtgtatgcaggagtagacacgtgcacgtggcacatgcagggaatgggaaggtggagtgttgacaaagaagaagaggatgatccaagtttcgaaatgattccaaaagttatgaactataagccaaagtgctcaatcgccaaacatgaacttaaataaacttcactcgttagatcgttttctcacattaaagccgctctacacttttacccattttaccatttataataaccaccacacatagatattaagttctatggattttattcgtaaacttaagttatgatcaaatagctaaatgattttgcgatttgcccgagttctgtttgtttctaaaatggttatccaaaaagcatatttttgttttatatagaatttgtgatatagaagaaatatactaaaaatgttttaaagtctgtctaaatcataaaccaatgcaaagaaagtgaaataaaccaagatctcgagcaatagacataataaataaacaaacacctaataacatcacatccccactaacaaatgtgaacattaactgttaaaaatcaccaaaaaagtcatcaagatttggctttccttttcaaaagcagtatacgtctctgtctcacacagacagtgtattcaatgcgttgtgttgtcttcccacttttcaccagctgaggttctgcttctttctcttcttctctccaaaacaagaaaattctgcagaataacttttcattcacgagagtggaaggttacagttttccaaatccgagaaacagacacaaaattggtccctctctaaaagttactatcttcgtttaacaaagagatagctcccaatccagtacaaaacagagtactctgctctataaatttcgttcctttattactctgctctataaaacagattattctgctctataagagagatagataaatgagctaaagctcagtaatttctaaacagagagacaagaaaattcaagaatg

SEQ ID NO: 19958 - DNA, 3003 bp, Unknown; identical to SEQ ID NO: 19957
  misc_feature (1)..( 3003): 2750-1469P.txt file - cDNA_ID_1823797; gDNA_ID_1620698; Annot_ID_164958

SEQ ID NO: 19959 - DNA, 3003 bp, Unknown; identical to SEQ ID NO: 19957
  misc_feature (1)..( 3003): 2750-1469P.txt file - cDNA_ID_1823797; gDNA_ID_2926180; Annot_ID_140541

SEQ ID NO: 19960 - DNA, 3003 bp, Unknown; identical to SEQ ID NO: 19957
  misc_feature (1)..( 3003): 2750-1469P.txt file - cDNA_ID_1823797; gDNA_ID_2926180; Annot_ID_200207

SEQ ID NO: 19961 - DNA, 3003 bp, Unknown
  misc_feature (1)..( 3003): 2750-1469P.txt file - cDNA_ID_1823807; gDNA_ID_1620698; Annot_ID_48715
ttatagttttaatcttgtgattgatttttgcatgttgttatgtagttgcacctacttttactattgtttacactaattatgacatgatcatcatcgctgttatacaagatccataaaaagtaaattaaattaaaaatccattaatatattccgcggttttgcaaatatcttaaaaaatagtacagtatcttaccgtaccatattaattagtgcaatcttttgtcaaagataattagctaactagtgcagttttaaacaagacttatttatggtatctaattgatttcggttttgtgtggcaaagcaggcaactctaatggaggagcaacgaaaaagattgttgcatcaatgggcctttttggtgtggttgcaagtctgttcttttaattcaactctacaaaattctgtgtaattgttcttctcatcatttttgtttgttttcaaatctgactactcgaacatttatcgaatcaacaaaccttaactttaataattccgcttcgtcaatgttggtattaaaacctggtctgcgtaatttgacagatgtgtatagattattttttaggtttgcattggttaatgtgattatcacgtcttcatacaaatgccccacccgaaatttcatttcaatatatattatggtaagccgtacgcagatgcagatcatttaaacatatttgttactacaagggtttcaatattcttatcaatttttagtaggtctaattaagatgtccagttatatacatttaatttgaattacagtggatttaatgaaacataccaaagtacatacattcaggtcaaaggcagtgagatattttattagtagataactatactagcaaaaacaacatactgaagaagcaagctgaaatatattttggtttgcgatgaagttgtaatttgaccattcacaaatgttcttaagaaaaaacaagaattgtttcataaacaaggaaaaaaaaaaaacgcatcatcattattcattagctaacagcaagaaattgaagaagcaagttgaaatcatcatgtatgcgaaaagcttggtaagaaccatcgagcagagagttcaagtaacgaacaatcgaaatcaaatttgtgcagtggctccatctcccgtgtctcgtaattgaacagaaagagatcttttgtggtcgtgtcatggctatcactgaaatatatagtatttctatggagtccctcaacttcattggcgagcacggtgatgcctagatccaaaagcattgcctcgtcgcccaaagaatcagcaagttcatatttatcaagaaatgtccctgacgaataaaacttgtagacgttgaatgactggattctagaccaatgtcttaacattctttcaaccaagaggacatctccggttactgtgactacaagttttgtctcagcaacgcaccatgaattacttaattgacgactacgaggacttaaccactcagatctatagacatgcataaaacattgaaaggcttttcgaggaatctctccagaaaaatctaggattgtgaaaagatttctgtagctaaatgagtaaagcttgtgatccttgtaaaccatgtcaagagaatctaaaataatttctggaatttgattccacaacttatctccgttcttggcataaaccacacaccaatatccaagcccccacagagctatgtactctttggttttctcgtcaatccaaaacacaggggtacgtacggtattattacctttgaataacttaacgtggttgtgatcgtcgaaagttagaaaatcatcatctatggtttggtcaacctttaccatgccaacttgttgtgattcaatagcgggaagaccgatcttctcgtaggtgaatggattcaaaatgtatagattatactttgaatcttgcatcaggagccaacttccataggttgctagacaaacactctttgcaaattcaacaccaagatcttgcgtttggtaaagttggtctttgtcctcgggattgaaaaaaatcgtgcatgaactgtttttgttgttgtttttgtctttggggaagagcatcagccaagggatctgatttttgggcacggattgtttcgaagcagagtaccaagacgaacacaccgatttggcttgtcgaaaattagcaaagctgaggcgtttgaaaactaagttcaagagatctagaggaagatccgaccaggtattagggttttggttcttctccatgaaaacgacaatatttgagatatatagagagagttctcttatcaacaaataattatttgagtgaggagatatctctaacaaaagattttataaaccgaatagatctcggaatttcatggtttgctttgttaaaatatgggcttttgtgaaattccgaaatattggccccattaattaatcagtatatattttgttcacttggatccaataaggtgcaagacatgaagagagaaaggtaacataggtgaacgattttgttccctaaataaaggttcaattcaacaatgtgattctcacgtcttatacacaaatgctccaccataaatttcatttcattatatacctattttgacaccgaaaagagtttggaataaatatacctattttcttcttaggtctgaaatgtccagtaaaatacatttgaattacaactgatttaatcatttaatgaaacagaccattagttatacatatacacgtcaacggcattgaaattgtattagtattcgcctttcttcatatatgattagaatgaatgaactgtcgaatccatatcaatgaatatttagttttgttataatcctaataaagatatgatctggattatattaatgacacatatctttgaattgtcagggccgtccagcttatattgattttcgacattctgtccttaacaacttcttcgcaaaacattccattttatgtattaatggttttattttaaattggcttccatatatatacatgaacatgccacataaaatattcattctcaaaatg

SEQ ID NO: 19962 - DNA, 3003 bp, Unknown
  misc_feature (1)..( 3003): 2750-1469P.txt file - cDNA_ID_1823807; gDNA_ID_2926180; Annot_ID_140535
tatagttttaatcttgtgattgatttttgcatgttgttatgtagttgcacctacttttactattgtttacactaattatgacatgatcatcatcgctgttatacaagatccataaaaagtaaattaaattaaaaatccattaatatattccgcggttttgcaaatatcttaaaaaatagtacagtatcttaccgtaccatattaattagtgcaatcttttgtcaaagataattagctaactagtgcagttttaaacaagacttatttatggtatctaattgatttcggttttgtgtggcaaagcaggcaactctaatggaggagcaacgaaaaagattgttgcatcaatgggcctttttggtgtggttgcaagtctgttcttttaattcaactctacaaaattctgtgtaattgttcttctcatcatttttgtttgttttcaaatctgactactcgaacatttatcgaatcaacaaaccttaactttaataattccgcttcgtcaatgttggtattaaaacctggtctgcgtaatttgacagatgtgtatagattattttttaggtttgcattggttaatgtgattatcacgtcttcatacaaatgccccacccgaaatttcatttcaatatatattatggtaagccgtacgcagatgcagatcatttaaacatatttgttactacaagggtttcaatattcttatcaatttttagtaggtctaattaagatgtccagttatatacatttaatttgaattacagtggatttaatgaaacataccaaagtacatacattcaggtcaaaggcagtgagatattttattagtagataactatactagcaaaaacaacatactgaagaagcaagctgaaatatattttggtttgcgatgaagttgtaatttgaccattcacaaatgttcttaagaaaaaacaagaattgtttcataaacaaggaaaaaaaaaaaacgcatcatcattattcattagctaacagcaagaaattgaagaagcaagttgaaatcatcatgtatgcgaaaagcttggtaagaaccatcgagcagagagttcaagtaacgaacaatcgaaatcaaatttgtgcagtggctccatctcccgtgtctcgtaattgaacagaaagagatcttttgtggtcgtgtcatggctatcactgaaatatatagtatttctatggagtccctcaacttcattggcgagcacggtgatgcctagatccaaaagcattgcctcgtcgcccaaagaatcagcaagttcatatttatcaagaaatgtccctgacgaataaaacttgtagacgttgaatgactggattctagaccaatgtcttaacattctttcaaccaagaggacatctccggttactgtgactacaagttttgtctcagcaacgcaccatgaattacttaattgacgactacgaggacttaaccactcagatctatagacatgcataaaacattgaaaggcttttcgaggaatctctccagaaaaatctaggattgtgaaaagatttctgtagctaaatgagtaaagcttgtgatccttgtaaaccatgtcaagagaatctaaaataatttctggaatttgattccacaacttatctccgttcttggcataaaccacacaccaatatccaagcccccacagagctatgtactctttggttttctcgtcaatccaaaacacaggggtacgtacggtattattacctttgaataacttaacgtggttgtgatcgtcgaaagttagaaaatcatcatctatggtttggtcaacctttaccatgccaacttgttgtgattcaatagcgggaagaccgatcttctcgtaggtgaatggattcaaaatgtatagattatactttgaatcttgcatcaggagccaacttccataggttgctagacaaacactctttgcaaattcaacaccaagatcttgcgtttggtaaagttggtctttgtcctcgggattgaaaaaaatcgtgcatgaactgtttttgttgttgtttttgtctttggggaagagcatcagccaagggatctgatttttgggcacggattgtttcgaagcagagtaccaagacgaacacaccgatttggcttgtcgaaaattagcaaagctgaggcgtttgaaaactaagttcaagagatctagaggaagatccgaccaggtattagggttttggttcttctccattgaaaacgacaatatttgagatatatagagagagttctcttatcaacaaataattatttgagtgaggagatatctctaacaaaagattttataaaccgaatagatctcggaatttcatggtttgctttgttaaaatatgggcttttgtgaaattccgaaatattggccccattaattaatcagtatatattttgttcacttggatccaataaggtgcaagacatgaagagagaaaggtaacataggtgaacgattttgttccctaaataaaggttcaattcaacaatgtgattctcacgtcttatacacaaatgctccaccataaatttcatttcattatatacctattttgacaccgaaaagagtttggaataaatatacctattttcttcttaggtctgaaatgtccagtaaaatacatttgaattacaactgatttaatcatttaatgaaacagaccattagttatacatatacacgtcaacggcattgaaattgtattagtattcgcctttcttcatatatgattagaatgaatgaactgtcgaatccatatcaatgaatatttagttttgttataatcctaataaagatatgatctggattatattaatgacacatatctttgaattgtcagggccgtccagcttatattgattttcgacattctgtccttaacaacttcttcgcaaaacattccattttatgtattaatggttttattttaaattggcttccatatatatacatgaacatgccacataaaatattcattctcaaaatg

SEQ ID NO: 19963 - DNA, 3000 bp, Unknown; identical to SEQ ID NO: 4334
  misc_feature (1)..( 3000): 2750-1469P.txt file - cDNA_ID_1823861; gDNA_ID_1620700; Annot_ID_48760

SEQ ID NO: 19964 - DNA, 3000 bp, Unknown; identical to SEQ ID NO: 4334
  misc_feature (1)..( 3000): 2750-1469P.txt file - cDNA_ID_1823861; gDNA_ID_2926192; Annot_ID_141089

SEQ ID NO: 19965 - DNA, 3003 bp, Unknown
  misc_feature (1)..( 3003): 2750-1469P.txt file - cDNA_ID_1823871; gDNA_ID_1620700; Annot_ID_48756
gctgcttcattgtctaccgtcacatgcacgtacatatccgttatgcctgaaccatattcacaactctttttaaaaacttcaattgcacaagtctaaggagtttgatttaaatgttcttaccccattctccagcaactctcttagacttgtcaataagtttgtaaccaactccattacgatgcagctcttttgcaacacagacgttgctcaagtatgctctagcaaaatccacaccaatcccctataacacaaaatactcttaggctactcaatttgtccaatttcagattttaagttcagcattgttggcaacatcaaatagacaaatacctctggttttgttccagcaatttcatcaggaagccaacgacattggttaagatcaaggcttcccaccacaactctgtcttctatgccatcagagaactgagaaacagatgaaccatagcacaaatccatatcacagttttttctagaccaggaagtaacaatgacatgatgacaattccaaatgtagagcaccataacttaaatgcaacaaaccctcttgaacaggtaaatacaggatgaccaaattgagtacacagaccttacatgcagagcataaatcctcaaaagagcttgataattgcgacaatggaagggtagcatttatgcaagcgacccgcgtaaacccttccctcttccctgaagttctctccttaagcgcctcgaattcacgctctgccaagtatcttctatgatcctaatgaaacttgaacagcaaactgtaacatcagcataagaaacaaaccataaaccaaacaaaacactcactaactaatcacacaacaacaacgaagttcttcaaaactataaacacagctccaacatcaattatcatttcatctaccaattcatagtcaacggagttgacttcatgatacaacaaatagctaaaaatcatcttctaattcaccgattaagtaagaaactgacttggatattgtaagcagaaggattgagttcgttgaaggttcgtacgcggagacaagctgcagcccaaagctcatcttctgacaccgattcggatatgacgaaagtcgacttgtcgatcgctggagcacaaatgtgtgaggaagcagcgacgggacggaaccgtaacttcaatgaaggaatcgaaagatacgagcgtgatgatccatctgtgtttgggtcgccgaaaatggcgatagaggatgaacttgggagagacgaacagagaaacgccattttttcgcggactaatcacatcctcagcttcttgctaagcttcaaagctcgcatgtttgggcttttctattatttgggcccaatatgagcccatagttttctgtttgtttacgcttctttcaatttttatccgagagaaatggcagccacacaaataccaactaaatgtcataactcataaacaaaagatacgtaacaaacttttaacgttttatttcccaccaaaagaaaatcaacatgtgtcatcatcactcatcatcttttctttcaacgacaaaaaataacattgttcttatcgcaacaatacatgttttatcatcatcatttgaatgtacgtaatcaatgtatctcgattctttttggttgatatagaaaagaatttggagttgtattttgttacctaataaaaatcaattaaaattaataatagtaatctacaccctcgttaagagaagcaagtagagctagttcatgcatgatgatgtcttagtaaaagaaataagattatctcatataaagtaatagttagaaagtgtggaaggattagaatgaggatgatgatgatgtgtgtcatgagtcattgatctttgtcattatcctatgattcatatctcttctttctcgtgcatccaattcttattggtcaacaaataccaatagaaatcatttcagcaataatggacagaaacctacttacgattggtgggagggatacacaagaagacaactagagtgactaactataacatgttcacgcatatgatcttttatctattttcataattctgatgtctgtgaccaccttgcaatacacctgtacttaaatgtagaatatacgttataatattcgtaatacaacgcatcacataggacctaaatggcgatttttatggttgcatagtttcttgaaaaatgttttattttgttgatacgtattcaatcgtgattgtcaagagaatgaaatatcatacagtgaaatcaaaaggaattaactaaacaataattggtagtcaaatcttaaaatgctatacgtataattttcttctttaatttttctttttttcttttttattttgtaagagatttctttgaacaataattaattcaatctttccttacgtattaaacaatgaatagaaaaaaatcacaagacattattgaataaatgtcggattatctactatatatgtgtgcgcatgtgatatagtactgtaatagtgggctacaggccaacttcggctttccaagaacatggttgcatcgagcatatctttgctagattttaaatataactacaacttcttgcttactttgtgatgcggaaactcaaaaccgtaatcactcatgttatattttttgttgttgctttcaacgctaatatctgaaaccagttttcgctggtctaagatccatttgcaagaaatgtcaacaaaataaaaagctcttatcattcccacgagttttagttaaggtaatctattattccaagacttccacgaaccacctatatatagaagcttacatattctatagacttaataaatgtatagttcaatattatgtcactaacgtacgcggctaacaggtttgttaatccttcctatcacatgattgacatacacacacacacacacgcacgacacattatttgtattcagtattcacatatacgatatataattacaagagacgtgtatattgagagattcattttttagtgattgtagatcttaagagagagagagagagatg

SEQ ID NO: 19966 - DNA, 3003 bp, Unknown; identical to SEQ ID NO: 19965
  misc_feature (1)..( 3003): 2750-1469P.txt file - cDNA_ID_1823871; gDNA_ID_1620700; Annot_ID_165046

SEQ ID NO: 19967 - DNA, 3003 bp, Unknown; identical to SEQ ID NO: 19965
  misc_feature (1)..( 3003): 2750-1469P.txt file - cDNA_ID_1823871; gDNA_ID_2926192; Annot_ID_141085

SEQ ID NO: 19968 - DNA, 3003 bp, Unknown; identical to SEQ ID NO: 19965
  misc_feature (1)..( 3003): 2750-1469P.txt file - cDNA_ID_1823871; gDNA_ID_2926192; Annot_ID_201127

SEQ ID NO: 19969 - DNA, 3003 bp, Unknown
  misc_feature (1)..( 3003): 2750-1469P.txt file - cDNA_ID_1823883; gDNA_ID_1620700; Annot_ID_48752
tcggaagagatccaaccttgaaattgaacctcctttgttggtaaagaatgatagtgacgctgattcttgtactcctcaagccaagaaacagaagtctcaggaagcaaatgatggagacattgaaggaattgtctgcacagataaaagttatgaggatcctaactcattaacttgtcctgatacaaagcttaatgattttagcaagtcaatgagctcatttgctgttgatcaagtatgggctttatatgatcctagagatgatatgcctaggaactatgcccagatcagggagatttttgagtcccagttgagtttgcaggtgacactacttgaacatgtcaaaactacaaaagatgagcagtctattctcagtggttgtgggagatttgaatatggagatacagagatcaagagccacttgatgtttgctcatgagatggatcacatcaaatctgctgaagaggtcattgtgaacccgagaaaaggcgaaacatgggctcttttcagtgattggaatgcaagttggaacagtcacctagaactacaggagcttccttatagatacgactttgtggaagtcatctccgagtttgacgatcttataggcattcaagtggcctatatggggagagttgaaggatacgaatcggtttttaaccatgctgagcagtatggatgcatcaagattgtgatcccacctgcggaaatgcagagattctctcacaaagttgaatcagtgaaattgagcgggaaggaggaagagggaatcccatttaggtccttcaagctaaaccctgctgctatgccgagatactatcatgtgcttgaggaggtggtggaaacggaaatacaaattaaagatccaacggtcgtacatcaaaatggatccacaaaagatcttcccataataatagattgagggattcaagcctggttggtgcacctttcttatctatgcaaatatatatttaagtatgtagagtgcttggtgatggctgaggttgcaggaagtagtgaaactgtaatctttttggtttctgtatctgttttctaaactgtctatcttctgaattgtaccaacttcctttgatataaataaaagagaatgctttaggaaaactaactgcctacttgctcgcttcggcatagacctcacatgtggattactgagtgtctcaaagtttcaactttgttttcacgaattgcattaaaactaacataatgaccatcctatgttgatcaaatgcgtctgctgtaacagtctgaacactacaatctaattgacacaagtcaatacaatccccaagctttgtatatcctcgaaactccagttctattattgaaaccatattcgtgcatttacataaataacacataacagaagtaaagactgaaactttagagtctaatacatcattaccttataaatacttccaaatgctataactatagacaatataaacgccaaagataaacggaatacgatccataacctttgcatcatcactcaaagcagagtaagtagtggctattgactatcctctgctgttgttgagaatcgaacctagagttcccaaaacggcgaaagcaagcaaagggctaacgtcaagcgtatcaaagactggagggataatgttcctgaagagattaagataaggatcacacagatctctaatggctgacaaaggctgacgatcccatggaatgtttgggaaccaactgagcaaaactctgaccatcagaacaccactgtatatatcgagccatttcgatagcccggctgcaactaccgtcaacggagtgttcagataaccggcgggtcgatcacggagcgacgcgaagaacaacggacttgctgttcggaaagatgcttgaatctgtggagataggttcacaattgcgacagagagcttctgaattagagatttgattacgacgccggctagaagcacgagggtggtgatcgatctagttgagtcggagaaggggaattgagaagggggtttagaggagagtaccggagacgaggaggtaacggcggaggaaacgatggttctagcgttatggagggagagattgaaagagagtttacggggaagagagagacggggacggatgatcggaggaggtagtctagggtttgcgagaattgaagcgcgaagagcgagactgttggttgtgaaagaagccatctttgttcctcggtgccggagattactcactcctcagaatgttgtatcggaggaaataatgaacccaaaagattaaaatagaaaaataaaatatttatttttggtcaaaaatttatctctttgtataaattattttagttacgaaacttcgttgcccaaaatataaaattaaaaaaaaatacgaaactaccttctttatttatttttattcaacaaataaaattaatttaattaaggatagaaaatgaatcgaagtagtgtactagtggtatagttaaagaaaaacgttttatgtaccagcttttatcacaacagctttacattgtaaccatgtttgaataaatcaacgaagaaagtcgttaaaaaaaaaaaacgttttctgtcaacaaatataattaattaggacggttctaaaaaattaaatagaatttaattacttcccaaatttgtagttttttttttgattcccttgaaattaataatctttttttttcccacaattttattaggaattttacaacggttgttatttcccggcaaaaatattaacgaccataagagttaatggaagaagcattgctaaaaatagagggaggatcgtcccacaccagtcaaacctatatgtcttctccgtcgtccactaaaatcttatttacccctcaaaaagacattcctccactacaaaaacttgagagcaaaacaaaacaggttatttgtttgacaagaaaacacaaaacattcattctttcgtttatatttgaatatctttccttctagggaatgctaatcaaggatttgttcggcagaaatg

SEQ ID NO: 19970 - DNA, 3003 bp, Unknown; identical to SEQ ID NO: 19969
  misc_feature (1)..( 3003): 2750-1469P.txt file - cDNA_ID_1823883; gDNA_ID_2926192; Annot_ID_141081

SEQ ID NO: 19971 - DNA, 3003 bp, Unknown
  misc_feature (1)..( 3003): 2750-1469P.txt file - cDNA_ID_1823899; gDNA_ID_1620700; Annot_ID_48746
ttcgtggaggctttgattcaatgcaatctcaattctttagcagatgttaccgagcgtctacaagcagaatctatggagaagaagatatgagatgtgacttgagaatcttttcattcggaaaagaaggaaaaagaccaaagaagagaaataactcttcccttttatagcaatgtctatgttttttcttcttctatttccattttctgaatgtttgtatattattggaagtttgtaacgaaatgatttcgaatagctgtcaaacgagaaatataaattcaaatttgtaagtgtttatatgaaatgcttttttatttttaacatttccacatgaaaatataaataacatatcatgacacatgcaaaatcatatttatgaaagttttttcaactctctccattttttcgacatatcagcattagatagagtgacacttatcacatcaacatatgaattacatttcttatttaatttaatgtatttaagaatttataatcatgcattaattctttctaaattttttgacatgtttgaacttattaattaaataatttcaatttaattaggtacaaagtatatcaaactcacataaataacttatttaaattaaattatataaatcgtataaacttatgtataaacataaaattaatagaattttaatgaacttttagatttgattaaagtataaaaattaaataatatgatataagaatttatttcatgttttcatatactaatatatatatatatatatatatatataaaagattaataacaattgatattagttaaatttacggtttagtttaaggtaaacccaagatgctctcatctggaattctgttatgatctgtacgtcctcaaagttccagagatgttgagaaagatcaaacatcagcagcgtcagaggctttttctctggagaggtgatgttgaatggctctatgcgctgctcggagagcaaaagagtcttgaagaagactctagcaaatccatattggcatctaagcttgatctttgtgttcctgttatgaaacacagaatctagactgagactgaagttggatacctcagctttgggatggagaataccggaactcttggccggagtaagaggatggaaagcatgctgaagatgagcaagagcgttccaagaaagactatgacgaagaaaacaaatcagaaatatactaagtatgagttgtttcaaagaacgtagtaatggtttataataatattaacaatagaataaaataaatagtaatggtttaagaaaatattaataatagtgagcaaaagctaagcaaaatataagcaaaacataataacatagtcaaaataatatggaaatgacaagtatataaattatatgttaaaagttaagaaattgacttggaggtttgtgttgggattttcccttaacttaaataaaggttttaaatgtgaacaaaaaaagtttgaagttttagttgggaaaatgttttgatttggaggtttgttttggaattttttcacttacctaaaaagattttggttattattaacataaaattctactaataacaattgatatgcttcttcgtgttaaaaacaaaaaaaaaacaattgatatgcttcttctttttttgtgcacccaataaatatgaattaaataagcatttttaatagatttatctcttgatagggtatccatctaaacaaatacaaaaaagaatacatttaaccaaaatgcttatctaatgtatatttaaatgtaaaactttattgtatttgttaatttagcaaaagataaaatgtctaattgctaaatcatatttacaaaatataatatctgttaattaaatcatgattcagttgtttgggctgttaattttgttttaatccgtctttgggcttgacccttctgtatttgcctattgggctttatgaatgttatgaatgaaaatgaatagtcacaaaacaaaagaaaaaaaacagaatttgagtcggtacacaactgttaacgaggtgtacttggtggaatcatagacacgtgtcttgacactcttaaggcctcttcaccaccaaattacttccctaacaaaagaattattattattgtgaagccccaaaagatcgaacattctaattcaatggcctacttgctgaccaagcaaaaaggaccggctccgttttcacctaattccgagcttcacaacgtgccttccattggttgaatattcaactggtttaaccaaaccgaagttacacatacgatttgagtcggtacacaaatattacgagacgtactttgtggacagtttgacacgtgtatcgccactctttatccctcttcaccagtcaccactcaccaccaacttaaaaataaaataaaaagagcatatattgtggagccccttacatgatcgaaaattctcgttcaaaagcattcgttaagaccgtgtgttgtgtgtcgttttttgtcgacgaaaattagaccggctctgtttttattggctcgtttcgattgaaagcgtggctataattggtttaaccaaaccgaagtcgacgtctcggtttgttcggttaagattaagccttgtagaacattccaaaacgccgcgtcaaagcttttagggtttgattctgctgtgtggctacccactcaagtctccagtgttcctttgtggctctggtttgccctattcttctcttccccctctctctctctctctctctcttgttttctttttccctcttctccaaggaatctggaaaaaattaaaccttttttctaaatccctggaaatcagaaaacttcctattgagaaaccatagattcgatccaagcctttgattgtatcaaaatctctgcttcaccaagaatttgggttgatacagaagaaaaaagttaaatggttgaggcagagcgcgcggagaatagttggattgcttcggaaacgtctccgtcgtcgtctccggtggtaatagaaagcagtgatttttcgataactgatggaatg

SEQ ID NO: 19972 - DNA, 3003 bp, Unknown; identical to SEQ ID NO: 19971
  misc_feature (1)..( 3003): 2750-1469P.txt file - cDNA_ID_1823899; gDNA_ID_2926192; Annot_ID_141075

SEQ ID NO: 19973 - DNA, 3003 bp, Unknown
  misc_feature (1)..( 3003): 2750-1469P.txt file - cDNA_ID_1823946; gDNA_ID_1620701; Annot_ID_48777
ggctgccatgagaagagaagaagatgttgaagtcgatgattcgttttatatgagaaagtgtgtggagctagcaaaaagagcaattgggtgtacaagtcctaatcctatggtaggttgtgtcattgtcaaagatggtgacattgttggccaagggtttcatcccaaagctggtcagcctcatgctgaggtaacaaaaattcaatctttctttgttgggttactgaaaatgagcaaactttaagtcttgcttgtggaattgttgttgttggcattggtatggtaggtgtttgctcttagagatgctggagagttagctgagaatgctactgcttatgttagtttggaaccatgtaatcattacggaagaacaccgccgtgtacagaagcattgattaaggctaaggtgagaagagttgttattgggatggttgatccgaatccaattgttttttcttcgggtattagtcggttgaaagatgctggaatcgatgttactgtgagtgttgaagaagagttatgcaagaagatgaatgagggattcatccatcgaatgttaacagggaagccttttctcgccctcaggtaaagttcattgcttctcttgagtggagacaaatccgagtcaatagattgtttttaagttttgaaaatctttgcaggtattctatgtctgtcaatggttgtttgctagacaagattgggcaaggggcttcggatagtggtggatactactcgaagctattgcaggaatatgatgcgataatactttcttcctcgttatcggatgaactctcgagcatttcttcacaagaagctattaatgtttcgatccaacctattcagatcatagtagctagcaatgcacaacagtctcatatccttgcttcttcccacactgtggaagaatcgggtccaaaagttgtagttttcaccgcaaaggaatcggttgcagaatccggaatcagtagtagcggggtcgaaaccgtagtattggaaaagataaacttggattccattttggattattgttacaaccgtggactatgcagtgtcttgttagatttgagggggaacgtcaaagaccttgaagttcttctgagagatggatttgagcagaaactattgcagaaagtaattattgaggtcttgccggaatggagcacaaaagatgagagacagatcgcgtcgatgaagtggttagaatcaaagcatgtgaaagatttgcagtctaagcaattaggtggaagcgttttgctagagggctatttttgatgttttcatgtatgaatgaatacaagtcatgatatttaccttttttaaagcatagtattattaaggttttacagatcctattattaatagattgataacagatttttgagaaaatgttgtattttcaaaagaaaatattttcacatgttgagaatctgattcgaccttctatggcctacacatgatgggtatcctaagatgagatgttttttcttaattggagttcataaaccaaaacccataaaaaaaattaaggatgtgtaatagaatgtgaagtacattcaatgagaactgattgttgatgtcgattgcgttacaaatttgacaattctttttggattttggtggaaatgtgaactaactgacaacaaacatcaaccatgttggatttgtttttgtcaaaaccgatatatctagagatattcgaaagaaagaacgaaataaacactatacaatagtcaattttaaatcactttatgatttaacaatcctaagttcctaacttcaaatttaagatttacaatagcatgaattttagtctttcttattgtttcatagcattattgtattaaaaaattactctacagttacaccatctctctttataatggttgtttcaattgagttaatcatttactattaatctgaaaatttgtagtatgaatgttattgttggtacacaaattggtgatggaacaaaagattaagaggatatcttttatgtcgacaatggtcgagtggttcaacaaaatccacgcaatcgcctgagcgaaaaagttgaccatactcagccccaccactctccacttcataacctttttcttttatccttcttccttttgcatttatacaagtattttccaatgacggaatgcagaaagaaaaaaatttgttaagcaaatgtcataaaatataaaaatatctatagcaagtgactgtaactacgattaactcaaccgattggagaattgagtaacttatatcgaactcaagttcgaacatacgctatatatgagagtcaaaattattgatcaaaatatgcaatgtaatggtccaaaattcaaaatattaccaaaaagaaattctataagttaatgttggaattatgataataaaaaaatactaattgatagatatgaaacaatttaagacgatccatttgagacccgggaaatagattagtttatcaagtattaatttataaagattttactttggactatttgttcaaaaaactacgtgatgatgagttttctatgcaaaatcaattaccgatatgtggatgattcttgtcttttgtagtaatgttggttatctttcactcttaatgagaggtttaatatcatgtgagagttaacgagcttcttatttgagtcaattgtagataaatagcttaacatatgcccttataaactagcgttgattctcaatccaatttgaaactattaacagaaccattaaaaactatatatgaacacataaaatatataattgaccataacgacgagtcaagatatatatttaaagaacttacttttttccactttgttttgctttttttttttttagtctttggtacatatatattacaaacccttttccagtaaatagttagcacaaactaattatcagatgtcacttaaaccaacctccttctttatataagcttggttaacattgagtttgttatcatggtctatgtgaaacaattcaggaataaaaaaagaaatg

SEQ ID NO: 19974 - DNA, 3003 bp, Unknown; identical to SEQ ID NO: 19973
  misc_feature (1)..( 3003): 2750-1469P.txt file - cDNA_ID_1823946; gDNA_ID_2926177; Annot_ID_140373

SEQ ID NO: 19975 - DNA, 3003 bp, Unknown
  misc_feature (1)..( 3003): 2750-1469P.txt file - cDNA_ID_1823952; gDNA_ID_1620701; Annot_ID_48774
gaagataagagagtcgtcaacataccatgaaagtaagtgtaccagcttctgcagcaagaacacctccagagacgggagcatccaacatgactggcttttcccaattatctacatcaaagatgcttgaaactagtgaaaatgaaacaatctcgacttgttcacaagaagaacaaaatgaagctgttgttaactcataagaagaaactaacttccttccaaatcctatctaagctttacctctcttttctttcaaattacaattagaaacagcaagtgagatttttcgagttgtttgtggatcaatagtggatgaatctataaacaaagcaggtcttatatcattttctccaagaagcaacccatttgttcctgtgtacacatccatcacctacatcaatcacaattttttttccttcataaaaatcatccaatcaattgaagattaacattctttcagtaccaggagtaaacaacaatactatctcgtagactaggtgcagctaatcatacagctaacaggacgatctttcaaactgttttcatataaaactattgctaaaggtaaataacttacatgagatgatgaaggcaacattgtaatcacaacttcgctatcttgtgcaacttcataaggagtttctctagaagagactcccatttcagtgaacattttcataacatcacggtttctgaaaattcaaacacaagtatatgcacaagaaagttaatcaaaggaatcaacattaaccaaatatgaaaattgataggcagcaaaacgcactcaaagtacattacatgtcatgaacggtaactttatatccagctctaattagattattcaccattctgaatcccatatttccaagtcctatgaaaccaacattctgacaaaacagcaaaaatgagacttcatttacataaattttgggtactgaatcagacaaattttgctgttaaaaatctaatccagacaactttttttgcagaactgatgaatttagataagtggtcaagatcaataagcaatttggccactaaaattcttattaactatgctcgagattacaaaagttaagatcttttattccaactaccttaaggatcatgttttagaacgtttcaataaaattctaggtgacttatgaggaaaagagattatgttttctgatcatgaagacaatttaaaaagcagaacctggaattgatttgaattttgagacgaagaagagaaccggtggagcgacccagacacgaaattggttttgaatttagaaagacaaagtagagtttgcgctctgcgaatcgccattgatgaatttcttcaaactcagagcaagttaacaattagcaaatgagagtgagttttagacgtaagtgtgtaatctcatcaaaacactcagatttttgttttttgaattatgaccccttaactattaatttattctgaacccggacatttactttcaacattatcagtagaacccaaataattggtctgatgcccttgtctcttccggtcttccctagtcaacgtagtcagcatgtgggacccattttcctacgcggtatttatttcgcttctacattttcctactaattaatgtggtatcaacttcaaaaatatttatttgtccgaatattcattactattttttctggattgttcaaaaaatcatgtttcatttactacacattttccttgcaagcttttaatatctgtattttggtgtaaataacattcactccgaactctcattactctttttattttccctattatttatttatgtaaattcatttattgcaagtttctaccaaaatttattagaacactgcgcaattttcgcttattttcccaatgctgtaaatctctctcactaaaggcaaggacatagactcataaccatattggataaaccctttcacgtccaccatggtcacactcactaaaaacattagtgtaagtagcttttttcattttttttggattcctttcccgggccattccaggcgggtaattaaactatattttaaatctttcctcactgaaaagactatgaaaaagtaaattaatatataattttcttctcgtgaacccatgaaaataatttcttgctattttactttttatttagggtttttgatttggtgtccgttcacacgcttcaagacttacccttttacaaggtccttgtcgttcgtcactgtcgaacgtgaaaactagcaaaacattttctctatctttaattttgttttggcttctttcttttgttcttaaacagtgacaatcttttaagggtttttaatttttaaagtgacccacaaagatttccctcagttagctcagtgactcagtctacaacactgttgagcttaatccaaaaccccgtgcagttcatgagctaatgaacaaaatgattctgctttaaagtttttgtcttccttcttcttcaactctgtcgacattgttcttgcagtgagaagcttttttcatccccgtaagtttaaaaatcctcacttttcatttatctctttgctttggagttaggttagatctcggaatgggacccaaatattgaatagcccatttgttcatttaatgtttttttcagctgattccctttgagtgaagattgtctcttctcactcagtagcattactgcattttgtttgattggggtttctcagaagatttgttcatcttaggtaaagtttctttctttagcttctgtttttttttttatcagagtgaaatttctggtattgttgatttttgcagaaagatttaaacttttttttggtaacattgatgggttttgtcttatttcattatgttttatgtcagatttacttggggttccatgaattttctgcgttggtgagctggaaaagttgttgggattcttcaaaaactgtagctttttgggggaaaagatttgaagtcaaggaaggatgaatctttctaggattttgttactctccatgttttttctatctgcaatg

SEQ ID NO: 19976 - DNA, 3003 bp, Unknown; identical to SEQ ID NO: 19975
  misc_feature (1)..( 3003): 2750-1469P.txt file - cDNA_ID_1823952; gDNA_ID_2926177; Annot_ID_140370

SEQ ID NO: 19977 - DNA, 3000 bp, Unknown; identical to SEQ ID NO: 4348
  misc_feature (1)..( 3000): 2750-1469P.txt file - cDNA_ID_1823956; gDNA_ID_1620701; Annot_ID_48773

SEQ ID NO: 19978 - DNA, 3000 bp, Unknown; identical to SEQ ID NO: 4348
  misc_feature (1)..( 3000): 2750-1469P.txt file - cDNA_ID_1823956; gDNA_ID_2926177; Annot_ID_140369

SEQ ID NO: 19979 - DNA, 3000 bp, Unknown; identical to SEQ ID NO: 4347
  misc_feature (1)..( 3000): 2750-1469P.txt file - cDNA_ID_1823964; gDNA_ID_1620701; Annot_ID_48771

SEQ ID NO: 19980 - DNA, 2848 bp, Unknown
  misc_feature (1)..( 2848): 2750-1469P.txt file - cDNA_ID_1823964; gDNA_ID_2926176; Annot_ID_140367
atctcttaattataaggtttattggatctaaagacgggtcatcaaagatttcctaaactgaagcaaaatacactaaatattcaaatatctatctgttaccaaattataaacaaataagttcgtaaaacaatttaatattttatatacgaaatcaattaaatcttaatcacataaaaattagcacaaaaaaagtattcaacaattaaacaattatcaaatctctgtgttatataagttttgatactatattcgaataaagtgtaatatatcttttcaatttgtattctttaactaatttaagctacctaatatatttgctaatcttatacctatcaaaaccgactatcgtttcttatctctacagtatttttgcaagacttttttagtggatttggataaaagtgcattcgggtcatatggtacattctcctattaaataaatatggtgcactcctatgttattagctaaaatattcagattataattcagagtcatatcataaataaaattaatattaataaaataaatggctttttggcaagacggatttggagagacgggtttttgaatcaacattaataaaaaaataaaatataattaatccactgtttgaatacgggttaaatctttaatttattattttttaagaccactaatattaaacatatcaaatcatcctaatttagaaaagattatataaaaccaaaaatgttatgtggtatgtataatgttactatatataaaattaaactataaaatataaatgtgttagagaatgatacaatttgcaaaacttttatatataataaataattcttaaattttaaaaattattactttaaaaaaatattacgggacgggtaaaggaattacagaacgggttttattttggaattgggttatatggtggatgtatttgaatcaatatttataaaattttaaaatattattaatatgctgttttacaaggggttaaacttcagttttttaacaattgtctcatggattcgtggtatagcgttacttaataacaattataaactgtaaaatataaatattttataaaaataaaatttgcaagttttaatagatattactttaaaaaaataaatcatcccgcggtataccgcgggttaaaatctagttctgtttaaaatctccatgtttcttccttaatcacacttttacttttggtcatatgatatgactcatattttagtgttatgcattcattacatgacatggttttcttcaaattttggctacaaagcacaagaaatgtgagaataccaaacattaaggttatgattcgtaacattgcataatagcataacggtataagttgcataataaaatatgtagaatgaaaaaccgtagaatcaaattacttaaaaatatatgttgattggatacattttacagaacgacaaataaaatattatatcaacaatatatatttatactaataaaactgtttttaataaattttaagtaatatttgataataaaaatataagattcttaaaatctattaaagagttgtgaaaatgctgattagagattttgaaatgaagtaagtaaagatatggttagttatttggttgttcggatttttagggaatattatttcgtgtaatattgaattagtagagattcaagggattaatgtgtgcaatttatgagggtagtgcaaaataatatttttgtttaggtaagtaattagtgcaaaacgtgaataattgatcaaaaatttggtcattgtcataaagaagacaatcttgtctgattgattttgtagggactaaacatacaatatcgaaattgaaaaatgatttttcgacacaaatcttccccaaaaatgtatatgtagattattaataacataatttttgtgtaaataattatagttttttattgtttaaaattgttagtatttaagatgcgtaaaataataacaatttcttatgcgaataaaaactatatacccattttttgcataatgaatttttacttgtaaatttaaacaaaaatacaaattgtgcgtttttacgttttcttatacaattatgcaaattttcttaatatgagaatttttttacataattacattaaaaaacgccttaccaatcagagccttaaacctataataacttcacacgtaaatggtatttattttcttctagaaaaagagaatggtggataggggaataaaataaaaagttggaaaaagaaacgattctacaacatgtaatgaccaaaacaccctccttcctccctctaaaaccccattctctctctcccactctctttttctctgttgctctctcctgagttcttcttacatgaaagtccgctgaactctttaggttcgttgtcgattattcttgctttatgtttgtgtatttattttttgaacttctgggctctttctgaaattcaatttcattgacccatcttctctgttcatgacaattcgtttgtcctaatgttacactcaaaacccttttttgttgtttatacccaaaccctctatctatctgtacttccttggaacgaaatttttttgctttgactcaatttctttcttagaattagaacattgagaatgttggaactcaaatagatgttggttcgattttgaactttttgtttatttattaatgttttctatggctctgatttgaattgtcaagtttaagacattcttcttcttctcttagataccctaatttcaggggtatgcacattttgcataaaagttccaatctttcctgatcgttgacaatatttatgtgtacccttttgtttgtctcagtgtgttaaagaagctacattgtgtttgtgatg

SEQ ID NO: 19981 - DNA, 3000 bp, Unknown; identical to SEQ ID NO: 4346
  misc_feature (1)..( 3000): 2750-1469P.txt file - cDNA_ID_1823976; gDNA_ID_1620701; Annot_ID_48767

SEQ ID NO: 19982 - DNA, 3000 bp, Unknown; identical to SEQ ID NO: 4346
  misc_feature (1)..( 3000): 2750-1469P.txt file - cDNA_ID_1823976; gDNA_ID_1620701; Annot_ID_165069

SEQ ID NO: 19983 - DNA, 3000 bp, Unknown; identical to SEQ ID NO: 4346
  misc_feature (1)..( 3000): 2750-1469P.txt file - cDNA_ID_1823976; gDNA_ID_2926176; Annot_ID_140363

SEQ ID NO: 19984 - DNA, 3000 bp, Unknown; identical to SEQ ID NO: 4346
  misc_feature (1)..( 3000): 2750-1469P.txt file - cDNA_ID_1823976; gDNA_ID_2926176; Annot_ID_199899

SEQ ID NO: 19985 - DNA, 3000 bp, Unknown; identical to SEQ ID NO: 4345
  misc_feature (1)..( 3000): 2750-1469P.txt file - cDNA_ID_1823978; gDNA_ID_1620701; Annot_ID_48765

SEQ ID NO: 19986 - DNA, 3000 bp, Unknown; identical to SEQ ID NO: 4345
  misc_feature (1)..( 3000): 2750-1469P.txt file - cDNA_ID_1823978; gDNA_ID_2926176; Annot_ID_140361

SEQ ID NO: 19987 - DNA, 3003 bp, Unknown
  misc_feature (1)..( 3003): 2750-1469P.txt file - cDNA_ID_1823982; gDNA_ID_1620702; Annot_ID_48798
tgcatcggatctgggcaagctcttcattggcgggatttcatgggacacagatgaagaacgactgcaagagtattttggcaagtatggagatttggttgaagctgtgatcatgagagaccgtactaccggacgtgcccgtggctttgggtttatcgtttttgcagatccttctgttgccgagagagtcatcatggacaaacacatcattgatggccgcacggttagtattcttggatccattgcttgacaattcatctaattatcagtcttgagtaatcgagtgttctaaagtctcgatctttctgtaatgattctgtcttagaggtcttattggtctcgctgctcgttaatgagcaacggattgttctataatctcgatctttctgtattcatgctctcttagagatctgtttggtgtcatccattaatgagttttaagcagcaacgtttagatctttctgtaatcatgctcttttcgaaatcttctgttgtcattagcttctggatttgctgttactgttataacttgtgagaatgtgttgttgctttgtgttgaagtggcaatgttagtgttagatcaatgagaaaagaatgaaagatctttttttatttctttgttgcaggtcgaggcgaagaaagctgtcccgcgggatgatcagcaagtgctaaaacgacacgccagtccaatgcaccttatctcacctagccatggtggtaatggtggtggagcacggacaaagaagatctttgttggaggtttaccgtctagcattactgaggccgagttcaagaactactttgatcagtttggtacaattgctgatgttgtggtaatgtatgatcataatacacagaggccaagaggctttggcttcatcacttttgattccgaagagtctgttgatatggttctccacaagacctttcatgagctaaacggaaaaatggttgaggttaaaagagcagtgccaaaggagctctcctcgactactcctaaccgaagcccacttattgggtatggtaacaactatggagtagtccctaataggtcttctgctaatagctacttcaatagttttcctcctggttataataataataatctaggctctgctggccggtttagtcctattggtagcggtagaaatgctttctctagcttcgggctcggattgaatcaagaactgaatttgaattcaaactttgatggaaacactcttgggtatagccggatccctggcaaccaatacttcaacagtgcttcaccaaaccgttacaactctccaattgggtacaacagaggagactctgcttacaacccgagcaacagagacttgtggggaaacagaagcgattcctctggtccaggttggaacttgggagtttcggttggtaacaacagaggaaactggggactttcttctgtggtgagcgataacaatggctatggaagaagctatggggctggttctggactttcggggttatcattcgcgggtaatacaaacggttttgatggctctataggggaattgtatagaggcagctcagtttatagcgactcaacatggcagcagtcaatgcctcatcatcagtcttctaatgagttagacggcttgtctcgctcttatggctttggtattgacaatgtaggctcagacccatcagccaatgcctcagaaggatactccggaaactacaatgtcggaaatagacaaacacatagaggtacactcatcgatgtcaaacttttttccttttgcatctcatctgctacatttatttttgcctgttgaaaagtaattagattgattaacgttttcaggtattgaagcatagaaagaaatcgacgaagagaagtgagaattgtagatcaagaagaacagccatttccgttgcagagtttgaagagttgttatttcgatatcaagtagagaaagaaaccaactttcttcatcacagtgagtttcttgttttgtttttttcgtcgttagcatcacaaacacaaaaaagagaagtttatttttactttaaaaattcttacataagataagatcagattggtagctgcaaagatacaacatggatgataaaaaaagatttggtttcgtctccatagcaataaccagagatcgttgattctcgatcactattctttaggtttctctccttcttcttccatgatttcttgatgttgtgtgctctgtttgtaactctaattgttaaaattttttatgttacagattttttttttcttttggtttttaaactttggattcgaattgttcatgggaacttttggatttttctattagcgtgagagaaaacacattgtgcaaaaggctccaaaatgattattttgttacatttcatactttttacctttgggtttcttttctcttctgcttacagtataatctatttattaagtacatgtggttaattcatgattttaaggtaaaaaagtaaacaagcttatcttccaaattggatttgtttccaagaagacattggggttgttaccaagaatttgagaaagcctgaattattggatcctttgactaaaccaagacacatttgggtccaggaagtgacaatcacattcacacaaataattaaccaatcttaaaccatgggacattgtgattaagagctacaacatcagttgaacttgaacattatgagactacatcttgagcattagcactagcattggaagttaatgggcttcaggcccactaagtaagttttcagcctaagcaatatcttcaataatgattttttatttatttaggatatttacttttaaaaatgtaaaaacaaaaagacaataaaagtttgttgacaaaagaaaaaaaggttcaaaagtcccaacggtcgaatcgaaattcagacagttcaaaaagccgctctccatctccttctctcttacagaacataatcagatctctcttgctctctcaccctcactctcactctcactctcattgtctgaaaaccatg

SEQ ID NO: 19988 - DNA, 3003 bp, Unknown; identical to SEQ ID NO: 19987
  misc_feature (1)..( 3003): 2750-1469P.txt file - cDNA_ID_1823982; gDNA_ID_1620702; Annot_ID_165123

SEQ ID NO: 19989 - DNA, 3003 bp, Unknown; identical to SEQ ID NO: 19987
  misc_feature (1)..( 3003): 2750-1469P.txt file - cDNA_ID_1823982; gDNA_ID_2926189; Annot_ID_140951

SEQ ID NO: 19990 - DNA, 3003 bp, Unknown; identical to SEQ ID NO: 19987
  misc_feature (1)..( 3003): 2750-1469P.txt file - cDNA_ID_1823982; gDNA_ID_2926189; Annot_ID_200896

SEQ ID NO: 19991 - DNA, 3000 bp, Unknown; identical to SEQ ID NO: 4367
  misc_feature (1)..( 3000): 2750-1469P.txt file - cDNA_ID_1823990; gDNA_ID_1620702; Annot_ID_48794

SEQ ID NO: 19992 - DNA, 3000 bp, Unknown; identical to SEQ ID NO: 4367
  misc_feature (1)..( 3000): 2750-1469P.txt file - cDNA_ID_1823990; gDNA_ID_2926189; Annot_ID_140947

SEQ ID NO: 19993 - DNA, 3003 bp, Unknown
  misc_feature (1)..( 3003): 2750-1469P.txt file - cDNA_ID_1823994; gDNA_ID_1620702; Annot_ID_48793
atcgattatgctctgaaaaacagggatgttaaactcgttccatgtggacttgattttggccgaccagggtaatatacattttcatctgcattgaaaaatttcatgattcgtcatctgaacacaaatgttttgctgcatatcttcagatttagcagttttagagaacaccggttccacccttctttagagaagactagacgtttctatcctcacgtgcacaacatggatggattctttgttgcaaaggtatacacttggttaacctatgaatagcttttccctgcaaaacagatgttttataaaatatgaatagtgattaaaccaacgaggtatttactttttcctttctttgttctgcagctgaagaagatgagcaatgcaatgcagccttcaggaaatgatgagccagctgtaacaatggagcaagctcaggtgtcgtctagtgatgatgatgatgagaaagctgaggccattgaggagttggagaagccacctgttgccagtgggcaacccaagagagagagtaacactaaagaagacacgaacaaacgaaaaaatccaaggtcaaaggaaattcacaaaggcaaaaggaataaaaacacaaaaaccgaaagtggtaatgtggaagaacccaggaagcaaaagaagaagagatcacaatggaagaatgagattgctcaagctaggtaaaaaaactaagtgtttccttgacagacaaaagagaaaaccttcttatgtacattgttgtatcatacacccatttacccataaatggttgaatatgttgcagggaagaaaaaagaaaaaccatgagagagaatgctaaggagacgccaaagcacaggggataagaataggtttgagatcgtgatgcatcttgaagagtagaatatttcggtgttctggccatggcgaaggacacaagaaaagaggcttcattggctgaggccaaggtatctatacaatggctttctagttttgattaatttactgcgtaaagaaagggtgacacccacatggattagctgttacatgtccaaaagttttgtatcaatcacataacttgatttttgtgagaggctgtttctattttccgttttcaattggagttgtaaaatttattgaaaacaaaaacgagtccctactttctctcacaagtgtgtttgaaaggctattcatttttctgctcctagcaattatttaataaaatacataaatcttggagggttgggtccataccaccacataaggatagaatttctcatagtattgatttgacgaaaaaataagggaattgggagtgagctggtcattgttagggagagatgtgaaggttttctgaagtgggacttgagtgttggagaaacatgacaatccaattcaactcttcttcatccatctttatcagattctcctccgttggggaccttacatttacttctctcacactaatcttcttgtttctatttttagattataagcccatattataactgctagtgcttgtagccttgtatacacaaactcacatgcatcacatataacatcgtataattgctgtattcactttatatttggatatccaagattatagaaaagagattcctttgcaggacccaaaagatacagcttttaaaagcaaatgagttcattttaatttcttgctaaccaaaatggtaagtaattttgtggacttatggtatggataaataacaaaatctcaataaaccattgaaaataggaaatcaaaaaatatatttctgcatataatttgaaaagaaaatttgcatggaaataactatgtttttgaacaaactaaacatggaaataattattaccgcaaagtacaaggcattacgataagcatccttgaaagctttgtctttttttttgggaactcgaaagctttttgtcttccagttgtaagaaaaatacaggaaaaaagaattgaaaagccctaaataaaaaagtcgaaaactttagctttgaccaactctttcctctcttttcatggtagacccaactctctcatttcttactctctgattcatctctctctctctcttcatttccatggaaggaaggtgatgagctttctcaatctctctttactgattcttaatgaaagtcatctcctttctctttggtatcccttttcttcttctctgcttaattcctgaccaaaaattgtgacaagatctttcaatccaaaagctatatacattaaggtaacgatttatgaagtatttctcctcaatttcatttcttttgtttctacgagtctgcatagatccagaagagctttgcttgattgttcttactttcctgagatctgtttaaacttagcaaaaaaaaaaagtctactttgcatgaaatgtgtgattagggtttatgctaattttggttaattggagaatcagagagtgttccctgatgtggaagtagtgaattactttgggttgagtaaatgtatgtctctcaattgattgtcaacgagatttgagctcgagatccgtaaccaagttgagctaaagcttctttctttcgacttgttctctatatgaaaattattttttctttgactcagttatttttcttaatttgatttctttgagctcgatcttatgattcatactgcaatgattgagttgtggcatcagctctgatggtatcttctgtttttaaaaaatagcaactttttagtgtttttctgctcagctctatgttaaaggatgtttcttcattacggggagaaatgaatgagagctcttgtttattgatcttcccatgattctagttctaaacgagccttctgttatctgaatttgaagtgttttaagcttttttattctaataagccgtcttcttctctgacgctatgttttgctcactgcagagctcaggtcactatctgacgggatccgtgacaatagtggttactggagtcaaaagcagctccttgaatcttgagtgttaagtagataggtaaggtaaccgttcatg

SEQ ID NO: 19994 - DNA, 3003 bp, Unknown; identical to SEQ ID NO: 19993
  misc_feature (1)..( 3003): 2750-1469P.txt file - cDNA_ID_1823994; gDNA_ID_1620702; Annot_ID_165116

SEQ ID NO: 19995 - DNA, 3003 bp, Unknown; identical to SEQ ID NO: 19993
  misc_feature (1)..( 3003): 2750-1469P.txt file - cDNA_ID_1823994; gDNA_ID_2926189; Annot_ID_140946

SEQ ID NO: 19996 - DNA, 3003 bp, Unknown; identical to SEQ ID NO: 19993
  misc_feature (1)..( 3003): 2750-1469P.txt file - cDNA_ID_1823994; gDNA_ID_2926189; Annot_ID_200890

SEQ ID NO: 19997 - DNA, 3000 bp, Unknown; identical to SEQ ID NO: 4361
  misc_feature (1)..( 3000): 2750-1469P.txt file - cDNA_ID_1824002; gDNA_ID_1620702; Annot_ID_48791

SEQ ID NO: 19998 - DNA, 3000 bp, Unknown; identical to SEQ ID NO: 4361
  misc_feature (1)..( 3000): 2750-1469P.txt file - cDNA_ID_1824002; gDNA_ID_1620702; Annot_ID_165114

SEQ ID NO: 19999 - DNA, 3000 bp, Unknown; identical to SEQ ID NO: 4361
  misc_feature (1)..( 3000): 2750-1469P.txt file - cDNA_ID_1824002; gDNA_ID_2926189; Annot_ID_140944

SEQ ID NO: 20000 - DNA, 3000 bp, Unknown; identical to SEQ ID NO: 4361
  misc_feature (1)..( 3000): 2750-1469P.txt file - cDNA_ID_1824002; gDNA_ID_2926189; Annot_ID_200888

SEQ ID NO: 20001 - DNA, 3000 bp, Unknown; identical to SEQ ID NO: 4360
  misc_feature (1)..( 3000): 2750-1469P.txt file - cDNA_ID_1824006; gDNA_ID_1620702; Annot_ID_48790

SEQ ID NO: 20002 - DNA, 3000 bp, Unknown; identical to SEQ ID NO: 4370
  misc_feature (1)..( 3000): 2750-1469P.txt file - cDNA_ID_1824006; gDNA_ID_1620702; Annot_ID_165112

SEQ ID NO: 20003 - DNA, 3000 bp, Unknown; identical to SEQ ID NO: 4360
  misc_feature (1)..( 3000): 2750-1469P.txt file - cDNA_ID_1824006; gDNA_ID_2926189; Annot_ID_140943

SEQ ID NO: 20004 - DNA, 3000 bp, Unknown; identical to SEQ ID NO: 4370
  misc_feature (1)..( 3000): 2750-1469P.txt file - cDNA_ID_1824006; gDNA_ID_2926189; Annot_ID_200886

SEQ ID NO: 20005 - DNA, 3000 bp, Unknown
  misc_feature (1)..( 3000): 2750-1469P.txt file - cDNA_ID_1824010; gDNA_ID_1620702; Annot_ID_48789
taattgcatattttaaagacttttcatggctttttagctcaagctttactctgtttctctttgctcttgttcaggagatcaaatcaaagacctctctgtttccgatatgagtacccgttattcctctcagttgcaatcatcagccattaactccatcactgtctcctcatcttcttccttcgcttccacgcaactggatgataacactcacacggctccggagagctctccatcttcttccttcttcatgagacttgccatgagggtatctagagcaaggtggttcattttcttgagaagagtctttcattaccagaacgcctcaagatccgatcttggcaccaatcctttcaattctatcgcttggatggtatcagagctcatcgctttacttttacagatcactgtgataacatccacactagctttgtccaaaaacgagaggcctgtttggccgatgaggttatggatcactggctacaacgttggatgtctgctcaatcttatgttactatacggtcggtatcgtcagcaagatactagccatgaaaatgcatttagcttcggcgatattgagcagcaacaaagaagcagggaagagaccaccaggttactaacaaaaatctagttttttcaagtttgatcataaaatgcaaagatttctaggaaaatgacttatttttgtgtgtgttttaggtgctcgcatttgatgaacaaatgccggacatcgctggagctattctttgcgatatggtttgtgataggtaatgtatgggtttttgattctcggtttggttctttccactatgctccaatccttcatgtcctctgcatctccctactcgcttggaacgctctctgttactccttcccatttcttctcttcctcctgctctgttgtgttgtacctctcgttagtagcttcctcggctacaacatgaacgttggatcttcggaaaaaggagcttcagatgaccagatctccagtctcccaagttggaaatacaaactcattgatgaaacttctgattcttctcaagcaaacaatgatccggtaagcactaatttgaattctgaaataggtcaaatagtcagaaatcaatcttgatatcaaaactgaaacccaccggtttcattattgcaggaatgttgtatatgtttggcaaagtacaaagagaaagaagaagtgagaaagcttccatgttcgcataggtttcacctcaaatgcgtagatcaatggcttcgtatcatctcgtgttgtcctctttgcaaacaagatctccctaactgaaaaatcaaaacaatacatgagtcacaagattgaatctctgaccaagtaccatatatgtgtttttttttttttctgttgccgcctaaacacgtttacttgtgtgaatgtcgttatcattcctttttttttcttgtgtacaaagtagctcaccagtaactgtaattttacctaaaaaaaaagttaaaaaacatgatcaatctgttgttttaccagtagagtttgtccctctcttaccattaatcaaagttttaattgttggttaatgtaactaagcttatactggtttttgctataatattttttccaaagacaatttaaaccgaattcaaacccagagaccaaatcagaccaaagcaacagtcagaatccgaataacatgacacgccgtcgtataggaacgattattgaaacgatggtgtttaagacagcgcataaatggacacatgctccactagacgacgacgtgtgaaagtgaatgtaacaaggagttttattacaactgtatcaacatcgagtaaaaataaacaaaattatttattttttaaatttaaaaagtataaaaacgccaacaaacaaaaataatttggtctttttcttagcatatttaaaattttgcaatatattcattctgcttatagaaaatcgtgtcgaccttttttctctcacttacccaataagagcttttttcgcgttttccaccgcaaccaccgtcaccttcaaccgccggagccgccgcaaggaaggctcatcatccgccgtggcgtaaggctttttcttcttctctttctcccttttctacgatttcgcggtcggtcgcttcctcgtaatctcgtgtgtttattccgggaaaatcgcgatgggaaacaagttaaaatttgagattgagaatcaagcaactaatttcttcgcaagctgatagatccatgagctgattaccaagtttatataacgagattcatcgttgttgtatctctgaatccgaacgatttggaatctaaaactcattggatcgctttttctcatatccgtcatttctccttagcttaatcacttctctgattcatatcgcgattagattcaggtgtcgatcctcagaggattatattttctgacgattaatccgtctggatagttttattatgttcttcatgatgcattttttttccccgcaaaattcatgatgcatttctgacgtgaaattgggtgtttttgattcctcattttatcctagttcatgtattttttggggctgtttcttagatttgggtttcgtgttttagcttaaagatagttcctaatccatgaatacattggttaatctggaaatgaatctggagttaagattaatgcataaagtttacgaccgtttataatatgcgtctcctctgtttgtgtttcatagtatctggtgctttagtctaattcagatctgatctgagaatgatgaatcttgtttgctcctgtcaattcttctttaactgttttgcaatttgatgagctaataactgactatatctcatttccttcccatcgcagaattttttgaggtgtacaaagcattgcctatttgacgaaccaggaaatggttaaaaggtacttatcttgttcaaatgcatatgtctttagattcttccaagtggttcgaaagttcttacattttattgttatttaacaggcatggagagttttgatttacaagatatatcatg

SEQ ID NO: 20006 - DNA, 3000 bp, Unknown; identical to SEQ ID NO: 20005
  misc_feature (1)..( 3000): 2750-1469P.txt file - cDNA_ID_1824010; gDNA_ID_1620702; Annot_ID_165111

SEQ ID NO: 20007 - DNA, 3000 bp, Unknown; identical to SEQ ID NO: 20005
  misc_feature (1)..( 3000): 2750-1469P.txt file - cDNA_ID_1824010; gDNA_ID_2926189; Annot_ID_140942

SEQ ID NO: 20008 - DNA, 3000 bp, Unknown; identical to SEQ ID NO: 20005
  misc_feature (1)..( 3000): 2750-1469P.txt file - cDNA_ID_1824010; gDNA_ID_2926189; Annot_ID_200885

SEQ ID NO: 20009 - DNA, 3000 bp, Unknown; identical to SEQ ID NO: 4385
  misc_feature (1)..( 3000): 2750-1469P.txt file - cDNA_ID_1824054; gDNA_ID_1620703; Annot_ID_48808

SEQ ID NO: 20010 - DNA, 3000 bp, Unknown; identical to SEQ ID NO: 4385
  misc_feature (1)..( 3000): 2750-1469P.txt file - cDNA_ID_1824054; gDNA_ID_2926174; Annot_ID_140257

SEQ ID NO: 20011 - DNA, 3003 bp, Unknown
  misc_feature (1)..( 3003): 2750-1469P.txt file - cDNA_ID_1824065; gDNA_ID_1620703; Annot_ID_48805
tgacaaaaaattttgggcttttatttatctgtgtactattaaattaaaatgtgaatatatataaggacaaaattgattagacgttttacgagggtcttctgtttatttttggcttttgattgtttctatcacttttgtggaccaattcatgttttcttataaactaataaaggataaatattcgaacaatcaaactacttttatttaggccatgagagttataattgtattagtctaaacaaattagaattcttttacttaagaaatttgtagccacaatcaacatagtttcttttgtaacatctctactagaacaataatattgacattttacatatgatttgagaaaaaaaaatgaagtagaacaactaaaaagaaactatctagctaatcaaacaggggacacgcacacgatatattagccgtaggcgacccaactgagctaatgctaatggctcccaccacactaatagatcagtcccaaccaaaaacctatgtggtgtttggaattagaggggctattaaaattttagttatacccgaaaaggaataaaaaatgcgtcaatatctttaagcagccccaagattctaatcttaggcggctatgatgactaaaaaaaccaatcaaaggaaatgtgatttggataatttttagttaaatgtcaatatcagtcccaaccgatacgttgatgagactattactatatcattcctcgatatgcatgcatacattcaagttacagcaaattgtctcgttactaaaatattcattatttactctttaagttatgaaatgattgaaaaatattcatttttatatctaaataagtagtatatatataaaagtagtaaattaataatgtttttttttaatcaaaattcaagtatgccacctagtacaacaaaaactatactcctgtatatttgtaacaacaattcatacagtcaaaatttcatttgttaaaaacatgagatataattaataaaatacaatttcttgatttctagctatggaaactaatattctcccttgagttggattaaccgcatgacacatttatagatccaatacggtagtatgcgttgtcaatctaactattgacagtttacgctcttgctcattaaaaccaaatagactatcgtagattttgtctaagagttgcacaaaatgtcttctatcctttcttttcacaaggattgcatatgtttgactttcttcctcgtaacatcaacgcctacttcgtaaatttttattttattttgtctcgataaataataaattcatatttcatgacaattgttagatcctcagaaatctgaaataccagtatgctagaaatgccacatatttgtaacttcttttagattcaacttgttgtatttcagcttttgcttcttagtaaaattaatttcggtggtttatttttgaaaaatcacacatacgacatcatttgatacaagtgtaaaaactgtttagtacaatttttcaattccttgaaagctaaaagggtttcatattctaaaacgcataacaaatacgatacatattcaaatgcacgtagatgtatataccgagatacatgtggtttaacctgctcaatggtgaaaaatccaactctacaaacgttaacaccataattaattgttttcatagtctaaacgcaactaatttcctgtaaaaagtatcagtaccaacatggcctatatcaagtacacaaaaacatcattaactgttattccaatttcattgagcattgagttgtatcagcatcatccatgttggttcatgtgggtcattcacgagaccaatggatggtgacagaaaacatgcattttcaattagcaggtgagttaataaatgaactaataccacttttattattataagcttaatgagtgtatttggatattttttgttttagttaaagtaaacatacataatgatgacaaaaaacaaacgatattttattttgtcaacatttcctatacgatgcatagacatgatcaatgcagtgagatattttgtcaactaatcatatcaatgctcaatgaaatcaaaatggatattttgacggttcacggtttgattggtctaacacaccggtccgacaaggctttggaaaccattttttatatccatctgattaccaagaaaatatactgtataagataaacacaatcaatcaatagtatataagaccattctctaaacactatctttaattataatgtgagtggatcactcgtatctcggatttcagcccaatttgttttaacatgataggcttgttaaacgagaggctggctcatccatcgaattcctttgacatgatccaaagttactcttatcgcaaatagattagactacggttcaagccataacacttaaatccacacttcatagtctcttgaccaaacaacacacttatgcacactatctttttaaataaaacaaccgtaatttgggtcgatacatatagggttccttatgtaagcccaaaatgtaaattggctttaatcagccattaaatgggccaacaaggcctttaaatcaaaacagtataacgacaaaaacgtacttggacgtcaaaaacagatagacacgtggcagtttattgttgatagacaaaaatcgtgaagccgcttcttggaatggagattcttcactttggtggactagagactctttgaggtctcaagttaactctttaaagtttaaaccttttgacttaattcaaagccgtacaactttttttgttcgccgccgcgtcgccggaaaatcatcaccgttagtcttcttctcttccttggtttatctttttgctgctaaaatcaaatttagggtttaatcacttcactgttgtaacaattactgattcttactcaaattgattcgttgaggcattgtcttttcgaatttgatagttttaactgaatcttcttgtattagcttcaagcttatatactatgtgaatttggtagcaggtatatgcgataaacatg

SEQ ID NO: 20012 - DNA, 3003 bp, Unknown; identical to SEQ ID NO: 20011
  misc_feature (1)..( 3003): 2750-1469P.txt file - cDNA_ID_1824065; gDNA_ID_1620703; Annot_ID_165155

SEQ ID NO: 20013 - DNA, 3003 bp, Unknown; identical to SEQ ID NO: 20011
  misc_feature (1)..( 3003): 2750-1469P.txt file - cDNA_ID_1824065; gDNA_ID_2926174; Annot_ID_140254

SEQ ID NO: 20014 - DNA, 3003 bp, Unknown; identical to SEQ ID NO: 20011
  misc_feature (1)..( 3003): 2750-1469P.txt file - cDNA_ID_1824065; gDNA_ID_2926174; Annot_ID_199731

SEQ ID NO: 20015 - DNA, 3003 bp, Unknown
  misc_feature (1)..( 3003): 2750-1469P.txt file - cDNA_ID_1824073; gDNA_ID_1620703; Annot_ID_48802
tgtttttactacacacatttgcttcctcgaatgatttgaaagtagtgacgggaaggaacgatttgcattccgctgctgagagataatgcttgcattgcacttgaggacacctgatgggaacctctgaagtctttactttcccttcaacgtacgttttcatgcagtgcgaacagaatttgtgagtgcatttcaatgatagcatcatctcagactgacggtcttcacagcagatcgagcagttctcgatcggtttatccccatcaagattagaagacacgattcctaccgctacttgagccaagcttagagcttcatcaagatcacagaaaggagcaagctttagaacaaacccattaaggttacttgttttctccaataccctttctctcagagctactaaaagagggatctcgagctgctcctcacgagttatctgcaaagtcaattcatataaaacgtgagctcaaacctacaaagagatacaaaaccatatgaaagcaagtctcttcaacaagctaaagaagagagactttacctgattatagagcaactcggagtcggttacagcaaccacagagctgagattgttctgtaaagctacttcaagaccatccataagagctaaatagttagctacagactcttcgacataaaaatccaacttcttctgaacctgaatcaactccaaatctcctgacctctccaacacaacaccaattcccgaataaccagaacccaaatctcctctttcgaatatcgagactcctttaaagaccatcttaacagagaactcatcatcaagatcatcttttttctcctcctctacaactttagctatatcatcactaccctttaaccaaagttcttcatcaccacaacaacttctaaactcttcctcatctcctaagtgattcaatggaagctcctcacattcacaagaatcctcttgattttccatgtctggaaacaaacctatctaaactacaaaaaggtacaaactttcttaacttagcaacacaccaatgaaacccatatcggatctgcaaatttcatgaaacaaaaccgaataaaaatgagataaagctaattcttttagatatcatctaatctcaattataccatatactgagagagagaggaaagggaacaaaaaaaatgaactttgcattacagatcaacaaaacagctaagcttgatgaagttacataaacagatcagcataaatcagagaccaaatcatttgaaagtacacagaagataacaaaagaagcagctcgatttgttgacccactaaacaccaaccagaccctcaattattacatatttcaaggaagaaaaaaattctaatttatttaagtagcagaaatcaccagagattttgtaataaaacgagatcggttgaaattaaagtatcattaagcaagaacagaaatccagaagctttcttaccagtggaaggagatttacacttggaaactaaaattaagaagaaaactctaagctataataacatcttcaaaatctctgtttttttccaggaaaaaaaagaaaataaacgcattgttttggatgtttctactgagtttttgtggagagaagaagaagaagaagaagaatcatcggttcttctggttttgctctctcttcgaatggcgtaagagaaaagttttacttttttttgttttgtttctttattctctctttttttatttattaatttattttatttttctgagtttttggcttcactttgctgtcattctcgtactgtacaatgttttatattttcccacaatgaaataattattttcacattactaatcatcaagtatttaatttaaaatatatagtttaaataattgaaactgtaataatggaattggattagaacctgagcatgaagaattatagcttaagaaaccaaagttagcacatggactttgtctcctctcattgagaaaaaaagctgtaacttcattaaaaaaaaatctttctctgacttttaacatccaatagttatattccctttgaataaagttagcaaaaagaagtacaaaaatgaaatttttaataattgtatttctgcaatagaagacactcgaggacagtttatggcagcaggaagtttgaaaatggagacagcaatcattagcttaattgtttataatcttaattcaaatgggaaatgtgaacatggacttatcttttattgcagtgtttgtggcatctgaagaaacagtaattaacagaggaaataaacagaacaaatgcgattactaatgaattaaccaaataaatggagcaaacacagaacaaacaattgaacatcatttctaatttgaataacacttctcatttgaatcttgtacatcatttctaattttaatttgtaatatatgggcctactgagacatatcaatgtggcccaatatcaatagatggcctactcagatttttcctttgaacacaactaattagtaattcctaatttgctaataatgaaaacataaacaaattttgaagtaggaaataacgatatattaccaatggatatgacaaagaaaacgacaaattttgtagttttttaacagtttgtaaattgtaacatattcaattcagcgatgtcggtagttcaattttaattcaacattaaaccaatttagcaatacattttgacagtaaaataatacgacatttcatgtatcgtttggcatgatccacaccttccaggcttctcttcgattaaacaaaactataggataatataaaatacaatttaaaacctttttctatctgataatgtacatacacaatcaataaaatcaggattccgattctctagtgtaatcttttttctattgatttagtcataacttgactttccaaatcagcagcaccgagaacaagccggcaaatcttctatataagacaaccaaagacaaaacaatttatctcatcaaaaattcaaacatcatatattataaaacaatctcaatactaatg

SEQ ID NO: 20016 - DNA, 3003 bp, Unknown; identical to SEQ ID NO: 20015
  misc_feature (1)..( 3003): 2750-1469P.txt file - cDNA_ID_1824073; gDNA_ID_1620703; Annot_ID_165146

SEQ ID NO: 20017 - DNA, 3003 bp, Unknown; identical to SEQ ID NO: 20015
  misc_feature (1)..( 3003): 2750-1469P.txt file - cDNA_ID_1824073; gDNA_ID_2926174; Annot_ID_140251

SEQ ID NO: 20018 - DNA, 3003 bp, Unknown; identical to SEQ ID NO: 20015
  misc_feature (1)..( 3003): 2750-1469P.txt file - cDNA_ID_1824073; gDNA_ID_2926174; Annot_ID_199726

SEQ ID NO: 20019 - DNA, 3000 bp, Unknown; identical to SEQ ID NO: 4378
  misc_feature (1)..( 3000): 2750-1469P.txt file - cDNA_ID_1824077; gDNA_ID_1620703; Annot_ID_48800

SEQ ID NO: 20020 - DNA, 3000 bp, Unknown; identical to SEQ ID NO: 4378
  misc_feature (1)..( 3000): 2750-1469P.txt file - cDNA_ID_1824077; gDNA_ID_2926174; Annot_ID_140249

SEQ ID NO: 20021 - DNA, 3000 bp, Unknown; identical to SEQ ID NO: 4419
  misc_feature (1)..( 3000): 2750-1469P.txt file - cDNA_ID_1824094; gDNA_ID_1620704; Annot_ID_48847

SEQ ID NO: 20022 - DNA, 3000 bp, Unknown; identical to SEQ ID NO: 4419
  misc_feature (1)..( 3000): 2750-1469P.txt file - cDNA_ID_1824094; gDNA_ID_2926206; Annot_ID_141725

SEQ ID NO: 20023 - DNA, 3000 bp, Unknown; identical to SEQ ID NO: 4405
  misc_feature (1)..( 3000): 2750-1469P.txt file - cDNA_ID_1824120; gDNA_ID_1620704; Annot_ID_48835

SEQ ID NO: 20024 - DNA, 3000 bp, Unknown; identical to SEQ ID NO: 4414
  misc_feature (1)..( 3000): 2750-1469P.txt file - cDNA_ID_1824120; gDNA_ID_1620704; Annot_ID_165193

SEQ ID NO: 20025 - DNA, 3000 bp, Unknown; identical to SEQ ID NO: 4405
  misc_feature (1)..( 3000): 2750-1469P.txt file - cDNA_ID_1824120; gDNA_ID_2926204; Annot_ID_141672

SEQ ID NO: 20026 - DNA, 3000 bp, Unknown; identical to SEQ ID NO: 4414
  misc_feature (1)..( 3000): 2750-1469P.txt file - cDNA_ID_1824120; gDNA_ID_2926204; Annot_ID_202085

SEQ ID NO: 20027 - DNA, 3003 bp, Unknown
  misc_feature (1)..( 3003): 2750-1469P.txt file - cDNA_ID_1824123; gDNA_ID_1620704; Annot_ID_48834
actatttggatctttttgtggctcaagctcctgctaaattcaatccatccctcatctcaagatcggcaaattttgtaagtagtcttgtttccatctcttgaatatgatgaagttgcatctgacatactgaatttactatgccatagtaagcagatcgttgttagtttactattttcttaaaattaaatgtgactattgaaacatgcatttgagaatactattttatctgtttcacaaatgatatttaagaaaattgaaacaaatttttataatcttatttacaacttaagttttcttatgatatgaaagcactccaccgagaaacagtgatttgaatgagatggtttaatttattttctgcttcttttcagctaactaggaattggtttcctgcaaaggaagcttcacttaagcgtagaaacatcttagaattgctttacaacctccacaaaggtcatgatccaagtattcttccagctaattccaaaagtgaaccacctcattgtggagtttccaacaggaatgatcaagaaactgaaagtgagaatgtgattgagtgctgtaactggataaaaccatttgatggttcctcatcaaccgttacagacatttcccaaacgaagacttgctcgccggatctgattcttagcaaagaagtttcttacagcggaggttatgaccctccgtcttctaagctccgaaaggtcttcatgtcacctattgtggtaaaatttcattttctatatcttcagtttagattctactgctaagtatcttatgttgataatgtttctatacaatttctcaaaccaggaagaagtgcaagaaagttgtgagaaaaaggaccatttggaaatggacatacagaaatccactggtcatgagatagaaacattgcgaaaagagggatgcatgctttatattgaggacagtgatgatgaagaagctgtttcagtagaatacgtctctgattctcaagattcatatgaagttgagatgaaagtagaagatgatgatgacgatgagcttatagttactggagaatcttcagggattcatggaagcagagaaatcaagtctgattcagcatcgatcgaaagagtgaacaaaagtagagattcaactgctgcctcttgttataatgactttcttcttgtgttatctgatgatgagaggagctcagacgacaaagaaaacatcttaataagttcaaatgtgatggccaagccaaaaacttgatactttaatgaagatgaatatcgccaatctaatgcgattattatttttatggttttctaatctctttgcccataatgaatatcatgtcaaattttatattcaatagtgctcgtctcttatacgaccagtatcaaagctttgtttttcaacagacaaaaaacaaaagaatctgctgttattatccaagtgggaggatgaaaaccgagagctcacacaatgctttaatacaaaaagaaactgatgtcgtcgtccattcacattcacacgtcttcgtctctactctgatgctccaggagcaattgttccaactcttccttgcgtcgggctatctcctgcaataagggtcaatgacttagaaaccatttgagtgatgataataatgatgcagatagactatcaattgacacttgcctcaagatccttgactgcttgttctcttgaaacttccttttgctgtcgagcacgcttcagaaagccgatgcagagaactccctgaagttcagacaacgatcaaagattgacagtgaaaacataaacgggaactcagatattgaaaaacaaaggaagtgattgcccaagaagctcatttttcaagttagaaatagccctacagattcgctaaccaccacatcaagcatctattgttcagagttgggagttatccaagtgatcctaaaggtctggggacaaagtgtcaacatgagttcttacaacaaaccaagaatcgttttcaagtgaaatgcattcttataagcaagatgcaaccacaaggcacaaactaatacgaaaagattcaacaataagcgagagcagagagggaataagcagatgtgatataataggatgaatggtgatagcgtacagaaatgacatagataacaccacaagcaagaagcaagtagcttgcgatgttctgtagaagcaggagatccttcttttgagtcatatagtcagggaaagctcttgtcatcacagcaacactgaaatgaacaaagtaaagatatatacataaaacataaaatcatacagcaaccaaggaatggtctcatttttgagtacctggcctggaattagctgaagcagcactcaaaaaacacatcataaaagaacaacacgatccattccaacacaagaggtacaaaagaaggttactaagctgtatagatgtacttacaaaatttgaagcattcctctaccagcccagtattcaagaacctgtaaacagatttgcaaaattagaatcaattcatgttagaaaatcaaaggaaagagatagcaaaagatacgaaaccttggaaaatttgagaatgaaaccccattcagtctcaacgagaacaacaaaacaagcaatcaccacagcataacaccggaatattccatcgaagagctgctcggagaggaaaagataaaagctttacacagagatcatcttcaagtaatctaatgcctgcgcagcgagagaggaaaaagagagagagagagagagagattatacatcgtggctgtcacggaaggagcgaacggcagcgagaacgttaacgacaacacagagaatggcgatgagagaggtaacgaggctgaagcatctacaaacaacaaggaaaggatctgctctgtttccgagcttcaatttcgcggatccggaagaaggtccggcgggggattcttcgatttcctcagtcctatccatctaaaaccaatttcccggtgagaaaatccgccgtcttaagtggaatttggaatcgagacgcgaaaaacgaaatg

SEQ ID NO: 20028 - DNA, 3003 bp, Unknown; identical to SEQ ID NO: 20027
  misc_feature (1)..( 3003): 2750-1469P.txt file - cDNA_ID_1824123; gDNA_ID_2926204; Annot_ID_141671

SEQ ID NO: 20029 - DNA, 3003 bp, Unknown
  misc_feature (1)..( 3003): 2750-1469P.txt file - cDNA_ID_1824127; gDNA_ID_1620704; Annot_ID_48833
ccaattccccatcttgaacctgagttctccccaatggtataaaacccatctttgaggattttcgcactggtgtcttaagctccaagcaacaaatgggaccatggcggacagtccatgccacatattaccgtaatcgtaatgattatacgagacaaatgtcaatccctcctggagactggcattgacaggaagagcttgaggccaagccagtgcataagtagttccatatgatccatcatgctcatcaacccctttcaagcacaaaagccttcctttcgaagattccgaaggaaattcttgatattgaacctcaccttttgtttggttatcgtagagagagctcataaaccaagtatgaccttcaagtggtttgtttgaaaaacgaaggtctttcaggggaaggaatgttaccgactcacgtagtttctccaccaagtaagccgtctcgttctcagattttatttgttcaggttcttgttgttgttcttttagatatgtgaatagtgaaggaggaagtaaaatgggttgttgggtaatgtgaaatgaccagatttgaagaagaacaaaaactgtgacgacaagacacaagacgttcaaggagaacttaggggaggctaagcaagtaactagattccttgaaacgctgcgtttagtcatgttttgaatgggaagagtgaatgaatgtgaagactgaagaaagagaatggtttttatcagatgacatgggtgaaatgaaactcgtgaggcaaaataaagctaactttatttgccaaagatgttgatgcattgcatgtttgaaaaacgaacgttatcacatctgcgccaacatttgtggcagtttttagcatcgactaacacatgcgtcttgttttattttctaaatttgttcagaaagtttttaagaaagaaatatgtatttattttgataaattgacaacccgaaattttcatataaacttaaagaatttagatagtgttttactgcaactttaactaaaaatcatgcacttataccaacttatacgtgtatatatcaaacgtcaccaatttttttatatattactatgagtaaagaaccaagtaagcactttaacaaaccacaaacaaatttaaaatacaacatattaataatcaaaaggaaattaaaggtacaaaatacaaatcatcaaacgggggtatgcgtaattaaacaaacaaaaacacaccacaatgaaacaactaattacaacaatcttataataaaatatacatcatcaatcacatgaagtgatgatagttcaaggactcgaagtagttgcagaaggcgggggagagaagaacggaatggatgggagactagtcggcagagagggaatggatgggagattagttggaagagaaggaatggatggaatattagtcggaagagaaggaattgttgttggaaatgaaggcaaagttggcattggaggcattgccgtgggaatggtgggaagatttggttgtggcaaagctgatggcattggaaatggagacattgcagtgggcattgtggggagagttggtaaagacggttgtggcaacgtcgatggcaatggaggtagtcccattgttggaataggcagatttgggatttgaggaagaggttgttgttggagaaggcggcgtgaggctgagcaagtgttgatcatcatagaggaagagaggcacactagaaaagcaatgcggaagagcttgtatgatgccattttgctttggttgtgaatctctaattatggttaagcctttctaattgcttctcttgtattgcttgctttgtgttgatgagaaattcaaagatatgcgattgagtttatatagcggcaagagtctctatggataacaaagaccttttattcaaatatcatatatggtttggttaggtgtactttatggttggcttgagctattgttagttcaacttaatgtgtgtttaatagattattttgacaattcaaggatttttattgaagttagttcaacaatcaaaactatctaactctaatacacatgttaagtctataaccaaacttttaaatgtcattttaagcttataaataccaattaccaccgtaagtatattataaaatctgatgtaacaacataaattttgtgtaaagctatgaaatatgaaataatctccaaaacaccaaataaaacaaacaaaaattatgatcattattttgtcacagctgtaccaaaaactccaaaatggaatttcccggtcaaaccggatacatggtttgccaaataaaaaaccggaaagacgaacaactaatggtttgacggatatgaccggtcgaaccggatagacaagcaattgaattttgaaaatctgtggtcattcccgaaaagtcaacctaactagacagaatcgaaattcaaaattccgtctctttggtacagaatacgctttggaccttctcgagcccgtcggaactgtaactcagtattattctggcgccgatgactctccggtcagttcaatcccgaagtaagcggaaaccgattgatgtatttgattactctgacgaggatgaccgtgttgaagaggagtcgaagaaactccttcgcaaattcgattccccagttactaaaaaacaccactgcgccatcgataagtatgaattccttcgatgctgtgagtgtttcttctctgaatttctcattgaattttgtttttggctgtgtcctgcaaaatatttgggaaggaagatcttatttctcattgaatttccccaagtttaacatggtaacacaagagaaggaatatgttattttttgtgttaatatctttctattgcagttgcgaaggatacccaaagcgagagtaaagtattgcaacacattgttattgatgttgaaggtaatagtaggaaaattatatcttggagaacagttctcaactacaaatgatgaaaattgtgtagaattccaaattttcagatgctagtgtgtgtggtagaatagaaataaccaattatg

SEQ ID NO: 20030 - DNA, 3003 bp, Unknown; identical to SEQ ID NO: 20029
  misc_feature (1)..( 3003): 2750-1469P.txt file - cDNA_ID_1824127; gDNA_ID_2926204; Annot_ID_141670

SEQ ID NO: 20031 - DNA, 3003 bp, Unknown
  misc_feature (1)..( 3003): 2750-1469P.txt file - cDNA_ID_1824143; gDNA_ID_1620704; Annot_ID_48829
aagcgaattcgaagaagaagagacgcttagattgttaccaaagtgtaaacatgcttttcatctttattgtattgatacttggcttagatcacacaccaattgtccgctttgtcgtgctcctatcgttgaggccaacacaatgattgatgatcatagtgaggggctagaggagataagtgtgatgattccagaagaaaatggagatgataccgatgaagaaatcgaggaagaaagagatggctttgttagtaatattagtagagatcatggtgagtcacaacaacagcgagtgagacgatcagtgtcgttggattcgttatcgggtttaagggtaagtgaagttgttgtgggtagagaaaaggagaagttgaagagaggcaataatattggatctgggaggtcaagtttattgaagagatctatctcttacagtggaaagtagtactagctagcttcagtgctaataataaaaacaagaagtccataaagtaagtaagtttcttgaagaagaaaatcaaatcaaacccaacaagatatagattgtattcatatgtatgaaggtgatataagattacgattatcaaagctagtcactcttgtaaagttaaaagagagttttgacaacttctactactctgcttagatactctggatttgtggattaagtataaatatacaccaaacttcgttttgtatgttacttatttattgttcctcaagaaataccatctggattttaattatttttagattcaactgtcttatgtgaatggatttacatttggcgttgtggatctctaacactaactatatgaaacgctgcgtttcattaaaagaaggtaaaaacgacaaagagaatcttcgtcttcatcgatcattgttgtgtaaaactcttgttcctcttcctcttcaacgtgaacacttctatttctcagagaacattcacctatatgtctttcttcaaggagaagtcttcctctttccagatttaggttagattcatgttataactttttctaagatttctgatttccgaatttgaattttgtttatgatttagtgtcggtgtagaactgaatgatactaatgcaaatgattgagatcgatttgatgtaaaattatcaccttctcgtgtaatttaaaggtcgaatcgtccggggtcacattgtcgcaggtttatgtttatcctctaaattagggtttcttttgtgaaattggggattttttttgtctgcttacaaatcatgctgttttatttctcttgaaattaacttcatgctgtttttgacatagaatacaacagacaaactagatttaacagaactgttaagatgaacggaacataagatgacttctaaaaatggataaattttaggtcaatttttctttccattttcagttttctgaccctaggtgagatttgttttggacttttcatgtattgtacatgtgagttaatcaaataaaatctaggttcatgcatttacaaacatagtttaggaagtaaaatcacatgttaagttttgatcttaaactcttgttgttattcttgttgttgtttgctacttgttagaattatgaatctttgacctatagcaaatttccataaaatcaatcatgttaacccttaatccaaatcctccatcaaagagtttttttgcattagttagcttctcatgaagcgaatttggttttgggaaaagaatttgtggggtggggtccaaaactgacacgacacaaaaactttggtttctccgtctttgttggagaaatgcattcacatccacttcttaccaaaattaaataaatcaatatttaatttttttaaggccttcttgttttttcagatgaacactcttcagatgccttgtgccttattgatccagattcgaagtacccaactttactctctagacctttttcatggcagccactcccacacacttctctgtctcccatgatcctttttcttccacgtctctccttaatctccaaactcaagcggtatgttgtcaattcttcttccccccctccctatcacactgtttcatctaattctgactattggttttcttaactctgttgcattttttatttcagatctttggtcccaatcacagtttaaagacaacccagttgagaattccagcttctttcaggtaatttcttggctttactaacttttcagtttggaattgggataacgatccgtaattatgatatagttgtgagagaatctatgataagaatcttagagaaatcacttggtgatgcattgtactttgttgaagaccctttttgtttgtacagcttatgtttttgtttcttaggtttctataagtagtgtgtcttttataagatttgaaaagaagagtcttttttgtgatgcttcaaatggcaaaatctcagtgaagatgtttttataataatcaaatgttcagatttagtatgtttttgtggtgtttgcagaagaaaagctacaaacttgcaagtgatggcttcaggaaagacacctggactgactcaggaagctaatggggttgcaattgatagacaaaacaacactgatgtatttgacgacatgaaacagcggttcctggccttcaagaagcttaagtacatgtaagttgcagagtaccaccaattgtcatttttcaatggttaatagattacttatttcctttcttcttcacctgatgatattctcttgagcagggatgactttgaacactacaaaaatctggcagatgctcaagctccaaaggtagctttactcttcaacgaaattttattgttcatggaaggcttgagatatcttctgtggtttgaattttgtctggagaaaggaattgttactaacagtttaagcaacagtttctggtgattgcttgtgcagactctagagtttgtccttctgctgtcctgggattccaaccgggtgacgcattcactgttcgtaacattgcaaatttagtacctccatatgaggtataacatttaatg

SEQ ID NO: 20032 - DNA, 3003 bp, Unknown; identical to SEQ ID NO: 20031
  misc_feature (1)..( 3003): 2750-1469P.txt file - cDNA_ID_1824143; gDNA_ID_2926204; Annot_ID_141666

SEQ ID NO: 20033 - DNA, 3003 bp, Unknown
  misc_feature (1)..( 3003): 2750-1469P.txt file - cDNA_ID_1824147; gDNA_ID_1620704; Annot_ID_48828
tgaccaaaaagaaagtaaataactaaaatgagaaaatgaaaaccacgagctcccaaatttcctgcggcttctttagcctcttgtttcgtttatgtaccactttctcgactccacactttataaaccaaatcctccacgaaactccaaacacattgtccaaagatcaatacacactgttttaagaagaatttgaaaagaaaaagaaaaaaagaagatgaatgccggaaagcaagcttcgtgggcggtggcgacggcgatcgcagccgtggaagtgctaaaagaccaaggcgttgctcggtggaactaccttttccgcttactccacaaagaagcaatggctcgcgtccgtaccattacagtcccatctcgtccctctcctcctacgtcttcatcttcggctacttccatcagatccaaacctttgtccaccacaccctttgagacatcctttgagaaagctatgggtcttagctgctttggtcccaccaccgttagattctagatctctatgtactgtgttgtatgtacgcaaatcagaatgtgcatgcgtctatgacttgtttttgtttacccatcacatcattagctaggtccactaaatgttgtacttgttggagtcattattctaacattttgttttcaatattgaaataaatctggttttatatagacataactaaaacaaaccggagtgtttaagccggtttatatttataccacaaagaatcttaatccgctaaatttacatcaccgaaggatggacccttgtgagtcacacaattggtgtgcaaattagaagaaaaacatcaattcattttttattacatggaaacaattttagaattttttttgctatgatacaatgttaccaacccatcattatttgatttatgataataaatttcattatgtaaattttacacatgacctagtgtataaaatagacatactagctggaccataatcagacgaacttaatatcggttaatacactaccggttcattaagcatttagacaaaaaaaaaaaagaagaagaagtccatatacatgcatatatacgaaagtcacatcagaagatcagacatacaagtacaacgactagtcagtggacgcagtttgttgtgtggtgggacaaggtgagaatatgcccacagatatcgctattgctctctttaaccattttggtccaaaacactttgccaacttttttaataaagactgatacaaattttagattgatacaacttaacattaaaaccacccaaataaaacttcgtaatatagataagcatcattgtaccacaaccacacaccaagccaataagtcaacaactactcctaacccttttaaacctaatcaatacaatttaatattagaccgactacgtgatggtgcatatgcttctttttaccaaaacatatatattcaagcaacaattaatacatatttcgattctcaatttaatcaactgaagaaatttcggtcacttgttttaatttttttttgtaaagcttataatttttattttgtaccaacatttaaaaatcaattattttggtgaaattaggatgatagataccgtcaacctacttttgttgaccaaacttgattctaaagaaagaaagcaaaagagagagaacaaaaacgaagacaactctcatcttcttttctctttctttttcctctttctccattgcttgttgattgatgatcttgaagcaaggatcatgaggttccttcacagatttctgttggaggatatgcccaaagaaaccttttcggactctctctgtaaaaataattgcatccaagagttgaaaactctaggatactgttcatcctattgtcttgacgagtgtccttccatctgcgagatcgtcgtaatttcaggtctttcaccacctgcagagatccacccgacgataacttaaagaggatcttgatcatctctgcttcatctatcatcacaactctgtttctccttactttacttgttctctgcttcaagttttactataggaggagaagatcaataacaacatcaagaagatggagtatggaagaagctaggaattgggattttgatggaccagcacctgttattgttgatcatccgatttggcatatcagaaccatagggttgaatccaacggttataagttccatcaaagtttgtcagtatagtaaaaaagatggtgttgtggaaggaactgattgctccgtttgtttaagcgaattcgaagaagaagagacgcttagattgttaccaaagtgtaaacatgcttttcatctttattgtattgatacttggcttagatcacacaccaattgtccgctttgtcgtgctcctatcgttgaggccaacacaatgattgatgatcatagtgaggggctagaggagataagtgtgatgattccagaagaaaatggagatgataccgatgaagaaatcgaggaagaaagagatggctttgttagtaatattagtagagatcatggtgagtcacaacaacagcgagtgagacgatcagtgtcgttggattcgttatcgggtttaagggtaagtgaagttgttgtgggtagagaaaaggagaagttgaagagaggcaataatattggatctgggaggtcaagtttattgaagagatctatctcttacagtggaaagtagtactagctagcttcagtgctaataataaaaacaagaagtccataaagtaagtaagtttcttgaagaagaaaatcaaatcaaacccaacaagatatagattgtattcatatgtatgaaggtgatataagattacgattatcaaagctagtcactcttgtaaagttaaaagagagttttgacaacttctactactctgcttagatactctggatttgtggattaagtataaatatacaccaaacttcgttttgtatgttacttatttattgttcctcaagaaataccatctggattttaattatttttagattcaactgtcttatgtgaatg

SEQ ID NO: 20034 - DNA, 3003 bp, Unknown; identical to SEQ ID NO: 20033
  misc_feature (1)..( 3003): 2750-1469P.txt file - cDNA_ID_1824147; gDNA_ID_2926204; Annot_ID_141665

SEQ ID NO: 20035 - DNA, 3003 bp, Unknown
  misc_feature (1)..( 3003): 2750-1469P.txt file - cDNA_ID_1824151; gDNA_ID_1620704; Annot_ID_48825
atgctacgagaagaaaatattaccataagcgtttccaatcgcgaagatatttgaggtagagcagacaacgatcagacacaccaccagaagggaccagttaagaaccggtatataaatctgtccaatgaatttctttgaggtgtgaatgattttaagacgtgggaaacagcctagtgctattgactgtttgatgcatgtaaatgtggctgttgtcattgcacgactggcaattaaagcagcaacattagaaatgagaaagactggccagaacaaagaacctgaaaataaaaaagagtgataaacagttagaaacgtgaaatgagaggtaaaatcaagccagcaaatgaaggaatacccttgttgatcttgacgtactgtggaagctagtggatcttacttggaactgacgaaaagaaagcatccccggcagcgctggaagttttcagagaggtatgcggcttgacccaaataacccagcaagaggcaaggtaacaccagaaggataaaagtaagctgcagataaacaccagtactgaatcaaaagttcagatgactctaagaaagacaactatcagaagagcaataaatgagtatttatctccttaaagtacctggatagagtgaacagagaaatagctaagatctgcaaacatggcctccgatcctgagacaagatccacatgtatagaaatgagcaatgacatttagtcaaaaagtcattcaatgtatttaagctttctaaaatatttcccagaatatgaaacttaccagttgcacataaaacgcaacccccaagtgcataccaagcatttacagagtttctcttgaaaaagaaatagatatatgcaggattgaacgctttaaaaacgctgctgtcatattttacgaggttgtaaattccaatgcccgctagacaaaaaaaccacagaagtaaagcaggacccaaaacaagccccaatttgctggttccatatttttgtacactgaacaagatcacaagaaagctgactgatatcacgaccacctgatctgcaaatgaagccatagtcagaaactttacacaaaaaatagtcactaatcactcatcaagataagattatgttttttgaaagctttgtacaatcattagcccctattcagggggcagaagagtttaccctcttctttgttgtatctataatctaattgaagtcaagggacccaggatgcaaccattaaagacccataaaaagttttctggtccaaggaatacatatatccaaggaacgattacaagttttgaaagccagacgaaatcatgctcgtgaccatacataggcgctaataaacgtcaactagaattagttaccttgttctataacaccaactccaaccttcagaccaccgatagcagacattactgtgtccaaaaaagagggtaaaatttagctgcagattattcatgcaacgataatgctcacatgctttttctctatacttgatatgtgacataggaacaaaaaatgtagcctgacagcatataagtacctgacattgctggcgtaacaacagcatcagcaatcaccatagcagtgccggcaagaactaaaatcagaagaagctttttcaaggccattgacgcctcaagtctttctttaattatcaatgatctttcaagttctggagacggaaccttcaaaccaaagcctgatatgcgagcatctgatggaagttgatttgggataaggctaacatttgcatgccggcagatcaacgaatacaaagcaaacgtcccacctgcaattcatttccaaaacttaaacctttaaaccttaaatgaacttcaatctacaccatataaagaggaagagatataccttcgccatcgtcattggcccaaagaacaaaatgtacatactttacaagaggaatcaatattaaagtgtatataaccaatgacaaggctccaataatatcttctttgtcgttaattggagatcttctgaacatgacagtgaaggtatacaatgggctagttccaatatcaccaaatacaaccccaagtgtctgcaaagcaagtatgagtttctttcctataccagtgtcctgaaaaaacacattaccaagttcaacaactcaatcagatcgaaaagtaaacaacatgaagaagaagaagaacattcacacacaaatgctaacctcgatttcgtttttctgagttccaggaatctcaagagcatctacatcgaaagagtcaacggcagggctagtgcgaatcaaacgctgctccacattgtcatcctcctcatcggaatccatttccgggtgattatgctcatcatatccatcatcgtcgtaatcttcattaacctcataatcatctttctcatcgaacacccatcgcgacaatgacgtcgttgaatcgtctccgccaaactcctcatcaatctcagacccatcgcctccactgctttcttcttccacgtgaaacatcaatcaccgttggaaaacactgaagatctcgagattgtgattcagattcgtatctctgatccaaggaaacaggattggaattggtgtttttgagagattgagagatggaagagagagattgatctacatacactggagaggacctggcacgaatgagaaagaagcttacacgtgtccaatcatgattggattcgagactcacggtttaaggaaaaacaaaccagaccaaattaggcttaaccgctaaaaaaccgggttctcgttttgaaagattgagagagacgatctacaaaggaggacaggacccggcacgaatgagaagaagcttacacgtgtccaatcaggattgaacgatttaatcaagcttaaccgtatgtaaaccggattttagctgggtccacaagtagtcaaatatagattttttaatagtcaaataattttcataggggcgaagttcaagatgagttactacactcatcaaagctcacaaaaagagaagagaagagacgaggatcaatcaccattctcatg

SEQ ID NO: 20036 - DNA, 3003 bp, Unknown
  misc_feature (1)..( 3003): 2750-1469P.txt file - cDNA_ID_1824151; gDNA_ID_2926204; Annot_ID_141662
aatgctacgagaagaaaatattaccataagcgtttccaatcgcgaagatatttgaggtagagcagacaacgatcagacacaccaccagaagggaccagttaagaaccggtatataaatctgtccaatgaatttctttgaggtgtgaatgattttaagacgtgggaaacagcctagtgctattgactgtttgatgcatgtaaatgtggctgttgtcattgcacgactggcaattaaagcagcaacattagaaatgagaaagactggccagaacaaagaacctgaaaataaaaaagagtgataaacagttagaaacgtgaaatgagaggtaaaatcaagccagcaaatgaaggaatacccttgttgatcttgacgtactgtggaagctagtggatcttacttggaactgacgaaaagaaagcatccccggcagcgctgaagttttcagagaggtatgcggcttgacccaaataacccagcaagaggcaaggtaacaccagaaggataaaagtaagctgcagataaacaccagtactgaatcaaaagttcagatgactctaagaaagacaactatcagaagagcaataaatgagtatttatctccttaaagtacctggatagagtgaacagagaaatagctaagatctgcaaacatggcctccgatcctgagacaagatccacatgtatagaaatgagcaatgacatttagtcaaaaagtcattcaatgtatttaagctttctaaaatatttcccagaatatgaaacttaccagttgcacataaaacgcaacccccaagtgcataccaagcatttacagagtttctcttgaaaaagaaatagatatatgcaggattgaacgctttaaaaacgctgctgtcatattttacgaggttgtaaattccaatgcccgctagacaaaaaaaccacagaagtaaagcaggacccaaaacaagccccaatttgctggttccatatttttgtacactgaacaagatcacaagaaagctgactgatatcacgaccacctgatctgcaaatgaagccatagtcagaaactttacacaaaaaatagtcactaatcactcatcaagataagattatgttttttgaaagctttgtacaatcattagcccctattcagggggcagaagagtttaccctcttctttgttgtatctataatctaattgaagtcaagggacccaggatgcaaccattaaagacccataaaaagttttctggtccaaggaatacatatatccaaggaacgattacaagttttgaaagccagacgaaatcatgctcgtgaccatacataggcgctaataaacgtcaactagaattagttaccttgttctataacaccaactccaaccttcagaccaccgatagcagacattactgtgtccaaaaaagagggtaaaatttagctgcagattattcatgcaacgataatgctcacatgctttttctctatacttgatatgtgacataggaacaaaaaatgtagcctgacagcatataagtacctgacattgctggcgtaacaacagcatcagcaatcaccatagcagtgccggcaagaactaaaatcagaagaagctttttcaaggccattgacgcctcaagtctttctttaattatcaatgatctttcaagttctggagacggaaccttcaaaccaaagcctgatatgcgagcatctgatggaagttgatttgggataaggctaacatttgcatgccggcagatcaacgaatacaaagcaaacgtcccacctgcaattcatttccaaaacttaaacctttaaaccttaaatgaacttcaatctacaccatataaagaggaagagatataccttcgccatcgtcattggcccaaagaacaaaatgtacatactttacaagaggaatcaatattaaagtgtatataaccaatgacaaggctccaataatatcttctttgtcgttaattggagatcttctgaacatgacagtgaaggtatacaatgggctagttccaatatcaccaaatacaaccccaagtgtctgcaaagcaagtatgagtttctttcctataccagtgtcctgaaaaaacacattaccaagttcaacaactcaatcagatcgaaaagtaaacaacatgaagaagaagaagaacattcacacacaaatgctaacctcgatttcgtttttctgagttccaggaatctcaagagcatctacatcgaaagagtcaacggcagggctagtgcgaatcaaacgctgctccacattgtcatcctcctcatcggaatccatttccgggtgattatgctcatcatatccatcatcgtcgtaatcttcattaacctcataatcatctttctcatcgaacacccatcgcgacaatgacgtcgttgaatcgtctccgccaaactcctcatcaatctcagacccatcgcctccactgctttcttcttccacgtgaaacatcaatcaccgttggaaaacactgaagatctcgagattgtgattcagattcgtatctctgatccaaggaaacaggattggaattggtgtttttgagagattgagagatggaagagagagattgatctacatacactggagaggacctggcacgaatgagaaagaagcttacacgtgtccaatcatgattggattcgagactcacggtttaaggaaaaacaaaccagaccaaattaggcttaaccgctaaaaaaccgggttctcgttttgaaagattgagagagacgatctacaaaggaggacaggacccggcacgaatgagaagaagcttacacgtgtccaatcaggattgaacgatttaatcaagcttaaccgtatgtaaaccggattttagctgggtccacaagtagtcaaatatagattttttaatagtcaaataattttcataggggcgaagttcaagatgagttactacactcatcaaagctcacaaaaagagaagagaagagacgaggatcaatcaccattctcatg

SEQ ID NO: 20037 - DNA, 3000 bp, Unknown; identical to SEQ ID NO: 4398
  misc_feature (1)..( 3000): 2750-1469P.txt file - cDNA_ID_1824155; gDNA_ID_1620704; Annot_ID_48824

SEQ ID NO: 20038 - DNA, 3003 bp, Unknown
  misc_feature (1)..( 3003): 2750-1469P.txt file - cDNA_ID_1824163; gDNA_ID_1620705; Annot_ID_48878
gtgtctcgccatggcggctaaaccagcggcggttgttatctcggcagacgggacttacgctgacgtggctgccgggacgatgtgggtggatgttctgaaggcggcggtggatagaggcgtctcgccggttacatggacggattatttgtatctcagcgtcggcgggacgttgtcgaacgctggaatcggtggtcagacgtttagacacggccctcagattagtaacgttcatgagcttgacgttattaccggtacgtaaataccaaaacttcactaatctcgttacaattttttaattttttggtaatataaattttgtacggctcaactcttaattaagaatgaaacagtatctatgatcttctagatgctctttttttgtctgcaagctttaattgtagtaacatcagcgatatatatatcacatgcatgtgtattattgatgataatatataatgttttagttacaaatttgattctcaaggtaaaactcacacgccataaccagtataaaactccaaaaatcacgttttggtcagaaatacatatccttcattaacagtagttatgctataatttgtgattataaataactccggagtttgttcacaatactaaatttcaggaaaaggtgaaatgatgacttgctctccaaagttaaaccctgaattgttctatggagttttaggaggtttgggtcaattcggtattataacgagggccaggattgcgttggatcatgcacccacaagggtatgtatcatgcatctatagtgtaatcaatttataattttaatgtagtggtcctaaatccaaaatttgatttgatttggttggaacgtacgtatatataataagtcaaaaggctgattttgaagacgaatttatatacttttgttgaattaaatctgattttgcttacgttttattagattctgcgtaataaatcctaggacttgctcgagtgtaatcttgtcttatgcttgcaaatcttgttgatgtcaatatctaatcttttttattatatttccctacgtaagttttagatatagttattttaaactgctataaattgtgtacgtatagactttagataaaaagttgtggtcgcttgcacctatttgtttatcgctatagtgattcaaaggtctatatatgattcttggtttttctttttgaaaaaaatagaccatacaatccaaggaagatgatcttaaatggactaatttatggatataaattgatatacaaatctgcaggtgaaatggtctcgcatactctacagtgacttctcggcttttaaaagagaccaagagcgtttaatatcaatgaccaatgatctcggagttgactttttggaaggtcaacttatgatgtcaaatggcttcgtagacacctctttcttcccactctccgatcaaacaagagtcgcatctcttgtgaatgaccaccggatcatctatgttctcgaagtagccaagtattatgacagaaccacccttcccattattgaccaggtactaaaatccattattcatgatgattatcttcacacaatcagtatcatcaccaattaccatcatcacttgtcatatatgatccaaagtaaatatatcacatgatataaataaatcgttcaaatctttttttttaaagaataaaagaatcattttcaagcattactcatacacatctacgaatcaccgtgaccatatataaccatacgcttattaaataatcatttttgtttgtaggtgattgacacgttaagtagaactctaggtttcgctccagggtttatgttcgtacaagatgttccgtatttcgatttcttgaaccgtgtccgaaacgaagaagataaactcagatctttaggactatgggaagttcctcatccatggcttaacatctttgtcccggggtctcgaatccaagattttcatgatggtgttattaatggccttcttctaaaccaaacctcaacttctggtgttactctcttctatcccacaaaccgaaacaagtaaatatttactttttgattttgttttatttgaaagtatatcccaataatgtatgttaaattgttaacaagaatttattttattaatagatggaacaaccgcatgtcaacgatgacaccggacgaagatgttttttatgtgatcggattactgcaatcagctggtggatctcaaaattggcaagaacttgaaaatctcaacgacaaggttattcagttttgtgaaaactcgggaattaagattaaggaatatttgatgcactatacaagaaaagaagattgggttaaacattttggaccaaaatgggatgattttttaagaaagaaaattatgtttgatcccaaaagactattgtctccaggacaagacatatttaattaacttatcacatgtcttaattaatttgttatgtaactttagaacgtatttttataacatatacagacaagtacgttcatcgtctaactaacaaatattatagtttagtgatttggttaggctacttacgttaatctttttcgttcttgtatgaaatatattgtataagtcaaaagacaaagaaaaatatattattatagcggtataggtctctcagaaattaagaaccaattatttcttttattaagaacttttatgtggttaaaaattactaagaagtatacaaaattttctaaatttgaaagtaaattaagaacctgttttattaagaaaaatttcgataatatctgtcaaaaaaaacaattcccataactttttaactattttcctttttacaaaatcttctcaaaaaaactgtgacagactaatttatgaaacgacatacatgttgaaatgctaaattgaaaacggtgtgttatttggaaattcaaaacgttttcgtttagaattagtacaaagttctcttcattggccaaaaattcaaaacgctgtcgcttttaaattagtacaaagttctcgtccttagccaaatgcatctatg

SEQ ID NO: 20039 - DNA, 3003 bp, Unknown; identical to SEQ ID NO: 20038
  misc_feature (1)..( 3003): 2750-1469P.txt file - cDNA_ID_1824163; gDNA_ID_2926196; Annot_ID_141289

SEQ ID NO: 20040 - DNA, 3003 bp, Unknown
  misc_feature (1)..( 3003): 2750-1469P.txt file - cDNA_ID_1824167; gDNA_ID_1620705; Annot_ID_48877
tgctctcgtagcccagacgcacattactttaacaaaccgaatcatatctcctaaaacttgccaccctttgaaaggtaaatgctccacgcttaaatgaaaatcatacaaatctaactttcttgtatcttaactaaatcgataatcagtcattttgtcatattcagtgaaactattagagtactgattccatttccatagactatcaccttatcattgataaattttgagtctttatatcatgatagtatatagagctcacacatttccaaaaggttactagatgagtcccatgactttcttactttttacccagaaactttagtaataagaaaggcacatatttcaacagattaatctagcaaagagatcatgaaagtgatgaacatgtagcttcaggagctttagaagacctatctctagagaatagcaattgagaaagcattgtgaccaaaccatatatataagcagtaacaatgttggtcaagcttcatacacagtgaacaaacaagaggagagcctcacacgattcatagttcagaacctagtcatgactatcacacactaatcaagctttatgaaaatcaagataaatcataggtagatcgaatctatcaggaactgtttcactaatctgacatcaagtaatataaattgagaacaagaaggggcaatttcgaagatctagagatcagatcaattattagcttacatgaagaagatagcggtaatgacgagaccaatcgcaagagtgaacaccgataaagtcggatacagcgccaccggaatcggactcgcaatcggtttcgccgccttctcaccgggaacgagcacaaacacaccaaacaaaatcagaaatcgtaaaagcaacaaatagagagatcaaattagctgtgactgaaagcacttggacggatctagatttaccattgttgctaagctcttcttcttcttcttcgatctgaggaacaatgaaaaagctatttgactgatctcgctcgcttgatcgcttcactaaacaaacacgagtcgcttccggtttgtacttaaccggcttgttataacacaaccacggttattttatgggccagtttttctgtttaaaggttcgatttaataggcccaaatatacttattaaggcctttgatataaaatgtgttcatatctttatcttcttttaacgttgtataactttattcaaagtgcaatgtgatcctttaccattttcgaaaattgaaatccacttcaatgtagacatctccaactccttgtcaatcaatttccggattgaagattgggtactctctctagatttagttcccacctgaaaatatgggaccggatgtaatagtaacagatttttgtattggtcaacaatgacttatagatttcgtttttttcatggaaaggacttagaaattggttagggtttaatttgttgaccaatacgaaaatatggtcccaaagaagtgttgccatactaaatgacgaaaaccggctgccgaatatttctataggtaggacatagaacttacatcaatttgcgaccacatatattggaggtagcattttaatcgtctctagacttaaagggctatagcagatagaggagacggtttactcactcgtttgctatttgcagatatttacgaattttggcacatggatccaagaaaacaattctgcctgttgtgtgtggatagattttatgcagaaaaaaagtactagtccatcacatttactttaaaaattaaatcaacggcctagtatttttgttcgattataacaaaactattataaaaaaaaaaatgtacttatatttaacactattgattaattaataaatgaatcttccgactgttttctttgtagggcgtgatgtaatcacgggacggtgagtcggtgatatcattcgtgtgcttcactctctaaacatatagcgaagtaaattgacaaaaaaaaaaaaaacaaatagttaaccgtcgacaattcaataatggatagagtttgtgattaaatcatctataacatatatatatatatatatatatattaattaaatgtttgtctcactttgcatgtgatacgaaatgaagaaactacaaaaaagtgaagttcgaggtggaataagccttttgctttctcacgccacactaaaacttgcgtatgtgtttcgattctgcgccggtcctgttgattatagaacatgtaatttaataggagaaagtaactgttagtatagtattaaaaacgaatgtatataattttactattataggtatgatcgacttttgtactataaatttcaataacattccttcaatgaaaaaaaaaagaaagagttatattgtaatagactatagttttgtgagagagtttcaagtaacgtttgcaattggacgaacttttaaagaatattaactgcaaaaacactacttgggtgtagaaaagtgttatttatgaaccggcccacagagtcggagtttggtcggttccacaaatttcaaatttacgttgtgatctacatacaataaattatcacatcttataaagtcaaatgaaactacctcaactatactagaaaatattgaatactaaattataaaatacagaattagaaacttatcaggggtgttaaaatcaatttacccagtagactttttattattgttgaactacgtttaaacaacatatagatatttcgaagtcaatgcagtcaaatatttcatacaaaacactttcgacgaacacaacttgtatctttttttctctttggtgtcaacaagacttgtatatatatcaacatcaatgaaaatacgcaaagatatatatgttcacgtgacaatttattacattaaattgtatatagtctctctatggttctatataatctcatactttctacctcatctctatagtaatcccataatcaacaagacactctaatagtaatatctcaacctccgtctcgttttcccattaacctacccgtttgttagattatg

SEQ ID NO: 20041 - DNA, 3003 bp, Unknown; identical to SEQ ID NO: 20040
  misc_feature (1)..( 3003): 2750-1469P.txt file - cDNA_ID_1824167; gDNA_ID_1620705; Annot_ID_165269

SEQ ID NO: 20042 - DNA, 3003 bp, Unknown; identical to SEQ ID NO: 20040
  misc_feature (1)..( 3003): 2750-1469P.txt file - cDNA_ID_1824167; gDNA_ID_2926196; Annot_ID_141288

SEQ ID NO: 20043 - DNA, 3003 bp, Unknown; identical to SEQ ID NO: 20040
  misc_feature (1)..( 3003): 2750-1469P.txt file - cDNA_ID_1824167; gDNA_ID_2926196; Annot_ID_201472

SEQ ID NO: 20044 - DNA, 3000 bp, Unknown; identical to SEQ ID NO: 4429
  misc_feature (1)..( 3000): 2750-1469P.txt file - cDNA_ID_1824171; gDNA_ID_1620705; Annot_ID_48876

SEQ ID NO: 20045 - DNA, 3000 bp, Unknown; identical to SEQ ID NO: 4429
  misc_feature (1)..( 3000): 2750-1469P.txt file - cDNA_ID_1824171; gDNA_ID_2926196; Annot_ID_141287

SEQ ID NO: 20046 - DNA, 3003 bp, Unknown; identical to SEQ ID NO: 16106
  misc_feature (1)..( 3003): 2750-1469P.txt file - cDNA_ID_1824196; gDNA_ID_1620705; Annot_ID_48858

SEQ ID NO: 20047 - DNA, 3003 bp, Unknown; identical to SEQ ID NO: 16106
  misc_feature (1)..( 3003): 2750-1469P.txt file - cDNA_ID_1824196; gDNA_ID_2926196; Annot_ID_141269

SEQ ID NO: 20048 - DNA, 3003 bp, Unknown
  misc_feature (1)..( 3003): 2750-1469P.txt file - cDNA_ID_1824207; gDNA_ID_1620706; Annot_ID_48903
tgacaaaaaccctcgatatgaagcatctgacaccagaacatgttttttcaacgcagacgtgtaccaaggaggtagaaatatggcgtcatgtttgaggacaccgctggaagtaaacaatgatgggggtttatctgatgacacaatggagtctaggagctcaacaggagttaccatatttggcacaggtcttcagaatgaagttggcgaatacaattgctttttaaatgttatcatacaggtaacccttcacttttcataaacggtttgagttcttgggaatatagtatctataattccagcttaaagacttatttttgctgaaagctattttgttttgttttgatcttagtctctatggaatttggagctgtttcgagctgagttcttacggagttcaacacgagagcaccatcacgtgggagatccttgtgttgtctgctctttgtatgaaatctttaccgctttgagcgctgcttcaagtgaaaaacaaaatgaacctgtggcaccttcatctctcaggattgctttaagtaatttgtatccagatagtagtttcttccaagaggtaaaagaatttgattactggttttaaatgtttatcctaatacaatgtaaaccttcatttcattaattagcctaatcctgggcgtcatatggtggacaggctcagatgaacgatgcttcagaagtactggctgtgatctttgactgccttcatcgctcatttgctcaaagttcaagcgtgtctgatgtggattcctcagacagcaactgtactggttcatgggactgtgccaaccgcacatgtattgcccattctttgtttggaatggatatttttgagcaactgaattgctacagctgtgggctggagtccaggcatttgaagtacacttcctttttccataacatcaacgctagtgccctacgcaccatgaaggtatcgtatgagtgttcatttgattgcgttttcacatatataatttgattattcactgtggttttgtcccactttacgcctaataggttacatgcgctgaaaattcatttgatgaacttcttaaccttgtcgagatgaaccatcaactagcctgtgatcccgaaaccggtgggtgtgggaaactcaaccatatccaccatattctcactactccaccacatgtatttactacaggtaaaacttatttttaggattttgatgaatggaaattttttcagactgctgatatttgtgtcttgtcactaattattttggggctggcagttttagggtggcaaaacacatgtgagactgtagaagacatagcagctactcttgcagccttgaataccgagatagacatcaacatcatgtaccgtggtctggaccctaagagcacatatagcttagtttctgtggtacgcatttcttcctcttcttccctatgatattatcagaagagtcgttaaaacaccagctatgtgctgtgttttccttgtgtgctttcaccctaaaaacctcaaggtaacaaattgttcttttgctatttctgcaactccaggtttgttattatggacagcattatcattgttttgcacatagtcgtgagcacgatcagtggatcatgtacgatgacaaaaccgtcaaggtaagattatcaatgcaatgggttttgcgggcagcagatacactcgtggacattatcacccagtttttgtaatatctttcaggtgatcggtagctggatcgatgttctttcaatgtgtgaaagaggacacttgcagccacaggttcttctctacgagagacgttaaaataaaaaagaagcaaaacaaatgcagaccaagtagagttctgttgctacaatttaggagatctcgtaagtacatactacaaaggaagtaagtacgtttttttgacaagcagaagtaaactcgagaggaaagaatgtgattttacactcatctcagtggttctaacttctaagaggatggggaagacgattttgtctttaaaatttaagcaaaagtgttttcagtggaagaggtcatagaagaagatatcatgtagttttcttggttacatccttgtcacattaaggattatatgttcatataaatctatttcatcggtcatctctatagatcatatcatcattatacatatatcatatcttgtcaactaatgaaaatgaagtcagaagttaggagagaaattgcagaaactctaatccaatgaaatctctacatatcattcttttaacatttactatgtgactatgtagtagtatatgtttcttattttcttttcaatccgactgtgtttaacacttaggacttaaccgtaataaaacgacatttgaaattaggatttgtgatcgggtaagtgattcgaacattagaaagcaaactaacctatgaggctatgactttagttggtcgagagtcggctttcatatgcggcatttgcggggtcaatcccgcaaagaggcagcctgaaggcactcactagggatagctcttacaatgagcaagttgacaacctcatgctccttgccgatcctgatgaatatctgtcacagtgggcaagttgtgccagcatgtagcggttccaaaaaacacagcggttcaattcgcaaaccgagtagttcgcttcgtctggtaaagtaaaccataaaataccgatggttcaactagaaataattactaatcgaagtaaaccggtttgtaatcgctaatgtaaatctcttttttggtttagtgacattcttctgctccgtagcgagagagagagagagagcacaacaacgactcctgtgttactctctctacctctatcccctcaccaacaatctccgccgtaatacgtggccgggatctctcaggcgacgccgtctgttgactgtaatttaatatccgattttgaccatctttgcccatttggtggcgcgtatatatatatacgtacgcgtagagtattcttcatgccgataaaattaaggtatttaagctgaatcgtggatg

SEQ ID NO: 20049 - DNA, 3003 bp, Unknown
  misc_feature (1)..( 3003): 2750-1469P.txt file - cDNA_ID_1824211; gDNA_ID_1620706; Annot_ID_48902
caagttctggagatattgctaatggaaatgatgtgtcttctggtgcggatggatttctttcatggatcttcacaggaccctctagcgaggaacaagttgtgtcatggatgcgcacaaaggaagataaaactaatcaaggactggagatcatgcagcatcttgagaaggagttctatcacttgcagaacctctgcgagagaaaatgcgagcacttaagctatgagggagcactgcagactgtcgaggatctttgtcttgaagaaggccggaagagggagacttcagcagaatttacccatgaaagctatgaaactgtgctgaggaaacgaagagaagagctaaatgagagtgaccatgagttgttgtttatcagtagcaggtttgagttagatgctataacaaatgttttgaaagatgccgaaactcttaaccacaatcaatttggatatgaagaatcatatggctgcactagttctcagcttcgtgatctggaatctggtgaagctgatgaatgggggataaaggattccttacatgaggctgacagtttcatagagattgcgattcagaaacaaaaagagcagttgtctgcagaggtaagcttttctatctttacgcaacaccactgcaataatcaattaatgcctttctgattttaaaataatctgtacatgtgctatcacagcttagcagaatcgatgcacaaatgatgcgaaatgtcactgggatgcagcaattagagctaaagcttggaccagtttcctccaacgattatcagatagtattgttacctttggtgaagtcctacatgcgggtaagtatctaactcttttgaccttgttactttttcttccattgtgttgctgtgttctttcaggttctaattggcatttccatcttaatctccccatttccctctctcgctctctctctctctctctctctctctctctctctctctctctccaggcacatttggaggcgttagcagagaaagatgccactgagaagtctgatgctgcaagagaagccttacttgttgagctagctcttgattctaagaaggaggctcgaggaagaaatgataattcaaaaaacacgctggaaaagtccaaggacaagaaaaagattaaagacactaggaaagtgaaggatatgaaggttcgaactaatctgttgtctactttttaggtacttcttgtctatatttgtaactaactttttaatttttttgttataggcaactattggaagcgaccatcgctccaatgctgattcagttgaacacaggtgaagatctgccttgttcataatttttacttaagcgggtgtaacctggaaaatctttgtttctgaaaatgttggtggtttataatatgtcgttgatttacctgctaatttcttgttccagcccccttccggttgcacctgtcggcgatcattcagaggctgacattgtttctgaagctgttgaagctttaaaagaagaggaagaggaatataaacgccaaatagagctagaggaggaggagagaaaacttgaaaaaaccctagagtatcagagaagaattgaggatgaagctaaggagaagcacatggcagaacaacaaaagaaatacagctcttcagttcccatgaatgttgcaaagacagtgtataatgggtgcacagataatgaagttgattatttagttttacaaggacaagaaaaatccataaatcaggtaacaatagagtgacaaggtggtggagttatgttttttcaatcatcgcttgaaattaatttctggggttctttgctttaccaggagaaaaggaatggacgacttgatgacctggaaggagccagtgtgaatacaaatggagttttcccgtcaacaaatcattctgcgatatctgatactgcaaaggtgcagaatgtaaaatcccaaaaaggttagcattggtttcgaatatgaaaatatgtgtctactgacctttctgaggcacttatattgttttttcttttttttttgttgtagtagtgcctaacggcacagctatgcaagctggtattttccaatctgatcaacgaactgggaggagaactagacgccaaaaagcttcaaacaagttagctgatggaaaatatccggtcacacctcctgagaccgaaaatagtaaatctcagttgtcaggcaccaacggcgagagacattctgaaactctacgtaacaatggtggtaagtgacattttttttttttttttttttttttttttgtcctagaatcattttctttttctcatgttttcaaagcactgatagttgtgatctatagatgatctgatttttcttcttgagcttattgtttttttctgaacataattattaatttattagatgtgaccagtaaaggcacaaatgaagccgttagatttcttaaaactgatacttctgtaaccggtgtatcttgtttatgcttttatgtcaacgaggaattacattatctacattgattaccagcaattgttttctaacatcattcatcttgcattctagatgtgggaacaaagacattaagacaattacaagctgaagacgatgacgaagaaaggtttcaagctgacatgcaaagggcagtgcttcaaagccttggtagtttttcaacatccttgtttatatatctgatatcatgtctgacagttaacattttgcgatattttgctaagtgcccattttgtcactattgtctgactgactgtcatttgtatgaagaatggtgtattgtgtataccacttttcttcatcccagtgcactttttctttttatctgattactttaggtgtctgaaactattttttctccagcttacttatgccaacagctgctacgttttattttagaatttttagcatatttgttctgtaatcattttggggtgacaaaaaccctcgatatgaagcatctgacaccagaacatgttttttcaacgcagacgtgtaccaaggaggtagaaatatg

SEQ ID NO: 20050 - DNA, 3003 bp, Unknown
  misc_feature (1)..( 3003): 2750-1469P.txt file - cDNA_ID_1824215; gDNA_ID_1620706; Annot_ID_48901
tcgggtttagtgatttaagaaagtttccattataccctgattttatttctgttttcataatttgagccgagtaatttgttaatgaacaaattggtaactagtttgtccacattcaaaaaccaaacaaaaccagaaattttattgtagacttgtagttttgggccttttggttttctgtcccgcatgagaatcgggtcgaacggttatgctcgagtgactagacaaagtagttcactagtgagccatgcattatttatttattttttttcactaagtgttgtcttcatttcattaagttcacggttacaaaaagtgttataatggctctgccatttacagctttgaagacatacacataaacaggtaaacaagcaaccatggcatcagaaaccaacaaggttagccatgttgcataccagaaagttacaagtaaacgttaaaacataacaactgcagctatagagtatgtcttgacccaaaaagtgttatgaaggccatactactgaggcagattattccaaagcatggatctgcatctgttgaaatcaatgcagtcctaaataaaaaaaatgacagaattcatagagtgtttatcttttctttggagggttcagaatccctcccttcatgtgcgctttgtcttgttcatcatgagttcctttctcttcttgcctcttccttgtttcccttgtttccacccctcttgaagattgaccaacttcaaaaacccgacgagaacccgttgagagtgctgttccaactgaaggcgtgatattagaatcagttgagacctgttgaccttgacagagcccttgatagtaagtccctcgaccctgatgattaaggccttctcttggagcaggaaaattcggatgggctgcaagaaactctccatgattcagtggaggggtaacaattcttggtggagggagcacaggtgctggaaatgaagactccgtcatttgagactgagaattcatagacgatctaagcctttcatcatggaagacagctctttcccttccataattaggtagccttggtctataagggcaatagttcctgtgatgtgtaactctgaagcagctactacaaatcctcctcaatctctcatattggaacctgatgagagcagtttccccagaatcaaaagtgattctttggaagaaacgaagcctatcagtgattccaattctaactctgactctaatataagcaatttgagtcatcgttgcatcatggaagtccagcgtgatgatctcaccaatctcatgagcaatctccaaagctgtctcctcacaaacatagagaagaggaatgcctcgcatctgcacccaaagatctatggtagtcacaaaatttaagacaggagcaggctcccatctatgatttgcaacaaaccaattattgaaaagccacagttcccttctttgcactgaaagtaaatcaacttcattctgaaacaagaactgaacataagtagcatccagcattctaccactgaaagccatgcattatttaatctacttattcgagaaaatttatctcaatttggaaatatacgatgcatttgaatagcaatccattaatataggattagatacacccattaaacacgtgttaaattgataagcaataaataaattttaaaaaatgaaaatgatacagaatcaaccatcttagttttaaaatgatattttttttaattgataaccaaattgataaaaaaaatctcaatctaatgtaattttaaaatgatatttttttggttcatattaactaatcattaatatatatattcaatcttcaacataaagaatgaaaacaaaatattattagaaatatatttaaaaattgaatttcacaaaatgaggttatatgataagacgagtttggatcgatattaagacggtacactataccacaagtaaagtcttagaattattaattaaaatataattaaataatctttaacactaaacaaaacaaacaatcttaataaaacatatgtaacttaaaatttaaactttttagttataaaaattgatctagggtgtactgaagggtaaaatctaagggttgtacataaaataatatagaaatagagttatatatttataaaatacaaaaaatagattatatataactaatctatcaaaaaattacattttcagttttttttttaataaatagtcccgcattgtaccgcatgttaaaatctagttttaatagatagaaattagtaattgttccaaaaaacaaaacataaaatgtaattatataaaaatggtctacatcaacttggtaacataaggtagatttgaatcactctattttggatagtcactatactattcaaatgttgatttggtaaaccgaaattgtaattagcttcgtttttcagataacaataaccgcaacaagtagataacacatggtttaagcgtctcgattgtaagatatacatttcagtagcttgtcaattgtcataaatgactacaatatcagcaggtgaaaactatattgatccatacagaactaactaaacactaaatgcattaatatttcataccaaagagcaagtttagttagtgcacaattcaaatgcggtttgctaaagtgcagacggttcaaccgtaccgcttcaccgcctttttctataaagcgaaccggtgtgtaaatctgagttgtttactaaaatctccttttctcctattttggcatttcggtttaatgattattttcccctggcttcgaactccacacagagagcaaaacgacgactcttgttctactctctctatcttgttccccacaccagctttctccgccgatcttccgccatactacggtaccggaatctccgagatgccaccgtatgttgactgttaattaatttccggtttgactatctctacgcatttactggggcgtatataatacacacacacacacgcgtatacatgccgattaaattaggggttttaagctgaatcgtggatg

SEQ ID NO: 20051 - DNA, 3003 bp, Unknown
  misc_feature (1)..( 3003): 2750-1469P.txt file - cDNA_ID_1824227; gDNA_ID_1620706; Annot_ID_48898
atccttattactatgatacgagatatactgcatctaatgtaattgatacaaaaacgatatataaaaatactcggaaatttttcctgtaactctcctttgatccactatattgtattgttttaactacttaattttttttttggtaaggtgttttaactacttaattgttttctctatttgttaaaaattgtattacatatcaaatcttatatctctgatttcctttttttatttggccgcatcttttatccaaaatgatccaaaagactccaaagacaagatccaaaagctttttagcgttttaaggcgaagttgtaaagagatattgatagtttattactatatatgatgagaaattgagaatcataattatcctctatcggtacttagcattcagtcaacaatatttgaccaaagatcaatgaagtaaaaagaagatatatatgtacacagtttcttaaaatatatatatatatatattttaatttctctgactaattaactaatctttgtgaatgggtcaagagataaagaagcgtgcaagaaaagataattagagcataatcaaaccaattaactaaggtttcttattcgtcatactcatcatacgctcatccatactaagggactaattatgggaggagccactctttgagggattacctagaagctataataggttacgtgcacgtaaatgacattttggaatggattgatagataagttacaccatgttatttgtatcatcactttaattttgtagagtccgtaaaattttaaattttgttaatgtttttagtaatgttaagcacacttgtacaaattaatattttccgaaaattttatacggtttgctttttaagaagtgacatacctttagttagatttataattggtcaagtatggtttgtcacccctctttagcttcagttcgactatcagaagattttatgtttatgctaaattcttttctttttttaaatatgagtttattatttttagctcaaccatacataagtaaaccttaccaataaaccagtatcttaatctcaaaaaacaaattgtcaaacatataaactcccattggtcactttatattactgcaatacgagatttaccgtttaactaccaatttcaaaaacgttataattttttttctttcatttttcgtattgttactttttactgtttttaattattttgatattgattacaacttatctatctttcaaaaacgttgtatcgttttctattattaaagaaataggatccgaattgagattaaaattaaaagagtcgttgagggactaattaaacatgttaataaagataagatgtggatcccggttccggggacgggagagggaaggtcatgtgccattagggtaggaaccaccgagaggatgtgtcacgtgtcacgtgtgttggacttaggtgtcagaatggttttgaatggaaaaacaaaacaacgattctcagtagtcaataccccacacgatatcgtcatctttgttgtcttcattctttaaaataaataaattgaaaaggtactagtagttgtctagttccgtacggtacccgtccgtactctctagagcaataaatctttccatgaattttctttttctatctttctttcttttattcttaaaaatctatacttttgagtcttgacattgtatctatcttgtaaccttcaaattgtgagattagtagaaaaattgatggaattagtagaatcgcgagatctaatcaatttatatgaagagatataagtgaaacatatatatctgaaaagatttttttttttatacgagtacatcatcgaccatgtaatgtttgttctacggaaaaatgccaataaggtaaagaagttattgtgtaattgattttacgtcattttaatgaatataaataattatatgcaatctcacttcctctaaaaatcccacattcgttcttcgcaatatattatcataacttatctcgttttgttgcatttttcttccaaatgcatccatatagtatgaaagataaaacatatatataggattctataactctttttttctttatattttcacaaagatatgacaacatgaaactgtcttcatctacttcttctaatcagtccaataatcaacatttcaaactgattaggaccaccgtctgatccatttcaacaaaatccttctcttcatcgttccggttctcacgactagtcctgtggttcctatgtctctttttgactaatcaagctttttattgatgtatcacaatttttttttctttacttctgaggcacctatgacctatctaatgttatctcttaagaaaattttaatgagagatacatttgcttcatggacttcgatgattatgggcctattatatcattttaggcccatttgaaaattgaagttttgtgggtctcaaattaagtcaatacagtcagatgttgtgtgtccgagagcaagttaataatcatggacatgttaaagaatggaatcctctttttcttgtttattcgcatgtctgtttcttacagcattggtttgtctaaagactaaaattaacacgttatatgtttacaaaataaaaaaaaaggtaacatgctatgtagttttgtaattataattatgattatgatattgtaaaacaaatttggaaaatataaataagatggaaagagagaaaactaaaatagaataagactgaagaatacaaaaatgtaaaaaaaaaatcagaaacttttccatatatataaaattaagaatgtgaaaataagccaaaaacagataaaaagagagaattgggtaacaaaataataataattactcttttgtttaacgtaacggtggaaacagccttccctcttccctagtctcccacgcttctgtttcgcattttcccccattttctccggcgacggccaatcatcatcaaccgccggcgaaaacctcagattcgtgaatctgattcattcattccgtgattaagatg

SEQ ID NO: 20052 - DNA, 3003 bp, Unknown; identical to SEQ ID NO: 20051
  misc_feature (1)..( 3003): 2750-1469P.txt file - cDNA_ID_1824227; gDNA_ID_1620706; Annot_ID_165308

SEQ ID NO: 20053 - DNA, 3000 bp, Unknown; identical to SEQ ID NO: 4435
  misc_feature (1)..( 3000): 2750-1469P.txt file - cDNA_ID_1824231; gDNA_ID_1620706; Annot_ID_48897

SEQ ID NO: 20054 - DNA, 3000 bp, Unknown; identical to SEQ ID NO: 4435
  misc_feature (1)..( 3000): 2750-1469P.txt file - cDNA_ID_1824231; gDNA_ID_1620706; Annot_ID_165307

SEQ ID NO: 20055 - DNA, 3003 bp, Unknown
  misc_feature (1)..( 3003): 2750-1469P.txt file - cDNA_ID_1824247; gDNA_ID_1620706; Annot_ID_48893
cacattccttccttccattaagaagagtttagcttttctactttgttgattggttttgtgatttccgttttcacaaaaactttgtatagatcgatttgaagcaatttgagaaagtgatgaagtacataaagtcaggtatcgaaagcaatgctactcttgaatgtggtggtgatcagattggagacaaaggttacttcatccaacctactgtcttctctaatgttaaggtaaaaagaaaactcttctaagacatctttaatgttcttctattaccgattctccatggcattaatctcgaacgcttggttcaactacaggatgacatgcttatcgctcaagacgagattttcggtccagtccaatcgatcttgaagttcaggtatatagagctaccaataaaactgatccagtagacaaataagtcacaatttggtaaaaatggctgagttgttagagatttggtaaactgaaactaatttcgaaccaaccaaacctaaactttttttaaagataaatgtattcaattaaaaaacagaaaccatgatagatttggtttaacactggttatgatgttgggttcagtgatgtggatgaggtgataaagagggcgaacgagacgaagtacgggctagcggcaggggttttcacgaagaatctggacacggcaaacagggtttcaagggctttgaaagctggtaccgtatgggttaactgcttcgacgtatttgatgcagccataccatttggtggttacaagatgagtgggaatgggagagagaaaggcatatacagtctcaataattacttgcagatcaaggcagtcgtcactgctctaaataagcctgcctggatctgatctctggagtgtggtttcagcatcataaatgctcaaacaaaagaaatagactctataaagttacaatagtaataattaaggtcatggtttgtaatttgagtaacggattgtgatacttctaataaatttttcattgttgtttattcatcacatagctgttgttacactgagacttgtgtgttcattttggttttgcaagatttctattgaaactgaaaacaaacatgaaactgaaaaatgcaacgaaaattagaaaatatatatcttaaagtaattaagagttaaaactcaataattaattaaaaacttttcagttgtttaaatatatactctgtttctatataaatgtagtttaagagtttttatttttttcaaaataagtgttgttttcaactttctatacaaataataaatatttaatattttaatcaattatatttaattaataatatttttatataaaagaggtagattaaatgagactttcatgatttttttaatatgtgtataaaaaccttaaactaatatgaaacaaaggaagtagttgttaattattaaattcatatacagtatattcttagaataaaatatcaacataaaattgatcacaagtatgaaaaaaatactttttattaaaaggtttatcagataaatatatttttccttttgtaacagacaaaaaattatactaattttgaatatttattatatttcttaataaatttcgatacaagttttctatttaaataatatttttaacatgactgaaaaatgttgaacgcatcagaagtgaccaaatcgtgaattttaacttgttcgtcagccagaagtttccgtttctctttagtttcttcatcgcgatttttgctacttggctccaaaatccctcctttttcttctttctcacttgcatcattagctcacgatttcgagtatcgattcaaccattttgatcttcaatctatcttagggtttctccttaattcttctctcggattttagctcttctcgactattactcacctctctcatggcgatgagaggtgtcgatttcaagtggtgagctctctctctctctctcttcaatcttcattcacttgggtcgatctaaaggggacggattgcgaatttgattatcgattcccattttttttgagttttggggttttctgatttttgtaaattgtgcaggtacgatgggttcttcttgtcgatgcttgcgactagtgtgtatccttatgctacttggattctgtcaaatttgttttttttctttttcggttttgttcttgtttggatcgagctgagaattctcattcttaaagctaattctccaccattcgatataagatttgatgatcgagatacagttggttaatcagaagaaaaaagtttatttctttgaagatccgattgattagttttggttcttgtgggataggtgaactggattttgttttattagggtttaaggtgatctagataacctctccatttcgtttccttaatggttattttgcgtcgtagaatcattgtagctgtcaactggaacagatatcgagcttgtgaatacccgttgcatatatggattgtggtagctgcctcagttctattctttttgttgctctttcttattatcagtttcagtttcatttgtgtttgtctcctatgacttcaggtcgattacaccaccgtctttatcttccgtgtcttcatgtttgttgacaatggtcttgcttctggacttggcttgtaagttccatctaaatctccctagttctagagttacaatgagttttaaaggtttttactttttggaatcttccccggtttcccagagttatctgaacaagttttttttttgcgtaaaattgtctttgctatccttattccttagataggcgtttaattcattgagaagtattagattatgataaatataagctatttgggaagcatagaatttctttgtagctccagtcgaataggctcttctagttgcaagctttatcttagaagtagctagttgcaacgtttctctatctctctaggtagcaaattttatgaatatatggtttcttatgtcacattgatttctggtatgaacatctgttagggattttggaagtcaacagcggaacgccatg

SEQ ID NO: 20056 - DNA, 3003 bp, Unknown
  misc_feature (1)..( 3003): 2750-1469P.txt file - cDNA_ID_1824251; gDNA_ID_1620706; Annot_ID_48892
tcacttcctctcctttctttgataaatacttctactgcctttggtggggtctccgtaacctcaggttggttgatattcatctgtcttaaaacaaataaaaccgctgcttttggcgacttgttaactgatctttttttcttgatttggttttgtgtagttcctatggacagagtcttgcagcgagtacactgagcagtgagactatattcagttgtttcatttgtgtcgcgggtcttgttttcttctctcatctcattggaaatgttcaggtaaaattcaaatgaaaattagctctctccatagtttttaatggagtctaagtgatttctctgctttttgaagaactatctgcaatcgacgactgctaggttagacgaatggagagttcgaagaagagacacagaggaatggatgcgacataggcaattgccagatgagttacaagagcgtgtaaggcgattcgtccaatataaatggctaacgactcgtggagtcgacgaagaagccattctacgggctctaccattggatcttcgtcgccagatccaacgacatctctgtcttgccctcgttcgccgtgtaagccacaccagaataacaccacatttccattacgttccactcaagtaagaaaccctaattttacgttcttttaatttttcaggtgccgttctttgcgcagatggatgaccagctcttggatgcgatatgtgagcgtctagttccgtccttgaacacaaaagacacctatgttatacgcgaaggcgatcctgtaaacgagatgcttttcattattagaggtcagatggagagttcaactacagatggtggacggtcaggattctttaactctatcacacttagaccaggagatttctgcggtgaagagcttttaacctgggctttagtgccaaacattaatcataatctaccattgtccacgagaaccgtaaggactctctccgaagtagaagctttcgctctccgagcagaggacttgaaattcgtagctaaccaattcagacgtcttcacagcaagaaactccaacatgctttcaggtaatcctcgtatggtctcataagcaatataggtttcttgcttcacacgctataaggtttcttgatctttatgttttgactgtaaccagatactattcgcatcaatggagagcatggggaacttgttttatacaagctgcttggaggcgatacatgaagaggaaattagcaatggagttagctaggcaagaggaagaagacgattacttctatgacgatgatggagactatcaattcgaagaggacatgcctgaaagtaataataacaacggagacgaaaacagcagcaataatcaaaatttgagtgcaacaatattagcgtctaagttcgcagctaatactaagagaggtgttttagggaaccaaagaggatctacaagaattgatcctgatcatccaactttgaagatgcctaaaatgtttaaaccagaggatccaggattcttctgatagttgttgtgacaaatgcatttaggatttctgacactaacttgatttgctgtaaccaatagtcaggtatacaaagaaacattattacagattgaagtaattgtgacttgacgtcggtcgatattatgtcgatttctatccaacgcactcttggctcctacagcatttattggtacacaaagtgggctttgaaactcataaaacaccttgtgtttaagtctaattatgttttcacataatttaggtgaattaaaaaattaattaattataaattgaatttgggcaatgaccatattttggtcaaaaataatgagaatgacacttataaaagaaaaataaaggatatagtcatagactcattccactatttgattggacgaaaatgatttttgattacacacttcaacttgtatttttcttcgtctacatgattttgtgcaaaccaaaaaaaatatgtaatccctttcagtttattgcttgatatttttaatatataaactgattaaatctcgcaatcgtgtcaaaaaccatatatttgtcatttatgccataatttaattttaaagatgaatatgtgaatatagaatgaaatctgaaaataatattgtaaaaagcacatagaaaaaaaccacctttttctcaactttaatcattttcttgattagtaaccttttggagcagtagaattttctcattgtattcaaatggtacgaattaaatcttcttattaatagcagatgattttttttctttatttgtcgaaagatttcaagggacaaacatcacaatccgcaaagtaacctatatttacaagaaaagatgaaaaacataccaaatagatgacacaactaccgcttagaaaacgacttcacaccataactagcaacttttgcatttatatagatatttcctttattttcattataatttttccacattgccacaaaaaatgatatccacaattaattaattttaatttgtagttggatctaaatctaatatgaaagaaaaaagaaaaaacatattgagtctgaatcatatggatacacataccaaaaaatcagagatcacggcaagacaactttttgtcttatcttttagttttttatttgtcaacgttgtttgttgtcttactaatttattttaattattttttcccgaatctcatttttctaagagggaaaaagaaaaacatttcttttttctcttatgcaataaaaatcgcttcttttgtctttgatattaggaaacggacaaatcagtctagtcaaatagagccattcaaagtacggcaacacaaaccaagagagtgtaagttaagcgacatgtgttagagatatccggagatctcaaccgttggattctttctccttcaaatcaaattataaatcccatcaaacagagagagagagagaagaggaggagaattcgaagaataaaagataagaactttgacgttttgaagcttaaagcttgaaacttgtttcatccatg

SEQ ID NO: 20057 - DNA, 3003 bp, Unknown; identical to SEQ ID NO: 20056
  misc_feature (1)..( 3003): 2750-1469P.txt file - cDNA_ID_1824251; gDNA_ID_1620706; Annot_ID_165299

SEQ ID NO: 20058 - DNA, 3003 bp, Unknown
  misc_feature (1)..( 3003): 2750-1469P.txt file - cDNA_ID_1824265; gDNA_ID_1620706; Annot_ID_48887
cgaagccattctaactcaacaaaagcaaataactttcaacgaagaaacgcacaaaaaccagagagattgtgaaatagagagataaaatgaagtgattaacatgaggaagtgtggagaatgtacttcatgttatttttgaaaatctcaaatctgtagtcttttagatcgagcttcacaggaacatgatgatggcttgtccacctgctgtatagctttagtaatagatggatgagccaccatttggttccaatgaagctcgacctaaaagaaaatagatatgaagttttcagaaataacgcgaagttgttgggcattcgctgctaggcacctattgaggggattaactacgaaagtacgacccagttggtgatgttttctgcacaagaactaatttctgcagacaaagtcaccaccaagtttggcactcaaattcatcaagaaaaatgcaacccttttaaaggcacaaaatgtgaggtaaccatctatcaattcagatatgtagatgtagatctttcaacgaggcagccttatcaacgctattgcaatccggctttttttatcaaccacacattaattaaaagatgattccatgattggttacccaatctggaagaaaagagtttagatacgtaacttcagaaaataataatttagaaaaacgcggtagacaatccgccctaatattactcaaacgagaaatagaagatatcgaaaaagaggaaaaatattacggagcgatccaaactcatctagaagattggagaaagcgtgtcattcttcaagagactgcaccatcgagactagctctgtgcaatctgattcaaatgtctggcagtcgatccttcgtgaaaggatattcttcataacccaaattaaagcttccagctccgagtgaaggggagaagggctcctccagaggcactttgcacataagagtactgtttgatcaattccttgaaaacaccaccatcctaatcccatggttagatccgaagatttccatgatccatcaaccctacatctaatagaatgagtcagttgatccatagacaccctggtaacattcgattcaatcggttccagttgggccgcatcccacaataattgttcactcaaagcgacatttagaatatctaaaggttctgattgtaaacctttgaaaacctttttattcctatctttccaaataaactataaaatccatgcataaaagttatttccctctctctcatctattggagatggtaatccacaaaaaaagtaatgaagatttgaaaattccgaggttaaaggaaagcttcctgctattacaggaatcgaagacatttcccagacttgtcgagagtgaggacactcaaaatctattttttgtagtcaatttttaaaaaatatagtcagcctagtataactattcatgcttatggatatatttcgcaaggagtgatgacgaaaaactctggaacggatttgaactacgcaatgcctttggtcaagtacgggatgaggcagaacgggatataaatattggatagctaagaattcgtatagtccccaatgtggagaaggcgaatatattaggatcgagagagggattgctgattcaaacttggttacagaagagagacagagatgttgttaggattaaaacaaaattggttacacaatatagtgcgaccaaaaaagaaaaacatgcaattttacaaaatatggttgaaacaaaaggcccatgtcttttggtcctcaaaaactatttttgtgaattcagttgatgatacaaaaatagaaattcggtaaaataaacaatgatgcggttagatgtggtaagagataccgattaaatataacgacatgataagaaaaaataaaaatggactaaaaatactattaattttaaaaagaaaacaaattttgacagcaacattaaacataacaattttgctgtggattcaatggatgcttggtttcgttttgacggtaaaagaacaacttcgttttttctaaaggggcataaggttttgtgaaagaattataaaaaaaaactgttttgccaccatttttgttaatcgacttatcatatagcacttgtttttactagtgatatgcaatattacaactttttgtggaagaatatacaaacacacaaatcaaaaatccaagtagttattcatctaacttatttgtagttgatgaatggttatgtgtggttgagacaataaatataaccaagttgtaccgaatgaattggccatcactctattttaaacacaaaacagtgactatacacaatttcttaaacccgattgaaaaataatataaattggacaattaaaaaaaaacttctgacaagttttttggtttatttcggttcttcaaaccggcttgcatagaatcaaattttaattgtaaaacaaaaacaaaaaaagtaaagtcaaaaggagtaaggaaacgtggtcaaaaccgtccgtcactcacccacctcttaatctctccagtccctatgtcacctgaaaaagattggagatgacgtcacgcccatattgttttttcatttaagtcaccgcactgtcacgttatctttgccccttccatccacaactcctctctctaacccgacccgatccgcccgaactcgtccaagtcacctttcccctttttcgccccgtctctctctctctctctcttcttcgatttattggtgtttggttcgcttacgcgatttctcgaagaaaaaatctcgtattcctggatcgaaacaaggctgattcgattactcgctgtcgctgttgttgattttggatctgtgttttgttatcttcggatcgggaatcgaagccctagagatttgatccatttcgtcgcgaaattaggttttttttttcaccgataagtttttggatctaaagttatcgaatattgtcagggggaaaaaggaattttgaggatttgttggattttgctgaggatattgatgttgttcgaaggagaagatgatagaaggctatg

SEQ ID NO: 20059 - DNA, 3003 bp, Unknown
  misc_feature (1)..( 3003): 2750-1469P.txt file - cDNA_ID_1824265; gDNA_ID_1620706; Annot_ID_165293
gcacaaaaaccagagagattgtgaaatagagagataaaatgaagtgattaacatgaggaagtgtggagaatgtacttcatgttatttttgaaaatctcaaatctgtagtcttttagatcgagcttcacaggaacatgatgatggcttgtccacctgctgtatagctttagtaatagatggatgagccaccatttggttccaatgaagctcgacctaaaagaaaatagatatgaagttttcagaaataacgcgaagttgttgggcattcgctgctaggcacctattgaggggattaactacgaaagtacgacccagttggtgatgttttctgcacaagaactaatttctgcagacaaagtcaccaccaagtttggcactcaaattcatcaagaaaaatgcaacccttttaaaggcacaaaatgtgaggtaaccatctatcaattcagatatgtagatgtagatctttcaacgaggcagccttatcaacgctattgcaatccggctttttttatcaaccacacattaattaaaagatgattccatgattggttacccaatctggaagaaaagagtttagatacgtaacttcagaaaataataatttagaaaaacgcggtagacaatccgccctaatattactcaaacgagaaatagaagatatcgaaaaagaggaaaaatattacggagcgatccaaactcatctagaagattggagaaagcgtgtcattcttcaagagactgcaccatcgagactagctctgtgcaatctgattcaaatgtctggcagtcgatccttcgtgaaaggatattcttcataacccaaattaaagcttccagctccgagtgaaggggagaagggctcctccagaggcactttgcacataagagtactgtttgatcaattccttgaaaacaccaccatcctaatcccatggttagatccgaagatttccatgatccatcaaccctacatctaatagaatgagtcagttgatccatagacaccctggtaacattcgattcaatcggttccagttgggccgcatcccacaataattgttcactcaaagcgacatttagaatatctaaaggttctgattgtaaacctttgaaaacctttttattcctatctttccaaataaactataaaatccatgcataaaagttatttccctctctctcatctattggagatggtaatccacaaaaaaagtaatgaagatttgaaaattccgaggttaaaggaaagcttcctgctattacaggaatcgaagacatttcccagacttgtcgagagtgaggacactcaaaatctattttttgtagtcaatttttaaaaaatatagtcagcctagtataactattcatgcttatggatatatttcgcaaggagtgatgacgaaaaactctggaacggatttgaactacgcaatgcctttggtcaagtacgggatgaggcagaacgggatataaatattggatagctaagaattcgtatagtccccaatgtggagaaggcgaatatattaggatcgagagagggattgctgattcaaacttggttacagaagagagacagagatgttgttaggattaaaacaaaattggttacacaatatagtgcgaccaaaaaagaaaaacatgcaattttacaaaatatggttgaaacaaaaggcccatgtcttttggtcctcaaaaactatttttgtgaattcagttgatgatacaaaaatagaaattcggtaaaataaacaatgatgcggttagatgtggtaagagataccgattaaatataacgacatgataagaaaaaataaaaatggactaaaaatactattaattttaaaaagaaaacaaattttgacagcaacattaaacataacaattttgctgtggattcaatggatgcttggtttcgttttgacggtaaaagaacaacttcgttttttctaaaggggcataaggttttgtgaaagaattataaaaaaaaactgttttgccaccatttttgttaatcgacttatcatatagcacttgtttttactagtgatatgcaatattacaactttttgtggaagaatatacaaacacacaaatcaaaaatccaagtagttattcatctaacttatttgtagttgatgaatggttatgtgtggttgagacaataaatataaccaagttgtaccgaatgaattggccatcactctattttaaacacaaaacagtgactatacacaatttcttaaacccgattgaaaaataatataaattggacaattaaaaaaaaacttctgacaagttttttggtttatttcggttcttcaaaccggcttgcatagaatcaaattttaattgtaaaacaaaaacaaaaaaagtaaagtcaaaaggagtaaggaaacgtggtcaaaaccgtccgtcactcacccacctcttaatctctccagtccctatgtcacctgaaaaagattggagatgacgtcacgcccatattgttttttcatttaagtcaccgcactgtcacgttatctttgccccttccatccacaactcctctctctaacccgacccgatccgcccgaactcgtccaagtcacctttcccctttttcgccccgtctctctctctctctctcttcttcgatttattggtgtttggttcgcttacgcgatttctcgaagaaaaaatctcgtattcctggatcgaaacaaggctgattcgattactcgctgtcgctgttgttgattttggatctgtgttttgttatcttcggatcgggaatcgaagccctagagatttgatccatttcgtcgcgaaattaggttttttttttcaccgataagtttttggatctaaagttatcgaatattgtcagggggaaaaaggaattttgaggatttgttggattttgctgaggatattgatgttgttcgaaggagaagatgatagaaggctatgcatgggagggtttgtgagcggagacacaaaagtcgtcgtcggcacatg

SEQ ID NO: 20060 - DNA, 3003 bp, Unknown
  misc_feature (1)..( 3003): 2750-1469P.txt file - cDNA_ID_1824269; gDNA_ID_1620706; Annot_ID_48886
gctgctaaaattaggaattgaattcatgccactaagaatactgttagggctattagaaagtgactcaataaagctctcatgacgatgtgttccattgttatcctcatctaaattctccaccggacgcggaagatctctctgatcaggcttttcactcccaattcttcgattggattccatttcctccttatcccctttgttaatcatcgcaactaataacaacaaaaacccaaatcaatataaacaaaatccacatgtaaagatagatcatttaattttaccttgagaaagccattgttcacgacgaagacctagcttgctctgtttcaatttggccgacctgttcgtctgcaaacccaaagagtgaaatcaaatctttgaagagagaaatgagatttgaggaaggattgaaaacaatacccttttcttttttccgaaatccctggcggttggagctgaagtagcagaagcgttggtgatcgaatcagaaatcatggtggttgcagatgattccaaagcaacaacaaaatcaaatacaaataaatttcaaaatcacgaaatgaagatttctcaaaaaccctaatacagatttgttgcgagagagaagaagaagaagaaacgtgcgattttttatttttttttgctttgtttgttgtgtctgtgagagaaaacgagagagagagagataaaataaggggataacggaaactcctcgtctccgcacagaactttccttctgactaaagtaccctttcttttgacttttgcacacgctcgaatgtaggggtggttttgtaattgtgatggatctacacgtgtgagaaacttctgttcatttaaaaacggtggcgtacggtggactacacgtgaggatagttcatatgattcacaaatatcagcgagcttctagatcaatcagctgggtttcttctggttacagaaaaaattaaatgatttagaaaaacatcaaaaccacaaagtcaaagttgtgtctctttctttcaatttgatgaatcgatcaaacacatttttatcttatattttgatgtaacaacaaaacatgaaattaaacaggttaaaatagcttatgaaaattggtattagggagctaggaaactgcagatgagagttgaacaacatttaggtaagtttttaactaagtcatgattagtttattgtattttgaacattaacctgcaaaattaattactactataataagaaatcttaggtagcaacatgaaaaaagtaagaatgctaattaacaaattacattaaattttagaaagaaaaaaaataacatgttaaacaatattttttattgcatcaacatagttctaagttatgaaatgacataggatgataaaaatcgattttagtgaaatgacatgtaacttgtaatggtgaatcagttacatggtttaccatactttagagtgtatataacttcaatcgatcagtgaaccatttaagattacgtaaagatacatcaagtgcattaagagagaccaattgatctactcgacacaaacagagagtataagctagtgtctaagattgaccgataaataataataatacaaggatttggatttaatccttcaagccactctaacaattccaaaggcatgaagacagattatcaacatgaaaagctgaaacatgtggaatgttttttaattccacaattgtccaaaaaaaacaagcttttatgactttattacaagctaacacactgttcaatatgaaatcaagaaaagaatgaaaaaaaactgaaattaaagaataaatcctactcgaaatagacaaaccaacacgatggttcaaaagaaaaggtgaagttgagcagaatctgacttaacacaacaaacaaacaaaaacccacagaataatattcgggaatctacctgaaaaagagagcaagacacgcatcaatggaaaaagacttttatggatcagagatacaaacagagttttgatatgttatctcacatcaattgcagttcttgtgtacaaaaggtaacgccacacacactctcgatgaaagaaagagatttctgagtaaatggaatattaaaaaaagtatgtttgtttgctgcaatgcaaaagtcgaggttaaattcaaaaagcaaacatatacatacacatatgtgtgttacctttttcctagacaacaactgatcaaataaattactttattattagtatgaagtctgaactaagcattttccaaacagtttacattggctaatcgatcgaagtaaacgaacaatgtccagtgagcttaattatgcactagtgactagtgttataaacttcaaagggagtccaaatttcagcttataaaacctcgtaccgaattatgattatattagcgaaactggttttgggttaaaaacataacacatgtttatatagatagatattacatgctaacaactcatgatgagtagtaatgtgcaatgttagaaagtatggttcgttttcagaatccacctaacggttggaataactcgaaatgtacccatgagtttcctatctatatttagaacgacatgcataatcttgattgtgacactcagtaatatttctctctaacccgacccgacccgcccgaactctcccaagttacctttccccttttcgaccgtttctctctctctctctattctcttcttcgatttattggtgttttgttcgcttacgcgatttctcgaagaaaaattctcgtattcctggatcgaaacaaggctgattcggttactcgctgttgctgttgttgattttggatctgtgttttgttatctgcggatcgggaaattggaaaaaaacctagatatttgagccatttcgtcgcgaaattaggtttttttttttcaccggtgggtttttggatctaaaggtatcgaatattgtctggggaaaaaaggaattttgaggatttgtttgattttcgctgaggaaattgatgttgttcgaaggagaagatgatagaaggctatg

SEQ ID NO: 20061 - DNA, 3003 bp, Unknown; identical to SEQ ID NO: 20060
  misc_feature (1)..( 3003): 2750-1469P.txt file - cDNA_ID_1824269; gDNA_ID_1620706; Annot_ID_165291

SEQ ID NO: 20062 - DNA, 3003 bp, Unknown
  misc_feature (1)..( 3003): 2750-1469P.txt file - cDNA_ID_1824273; gDNA_ID_1620706; Annot_ID_48884
gcgaaatcccaaccgagagtgacatctcaaaccaaaagatggagtctatattaaagagacgaagactccaaagtcaagctacaaaatttccaagcaaagattacacagagaaaactttccgaccaaatgtgaatgtttatgaaagtttctgcgaaactccagtcatgtcggatgtacaaagccatacaccaatgtaaaaccgacacgtggaaagctaagattcctagcttttctttcttcatgagtctccaatagccaaagagtcaactccaaaaaaaaaaacccatttttgcattgaaatggtctcatgatggggtattttgggtaactaattagtcctgtctacatcttcccataaattaacagagtaggagcggattaaagaagcaagacgattcaaaagaaaaaagagagaagaaagtccactaaagaaaagagaatagatatagatcaatggcgtttgaagctcttaccggaatcaatggtgatctaatcaccagatcatggtcagcctcgaagcaagcttacctaaccgagcgctatcacaaggaagaagcaggagcagtcgtaatcttcgctttccaaccatctttctcagagaaagatttcttcgatccggacaataaatcttcctttggagaaatcaagttgaaccgtgttcagtttccttgtatgaggaaaatcggtaaaggtgatgtagctactgttaacgaagctttcctcaagaatcttgaagctatcattgatccaagaacctcatttcaagcttctgtaagaagattgaaaacatccgaatatatttttctttttttttcttttttggtctcttatgcttttacttcttcaggtggaaatggctgtgaggagtagaaaacagatagtgttcacaggacattcctcaggaggtgcaactgcaatcttagcaacagtttggtatttggagaaatacttcatacgcaatccaaatgtttaccttgagcctcgttgtgtgacatttggagctcctttggttggtgactctatcttcagtcacgcacttgggagagaaaaatggagccggttctttgtgaactttgtctcaagattcgatattgtccctcggattatgcttgctcgaaaggcgtctgtagaggaaactttgcctcatgttcttgcccaattggatcccagaaagtcttccgtccaagagagtgaacagagaataacagagttttacacaagggtgatgcgagacacatcaactgttgcaaaccaagctgtttgtgaattgactggaagcgcagaggcgtttttagagaccctttctagtttccttgagctaagtccttatagacccgccggtacttttgttttctctacagagaagagattggttgcagtgaacaactcggacgccattcttcaaatgctgttttacacttctcaagccagcgatgaacaagaatggtctctaattccatttcgaagtatcagagatcatcatagctatgaggaactggtacagtcgatgggaaagaagttgtttaatcatttggatggagaaaactcaatagagtctacgctcaatgaccttggagtggtaagtctctctctctctctcttttcatactgtgcagctccatagctccattcttgcaatcatttaaacccttcagagtgtttcctttttctgcagagcacaagaggcagacagtacgttcaagctgcattagaggaagagaagaaacgagtagagaatcagaagaagattattcaggtttgtggttgataagcttgttcatgaataatgcaggtacgtgcttcgtctgtttgtgtctaacaacataaaacttgttggttctgtggtttttaggtgatcgagcaagagaggtttttaaagaaactagcatggatagaagatgaatacaagccaaagtgtcaagcccataaaaatgggtattatgattccttcaaagtttcaaatgaagagaatgacttcaaagcaaacgtcaagagagctgagttagccggtgtttttgacgaggtgcttggtttaatgaagaaatgtcaacttccagatgagttcgaaggggacatagattggatcaagttagcaactcgataccgcagattagttgagcctcttgatattgcaaactaccatcgacatttaaagaacgaagacacagggccgtacatgaaaagaggaagaccaacccgctacatatatgctcagagaggctacgaacattatatactgaagccaaacggaatgattgcagaagatgtattttggaacaaggtaaatggtcttaacttagggttacagctagaagaaattcaagagactctaaagaattcgggatccgagtgcggatcatgcttttgggctgaggttgaagaactcaaaggaaagccatacgaggaagttgaggtaagagttaagacattagaagggatgcttggagaatggatcacagacggggaggtagatgataaggaaatatttctggagggttcaacgtttagaaagtggtggattacgcttcccaaaaatcacaaatcgcattctcctctgcgagactatatgatggatgaaataacagatacctgaaccttaggtggtggagtatttaagctattagaacacttgcttctcttaatttgtgcaataagaaatgtttatcaatctggtttccacttcatgatgatcttagaataagaaacatgttgtatgatcattgtgaagtaatgtaatagctctctattctaatgtcaaatttggtttccactttacagtgatcttagaatatatacgttactctactaaagcctaaagccatctcaaatagcatgaaccagtaacaaacaaccttccttagattgaaatggtctcatgatggggtattttgggtaattactcctgtctacatcttcctactatattaacagagtaggaggactaagaatcaagacgactcaaaagaaaaaagagaagaaagtccactcaagaaaagagaaatg

SEQ ID NO: 20063 - DNA, 3003 bp, Unknown; identical to SEQ ID NO: 20062
  misc_feature (1)..( 3003): 2750-1469P.txt file - cDNA_ID_1824273; gDNA_ID_1620706; Annot_ID_165289

SEQ ID NO: 20064 - DNA, 3000 bp, Unknown; identical to SEQ ID NO: 4438
  misc_feature (1)..( 3000): 2750-1469P.txt file - cDNA_ID_1824277; gDNA_ID_1620706; Annot_ID_48881

SEQ ID NO: 20065 - DNA, 3000 bp, Unknown; identical to SEQ ID NO: 4438
  misc_feature (1)..( 3000): 2750-1469P.txt file - cDNA_ID_1824277; gDNA_ID_1620706; Annot_ID_165285

SEQ ID NO: 20066 - DNA, 3000 bp, Unknown; identical to SEQ ID NO: 4432
  misc_feature (1)..( 3000): 2750-1469P.txt file - cDNA_ID_1824281; gDNA_ID_1620706; Annot_ID_48880

SEQ ID NO: 20067 - DNA, 3003 bp, Unknown
  misc_feature (1)..( 3003): 2750-1469P.txt file - cDNA_ID_1824283; gDNA_ID_1620707; Annot_ID_48923
cttttaatgtcggggaaaatggttttgacaagctcaaattcaaccattgttttgtcaatatattgccggtttggtctgaactctgaactctgaagaataaataaacaagatatgatttcgggcaataattattaatgctaattgttttaagctaaaggggaggggggagaggaagaaattttggttctttattatatcaacaaaaaacataacgaaaacatgaatctaggtatatcattttaatctgcatatccgaaaatgttccctatactaactaatacacgaatttattataagggaaacaaatagacaggtgatattttaaattagagctctacacatctctttttttgcttggtggctcaacaaaaacttcatcttcttttggtttcaaactctacaaaatcgtggatgcacttacagttatatataattagatatattactgataatatagattatatgatatggatctctctctctatatatacattgtatttaatccattattccatttactcaactcagacaaactatgattaatagataatatatatatatatatatatatatatatatatatatacacactgatacatttatatatcgcatatatatgtttgtaatcttgtatatatatctaacgtatggatgcatgaattttacaaaatgagagaaccatttattggtaagacttttctttgatatcatgaaggaagcagccaaagtaatatatattttatgttctgattattatatttttctccgctccgccaagtcaattgataaatttcgtgcaactaagaaaaatatctgcatcttaagctaagtcatatcattagaaatataaatatagaagtcatattcttatgttccttttctctaatcagattacatttaaaacccaaaagtttgaagatatatactagagttatttggctttgttacgttaacgtgggaggaaaatagcgagtgtttctgattaaagtcaagagcaaatgagcaatacatatttgtctgtatatgtatccatgagttactagtcgaaaaaaaaatgttcattacttttatgttatgtttatttttgtcaacaggtcgttgcagatttgcagcttatcttaaccctaatattttacacatatgtcatgtatgtatttctcagaatcaagttaagaggttaaacaaaaaaggaggttaaccagggtttgtagcttataatatattttatatttattatatgtagtttatattaatttttgtatatataagtgaaaaagctatgtaacaatattgtaaaaaacaacatatcatttaaattatagctccataatatatatagggaatagaaacaactcaaatgtaaataatatagtggtaagactcctaaattatataatccttaggcctcaaaaaagaatgcgttagaatgtaaattaacggtttaaaattttctgagaaaaaagatgatgaggattcggtccacaattctccgattaaccatataaaactctaaactttcatataactcttatcatgaaaccgtaaaagatcgtccataattattgatccagattttttcattaaataatagaaggattcaatatgattttagctagatagatttgggagtttaattagctggtttagctaattcaccagaaaatgttttatctaactagtactaattagcatattgtattttacatgttatcccaaatgaattatttttaattttcacacacacacacatgtatacacttttcatctagaatgccacacatcttcattttacttttagtcattgttagttgtatttttttgttaatgaatgattgaaaactgaaattgcaatataagaatattttgataaaaaaatatatatgacacaaatgcaaataataatagagaattctcaatatagaattgtttaaagaaatctatcatattaatctaaaaaattattatcaagatataaattaaaaaaaaatatcttatctaattctatatgtgcatgtggtatgtgtaataagctactacagacacgtaaacagatattactactttgaatagcaattacatttataactttacaaagaaagactacatatgtagtaaataaatctcaatattcaatctcgtttagccatttgtcatgatatttgtatgtagatatgctatataatatcacaaatatcatattcaagtagtaaaaaatctaaagaaaaaatagttgccaaaacaaaagagataagtaaaactagtcttcgtagttatctctctgaattatgcatggatatcattcccactcttttattcactctactattaagaaaaaaaaacgtgctgtatatgaaacaaaaaaaaaacccaaagaaattgttgatgtcaattgatataacacatatctgaaattaaatatttgatgtagcacaagaaacttaaatttaaaaaccaaataaacttataaagggtagactttaccccacatttgtctctctctacttaagccaaattgctctattcttttgttttctctttataattaggctttataaaccaacttttattaagaacaacaaaaataaaattgttatttatttggcaacagaacgaattattaaccaaattaatccatttgaatggccctcctctctctctgtctttaattagttggtttggtcaaaatctcacacgctctttatgcatgctctttgacacgtgctatcttcgtctctctcaaatgagctgtctctctaataagagtttcttctgtataggaaaggaaaggtctctctctctctatttacttatgagaatagcctataaaaccccttcacatctcccacttgttttgcatcacaaacatttcttccattacattaaaactccaaaaaattcatttttgttttcttttagagttcacaagttcttcgttgttcagctactcccactgtcataacacgaagtgggtttttttctgatcaaagaacaaaaacaaaaatg

SEQ ID NO: 20068 - DNA, 3003 bp, Unknown; identical to SEQ ID NO: 20067
  misc_feature (1)..( 3003): 2750-1469P.txt file - cDNA_ID_1824283; gDNA_ID_2926173; Annot_ID_140206

SEQ ID NO: 20069 - DNA, 3003 bp, Unknown
  misc_feature (1)..( 3003): 2750-1469P.txt file - cDNA_ID_1824291; gDNA_ID_1620707; Annot_ID_48921
gttcttctgttccaattccaattccttctgaaatattcatcgcaattcgtatcggtaatttttccttttgatcgcattttttttttatctttgatcttccgtattaaacgtgctcgatctatatactcaatgatcttatatgtgtatgatcatgtaatttggaagttgaaatgtaaatcatctattccttggtaaattattcttcgattttttttctgatataggttaatggtaattcctgtgatttttactgatgtaatctggtgttgattgttgtgaattcttgatctatgagattatgtcttagatttgccaaatgttaagtttgtttgatctttgacaaaatattgtaggtttaaagtaaaaaagcaatgggaggtggtaaagacaagcatcatgatgagcaagagaaaggatttcatggttttccaggaggtggacattacccacctgctcaaggaggttaccctcctcaaggttacccaccacaacaagggtatcctccagctggaggctacccacctgccggatatcctcctggtgcttaccctgctgcgcccggtggttatcctcctgcacctggaggttaccctcctgctggctatcctgcacctggagctcaccattcaggtatgcattgtctcgttaaagagctcttctttgtagttttggtaaatgttgatgttttctatgcaaaagctatggagtgtccttgtagcttgcttggattatcaacctgctaaatattgttaatcattgaatgttaataggaaaagactttataaatgtttcggttttctatgaaaaaagctaaagattgtgcgtgaagtttgctggatcattaaccttcgaactttgaatgataatagaacaatagtttgtaaatcttactgttttctttgtaaataaagcttagaactggccttgttgtttgctggattatcagcctgctaagtattgtcaagtttgaatgatagtatgacaattgtttctgaaatgttgtttttttttctgtgataaaaagatgaggacatataaacttactgtcttctgttttggtgtatacattgatgttttaattttaaatctactaggagtacatgtttaatcgtgtgtgcttatcaatatgcaactttgtggtctcttatatgcattctgctactttgtggttctccatgtaatactattttcttttttccatcaggacattctggtggtggactcggaggcatgatagcaggtgcagctggtgcagccgcagcagcttatggagctcaccatgttggtcacgcctctcacaacccttacgggcatgctgtaggacatggagggtatggccatgcccctgctcatggctttggccatggtggtcatggtaaattcaagcacggaaagcatggaggcaaattcaagcacggaaagcatggaaagcacgggaaacatggcatgtttggaggaggaggcaaattcaagaagtggaagtaatctcaaaaaccccacctttgatcctctcctccagtatagtctcattacctgaccgatgtttctaataatcccccttcaaacatatttcattttaactatgtcggtttagagattactggttgaggaaataattggagagtgctagtataaaccttatggtatctgcagcagaggtttctttaatctctcaatagtagatgctttgaaacttatctataatttggtattgtaatgacagtttgtgtttggttttttcttcagtatcttctttgtttgatcatttgatgttggtggagttctccaaaatatttatgctattgtagatcctaacctttctatcttgttattcttcgttttttggccattattttcgtttcgctcccgatccaaattccaaagtacttcaacaatatcttatgcaataacgagacaaacacttaaggtcgtgcaagaatagtgtctgtttttcactgattcacttttacagagaacaaactgaattaattttgattattgaatagttgacatgcaataatatttgttaatccaaatgaatagataaaaaaaaaaattccttgagagtaaagaaactaaattttggaagacaatttttaactagttttctctaaaactaggaaagtcagaaaatgagaaaacaaatttgattttattacggaagtgaagggctttccgacaaattgctttgctcagaccaaactgtaaccgacccaagcccaataaaaaagcgaatcgggtcaaacgaaaacagataattcagaaaaccctaaattcgtttctctttttttttcttcattctgagcaaagcagtaactctcaggtgcgtgtgctctccgctggttccttagaacaatcggcacacgctttttcatttcaatcttcttcttctactcttaagtatctcaggtactaatctcgatttctctatttctcgtccatggagatttagatttcaagtcagatgcttttcgatttgttacagatgtataatttttgtaatcgattgattcgcagcttggattgtattgagccatcgacataccttcaaaattcttataattgtattgaaagtgtttgaatttaatgtttttttttttctttctctcgattgttttgatttctgggcaagtgtcaacttttgtaacagattagtgacctttctctttatagatatgtggaagaatttggaatttacaaattcggttcaccatttttatctgaagcactgaatttgcgtttttcaagcttgagtgaatattatttcttggctcttaagattttgcatgtcaactattatttcatcattgttagcatcttgtggtgttcaagttattattttaaatattgtttgtgctactctatagttattccctatgttgttatttcgttcctttgccttagcgtgacatctttatttggtatatttgtatctgtgtgatttagtttcttcaggctgttaaactatagatttcatgtattttgtaggtctgttgagagatg

SEQ ID NO: 20070 - DNA, 3003 bp, Unknown; identical to SEQ ID NO: 20069
  misc_feature (1)..( 3003): 2750-1469P.txt file - cDNA_ID_1824291; gDNA_ID_1620707; Annot_ID_165344

SEQ ID NO: 20071 - DNA, 3003 bp, Unknown; identical to SEQ ID NO: 20069
  misc_feature (1)..( 3003): 2750-1469P.txt file - cDNA_ID_1824291; gDNA_ID_2926173; Annot_ID_140204

SEQ ID NO: 20072 - DNA, 3003 bp, Unknown; identical to SEQ ID NO: 20069
  misc_feature (1)..( 3003): 2750-1469P.txt file - cDNA_ID_1824291; gDNA_ID_2926173; Annot_ID_199650

SEQ ID NO: 20073 - DNA, 3003 bp, Unknown
  misc_feature (1)..( 3003): 2750-1469P.txt file - cDNA_ID_1824294; gDNA_ID_1620707; Annot_ID_48920
ttaatgcttggaatttgcagatacgagaagcggttaatagaaatgatccggtggaatcacttcttctgtttcgagaaatgaagcgcggaggatttgaaccgaacaactttacttttccatttgtggcgaaggcgtgtgctaggctcgctgatgttgggtgctgtgagatggttcatgcacatttgataaagtctccgttttggtctgatgtgttcgttgggacagcgacggttgacatgtttgtgaaatgtaattctgtggattatgccgccaaggtgtttgagagaatgcctgagagagatgctaccacttggaacgcaatgctgtctggtttctgtcagtcgggtcacacggataaggcgttttctctatttcgtgaaatgagactcaacgagattacacctgattctgtgactgttatgaccttgattcaatctgcatcgtttgaaaaaagtttgaagcttttggaggctatgcatgcggttgggatacgtttaggtgtagatgtacaagttacagttgccaatacttggatttctacttatgggaaatgtggtgatttggattcagcaaagttggttttcgaagctattgacagaggtgacagaactgttgtgtcttggaattctatgttcaaagcatattcagtttttggtgaagcatttgatgcttttggtctttactgtttgatgctgcgtgaagagtttaagccggatttgagtacgtttattaacttggctgcatcgtgtcagaaccctgaaacactaacacaaggaagattgattcattctcatgcaatccatctcggtacagatcaagatatagaagcgatcaatacctttatttctatgtattcgaaatccgaggatacctgttcagcgaggcttttgtttgacataatgacttccagaacatgtgtttcttggactgtgatgataagcgggtatgctgagaagggcgacatggatgaagctttggccttatttcatgccatgatcaaatcaggagagaaaccagatctagttaccttactctccctcatttcaggttgtggaaaatttggttcacttgagactggaaaatggatagatgctagagcagatatatatgggtgcaagagagataatgtcatgatttgcaatgctcttattgatatgtactcaaaatgtggaagtatacatgaagctcgagacatattcgataacacgcctgagaaaactgttgtcacatggactacaatgatagctggatatgctttgaacggtatctttctcgaagctttgaaactttttagcaagatgatagatttggattataaaccaaaccacataacattccttgccgtccttcaagcttgtgctcattcgggttctctggagaaaggttgggagtatttccacatcatgaaacaagtatacaacatcagccctggactagaccattactcttgtatggtagatcttcttggaagaaaaggaaagctcgaagaagcattagaactcatccgtaacatgtcagctaaacccgatgctggcatatggggtgcattgctaaatgcctgcaagatccaccgtaatgtaaagatagctgagcaagccgctgagagtctttttaacttagaaccgcaaatggcagctccttatgtagaaatggcaaacatatatgcagctgctggtatgtgggatggttttgcgaggattagatcaattatgaaacagaggaacattaagaagtatccaggtgaaagcgtgatccaggtaaacggaaagaatcacagtttcactgtaggagaacatggtcatgtagagaatgaagtcatatactttacgctgaatggtttgagtttgtttgccaaagataaacacgtattgtataaagatgtgtacaaagaacaaagttatgaacttttcatttgatgacaatgactttttagtggatttgttgttattacttttaggatatagttttgtgatggggaatctagtgttatcaacatgtgtttgaataattaatattacaagatatgtaaaaggaaaaggtaattatgatttgtggaggaccagattcttttggcattactttattttattcaccactaatatatttctggaatttattaacttaaaaggataaagactttttagacaactttaaataattacataacattaagaaaatatatttttccttaaccatgttcttagaactccgtgtccattgcgcgttcccacgacgtagatattttctttattatactttaccctttttgattttcgtattctcgtttaaaccccagtactttcttaaacacccaacagagccacatgtatccaacaaaaactattttttcatgcatcataagtgcaaaacactcataaaaaataaagtgattgtattcatgattaatttgtaactgttttgttttacgtttttttgtatttggagtatagatacgattaaaattacaaagactacaatgctttttatttatgattgtcttaaaatacgaggactagaaaacaattaaaatataaaatagataagatatgcttattcaaaaatgtaacgcgttaagtaattaatatttttggatacatccatccatatatatccttctccattagcttttgttcttctgttccaattccaattccttctgaaatattcatcgcaattcgtatcggtaatttttccttttgatcgcattttttttttatctttgatcttccgtattaaacgtgctcgatctatatactcaatgatcttatatgtgtatgatcatgtaatttggaagttgaaatgtaaatcatctattccttggtaaattattcttcgattttttttctgatataggttaatggtaattcctgtgatttttactgatgtaatctggtgttgattgttgtgaattcttgatctatgagattatgtcttagatttgccaaatgttaagtttgtttgatctttgacaaaatattgtaggtttaaagtaaaaaagcaatg

SEQ ID NO: 20074 - DNA, 3003 bp, Unknown
  misc_feature (1)..( 3003): 2750-1469P.txt file - cDNA_ID_1824297; gDNA_ID_1620707; Annot_ID_48919
ttctcaacaaattcactctttctgtactgcataccaagtaggagacatcaaaaaaccaaaactgaaggcatatctaagaagagaacccttataaagaatcatactcaccccatcatgacagccaagagaaaggtgaagaccgggatggatggttgaatggcagcagcataagtgggatttgtgtatgtaagaccgataagaaataacaactggttcccaaataccctatcaaaattgagaacaaagcagaggtggctttactgagatatttaacctctataaacatgaacacaagatattgagactggatagagatgatttcttaccctgctaagcccagaaagaagaatgacaagagaaggcttttattcattggagttctgatctttctacatacatgaaagacgaacactgttcactgattagattttgaaaacttgaacattcaaagtttgagagtggtctcgcttaaacttgacgcattacaacctcctaaaccattctttcatttactgatagaactagacaaccctagctcgagaaaccagatcctatttatcccaaaacccgaagaagagacatggaactcagagaacattatcaaagacattgtatctaaatctactaacagtggaagtaaacggaacacagatctcaacttaagtctaggcacattgctccaactctgaaatctagttcttctataatgcagatcacattgactttaaatcctcaggagaacttctacagattcatcagagaaaaacccaaaagcaaaatacgaaaatccatactaatggatcaggcaattacaaggggactgtgtatagttctcacttcatatataaacccacaaattgatcataaaaccaggaaaccattgaaacccatctcgagaattcagaactaaaaacagaggaaacaaaaacaagttgaaaaagaagagacctttcgcggaagtaagcaagaggagcgagaatagagagagcaagaagatcacggcatacacagaagacaagctggttgactccaacattaagagctactttagtaatcacatggtatccaccattaaagagctgaacaaacgccatagcagtgtgcgccatccgagcgtctctctccgccgccgatccacttccggtcaggatcatcggcgccgtcatctttccgatttactcggcccctctctgacttgtagttataagttatttctaaagcaaagactaaaaaagtaagatcctttacttcgttagcaacgaatctgcttcttctatttgtcgagtcctataggttctgtgcaaattttcatatacaatatctaggagatttaattctcaaatcgatctacttttatttgagtctgtatcattttatcaaaatatattcgtgtattattaaatctggttaggacatcaggctcatactcataggctgcctaatttaggcattaaaaattgaattttcataagtattttgaataaaccatttgactcaaattttaattgaaatacgttaaaatttgtaaataaagtaatcaaactagggccagaataaaatccgaaaaccgaaaaccgcatccgacgacttcaaatcttcaaaactgctcctctcttctctctttaaaatctttcagagaggtaatgttaatcatcggttaggaatctcttccgggttttcccggatctgtaaatatctctctttgtaagatttaaataatttctgactctttgtcggattctgaataccggctaagttcggttttttgtttctcgcttctgcgagatagatctcttcctttacgcggattgaagactctgttttactttaaatctctgccaatctcaccaacatttcgtggagtaatatcttcatcaattccttatgcccatagagtatggagcaaagaaccaactacatcaaatttggtgttgtcaatgatggagctttcctggagtttggatatgctcgaagatttttgaagccaatcctcattcgacccagagattctcgatgtcttagccttgggtttgagatcaccagaaggccggaggttttttatcgctatttggccgattgacggtggatcatcggactttcagcggcggtcggtaatttcagcggtggagctcaatgcctagacacgtggcgtaggatcgtgatacatcgttgatacatgatgtggatcgcgacacgtcatctgcaagtgtcattaaatcaatttgcgttaatgtttatcttttcttagattgattttgggtctgggcctaacttgctgtattcctctatggacttgtgtaacttgcccatttgggatttaatgaaataagccgacaaaaaaaaaaaaaaaaactggaaactgtaaaacgatatgaataatctggctccgaaaccgaacatataaagaattctcctatccaaattaccggaaccaaattcgactcgaatcaaaaaccgaacgaatatctgctaattcgaaataaaattatatatctaaaaatattagttatatttagttatactttatacccaaaaaatactaaataactaaaatatctgagataatttttatatccgaaatttttaagttatatttgttataattatacaatattttgcaaaattaaactaaattttagtaaaattaaacaatttttttgttttttctctctcaaaaactgatccaaaaacgaatcgaatccaacaccatccaaactgaaaccaaaccgaataatcatataattcaaacggataataaactccctcatcctgattattcgaatccgaaagtattcgagctaaatccgatccaaaatccgagtacacaagcttaaatcaaacaatagaaataaataactaatcacagttgcaaattagatattttttgaatataaagtttacaaattgaaattataaagaaacggagggagtaattaaaattaaattgaggtatttcaataaccaaaaagcccatcattgggtaaatcttcacatcgggacatg

SEQ ID NO: 20075 - DNA, 3003 bp, Unknown; identical to SEQ ID NO: 20074
  misc_feature (1)..( 3003): 2750-1469P.txt file - cDNA_ID_1824297; gDNA_ID_2926173; Annot_ID_140202

SEQ ID NO: 20076 - DNA, 3003 bp, Unknown
  misc_feature (1)..( 3003): 2750-1469P.txt file - cDNA_ID_1824305; gDNA_ID_1620707; Annot_ID_48916
caaaacaaatcgatacatggataatggggttattggatatattgtagccaattctatacggatagggagccctacgtttccacaaatatattgggatggatattaaagcattttaaaaacttactgaaaataaacattgaatattatatagtcaatcagccatcgtcatggggttagaataaaacaagcactcctttcaagttgatgctttgttttaatcaaacgtcatgatcccaatactaatattcccattttaacgtcacttaataacgtaattaagtcaagataatttacgattgatttttttagcataagtttaacctaatcttcaaattatgttgataatccccgcttaagttcttctttattttaatcaagtctactaaaactaataatgtattatgactcgattgccttgataaaaaggtaaaactgaaaagcacaagattttctcttctcccacctaacttttggatttctctattgtttttccacaaggaagacctaaatttcttagtttaatggatgattaattgttttgccaaaaaaaataatatcacaatggccaaccatgataaaaatgactgaaaagaaaaaaaatcattctatgataattagctaaaagccatttgagcaccaaaatataatctacagcatgtatttgtaaataattagtacgattatatggatttgattaagtaagagaaaacatttattcaaaacgtaacataattatttattaatggatcatatgtgtgttattcacgtggttgtatagtaacgttattgcgtgaaattcattttatatgcatacttgttggaattcaatacgtactgcataagtgcatagatatgccaatattcaagtgccaatgatgattgtgccgtgttcctaccaatcgttgtggatgagcatatataccatccacttacgagtaaattaaaaagaggcaaaaaaactattattggtttatcttaaatcgtttcatgtaattttcataagattcgtctatcagaatcgaatcttattaaaggaaaccacttaagaaatattaaaattgagtagacaaactaaaatatatagcactcgtaaaatataattaagacaaggagcaacattatccagttttctttatacatgggatctgcgggaatatatgcttatgttctggaaaaataatggagtaattgagttttataaaattgcgtgaacctccaaaatcaatgtatcaaattcagatccacataaaagttatcaacataatcaaaattatctttcaattatattagtgcttccaaattcctagtagtctaaatatcttgttctttgacaaaaaaaaaatatatcttgtaggttcggctttgaggaatctaagaaaattaccggacccaacttaagatatattagtatttagtgacgtgtaaaactaataccataaaaataaaatcaattatggtgatttagtagaatataaataaaataatgttaagtagaatttaatgatgatttatgatatggccaaatgaattaacttataaaatagttaaaaagttgttttgtttaataattgaagaaaaattaagaaattatttaatagattggtaaactaatttatctaaatataattttcaaaaataatataaatgatataaaactttggctaccaaaattgaactagtcctctttgggttggtttgactgtttgagaaaattgcttcttacagtttagctttgttgtctatgcttggccttggctgatcgacaaagtgattcgcataatcgcatcttttggatgcaaagacaaataaagatatactccaaaagatgcgactataacattcttttcaatattaacgctactttatcatcaacataaattacttaatcaacaaaacatgaaaataaggaacaaagctcgaaacgcaacatgcactacggaaaaagaggaattaaaatgaacatgtctacaatttgtcagtgaagttttggatgtttctactatgatatggcttgtttcatgcctaccatatgataagtgttctcgtgattctcgctttatttttgcatttttttcatttgtttgtaaatcacttattattgttgtttttcattttttttttctgcgtttggcgttttactggaactttaagttacagaaaacatgaatagggaaatttgttaatatgtaactaaggttagatattttgtaagtgacgtaataagtaaacagattattccatatcatttgtattataaaaatatgaaaattgtggtataacaagtaattttttaaagtttttttttcagttgttttatgttgctttccaaaaatatattaacacaaaaaggaggcaaaaataatctttaaggaaaaaaaaaactttttttaggaaatttttgaagaattaataaaaataaaagaccatttttcatattttcacttaattaaattggcttaactctgcaacaagtgtcgtcatcagtccttttaaaacaccttgtatcttccttttaccaaatccgccattgaagaataagagagagagaagagaactactcagatataaaaaccctagatttcttctcttaaaacccacatcgaatctcaactcagaaccaacaatgctccaacctttctcttcctcctctgttttctcgagaatcctctggactttcttggtttaagaagattcgttgttgaatcagagagaaagaaagcatccatttttctatcattgcttgcttgctatggaattgggtaaatctcgattctacttatgttgcaattgcttttctcctgttagattttccgattattctttagctggaagtgattatccagacgccatctccatcactttcaattgtattcctataccttcttctgaagattcttcgtatttctcgattcgatgtttataaacttcaaattctcttccaaatcttgaaacgaatttctcccaaaaatctctgtttcttcacaaaaaaacaaaaaaacaatg

SEQ ID NO: 20077 - DNA, 3003 bp, Unknown; identical to SEQ ID NO: 20076
  misc_feature (1)..( 3003): 2750-1469P.txt file - cDNA_ID_1824305; gDNA_ID_2926173; Annot_ID_140199

SEQ ID NO: 20078 - DNA, 3003 bp, Unknown
  misc_feature (1)..( 3003): 2750-1469P.txt file - cDNA_ID_1824313; gDNA_ID_1620707; Annot_ID_48914
ttcacataatacaaatctttagcagatatgcccattatctcttcaccagcctcctggaatgctgtgacgcaagtaagatctgtatggtcctgtatctgaagctgcagtatatacctgtagtcacattcatcaacgcttttatcacacttttcgcaccgccatgtcccatctccattgtctgttacctttttgctgcatggacgatcaccgttcatgataggacaagctgtgtagcagaagttatcaaacttcaagtataaaattgtggcactgactgtgatccagtctggtttttcggaggttcctagtttctcatctttaatttgagatattgtcttacgaacatctactttgccactgccggaaaactcccgagataaggagatacaagggacactctttccttctctctcaaaccagttcttcagtttctcagcttcaacaaaatctgggtcaatgaacagctgacttgatccaatggtgctcactgtctttccattaaattcactaatcctgcccgccttaacagcaagaaccggaaacacaccagaatcacaaagactttgcagcctttgtccttctgcattgcagaagtcaccccacatagttacctcaacacttcggcctgacatatccttcaactgaagtgatcttttcggtgttgcagttccgtttttcctcgttattgttacagtaggactgatagatgacacaataccaattacatcaacgatgcagttattctccatgctctcaatatccccaatggtacggaaatggaactgatggcgcggaattgcagcatcctcttcatagcattgttttatagttgatgcattatccagcatgatctcgtaatcatttcgaagatgattaaagttcttttgtgcaggccgcaaacttcccctcgagataagataaagattaccaacaacaatctggtcatagaattgatcagccacagcgttaaaacaagtaacacgtatttctccgccatcagcatcaagaagatcaaagttgaacactttcccttccccacggggattactgtattgcttaagtgctgctttattcgtgactctggccttgatggtccacctacctgaatatggactaagagcattaactggaattatcttaggaggtgcttcattcctagccactggtcccctgtttgcatacatcggtggtggtggttgaggctgatgaggataacttgttggaggatcacgagcatagtcctgcctagtgactccattacctgaagacggattgctgtatgcccgagtggaaggtgttgttgatgcaggaacactagaaccagtaccaccaacctgaggtgaaatagctgcattacttctccctggctcgatattgtttacttgacggataccactaccttgttgctcagttgtattaaacttaataccagaatctgctccacgttgatcattatgctttcctcctggaacaggatgcccgataatatcagaaatctgttttaacacctccagttgcggaacaataacaatcctggcatcaaaaacaaaactttataagattatgtgaaattttggtaatgtagtctctaacatgaagcaactatcattggctatatatccaaacttcaaaatcatgttcacaaccaattaccttcgacccttgatgacatcaccgacgaaacgagtaagtctaacaatagaaccgggttgaagagtcccttctttgacaagattgttgagatcagttcctagcattccttgatgcaagtatgtcccatcagataacaccatcctaaacctctctcttgttggatcttgttgagccataatctgcttcaaatccgtcacttgcaacaccggaatcatatctgcttcagtcgtcacttctccattcattatcttcccgattgctcccgccgtcaaacttacctccatcattacagattgacactaaaacccaaattcaaaagcgttacaaacctcaagaaaatttggataatcagtagaagcaattcgagattcgaggaggaaaagggtgaaatctttataaatgaattcaaaattgaggagacgaaaaacgatttgtttgaattgacagagaccagaggttgaagaagatgaaggatttgagattagcccctagagtgaaaggtggaaactttacgctccctttgagagggaaactaaagaaggagggtttcaagaatttggaaatcacaatcgagccacgatttggtgttattacggatctaccccttcacaaaattcccttacaagcttcgttaagatgtagactggtaaggctcaaagcacatatataggcccatttgaaggcccaaaatggcaagtaaacgaacatattacgtggaagacgtggcaagtgtactgctgagtcagcaatctctctccatcacattcacattgatcaaccctgtccgaaaaaattattttattattattttttgttgtaattgcatttaacacactcgcatcatagtcaaagactcaacgcggaagggaaaaaaaaaaaaggcgcaattgaaagaaaaaaattgataatcggtaagatttgatgtcccggcgtccgtcgttttgatcaccgtgagaaatggattcttcgaattgttgttctgagtaaaactcactcaccgtcaccggagaagaaagtgtaaatggattccgaagaaacgacgtcgtcggtaacgactacaaagaagcaaaagagggttttctcttcgttagctttgcgattccgtacagtgatagttttctcgatcattagcttcgtcgtcttgtcgtttctattaggaatcttagtgattttcatcggtgaattgtgggtttattcttcttcatctgcttctgcttctcttcattctcgctgcaaaattgtttccagctgtaagtttaaagctttgattctatttactttatcatcaattgattgcagaaattgataggtttcttgtgttaaatgatctcacttctaatgattgaaatg

SEQ ID NO: 20079 - DNA, 3003 bp, Unknown; identical to SEQ ID NO: 20078
  misc_feature (1)..( 3003): 2750-1469P.txt file - cDNA_ID_1824313; gDNA_ID_2926173; Annot_ID_140197

SEQ ID NO: 20080 - DNA, 3000 bp, Unknown; identical to SEQ ID NO: 4458
  misc_feature (1)..( 3000): 2750-1469P.txt file - cDNA_ID_1824332; gDNA_ID_1971812; Annot_ID_58142

SEQ ID NO: 20081 - DNA, 3000 bp, Unknown; identical to SEQ ID NO: 4458
  misc_feature (1)..( 3000): 2750-1469P.txt file - cDNA_ID_1824332; gDNA_ID_1620707; Annot_ID_48905

SEQ ID NO: 20082 - DNA, 3000 bp, Unknown; identical to SEQ ID NO: 4458
  misc_feature (1)..( 3000): 2750-1469P.txt file - cDNA_ID_1824332; gDNA_ID_2926173; Annot_ID_140190

SEQ ID NO: 20083 - DNA, 3000 bp, Unknown; identical to SEQ ID NO: 4466
  misc_feature (1)..( 3000): 2750-1469P.txt file - cDNA_ID_1824336; gDNA_ID_1620707; Annot_ID_48904

SEQ ID NO: 20084 - DNA, 3000 bp, Unknown; identical to SEQ ID NO: 4483
  misc_feature (1)..( 3000): 2750-1469P.txt file - cDNA_ID_1824344; gDNA_ID_1620708; Annot_ID_48946

SEQ ID NO: 20085 - DNA, 3000 bp, Unknown; identical to SEQ ID NO: 4483
  misc_feature (1)..( 3000): 2750-1469P.txt file - cDNA_ID_1824344; gDNA_ID_1620708; Annot_ID_165387

SEQ ID NO: 20086 - DNA, 3000 bp, Unknown; identical to SEQ ID NO: 4483
  misc_feature (1)..( 3000): 2750-1469P.txt file - cDNA_ID_1824344; gDNA_ID_2926210; Annot_ID_141955

SEQ ID NO: 20087 - DNA, 3000 bp, Unknown; identical to SEQ ID NO: 4480
  misc_feature (1)..( 3000): 2750-1469P.txt file - cDNA_ID_1824360; gDNA_ID_1620708; Annot_ID_48942

SEQ ID NO: 20088 - DNA, 3000 bp, Unknown; identical to SEQ ID NO: 4480
  misc_feature (1)..( 3000): 2750-1469P.txt file - cDNA_ID_1824360; gDNA_ID_2926210; Annot_ID_141952

SEQ ID NO: 20089 - DNA, 3000 bp, Unknown; identical to SEQ ID NO: 4479
  misc_feature (1)..( 3000): 2750-1469P.txt file - cDNA_ID_1824368; gDNA_ID_1620708; Annot_ID_48938

SEQ ID NO: 20090 - DNA, 3000 bp, Unknown; identical to SEQ ID NO: 4479
  misc_feature (1)..( 3000): 2750-1469P.txt file - cDNA_ID_1824368; gDNA_ID_1620708; Annot_ID_165376

SEQ ID NO: 20091 - DNA, 3000 bp, Unknown; identical to SEQ ID NO: 4479
  misc_feature (1)..( 3000): 2750-1469P.txt file - cDNA_ID_1824368; gDNA_ID_2926210; Annot_ID_141948

SEQ ID NO: 20092 - DNA, 3000 bp, Unknown; identical to SEQ ID NO: 4479
  misc_feature (1)..( 3000): 2750-1469P.txt file - cDNA_ID_1824368; gDNA_ID_2926210; Annot_ID_202563

SEQ ID NO: 20093 - DNA, 2037 bp, Unknown; identical to SEQ ID NO: 3918
  misc_feature (1)..( 2037): 2750-1469P.txt file - cDNA_ID_1824374; gDNA_ID_1620674; Annot_ID_48214

SEQ ID NO: 20094 - DNA, 3000 bp, Unknown; identical to SEQ ID NO: 4477
  misc_feature (1)..( 3000): 2750-1469P.txt file - cDNA_ID_1824374; gDNA_ID_1620708; Annot_ID_48935

SEQ ID NO: 20095 - DNA, 3000 bp, Unknown
  misc_feature (1)..( 3000): 2750-1469P.txt file - cDNA_ID_1824374; gDNA_ID_2926210; Annot_ID_141945
ttccccatccatagccgcaaatatgagagtcttgactaaatctgattagtaatttgaataagtaaagggtagcaatgattcttgtcatagttaggccaagcttcgtctcctttcacaagcgtctcatggcgcttccaaacttgtgcatcgtagttttcagttaaaatgtagtgtaaaccaatgtccttaatctccttcatgaacttttccaaggagtcacctctcttaggactgaaaaataatgcttcggaggcttttttggctttaagcagcatcttgatggttctcgcaaggtccttatgaaattccttgaaaaatgtactgttgaatcataaaaatatgtgtcatgataagggatgagaaaaaaacatatcgaaaaagcggaagactaaaatggagagcaaggtaccaatcgcttgcaactatgatgtcgaaagtgttggttaactctgaaagttgatgctgattccagtgcaactccatggcttttacgcttgtgccaccaaatgccatggagttggtttctatgttacgtttaatatctggatgttaagtacatcaatgaatccaaaacgttttgagtaccgagattccatatctcaagggtttcagccatagaagaagacaattctaatgaaacagtatatgcacaacacaaaaacaaaacatgaaggatacaattgactacttgggggtttccatcggagattaccacttctgatgcctcggttgcagctgcaataactaaaccggctaatccataccctgatccaagctcaattactcttttacctctgcaacatcccaatgagccgagtaaaattaagtagacgaagttataaaagaacaaagaacacagatgcaaatcagtcttaaacctgaaacgttctggctgagacttgcaaaagtaggctagtacttcttcagagggccactgacctggaaaacaacgacagtatgaattcagagaatcacaatttagatagcattagagttccctaagcaactaaatcttttttattcttaacttgtttgaatcatggttaatgccacgttgtatattgacagactaaaagtttaagcagatatagtttggttagcgattgtatcagccgcaaacaagccaaatacacagagcagagcagcaacattgtactactaagtttcaaaaccaacaaagacactaatttatgtgacaagtagagagatacagtgagattgagaacttacagacaagtccagtattatcaatgttgtatcgattagatatctcgaagtcattgagatcactacaattatccactctttgtctgcatatattttaaagaagctcttaggagtggcaaatctatcgaacaaaacataacattgtttcatttgatgaaaacttcagatcaaaatcctaacgttagatagagtttgggagagccagtgatgggaagtgtgtagcaaacggatgcttcacgagacttatccgattgaggagaagagtccaccacttgacaaggaatcaagttgaatccttgagttgctttccttgaaatccgtttggtctcagtttgagattgagaatctgaggaaaattgaaagatgatccattagctatgcgaatgtgtgaaatcgaaaagtggatgcaggaaggagaaggagtaggggagtatcaaccagatctacggagaagcgcttggcgaagaattttccatctaagagcagaggaagaagaagaagtgggatccattgaagaatcgttatagctttctccgccggaatctgaaatttctcttgcagactaaacagcaaaacagggaagatgacgatttcgcttcccggcgaactttagtttggtttttttgcctttttaacacagtactttttgggggtcaaacaaagtacagtgaaaattaaattgtcaactgtaaagtacagtaacatttagattctgatctcactgatgttaattattttaaaattgaggacttgttttgtaatttaatattaaaagtgacacaagatgacaacacaactgctataactcaaaagtcaaatgacaattgtcaagggataaaagctgtatgttagaaataaatcttattcactctttagatttggtgcacaattttttttaaaatctatagattttcttaatcttacttatttatacagttttaattactctaaaaactctattgattttttttttgacatctaaaactctattatttaattttcaaataattgtacttcatagagtgatatgagattatgcaattgatttcttcttaaacaaaatagaaaataacatgtgacagaatattatgtttttagtagacatatatttttatacaaaaaatagtataagtgttatatccctttaaatcttattcttatttttatacaagaaaaaattttcatcatcataattgattataccttttaatcattttttttgccttttatgttttctaatagaaaaaaaaaccaaagttttcctccatggtttaggtaagatcctactgttaaatagaatttcatttggcaaaacaaagtcaatacagattaccattatcatagtcaattacacatcttaattacttgaataattcttgtttagtgtgacactaaaaaaggtggcaaaacaataaacaaatgtacaatatacactcaacaaaaagaaattttggatataaacaaatttaatatttggataaagcgcgggaaaatctcctaaaatagttaaaaaaaaggttaaaccggcccggttcatagtcaaaaagtatgctcctcttgaaacacgcaacgcccacgtcttcctatctccgagactccgacagcaaggttacttaacagttaatcaaactagattcgctttcttccatcactaatcttctgactttttctatttctgccccaaatctttttcaaattcatataaataaccaaacacttgttcttcttcattcccccttcgtcttcctcctcctaaatcaccggcgataaatg

SEQ ID NO: 20096 - DNA, 3003 bp, Unknown
  misc_feature (1)..( 3003): 2750-1469P.txt file - cDNA_ID_1824383; gDNA_ID_1620674; Annot_ID_48210
accatcttttaaaataaaataaaaatctaaaagtaagaggtcgaatctatctgaacgcgcaatctccgccgtcaaatttggtagagctagtgaaaagtggtcccacgtctccgataatctatgcttaaccaatcgtaacgtaccacgtatagcgattactttggtaattgtagcgtttagtgaaatcgttttggcgggcgtaattaataaattcaaaatcagagcccaaattaaaaacaaatcaaaaccctagcgcctctttttttgttccatttctctctctctcactccctctttgctcaaatcgattctccctcgcttatcgccatttctccctcgcttatcgccatttctccctccattttcgctctctcgatatcgagcttcctctttccgcctatcgaatctctaatctgaagctgtctttctcgatctggatgtttatcgaagaaggaggtctctgttaatttaggtaataatcattctccgtgacttttttttccttttcgatttctagggtttaaatttgctcgagattctccaacttctttgatttgatagtttattcaagtgtaatcgattgaatgatttggctgaggtttaacttttcaatttcgttatccatcagttaatcgttttttacccagctagagcaaagtctgaagaatctggacttttcgatatctaatttatcataatttattgattcaattctggattgatgattttcatactgctttcactaggtgtatagggaaattaatctattgggaagtgttgtagtagctgttaggaggataaagaaggcatatggggaaggtatctccaaaggatttggattcaaaaacctcggtgaggaaaaagaagttgaaaagttcaagtaacaagtatttaaagccaggggctttggttcagctttgttacagcaaagcatcggctgctaagtcatgtaatgaattagggaagaaacgagtacctgtgtttgatactaagtcctgcaatgatttggggaagaaacgagtacctgtatttgatattaagcatgcgaggaacaataaaatggcagtggaacagttgaattctccaaaaagccctcttatgttgtcccctgtcaacgttgttaagcggagtactctggtgaggccaatgaagtttgatgatctgcaggtggagagtaataatacttgtaagaaaagccctttaatgttatccccaatgggtattgttatgcaaaacactctgttgaggacaccaaaaactccccaagctgatccttgcgtttcagaatcacagcttgagtctcttcccatggatttactggtaagtttttcgtttacatttaagttaataggttctttttggtagtcatctgaatgtatgaagttagttcttataaagatcacactttctgtaacttccaggttaaaatagtttgtcatctgcaccatgaccagctgaaggctgttttccatgtttctcaaagaataagaatggccgtatgttcttctttcccctgtttaagtttgcatccataaaagctcaattttttgcagttttacttgatgtgtattaatctgttttgacttttctttgaaacagaccatacttgcaagacaatatcatttcaattatacaacaccagaccgctcaagacaggaaatgttgagggtcatgaccccagttccaataaatcgttggccatttcgtaggtacatgttttacttcaacttttacccttttgaaaagagcatcaaacaactcgtttggctcataacaaaaccttctttgatctaaattagcagaggagatggaaacccaacaatggtgtcaagcccacatacccccaaagcaccaaaacatgctcctagaccaccctctcgaaccaaactcgcggagatgaagcaaatcactgctgttcttttccaagaccagacaccatttccttcaagatgcatcgttccttctgttctccagaggccgactttgttcaaaccaatggctccaaagcaccctcgagtgctcttctatgaggatgaactatgtcaagctgttgctcaaaacaacctcacctgattacacttagctgcagtcatatcggtttcctctctctgttgatagtaggttttgtcttcattgcataattgatcattgctcttgatgatcatcattacctatagtaagaagcatgcaagttttgtagcagtgctagttcagggttttaggtttacatgggaatctcctagtatcatttaaggggttttcaagtttttactctcttgagtttgtcataataagcgtctttgatttggtcagttgagtcttgtgtatattttctgcatatcttatctggatcagttgcttttttttttttaatataatttgattgcttatccttgctttcatcttattggttattgagttctccaatttatcgtaccgcgattcaaaccgtacttaaatgttaaaccggatattattaaatcgattgaactgaataagattcggttcaagtttggttatatttttcttaaggcctctgatttagttgggcctatttacgatcttacaagcccaaacttattgccgaagatccattattgaaaagtctcgacgcgtgtaagcttactatatccctgttgccaaacaaggcttttgtcccttgtagggccaatcctttatttggctataaataaaggatgtatgtcttctaaacaaacactttttctaatcggagagcttcgaagggttctgagatctcgcggctccttcgatcttctccgctcaactattacctccgatcgttggcttatgtctactgtaacctcttagatttgattttggcgcgttattagaaacccctaacatctttaaactcactcgaggtctctcgtgatcgatctagggtttcgcgagatctgagatttcatattttccgattcaccttcgcaatccaattttttttgttgcttggattttgtttgtgtgtaatcgtgtggtaagatg

SEQ ID NO: 20097 - DNA, 3003 bp, Unknown; identical to SEQ ID NO: 20096
  misc_feature (1)..( 3003): 2750-1469P.txt file - cDNA_ID_1824383; gDNA_ID_1620708; Annot_ID_48931

SEQ ID NO: 20098 - DNA, 3003 bp, Unknown; identical to SEQ ID NO: 20096
  misc_feature (1)..( 3003): 2750-1469P.txt file - cDNA_ID_1824383; gDNA_ID_2926210; Annot_ID_141941

SEQ ID NO: 20099 - DNA, 3003 bp, Unknown
  misc_feature (1)..( 3003): 2750-1469P.txt file - cDNA_ID_1824387; gDNA_ID_1620674; Annot_ID_48209
tccatacatatgcatacgtgggaagggtagacattggtagtggtggtggtggtcctggtggactatgactactacgccctctatcttttcgagagtgcctatataccatgcgttttactctatatatgtaaccatttcttttttccaaaagtatattactgattttaacatttaaatactagtttttataaagtgttttatactgttatagttgctccatgacggaaatgatcaaaatgtttacttatataaaccttgtaaatgtccattcgattcttcttttaaaacaactcacacattacacacacaaaactgcaaattaaactccgatgctaatcaagtccaaacaataacataaccttttttttgtatgtactctagtagtttgtattaatatttgttgctttatatggattagtgaattgtatacgatataaatcaataacataacaaaaagtatcaggaatacattacactaaagttgatgtcaactacccatttgcactatagatcgtttgtctagtgctgtaatgtattttaaaagagcaagtagatcacatcaaatttgttctttaaacgtagtgggaatgtatcatatacacgcctataaacggttttggtatatatgagtgtgttttactatgcaacaaacaaactaagttaacctaatttttgtaagcaaaatttcaaacgaactaacacaacatgatctatgtaacatgtcataattgtaaaagtaagagaggagacgtcttattattggaggtaaagaagatagacaaactgttgttttagtcgttaggtgaattgtctccatgtgatttagttgggaataatcgtgcttcttactttatgttaaaaaatatgtctcgaaatgtccttatctgtaacaataaatgggacagctaaattttccatacacatttaaaaaacaaaatatcactactaaaacctaagtatttatacagtacttttaactaatttttgtttggggttatcgaatgtctaacactttgtcggaatcacatctaaaaaaaaatagtttaacgaagaaagtacttctcagaatctgcattgcttctgagcacataaaataaataactaaactataagcatcaacacactttgtacctatctttttcatttttcaatgcttttaccaataccgtttatttttccctttctcagttagtttccaatacaaattaagttaaacctagactaatatacaaattatatgtgtcgatcaacattactattgtttataatttgataaaacgactgtatattattacaatcatatattcatatgcatttacaaacacttattatatactaaatacaatataacttcataaaataaataaaaagttatgtgctaatcaactaacctgtaacatatactaataatagctttaaataaacacatttaatatatgctaaaatacgaataaattatacccaatagtaattatttctgtaatttaatagcagctattaagttccagtttttttaaaaaaaatttaaatccaaaattgtttaaggttgtgtttgcacaaatggattgttactttaaaactttaaacaagaacataaacccatcattatacaaatgggctgaactaattgattagtaagcccattctatttctcacgtaactcagttattgcgttattggcccaaaccgaaatggacttttcatagacaactggtactctcgtcgtctagctgtgcaattaaagataccagaccaaaatacccttcacgtgatacaaacaacgagaaaaggaaattaataccaacacgagaaaaaatggaaattcagatttcgttttgtgatatatcgaaaagcttttagttatatagtttccaaaattttgaatctattcactcaattaataatccagtacgttattaatatcctatagagattaaaaaaaaaactcacaagaaaagccactctcgtaattaataaggcgtgatttaggttaatagtgtccttttctaacattcaatttaatcatgctaagtaccccaacattggacccgcacttcatagctcatactggaaattcctaattacccttcattcccaaagcgtaaaagcccacaaggataaggatacaaacgtcattacacgaaatgattaaagaataaagtaaaaaagaaaagtcgtactactacttaaaccatcttttaaaataaaataaaaatctaaaagtaagaggtcgaatctatctgaacgcgcaatctccgccgtcaaatttggtagagctagtgaaaagtggtcccacgtctccgataatctatgcttaaccaatcgtaacgtaccacgtatagcgattactttggtaattgtagcgtttagtgaaatcgttttggcgggcgtaattaataaattcaaaatcagagcccaaattaaaaacaaatcaaaaccctagcgcctctttttttgttccatttctctctctctcactccctctttgctcaaatcgattctccctcgcttatcgccatttctccctcgcttatcgccatttctccctccattttcgctctctcgatatcgagcttcctctttccgcctatcgaatctctaatctgaagctgtctttctcgatctggatgtttatcgaagaaggaggtctctgttaatttaggtaataatcattctccgtgacttttttttccttttcgatttctagggtttaaatttgctcgagattctccaacttctttgatttgatagtttattcaagtgtaatcgattgaatgatttggctgaggtttaacttttcaatttcgttatccatcagttaatcgttttttacccagctagagcaaagtctgaagaatctggacttttcgatatctaatttatcataatttattgattcaattctggattgatgattttcatactgctttcactaggtgtatagggaaattaatctattgggaagtgttgtagtagctgttaggaggataaagaaggcatatg

SEQ ID NO: 20100 - DNA, 3003 bp, Unknown; identical to SEQ ID NO: 20099
  misc_feature (1)..( 3003): 2750-1469P.txt file - cDNA_ID_1824387; gDNA_ID_1620708; Annot_ID_48930

SEQ ID NO: 20101 - DNA, 3003 bp, Unknown; identical to SEQ ID NO: 20099
  misc_feature (1)..( 3003): 2750-1469P.txt file - cDNA_ID_1824387; gDNA_ID_2926210; Annot_ID_141940

SEQ ID NO: 20102 - DNA, 3000 bp, Unknown
  misc_feature (1)..( 3000): 2750-1469P.txt file - cDNA_ID_1824391; gDNA_ID_1620674; Annot_ID_48208
catgttgtgttagttcgtttgaaattttgcttacaaaaattaggttaacttagtttgtttgttgcatagtaaaacacactcatatataccaaaaccgtttataggcgtgtatatgatacattcccactacgtttaaagaacaaatttgatgtgatctacttgctcttttaaaatacattacagcactagacaaacgatctatagtgcaaatgggtagttgacatcaactttagtgtaatgtattcctgatactttttgttatgttattgatttatatcgtatacaattcactaatccatataaagcaacaaatattaatacaaactactagagtacatacaaaaaaaaggttatgttattgtttggacttgattagcatcggagtttaatttgcagttttgtgtgtgtaatgtgtgagttgttttaaaagaagaatcgaatggacatttacaaggtttatataagtaaacattttgatcatttccgtcatggagcaactataacagtataaaacactttataaaaactagtatttaaatgttaaaatcagtaatatacttttggaaaaaagaaatggttacatatatagagtaaaacgcatggtatataggcactctcgaaaagatagagggcgtagtagtcatagtccaccaggaccaccaccaccactaccaatgtctacccttcccacgtatgcatatgtatggagacttgccaaaacccttctaagttgtaatctggataatcataaaacaaaattttaagaattagtaaaacttatcgcttgaaatgtatagaaaaatagtaatactattaagttttgtgcatttttcatatcttaattttttgttttttttttgtcaaccaagatatgtaaagataaattatatttttgagggtttctttgtttgtttgtattgttatcttttggtctcatacttatgaaagaacactattagtttaccgtccgtttcgccagctgtatagaaaaacaatcatggtaatccacgtgcagcaagaataatatgggtgtgaaactaattaaactaaagcatatgtatattgaacaaaaaagagcataattacaccataactgcaattcaaagacaaatcaatttcaaccgaaaaagggcctaaaggtgaatttgtgacgctttatttctttaaccattatcattatagttactgcaattcaaagacaaatcaatttcaagcgatcacatctcatttttttttatcccattatgtttctctgtttaattattttaaacatgcaacatttccatactatgctttcttcataatccgtcttacattaacatggaatcacaattatagtctaataacaagtatatgacctatcaagctaagttagctttactctcaacattacgaacgccaatacgccacctgcaagttttcccgatcaggagtttcaaaattctcagtggtcacacggatatacataaactttagattttagccattggaattgttcatatatacatatacaacttaaaacaaatatcaatatttgacgtcgttgcgccttatattacgacgaaaaaattacattattcgtttcaaacgaagtcattttatgccgacaaccaataaaaagacaacaaagtcacatttttaaaatttttgtaagacaatacttaacaggaaagtgataatctcaacggctttttataatctcaaactccaatatattattaaggtatcattagtcctacacaaaggttatttatttagcaatgtcacgtatacccatcaacgtgtaacaaactacattaactacttgtagctagaatttatgaaactttatggttaataaataaaaacagaaaagtcaccaggggcacattggtaattagagagagttttgctgggcctatgggtaaaaatacatggagaaaaaagcaggatgggggggctcttgagctccgacgagtggcaagtgaagaaggtgtgggagaaagaaagctaatgagagaaatacataaatcgacaaaaacaaaccgtcttctcatctctgcctctggatttaactctcccttcacagttgcatagaatcttcttctctgctcatattttgaagaaatctccaggtggttttgcattttcctggaaacgtatctctgtaattcctagacttgagtagtgttcttcttcttcttcaagcattttccattttttttttgggtaattttgttatagtatatagaaatccgtgaagagaaaaagtatatcggttgtcttcttcattgccatcatgtgagcattccaatattgtttcctctctctctctccatttttttaatttacttaaaagttttctgtgattttcaatgtcttttttcttccacttgacttgactctcggcggaggagtttgtcgccggcgaattgttcaaatcgtcggaggttgaaactgttcatatttgtgctacttttactttctggtctttgaattttactctttcgctttcgtcagcttcaagtctttcaaagacaaatcatctttagggattttcttaaaaaaaatttgtttgctttattggtgttgaagatctttgacgtagaaagcctatagacctggagaatctctttgattggtatcttatggactctctttttctctttgttgcttttgttgtcgcagtcgaagaaactgctccctcttttagtcaattctcgcttcactccctcaatataatgcgatttctcaaccggaatatctgaatctctcggtggttacctctgatatatcgccaggaactgaactcctactcgatctctatcaacaatgccgtccttgtagaactttggatccaactctctgattccgtcaatttccattaatatcagctcagcgaaggtaaaatttccaacaatctcgataattccatgtttttggatcttcaagttatgtttcctgtgcataatgatgattcggtttctatcgaccaggaactttgagtagaagaagataatg

SEQ ID NO: 20103 - DNA, 3000 bp, Unknown; identical to SEQ ID NO: 20102
  misc_feature (1)..( 3000): 2750-1469P.txt file - cDNA_ID_1824391; gDNA_ID_1620708; Annot_ID_48929

SEQ ID NO: 20104 - DNA, 3000 bp, Unknown; identical to SEQ ID NO: 20102
  misc_feature (1)..( 3000): 2750-1469P.txt file - cDNA_ID_1824391; gDNA_ID_2926210; Annot_ID_141939

SEQ ID NO: 20105 - DNA, 3000 bp, Unknown; identical to SEQ ID NO: 3925
  misc_feature (1)..( 3000): 2750-1469P.txt file - cDNA_ID_1824395; gDNA_ID_1620674; Annot_ID_48207

SEQ ID NO: 20106 - DNA, 3000 bp, Unknown; identical to SEQ ID NO: 3925
  misc_feature (1)..( 3000): 2750-1469P.txt file - cDNA_ID_1824395; gDNA_ID_1620708; Annot_ID_48928

SEQ ID NO: 20107 - DNA, 3000 bp, Unknown; identical to SEQ ID NO: 3919
  misc_feature (1)..( 3000): 2750-1469P.txt file - cDNA_ID_1824395; gDNA_ID_1620708; Annot_ID_165362

SEQ ID NO: 20108 - DNA, 3000 bp, Unknown; identical to SEQ ID NO: 3919
  misc_feature (1)..( 3000): 2750-1469P.txt file - cDNA_ID_1824395; gDNA_ID_1620674; Annot_ID_164203

SEQ ID NO: 20109 - DNA, 3000 bp, Unknown; identical to SEQ ID NO: 3925
  misc_feature (1)..( 3000): 2750-1469P.txt file - cDNA_ID_1824395; gDNA_ID_2926210; Annot_ID_141938

SEQ ID NO: 20110 - DNA, 3000 bp, Unknown; identical to SEQ ID NO: 3919
  misc_feature (1)..( 3000): 2750-1469P.txt file - cDNA_ID_1824395; gDNA_ID_2926210; Annot_ID_202550

SEQ ID NO: 20111 - DNA, 3003 bp, Unknown
  misc_feature (1)..( 3003): 2750-1469P.txt file - cDNA_ID_1824402; gDNA_ID_1620674; Annot_ID_48205
attctttctccatgtgtttcggtcatgatggagttggaaggatcagttttggggacaagggtagttctgatcaggaagagacaccgtttaatctcaatccttcacagtaagtggtgattcacttatgcgctaaattggaaattctgttcctttgtggatggcacctttaagccgtggttaaattcattgttgcagtccaaactacaacatcacggtgactcgggtacgtgtggggactactttaatagatgatgagttcacagctctctttgacaccggtacatcatttacttatttggttgatccaatgtatacgacagtctctgagagtgtaagcatctaaacaccatcatattcgtgtttcttccgcatgatgctgagttttgataactctatgattcacattatcttcttcagttccattctcaggcccaagataagcgccattcaccggattcaaggattccatttgagtattgttatgacatgaggtatgagtttgtatctatccacgctcaatgtctatttttcattgtcactcaaatcttaacatttttcttgtaaacggtgtgattagcaatgacgcgaatgccagtttgataccgagtttaagcttaacaatgaaaggaaacagtcacttcaccatcaacgatcctataatcgtcatctctactgaggttatactctctgtctacttctttctctattgctccgtctcttcttcaaccaaatctgttatctgtgtgctgatactattagaatctctgcatttcctcagggcgaacttgtatattgcctggccattgtcaaaagctctgaactcaacattattgggcgtaagatcagtttttcttcctatcaatcatggaacatccgctaaataatgacattgtttactcttaatgaaacagaaaactacatgaccgggtatcgtgtagtattcgacagggagaaactcgtcttagcttggaaaaagtttgactgtaagtttcctcttacgtgtgttatatatcactaaaaccctctgtttcctaacttatgatctgtgaatatctcttaacgcaggttatgatatcgaagagacaaacacaactgttgccggaacaaacaaaacagcagcggtagctccagcaatggcagctggaataaagactcataacaattcctcagagctacacaaaacaaaccaaaccatctccaaaagtaactcctccccaaaccaaatatccaaaacagtagatgtatggtcttttttcagatttgtgttcatattacttccacttgtgtagatttgtaagccccatccaaaacacatgccaatagtattttttttgtatcataacgacactatagggattttttcaggaaatatatgctcttcatacgcatcttactatctttgcaaattctcgtcttttttctcttcaataatgaggtagttaaaccgagataaaccgaaccaaaagggaatttggctgtaatgttgaacgccgaatattctaaaggaaattaaatgggttccacattgataacctgcctcggcaagtggccaacgctcgacacttttacacgaccgagacaatgaatctttcattttttcgtcattttattctaaaattccaatattggttcgagtcttagatataatttttagtattggatttgaaaatacactcattaatcattgttaaatatactaaaatcactctgatagcattgtttagtatatcatcatatgataatgcatcgtttgtccatagttaaaagttaaaactgtattctataaactgtaaatcgtgtgataatgttaacatttacagactatgtatcaatttgattattaaaaagcaaccaacgactattatgaatatacagtagtttttggtgagtatgaatatacagtagtttgttaagatagttttgaacaaatccacatttttacgatcatatctcataataaccataaagccatatatacattgctatttatcatatccaatgactaaagtgaatattgttaaatatgctagtagtatttgttaacaaatttatcttatgcatatattaatattatatattagccttaacaacaaaaaaatctatgacttgattttttcccatatatactaattagaagattatgtaagaaataagaaaaaatggatactgtatccctgatttggaaaacagagattttaatccttctataaatattttcatttatttgcaatcttacaattacatatgttttatataatggtatatctattatagtataatataaattcaaaattaagtcgaaagttgaccacataacttagcgtttttctctcttcggaacttttttttttgtgtaatttaatttatacaggaaaattaatttaggggaaataaatgatttaattgtttgacctattttaagagaattaaaaaaagaaagatttttttatttttgtgaaaagattagatcaaatcttacatggtaattttctaatgtcaacgtcaacaatcctgccattagctttttggccaatcagattcatccaaccaaagaaaaacaaaagtgtgtttttttccttgtgtttacttcaagggtaatttagtaacttctaatatccgcggtagccaagtaaaaccaaaaccaaacgaaaaaaaaacaaatggaaagaacatataaaatcgaataaaaaataaaggagagagagagagagagaagagaagagaagaggagactacactgctccatcatcttctccttctggggatttttttttggaaaaatcgttctgttaccttttttttgcccattactcaaaccctaaccctaattttctgaaatcgcagagagagagagagagaggtttcttcgaattctttcatcatcaattcgctaactttgtttttttggggttaaatcgattaatcgttattttattagatactgtcgatcggagctaatcgactctctcttaacaaaccctaattttttggtcctctctcatg

SEQ ID NO: 20112 - DNA, 3003 bp, Unknown; identical to SEQ ID NO: 20111
  misc_feature (1)..( 3003): 2750-1469P.txt file - cDNA_ID_1824402; gDNA_ID_1620708; Annot_ID_48926

SEQ ID NO: 20113 - DNA, 3003 bp, Unknown; identical to SEQ ID NO: 20111
  misc_feature (1)..( 3003): 2750-1469P.txt file - cDNA_ID_1824402; gDNA_ID_2926210; Annot_ID_141936

SEQ ID NO: 20114 - DNA, 3003 bp, Unknown
  misc_feature (1)..( 3003): 2750-1469P.txt file - cDNA_ID_1824406; gDNA_ID_1971923; Annot_ID_177192
ctctcaacgggaatattcaactcaaaatacatggctttaaatatttgatttacccaaaatctctgtgcataggaagagttgcaagaacacacattcttcattagtggttaacggcaaatgcaaaaaaacgttataagaagatgaatatgagaaaacgaatgcaggaagttaccaagtgtttgggggcaacaaaccatttgctagcttacacaacagaaaactacaacgaatttgaagccggtaattgcaacaacagagtctccagctgaggccaaacccaccaagatttgtttcatcattgaagacataaactctttgactaattacctttgtttggaatgaaaacctgcaattttgaatgctagatgatcaatttgcatacctccaatggaaattatatgaaaccaaaacagagaacaagaagtttagggcgctagagaatatcatctctcttatctacctaaccagattgtttcatattcttaagacttcacaatttatcgaagtcatcataacatcaccaatcagttcttagacatgccaaaacctaaaaaagggaaaaattcaagaatgaaacaagaacagagacaatacctcaaactctggtacaagatgaatcaaagtcatcaggagcaacacgtgcaatccaattgtttaacgtccgcttaacatcagtatgattaacataagccaactcatacatactacacaaattcaccaccaagctctcgttcaaagccgcggttggcactctctccaatgcactttccatcaccttaatcgcatccgatagatctctcaagtacatcaaacaaagagccttattgttgacagcgataatatcagagttatccctttcaatgcatttgtcatactctctcacagcagaaacatagtcctttgccacaacataaaccaaagccttattcctaccaacaagattgttgaactgtatctcgttcaataaaccattgctctttccttcattcaacatcttctcaactctatcaaacgtagttttagctccttctacatcaccaaactgcatctgaacagaccctagtttcgaaatcaaaaccgggtctaacggatcacgattgatcaattccttcatcaaatccaaagacaccccaaattccttgtgacctaaatgaaaccctagcaagcaattcatcacaaatgtctctcttttcttccacaattccacagaactctctaaactctgagattctttctctctgattcgatctcgaacaaagtcaagcaaaacatataaacgatctaacccttcctgacgattaccaagcttagtcgggatcaaagcgtagagccatcgtaaagagaaaggaaccatagatcctctccgattagggtaaatctcagggaacgattcgtacctgtaatgcgtcccgtcgaaatcgtgcaaggaattaagctcatgagaagcttcatcggagcgacgaagcttcgcgagagccataacttggtaagtgagataagtgagatgctcgtgaggctttgtgaggaggaagagagctctggcttgagatatcttctcgaggatcgcttgccatgagccacgggtcgaaagctcgtggagcgagccgagatcgtgtgttaattcgtcgagcgaattgaatcgttccggtggtagatcggcgacggatgtgacttgggatgaggctaattcgaatgccgtcggttcccctgcatcggttgactctgccatggcggtggaatcagtggaggagggattgaattcgggtcgggtttcggattcgggtaaatccggatccattgctggagatgactccgtgaacattgtggaagtaacctggtttggtctttggatttgggtcgtctttccaatagataccattacgctaaattcttctttttggcataaaaatttagattattttttattaaaaaaaaacatttgatatgattatgattttaggcggtttattaagatttttttataattagatcaaaaataattagatcaaatactaaaattggaggagaatccaaactttggatttcatatattttattttttaattcactagaaatgaaacaataattaaatccaaaattacaattaacttgtctcggatcgattgatcaatgttgattttttgtcttatgacttttcttcgtgtaacgaaaggagttacttaaatggtggagtaatggtaataaataccatgttataatattgttacatactgataatattattttccccatgttacatgttacatcattgatttttacgtagatatttaatataacgaccaaaaaaaattaagctctgacttggtccaagagattttttctcgattcttaccattgaccctgagctaagacttgaccaaattaaaagtctatgtggaatgtactgcaataagtaagtctttttaattaactaaagaatttcagacctaaccccatatttttttcggataaggggtatgaacatgtaaattattcaattttctattgtaggtatttaaattcgagatttttaaaaaatgaaatgagtgactaactagctagttcaaaccgtaaaacctattattcatttaatgatttgattaagtattttgttttaacaatagtttaggctttaaaaatcttacaatcaaacatcaaaatataatgtggttttactacggaaaaaggaaaagcagtgtagaagcatcgaacatacttgacttttatgacttacaaaacacatgaggtacacagaatcatatactacaattttactttgctaataaaagtcgatgtattattattagaaattatcactaaatcgtagaaaagtgaaacgcgttttctctccagtttttctccaaaagacaaatgagttatctgtaaacacatgacatgcaatgatctatcgttatgtatatatgaattgattaatctcgaactatatattgaaatctcagcttcttatcttctttgattcttggagacacgattggaaaaatg

SEQ ID NO: 20115 - DNA, 3003 bp, Unknown
  misc_feature (1)..( 3003): 2750-1469P.txt file - cDNA_ID_1824406; gDNA_ID_2926254; Annot_ID_143095
ctctcaacgggaatattcaactcaaaatacatggctttaaatatttgatttacccaaaatctctgtgcataggaagagttgcaagaacacacattcttcattagtggttaacggcaaatgcaaaaaaacgttataagaagatgaatatgagaaaacgaatgcaggaagttaccaagtgtttgggggcaacaaaccatttgctagcttacacaacagaaaactacaacgaatttgaagccggtaattgcaacaacagagtctccagctgaggccaaacccaccaagatttgtttcatcattgaagacataaactctttgactaattacctttgtttggaatgaaaacctgcaattttgaatgctagatgatcaatttgcatacctccaatggaaattatatgaaaccaaaacagagaacaagaagtttagggcgctagagaatatcatctctcttatctacctaaccagattgtttcatattcttaagacttcacaatttatcgaagtcatcataacatcaccaatcagttcttagacatgccaaaacctaaaaaagggaaaaattcaagaatgaaacaagaacagagacaatacctcaaactctggtacaagatgaatcaaagtcatcaggagcaacacgtgcaatccaattgtttaacgtccgcttaacatcagtatgattaacataagccaactcatacatactacacaaattcaccaccaagctctcgttcaaagccgcggttggcactctctccaatgcactttccatcaccttaatcgcatccgatagatctctcaagtacatcaaacaaagagccttattgttgacagcgataatatcagagttatccctttcaatgcatttgtcatactctctcacagcagaaacatagtcctttgccacaacataaaccaaagccttattcctaccaacaagattgttgaactgtatctcgttcaataaaccattgctctttccttcattcaacatcttctcaactctatcaaacgtagttttagctccttctacatcaccaaactgcatctgaacagaccctagtttcgaaatcaaaaccgggtctaacggatcacgattgatcaattccttcatcaaatccaaagacaccccaaattccttgtgacctaaatgaaaccctagcaagcaattcatcacaaatgtctctcttttcttccacaattccacagaactctctaaactctgagattctttctctctgattcgatctcgaacaaagtcaagcaaaacatataaacgatctaacccttcctgacgattaccaagcttagtcgggatcaaagcgtagagccatcgtaaagagaaaggaaccatagatcctctccgattagggtaaatctcagggaacgattcgtacctgtaatgcgtcccgtcgaaatcgtgcaaggaattaagctcatgagaagcttcatcggagcgacgaagcttcgcgagagccataacttggtaagtgagataagtgagatgctcgtgaggctttgtgaggaggaagagagctctggcttgagatatcttctcgaggatcgcttgccatgagccacgggtcgaaagctcgtggagcgagccgagatcgtgtgttaattcgtcgagcgaattgaatcgttccggtggtagatcggcgacggatgtgacttgggatgaggctaattcgaatgccgtcggttcccctgcatcggttgactctgccatggcggtggaatcagtggaggagggattgaattcgggtcgggtttcggattcgggtaaatccggatccattgctggagatgactccgtgaacattgtggaagtaacctggtttggtctttggatttgggtcgtctttccaatagataccattacgctaaattcttctttttggcataaaaatttagattattttttattaaaaaaaaacatttgatatgattatgattttaggcggtttattaagatttttttataattagatcaaaaataattagatcaaatactaaaattggaggagaatccaaactttggatttcatatattttattttttaattcactagaaatgaaacaataattaaatccaaaattacaattaacttgtctcggatcgattgatcaatgttgattttttgtcttatgacttttcttcgtgtaacgaaaggagttacttaaatggtggagtaatggtaataaataccatgttataatattgttacatactgataatattattttccccatgttacatgtaacatcattgatttttacgtagatatttaatataacgaccaaaaaaaattaagctctgacttggtccaagagattttttctcgattcttaccattgaccctgagctaagacttgaccaaattaaaagtctatgtggaatgtactgcaataagtaagtctttttaattaactaaagaatttcagacctaaccccatatttttttcggataaggggtatgaacatgtaaattattcaattttctattgtaggtatttaaattcgagatttttaaaaaatgaaatgagtgactaactagctagttcaaaccgtaaaacctattattcatttaatgatttgattaagtattttgttttaacaatagtttaggctttaaaaatcttacaatcaaacatcaaaatataatgtggttttactacggaaaaaggaaaagcagtgtagaagcatcgaacatacttgacttttatgacttacaaaacacatgaggtacacagaatcatatactacaattttactttgctaataaaagtcgatgtattattattagaaattatcactaaatcgtagaaaagtgaaacgcgttttctctccagtttttctccaaaagacaaatgagttatctgtaaacacatgacatgcaatgatctatcgttatgtatatatgaattgattaatctcgaactatatattgaaatctcagcttcttatcttctttgattcttggagacacgattggaaaaatg

SEQ ID NO: 20116 - DNA, 3003 bp, Unknown; identical to SEQ ID NO: 20115
  misc_feature (1)..( 3003): 2750-1469P.txt file - cDNA_ID_1824406; gDNA_ID_2926219; Annot_ID_142353

SEQ ID NO: 20117 - DNA, 3003 bp, Unknown; identical to SEQ ID NO: 20115
  misc_feature (1)..( 3003): 2750-1469P.txt file - cDNA_ID_1824406; gDNA_ID_2926219; Annot_ID_203202

SEQ ID NO: 20118 - DNA, 3003 bp, Unknown; identical to SEQ ID NO: 20115
  misc_feature (1)..( 3003): 2750-1469P.txt file - cDNA_ID_1824406; gDNA_ID_2926254; Annot_ID_204491

SEQ ID NO: 20119 - DNA, 3000 bp, Unknown; identical to SEQ ID NO: 8506
  misc_feature (1)..( 3000): 2750-1469P.txt file - cDNA_ID_1824449; gDNA_ID_1971813; Annot_ID_175853

SEQ ID NO: 20120 - DNA, 3000 bp, Unknown; identical to SEQ ID NO: 8506
  misc_feature (1)..( 3000): 2750-1469P.txt file - cDNA_ID_1824449; gDNA_ID_2926254; Annot_ID_143080

SEQ ID NO: 20121 - DNA, 3000 bp, Unknown; identical to SEQ ID NO: 8506
  misc_feature (1)..( 3000): 2750-1469P.txt file - cDNA_ID_1824449; gDNA_ID_2926218; Annot_ID_142338

SEQ ID NO: 20122 - DNA, 3000 bp, Unknown; identical to SEQ ID NO: 8506
  misc_feature (1)..( 3000): 2750-1469P.txt file - cDNA_ID_1824449; gDNA_ID_2926218; Annot_ID_203157

SEQ ID NO: 20123 - DNA, 3000 bp, Unknown; identical to SEQ ID NO: 8506
  misc_feature (1)..( 3000): 2750-1469P.txt file - cDNA_ID_1824449; gDNA_ID_2926254; Annot_ID_204471

SEQ ID NO: 20124 - DNA, 3000 bp, Unknown; identical to SEQ ID NO: 8705
  misc_feature (1)..( 3000): 2750-1469P.txt file - cDNA_ID_1824499; gDNA_ID_1971867; Annot_ID_58423

SEQ ID NO: 20125 - DNA, 3000 bp, Unknown; identical to SEQ ID NO: 8705
  misc_feature (1)..( 3000): 2750-1469P.txt file - cDNA_ID_1824499; gDNA_ID_1971867; Annot_ID_176477

SEQ ID NO: 20126 - DNA, 3000 bp, Unknown; identical to SEQ ID NO: 8705
  misc_feature (1)..( 3000): 2750-1469P.txt file - cDNA_ID_1824499; gDNA_ID_2926155; Annot_ID_139470

SEQ ID NO: 20127 - DNA, 3000 bp, Unknown; identical to SEQ ID NO: 8705
  misc_feature (1)..( 3000): 2750-1469P.txt file - cDNA_ID_1824499; gDNA_ID_2926155; Annot_ID_198333

SEQ ID NO: 20128 - DNA, 3003 bp, Unknown
  misc_feature (1)..( 3003): 2750-1469P.txt file - cDNA_ID_1824503; gDNA_ID_1620711; Annot_ID_49013
tcagtcactaagttaataataaaactactaagatgaataattaaataaagaccttatctctaaattttatgtttatgagttgatgaaccttctaaattttattttatcactatattaacaccatttcgacaagtaagaaatatgataaacactctacactaataatcatcatcaagtcatcataccataatcagtcataaaaaccaaaacaaaggaacaaaattatgtatgaatgttgtatatttacatgctatgcttttgttttcccctgtttttcttgtatggttctaccaaacttgttgatcacaaaggaccaggcttagtatctaccagtttatctgtagtttcagaggaaagggacaaaaatgaattatatattttgtttttattttgaattattctgccaattaaaaccagcttttaaagagataccaccaaaacaatcttgaattgacaatagacgcatcatgagaaaatttgtaaaatagagttatttgtgaatctattagacttgtgatatagacccttgttaattacttgactcatcaaacaagagtttttgaacttttgagttatcagcaaagtcgattagcgacacgggaatgggttaattatacttaaatggtccattagaatgagttcttatcattgtcattgtattgttgtttgatcattagtttccgttgatcgtctagcttttaccttgatataatagatttatttattttcttgtcttacttctctatgcttagtttattgctttaactcacctagatatataaaagtgattatgattgtataggttcatgaagaactaatccgttacaaagtatgaaagtagtcataaaaagttttctaataaaaacatctgagtacaatattcattactatccgcaatgctatactatagattgtgaatgtatttgtaggaactattattaatgaacactaactttgagtgtaatcaactctttattaagccacaaacaaaacctttatttattataaatctgattataacgtatacataaaaacatattatgaaatataacaacataatcacttctcttagtacgaaaacaacatttgccttatcaagttggtgaactcgccggaaaaaaatccaaaacaacttatagaaatacacataaaattgatttcttattgtgctggaggaggaggagtaaaaggaggaggaggaggaggagtctcaactaaaacatctagcttcatgccttgaacgcaaccacctcttccatcaagtagataataacgtctagtctcatagagaggaacaatatctctcccagctccacgtgtataattacgtattgggcggttggagatacatttttcataatcagccttgtttacctcaagaatgttgtgttggtctctatagaacacaaaatctgacaagaaagtgataaataaaacataagtctaaagacagaaccaagacttaacttaaccaaaaaaaaaagacagaacaaagaaagagttatgttctaactagatctggacttaaagaaaagttaaaaaaactattacaagatttaaagctaaaccaatttcaaatcagatctaaatatgacagatctgagagtgtagattgagaaagaagagatagagagaacgtacaaagccagtctccgacgtagaaatgtttgccttgagcccatagggtatagttaatgttggggttccagaactttttgtcgccgactaaatatttcttggctgttacttctggtatcggcgccgccactagaaaagccagtacaaccgccgagattagcaccatagatctccccatttctctctagcaaaactctctctctttctcccttgtagaattaattagctatcataaatatagtagttcatcagttccacttccactaaattattgtttttggcaaaacagtaacttaagttatataaaaaaaaaaatcattagtcaatcaatcacagtcctttatgataaaacgaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaatgaatttaatatattctaagtaacttgcttaaattttttttcaaactctaaagacataactaacataaagtaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcactcaacacaaactctttacgaatacttttaagtatg

SEQ ID NO: 20129 - DNA, 3003 bp, Unknown; identical to SEQ ID NO: 20128
  misc_feature (1)..( 3003): 2750-1469P.txt file - cDNA_ID_1824503; gDNA_ID_2926156; Annot_ID_139515

SEQ ID NO: 20130 - DNA, 3003 bp, Unknown
  misc_feature (1)..( 3003): 2750-1469P.txt file - cDNA_ID_1824505; gDNA_ID_1620711; Annot_ID_49011
gtaggttgataaacaaaagaattaaactatgaaatttgttgcaatcaaccttccacgtaaaatcgtaaaaaagagaccttgtaagtatctagcttccttaacccattcataaaccttgagtactttttacataagtagccaattgataggttggatgtaattcttcacaaatatactcaagaaaataacacacaatagataagctaaaccaaccctagttctaactattaagtttatgatgattcttacaacaccttgagtaaagaacactcttcagatcaagctgaatatcaacttcattttttgatgcatgcattgtttaccaaggttaataagcaacaattttaacaaaaaaaaggttaataagcaacaacaaaagcgtttaatgcaccagaaatgttgagaagcatgtcttatgggtctctctgtccctgattctagactcattctaagtgtttgtacactctctgtccctgattctaaggttgcaaaagaacaagaattagcaacatctcgatcacttgaattttcctcaagcgtggtcttcacatgaatttttgctcacatcttcaaggtcacaagggtttatgtttgacctttcttcttgcatagtgattatctttgagttaatatcaaattcatgttcctgttcaaaatgggccactcgtatatatatatatatataatatgtatttaaattgtggatatgttcgaatatctgttcgggttcggattgggttcgggttttaggatttagaagtttagaactcgttcgggtattcataaattttgggttggttttgaatatggttttttggatcgggttcggatcgggtaatcgggttctgtattatacccacccctacttctcactgtcagatctgaaaacatgaatattcatatcaaacgtgttacaaattacattatatcttatgacattttaattcaataataaatggcaataagtgaattgattcacaaatctcatcacattttcgttgtgggattttttaacgtctcttttaaattattagatttttttgggatgaaatatgtctgaacaatattcaggttggattaatgtatttttgtggtttatttttttgtcgagcctcattggccattagtaagtggtgatggcggcaacatattttaacggactagaacacatcccatgttttggttctgctaccgtattgaatgttcattcatagactcatagtccatctaaacatatacaatgagaaatatttaattggttctgataacatatacacaaacttacaaaaactaatttaatgctacttacatatcttacatattttcaacggctagctgaaatctccaacggtattcttttcatttatttatatataaattagtcaatatatatagcttgtcagctaaatccaaaggttgatatatgctcgtgagagctaataatcattcttcaattatcgatctcatttttaagaattattttgctacctaaattaagtagatgcactaaaattagtaaagcaaactcataattgtatagagattgcacataaattaaaattaaaaaataaatcacctaaaaaggcgtatagacttataaatttcatagagataactcacaaaaatattttcctaaagaaagatagaaatatttgaaactaattgatgctttgctctatttacaggttttattttgaatcaaaacgttgtactttagtaaaaactaattattatgattaaggaagattcttgatgaaatggaaagttgagtttattcaatcttagtttaatgaaatttttcacacacaaaaataaaataaaaattgatgacattagataaaaggtaaaaaatagactctattaaggttcaagctagacacccacttgcatattgtcattaattgttttccaaaactattaaagtataacaaaatattgcaatttgaaaaatgcattaagacctacttagataggtaggtagaagttggactaatttctatttactgttactaagattactttattttatctcttttatatttgatttgttacaatgctagaccattttttaataataattattatgattcactgtcagattttataactttttttttaccatcgtaacatgtgtgtcgccaaatagtttatgtgagtcactagataaaacggtaaaagtattcattatgacttcagttaacaatagtcaactctttatactttatactgtagtgttttcttatctccatttttctttttgtgtacatcttgtagaaaatcttcccactataacttcttcttattatttttaaaaaatactaatctactattatgttgttggacacaaaaaaaactaaactaatctactatgttgtatggataatctttttttgttgatagtctcattataaattaaaacgaatacttcacagttcactagatgattaaatatttgactcaatttgccaaatatgattatagaagaacttttctatataacataccttcaagtggatgaaaatgtgtgagattttttcttcataaatgttttttttcagtgacactatatttttctttattaacctgctatttcttctatatgactcaaaattgatttatttatctatcctatttttaaaaataatcagcaaaacatcctctctcaattacgattttaccaatattttgtttgtcgtttttgaacaaaaatttggctatctacgtaataaaccttaacaagagttatcaattttgatctaaatgatgaataaattatgaacctcaaaatctggacttggatccgccacttactagagtcacacaaacgtcaaaagaaggacccacgtgaaaaaccaaaaccaaaactaaaaccaaagtaaaaaagcacgtaacggtaaaacacatgaataacttggctataaataaatagcaaggctttagtcatgaatgagcactcaattcgatcactaactctcactcttagtacaaatattttcaagaatg

SEQ ID NO: 20131 - DNA, 3003 bp, Unknown; identical to SEQ ID NO: 20130
  misc_feature (1)..( 3003): 2750-1469P.txt file - cDNA_ID_1824505; gDNA_ID_2926156; Annot_ID_139513

SEQ ID NO: 20132 - DNA, 3003 bp, Unknown
  misc_feature (1)..( 3003): 2750-1469P.txt file - cDNA_ID_1824519; gDNA_ID_1620711; Annot_ID_49007
tttgaatcgtcgttgcattttttttcctcggaatcgctcatctccttcttttgtttcttctgtatcacggccaagtcaaaaaccctagttagataaggacgcttccctaattaattaattataacatatttttactttattgacattaattttaattttaattttatttttaagtaattttattttttttattttactaaaaacatctctaacatacatccctaatcataagtgatatatagctgagaatttatttttattttaactgattttttttttctatacattagataatgcatgaaatttatagatataaatttagaattaattattttgaaattggactgtgtcactgacttactgtcacacatttagtgcatatatgagctatgatgctaaaagatatcatccgtgaatgaaaagttacagtctcataagtcaaagaacataaaaagaatctgaaaatagtataaggtaaaacaaaattgtcatatgtatagtactcatgcaaaaaaagagtatttgaagaactatcggaagctcgaaatcaaatatctttttattaattagaaaactaagtagctagaagaagagaatggtgaagagaatgttagaatcacatgagagatgcataaatcttggaaaccggcattgataattagattcttcttctccagctgcttgagagttgagaggcgccattttttcacatgtcactgcccaaatgtgaatttagacttggaaaagaaacgccactagtttctggttcattatcatgactcagatttttatttttgtttactcagtctagatatgtaacccatttaacataaaccaacatatatatttgacagattttttttttctttttttatatttactttacaaattattttatcatttacaattaatgtttgaagattttaaaaacactttttcatatcaactttctacatagattagtatgtacaaatccaaaatatatgtaactaaataattacaataaatatcaatcacgtttttctttatttatttataatatttcacattttcattaattattgtgtcacctaaataaagcacaaaagttaaataaaaaagacaaaaagacactagcttttacaaaaaaaaaaaaaaaaaccttgcctattgcaaaacattacccccatatctcttcatatgaccatagcatttatatataccttcacttagaacaattcataatcaaaatctcaaacattatcaatataactatatagacgggagtcactagttagaagacatgaaattcattacatcagtattcatcgtattcattatgttatctttaattctgactaaaacaatgatttctgggaaagaggagaacgcgacatgcgttatggcaaatcttcaaatatgcaagtcggcggtaacaaccggaaacccacattcgaaggaatgttgtgaaaaactgaaagaacaacaatcgtgtttttgtgaatacttgaaagatccattagttgttccatatattacatatgccaaaataatcttagcagcttgtggtttatcttttcctaattgttgaagttttaaacatttatgacataatctataaatgttataatcatcaaaattatatttgataatgtttatcattggaagtttatcatgtcaaggttattaacctgattttaatatataaaaaatgtgttttcttatagaaatatattgttattatggatgttctaaattcaataactactcgtcttttgctctttagtaaagtatgatttttctatctaagtctctccctagacagaaaatataaccacatcaaactagaattcatgaccatactcatgaaaaatataaatttggatcatgcacatgataagttgtgttagtttgcagcgtgaaacgaatatcagaatctatgagcctatcaataaccttaacactgaagttgcgtccaatagaaaagttaaaaagacactaaaagccaaaccaaagaacatagagggattctaaaaaatagtataattagtgtaaaacaaaaatgtcatatgtgtagtgcttatgtaaaaaaaaaagtattcgaagaactaaggaaagcacgaaataaactatttttttttattaattagaaaaccatgtagaagaagagattagtgtagaacagaactgttagaatcacataagaggcacataaatcttgacaacatgcatccatgattggatttttcttatgaggatgcttgaatgccatttttacatgtcactgctcaaatgtaaatttaagacttcgaaaagaaacgccactagtttctggttcattgtcaagacccagatacttaattccggtatattcaatgtaactctgtaatctagttaatataaaacaaaagctttgagatatatatgcttttttctttttgtatacttactttacaaattcttttattatttacaattagtgtgtgaagattaataaaatactttttcatatcaaatttctacatagattagtattgtataaatccaaaatatatgtaattcaatatttaaaattaatataaatagcgaaaaattgtgtcacatagatatgaaatgtactaaattttttaattttattttcagacaaaagacattagcttttacgaagaaaaaaaacacaaaaaagtactcttgcctattgcaaaacattaccccatctctccatatgagcatcgataataaagatgagttatgttaatcatctttgtgattgttgtttgtgaggctgttaataattcattttaaaaaagggaacttaatagttgtctctaataggataagcatttaaaacgcagcgttttattactaacttacgtcattgtctcatgcaaatgacataagctagagaaaatcttgattcctccgtcaaggcaaaaccacataaagcctatctcctgccgcgaaacaaccgtttaaaccaccaattctctcatccgtaccaaagaacaaaaaaaagataaaatg

SEQ ID NO: 20133 - DNA, 3003 bp, Unknown; identical to SEQ ID NO: 20132
  misc_feature (1)..( 3003): 2750-1469P.txt file - cDNA_ID_1824519; gDNA_ID_2926156; Annot_ID_139509

SEQ ID NO: 20134 - DNA, 3000 bp, Unknown
  misc_feature (1)..( 3000): 2750-1469P.txt file - cDNA_ID_1824530; gDNA_ID_1620711; Annot_ID_49003
cgatcctataaattccacaaaagaggttctatagaaatcgttaaaaatatttatggatattttatgtaataccaaaacataaagtatcaaactaaagaatatggccaatctacacaactagttgtacttattatggccgttttatcctaaccaaattgatttatcaaataacatgttatttcctaagatattaaaccgcatgactgataatttgtatattcattttgtgtccgatggttaacaaagaagataccttgtcggatttaacagctcggacagtgaaggaagagactcttttggtcggagaaacaccgaaaggagcaccggagatgcccttcgggacggcgagacgctgagaaagagaagcggaggagaagctgctccttagctggctcgccattggagatgcactcgctgccattgttctttttgtcttggttgttctcttatgaaaattaaaataaaatcgagtttgaagtgtgtgatgaagaaataagcaatctacgaaacttgagattgcgtttgctgatgtggcaagacagaggatctgtttcttaagattgttgtggctctcagggatatgaattttgatatgtcttattctcattggatgttatcttatccactttgccccaatattttcttttaatatgtgaatatatccttttttttggaccgctggtgaaaatatgtctttacatatatatatttgtttcttgtattaatatttcatttccctttaagatgcttttaacatgagttttaaacttttaattgattatatctatattttaaataatgtaacctatatctttaatttaaaataatttaaagattttaactagtaataggatttaagacggttagaaatttaaaggctcattaggtgatcaataggacaaagctttttagttcattttttttaaatttaaacttttacttatcttgtttttgaaattgtcagtagaattttgtttttcttacttaaaattggaacattttgctatgcttgtctatccacttgatgagccgagccagagggtttggtgtttctttatctctacgtatgtttctcttgcaccaaattgtgtgacactgtggcttggaatatatatcgcgcaataaaaccttccatacgctcctgccatgggctatatatgcttgtgattagagatgtccagttcgtcgagtagtttgctttgtagatatttatagttagagcctcccatacttcagctgcatagctacaatagaagaataaatgatcctctgattcaatgcagttgctgtagagaaagaagtttgtcattgagagtctgttctggatcgccaaccatgtgcaaaaagaatactttggtgttgtgtgagtaaaccatacctctttatgccaaactaccttatttgtatcggtacgagtgtgattccaagtgtctttggttctaaagattgattgatacacatcgtttttcctttccataataccacatcctcttcatcggtttgattttgtctcttcatggtgagatctgtttcaatttgttttagggttgcagttatgtccatgcttccgccatcgacatttgctttaagatgtcaaactcaattcgtcccctctctcctatgatatccatcaaacagcccattgtaaaccagttatcataccagaatgaaacttttttccagttgtttacctcaactttgcaaaattgtttggccactcctttgtatttgagtaatttcttccacatctaagagcccaaagtagtattttcttttatttaccaaatagtgactcttttgagtaggtgtgccttgatctatttaatccataaggagtttttgtgggagacaagtccccaaatttatttcaaacaacatacctcattaacttcttttagtgatctcaagctcaaacttcgaagtcgtctatttttacaattttatttatgtcagaaatgcaaaataaacctataaaatataaaataatacgcaattcaatttttttcattatcgtcaaatgttaaaattttgataaataatatatcaaatggaatctctcgagatgatgaattcaactatatctttaaaatatttaaacacaaatatatgtgatcgtgaaaacgtttactgtaaagttgcaaactaaaattagatatattacatattattttagattcaatcaaattattttctattttttaaatctaaaaactaaaattgtaaaaatatcgattttgaatgtgtttttttttttttttttttttgcataaaacccattgtttttgatccacgtgagacacgttggtggagactagttcttttgcatggtcaaatcgtttagctgtttcaaagaattaaaaaataattaagtaaaaaagtctttttgatttatatattacgaccactattaaaaaagtaatgaatgaaaaaccataaagaaccctaaaaaaggtctttaataaaacgcaacaaaccaaaaaactgaagctcttgaaatttcctctcttcttcttttgcttgagctttaggttttgagagcaaagaaaaacgaagacgcgtcaaaggtgaaagtcaataatcatttctctgattccgattttcttctccattgatgcttctgattatttattccttctgggtttcgtttcaaccttgtgaaatttttgtcggctgcttctaatttcttcaatttctctcccaaatttcgtcttttttaggttatctatttcatgggtttatgtgggtctttaaaaccctagctaaatcatgtatgtgagtgttaaagttttgatcttttttgcctttcaggtactgaaatgtgtctattgcttcttgcttctggtttatgggtccctgcgacattttgagagtgttgtttggtttaggtgtctggtgtattgcttatataactgttgcaatctttgcgtcttttagaatctttcactgtatttgttaatttcaagagcttttgtggagaggttctgcttgcttgctacaatg

SEQ ID NO: 20135 - DNA, 3000 bp, Unknown; identical to SEQ ID NO: 20134
  misc_feature (1)..( 3000): 2750-1469P.txt file - cDNA_ID_1824530; gDNA_ID_2926155; Annot_ID_139505

SEQ ID NO: 20136 - DNA, 3003 bp, Unknown
  misc_feature (1)..( 3003): 2750-1469P.txt file - cDNA_ID_1824534; gDNA_ID_1620711; Annot_ID_49002
tggagtactcgtattctgcggctctacaacatcatcaaatgaaacattcttagaatggtaaagcccagaactttctactggtgactgggagccactgatgtttcctggtggccttaaatgactcttgcctctactattcatatctggccctgattttccaagactatcgagaggatcagtatcaacaaatactcctccgtggacagatgaatgatcagtttttctgctgttgaatttaccaatttcctccaatggatcagtgaaccctcctgtggaaggttctctaagggttgatgtagactcctccaagactacaaatgggtcttctttcacattagaagatgtctcggcagtccgatacggaggtttctgggattgactagttgtctctgaagttgtcctgcgcagaaagagtagatcatcaatcaattggtaaacaagttatgcctataccagcaaagatcaaaatgaaattttgcatataaacgagttatgctttcaaagactttctgggagttatcttctaggtttaagagagtacacataagagacccttgtattgtgtgcaagcaaacatacccttgagcagctctcaagacaggtctaggagaaacaattttgaagagcaattaatggatataaagacattgagtatagttcatgctacaaagctagatataaaggcactactattatgaaagcatgaagtctctagtctaagctctatacccttgagtcatttcacgcaagcaaggtcgcaaatttgaagagcgggtgacaggagcaaccctaactagtaaccacagatctaagagcaatgaccggatataaagacattgaatatagttcacgctacaaagccagaagtaaaggctctcaagtcagctctagctcctccataaccactgatatagttcatgctacatcacatttcattacgtgatggctctaaattctacacccttaacttctttcacgcaagcaagccctcagatttgaaaaccaatgacaagatataaagaacaatgacccatttgtagtcatatgaaatgaaattttgcatatgaatgaccctaacagcagattaaaggttgaagatttctcttgtaagttctacaaagtacacataagagaaccttgtatgctagcaaaaagctcttcagtaagacctaatatagttcatgctacatgtcatcatgtaattgttatggctctaagttctagacccttgagtaaactctcaagtcagttttaaggagaaacaaatttgaagagcaatgtcattcaaaattggatatgaatgacaagcaaaaggttgaagcttttgagagcaatataaaaaaaacttgtagacttgtagtatccaagtaaacagctatccataagcattatacagttcaagcaaaccaaaatctaagcttcatacccttaactaaaatcacgctagcaagctttcaaatttgaagagaacagcttccataagcaccaaatgctactacatttcatgctctaagctctataccgtttattcatttcatgcaagaaagctccctagctagtaaccataaacagaagaagagtgaatgaattcttaccgtttagctggaggagagctagtgcgaccaaacccgggaattaaatcatcaaaaatggaactacccttctcctctcggtcactctctttcttccccaaattgtttcccatgagatcatcgaaaggagaactgttctgtttcctgtgcttcgtaggagaagatgagatagaagagaaaacattctcaaacctagctgactgagaagaagtggaagggattttgagctcaggaatagactcaaacacatcctcatcatcatacacaggcttatcataaaccggcatagacgacgctgatttggatttgggttccttgaacataacatcatagtcaaaagcaggagcagatggagaacgagaatcaccagaagatccatactttggtggtggtccgctaaacacatctctgaagagaagatcatcaccatctcgaccaagatcgtcaaacaccggcaaagaatccgactttttaccagcggcagaggcgaagctataagaagaagcgaaagtgttgaaatcagcggcagaagagtttgattgagaagccatgggcgcagatttgccttgaggtttcaatccgaagtctctcgctaacaatcctgtgaaatcatccattggattcctttaaattctctagctccgaattcgaaaagctttagattttgcccactagaaatgaagaagaggttatcttcagatctgagtcgccattaacgaatcggatcaaagcatttgattttttaaaaagctcttttttcttcgttttccgacttgtttatggtttcttctccgactcgtacatgtttcccagtcttcataatttcttcattattgctaaatgggtcctaaagtttcagaaataacaaatttggtctccaaaatcttaaaaaaataaaaaaagtaattccttagagttgatcctcaatatatataaacttataattatattaattaccaaaatacaattatatgtttaacattttctatagcaatgaaactcttagaattatcaaaatatgtagaaaatatttgtcaatgtacaattttgttttttttgtgaataaattttggtattttacattggttcaaaaccaaaatgaataaatccaaaactctagccaaagtatcaccgaatttataagacttgggggacccaaattgaaaactctgaaactttaggacccatttagcaaaaacgaagaaattatgaagacacccagtcggagaagaaaccagagacaagttgggaaaacgaagaaagaaaaaaagagagcttttttaaaaatcaaatgctttgatccgattcgttaatggcgactcagatctgaagataatctcttcttcatttctggtgggcaaaatctaaagcttttcgaattcggagctagagaatttaaaggaatccaatg

SEQ ID NO: 20137 - DNA, 3003 bp, Unknown; identical to SEQ ID NO: 20136
  misc_feature (1)..( 3003): 2750-1469P.txt file - cDNA_ID_1824534; gDNA_ID_1620711; Annot_ID_165425

SEQ ID NO: 20138 - DNA, 3003 bp, Unknown; identical to SEQ ID NO: 20136
  misc_feature (1)..( 3003): 2750-1469P.txt file - cDNA_ID_1824534; gDNA_ID_2926155; Annot_ID_139504

SEQ ID NO: 20139 - DNA, 3003 bp, Unknown; identical to SEQ ID NO: 20136
  misc_feature (1)..( 3003): 2750-1469P.txt file - cDNA_ID_1824534; gDNA_ID_2926155; Annot_ID_198373

SEQ ID NO: 20140 - DNA, 3000 bp, Unknown; identical to SEQ ID NO: 4505
  misc_feature (1)..( 3000): 2750-1469P.txt file - cDNA_ID_1824538; gDNA_ID_1620711; Annot_ID_49001

SEQ ID NO: 20141 - DNA, 3000 bp, Unknown; identical to SEQ ID NO: 4505
  misc_feature (1)..( 3000): 2750-1469P.txt file - cDNA_ID_1824538; gDNA_ID_2926155; Annot_ID_139503

SEQ ID NO: 20142 - DNA, 3000 bp, Unknown; identical to SEQ ID NO: 4495
  misc_feature (1)..( 3000): 2750-1469P.txt file - cDNA_ID_1824549; gDNA_ID_1620711; Annot_ID_48998

SEQ ID NO: 20143 - DNA, 3000 bp, Unknown; identical to SEQ ID NO: 4495
  misc_feature (1)..( 3000): 2750-1469P.txt file - cDNA_ID_1824549; gDNA_ID_2926155; Annot_ID_139500

SEQ ID NO: 20144 - DNA, 3003 bp, Unknown
  misc_feature (1)..( 3003): 2750-1469P.txt file - cDNA_ID_1824561; gDNA_ID_1620711; Annot_ID_48991
aacctcaaatccaacaatctcataccccaatgccttcttcttatcagcttcagagatcacacccataccttcttcaccagtaccaatcacctccatgacattgccttcatactcatgaaccaaaaccttaaacttgaggtgattaatgatgtaatcatcattactgttaggtggcgaatacccaacaggatatccagtccactggatagtaaccccattctgcttagcgaatctcaaagcaggcaagttatcaagaatcatattcacttgatacaactcacgagttctctgtttcaagagcttgacctcatgctcattcaaaggactcgtagtgcataagtaaagagactcattggttctcatccgaaacctataagcagagttatcaatctgatcacccatgagaagctcaccaagattctcagcacttttcttgataccttcaagtggttggcagtaaggaagactatagtaactgaaaggaagctcagtttcaatagaagtcaaggaattgactttggcgaagatagagtctccatctgaatatgtgtgcatataactccctggtaagtaaaacccattgcaaagctgactaacaaacaccagtaacacgaatactcgatacacaccaaacattgtcccttcctgtatcaaaatacaaaaactctctcacgattagtaaaaatcactactattgtaacagattcaagcacattctcacgaatacattgaaatcgaaatggtttatgcatgtagatcagattcgtagtaaccagattcgggattaatgaatcagatcggtggatcaatagatcagatctcaaatggatcataaacgcaaaactcagaagctaattgatataatggaatacgaaaacgatgaatacaaaatcagaaaacgcgaaagaagaagcagatgcgaatccaacagatctcagagtattcgagagcaaacctgagagagagagatccaggtatggagatctacgagggagtcagatctagaagaggtggtcgagggactttgggttgtttcgaaggtcacgctgataatctctctcactgctttgctttggttgcttaatgcgttcgcaaagagagcgaataacgaaaatcaagaaaatcgtgggtgtgttgggtagttattctctgtgacgcgcttatacaatatgtcggtgcggtaatcaccgtgcctaacttcatctgaggccaaaaaaaaaaaaaaaaaaaacttcatctaaggccttgaatttctattggttgaactggttataattaattatatttttaagtaaacgacggtttttaaatgagatttttgtaaaatagagagagtataatgtagttaatttttaaaaaaataaaacaaagccaaatgaccaattttttggaaacaaaaaataattttatcacatataatttgaacatttttttttttgctaaagaattcaatatttactacaattttgaattattttgaactcttatgtaagaaagtaaaatttacacaaaatacatattttgagaagctggcatccggcattttgacatgcgtattttctcaaacattaaatacattaatatatatgttaactagcattataatagagtaaaatattcacaaaataatgttttgagaagctgaaatgtaacatgatattctacagtctagcaatttgaggttttctaccgaattttcatagtttgtattgtaaattcaaattaaatttaagttcatgtagttataagcacataaaaaagttcggtgaatggaaacgataaagcaatttagttcatggtgaaataggccacatgattattagcaggattcatagataagaatgttaacaaaattaaatggtaaattgggtttaattaggtttatgacctccggtcgtccttacgctattatctccacagcgtttttgtttcatctaatcaacgaagtgaactttcgaaatcgatatctgaattttgatttaaaaattggaggtaatcattcaccaatcggtttgtcaacgtaaaaatctctctctgattatatgaattgatgtgatgtgagttcttagaattatgattcatcgaattggaaaaaataaagttgttcgttgtcagtaaaattagggtaatttgaatcattaacgagtatatgtatgtattgtaagacatgattgatatacataatggtaaaagaagctaagcatgagtaaagccgattattggcagagatagtttttttcatcagtcttgatgattgtttcgattaatactctattggatctttattttattcatgaacttgattagaatttgttcctatatgcatgattttagggttaaaatttctcttgaatttggtatattctcttgaatttgattaaaattttatctgttttactttaaagtaaagtttagtgggcacagcccaacctaatgaaaataaaagaagccataaacagcccaataagaaagaagtaaagtgaaccaaatcgcaggaattaacctctgaaacgatgaacagaagaaattgcaaaaagaagaagaagatatgagttctcgaattttatcctccgattcggtaatcttcttacgtttctctgtacttactggagataaaaaaaatcgaaaattctcatcttttaagtcaattttgttactttctttcgaaagtttggtgattgttttgatgtgataacgcaggacgacgttgatgaagaaaacccgaaaactcacgagaatggtccaattggaggaaagactcaaaatttagggcaaagcaagggaggtgatagtgataatgttgtaaagactaatacttgtttcgtgtgtgatgggaaagacaattgggttttggtatgttacggagaggaatgtactatagctattcatcagagttgtgcatctgatgaacctgatttcgatgaatttggaaatttctattgtccttattgttggtataagcgtgtagttgtcaagtgtttggagttagggaagaagcttatg

SEQ ID NO: 20145 - DNA, 3003 bp, Unknown
  misc_feature (1)..( 3003): 2750-1469P.txt file - cDNA_ID_1824561; gDNA_ID_2926155; Annot_ID_139493
acctcaaatccaacaatctcataccccaatgccttcttcttatcagcttcagagatcacacccataccttcttcaccagtaccaatcacctccatgacattgccttcatactcatgaaccaaaaccttaaacttgaggtgattaatgatgtaatcatcattactgttaggtggcgaatacccaacaggatatccagtccactggatagtaaccccattctgcttagcgaatctcaaagcaggcaagttatcaagaatcattattcacttgatacaactcacgagttctctgtttcaagagcttgacctcatgctcattcaaaggactcgtagtgcataagtaaagagactcattggttctcatccgaaacctataagcagagttatcaatctgatcacccatgagaagctcaccaagattctcagcacttttcttgataccttcaagtggttggcagtaaggaagactatagtaactgaaaggaagctcagtttcaatagaagtcaaggaattgactttggcgaagatagagtctccatctgaatatgtgtgcatataactccctggtaagtaaaacccattgcaaagctgactaacaaacaccagtaacacgaatactcgatacacaccaaacattgtcccttcctgtatcaaaatacaaaaactctctcacgattagtaaaaatcactactattgtaacagattcaagcacattctcacgaatacattgaaatcgaaatggtttatgcatgtagatcagattcgtagtaaccagattcgggattaatgaatcagatcggtggatcaatagatcagatctcaaatggatcataaacgcaaaactcagaagctaattgatataatggaatacgaaaacgatgaatacaaaatcagaaaacgcgaaagaagaagcagatgcgaatccaacagatctcagagtattcgagagcaaacctgagagagagagatccaggtatggagatctacgagggagtcagatctagaagaggtggtcgagggactttgggttgtttcgaaggtcacgctgataatctctctcactgctttgctttggttgcttaatgcgttcgcaaagagagcgaataacgaaaatcaagaaaatcgtgggtgtgttgggtagttattctctgtgacgcgcttatacaatatgtcggtgcggtaatcaccgtgcctaacttcatctgaggccaaaaaaaaaaaaaaaaaaaacttcatctaaggccttgaatttctattggttgaactggttataattaattatatttttaagtaaacgacggtttttaaatgagatttttgtaaaatagagagagtataatgtagttaatttttaaaaaaataaaacaaagccaaatgaccaattttttggaaacaaaaaataattttatcacatataatttgaacatttttttttttgctaaagaattcaatatttactacaattttgaattattttgaactcttatgtaagaaagtaaaatttacacaaaatacatattttgagaagctggcatccggcattttgacatgcgtattttctcaaacattaaatacattaatatatatgttaactagcattataatagagtaaaatattcacaaaataatgttttgagaagctgaaatgtaacatgatattctacagtctagcaatttgaggttttctaccgaattttcatagtttgtattgtaaattcaaattaaatttaagttcatgtagttataagcacataaaaaagttcggtgaatggaaacgataaagcaatttagttcatggtgaaataggccacatgattattagcaggattcatagataagaatgttaacaaaattaaatggtaaattgggtttaattaggtttatgacctccggtcgtccttacgctattatctccacagcgtttttgtttcatctaatcaacgaagtgaactttcgaaatcgatatctgaattttgatttaaaaattggaggtaatcattcaccaatcggtttgtcaacgtaaaaatctctctctgattatatgaattgatgtgatgtgagttcttagaattatgattcatcgaattggaaaaaataaagttgttcgttgtcagtaaaattagggtaatttgaatcattaacgagtatatgtatgtattgtaagacatgattgatatacataatggtaaaagaagctaagcatgagtaaagccgattattggcagagatagtttttttcatcagtcttgatgattgtttcgattaatactctattggatctttattttattcatgaacttgattagaatttgttcctatatgcatgattttagggttaaaatttctcttgaatttggtatattctcttgaatttgattaaaattttatctgttttactttaaagtaaagtttagtgggcacagcccaacctaatgaaaataaaagaagccataaacagcccaataagaaagaagtaaagtgaaccaaatcgcaggaattaacctctgaaacgatgaacagaagaaattgcaaaaagaagaagaagatatgagttctcgaattttatcctccgattcggtaatcttcttacgtttctctgtacttactggagataaaaaaaatcgaaaattctcatcttttaagtcaattttgttactttctttcgaaagtttggtgattgttttgatgtgataacgcaggacgacgttgatgaagaaaacccgaaaactcacgagaatggtccaattggaggaaagactcaaaatttagggcaaagcaagggaggtgatagtgataatgttgtaaagactaatacttgtttcgtgtgtgatgggaaagacaattgggttttggtatgttacggagaggaatgtactatagctattcatcagagttgtgcatctgatgaacctgatttcgatgaatttggaaatttctattgtccttattgttggtataagcgtgtagttgtcaagtgtttggagttagggaagaagcttatg

SEQ ID NO: 20146 - DNA, 3003 bp, Unknown
  misc_feature (1)..( 3003): 2750-1469P.txt file - cDNA_ID_1824573; gDNA_ID_1620712; Annot_ID_49044
taagatactgatatagccaagaagtttgacatttagaattgttcaattcttgtagggtacattgagggatctctcaaagaaaacagaagagaatcagttggctttaatgaaaccggtaagctcttataaatatcaccctgtgtttctggttggtttatccacataaggcggagcttgaatcatcatcgcttatttgtaggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatatcagatgtctttggtttcagagtttgttactatgcttgcaaccatacccattgacatggtgtggttaaaaacgttaaagtcgattctgaggggaaaaaagtttacttattacgttacatcctcaaaagatatgatcagattaaaaagacttatcaatgtctcatacataaatcaaatactaatctactcaaaacttgaaaggtgatttcttcttctttttggttgtattgaccaactaacaacactacgtatcaaaatatccgaaaagattttaaaagtttcattggaatgggacaatgcatcttagatctcaatcctagtttacaagattagtttattagaggatgtatgcatacgcatcatataccaaaaccatgtggattactaaatcgggctcaggaccactaaatagattagattatctacaaatcacattattgtgtacataacaaatagaatacattatataaatcacacaaaaatgtatcgaagaaaagagaaccgtcgaaccagtttgatggtaatcaactaagataatgtttttttttctgatgtcaatagtgtttgtttatgaaggaatttatgatgagattattcgagaaggagtcgctttaagtgacccgatcctcgtgacgactcgttgctctttctttctttattatagattatagttgttcaaacaaatgaaaagtatctgagacgaataaattaatgggtggtctgtttctgtactataaagaggtccatgcatgtaccatatcatcttattatgtactattaaacaaatagattaatgattatataatgttttccgatatattgaaattagtttatgagtcacgagttaaatctgaaggcttcaccaaacctaaagttaaaagtctcaaaacagttaaacactcttgtgatatcatccctgtatataatctttaatgaaaacgtagaaaaaaagattatttgcaaccagaaaacatctgaacaaatatccatttctcgtggttttatgttaaaacatttgtcgtgttgggaaataattgaaacttttattttccaacattgaatttttctttatgttaaaagtgatgtgaactttgtataaaatgaaggaaaatttaaaagcactcccctatatgcgatgcgagaaaagggagagaagatatgtatgcacttgtttcttgtcacgttccgtttccacaaaatcagtagatatgccagtaactgtgttatcttcttcttttcgtgcgtctgtatccaggagacatataaatgatgctgaatttcctaactatttttaatttataaacatgagaagcgttaaatgggtagcagcaatcaaacgtttggtgcttaaaagcgcttatttgaagtataaacaatttgatatttataagataaaacagcattacatatgaaatatcatgattcataactatatatgcaaaatttgaaaacttctaaatcccaaaattacacaaagattaactaaactacattataatttataaataaataaaaagattagtatcaaaactaaaacgttaagaaatatcataagtgatgattagacgacagtcaaaatgttaaatttcatgatgaaaaaacaaaaaaaaaagagtaatttgtccaaatacaatcagctgactatatattttgtcaaatcatatatcatatatactaaaactaagaaaaagataaccatcaaaccaattcaatttatatccacctacatatgactttgatacattttttgtgtagtttgatcagtgataagattttcaatcctctatagtaataaaaattgctaatttcgataatttaagagataattacaaaaccaacaagcacctagacacccctaagatctaggagaatgcatcctccttagtcatcacttccttataaagtaaaactataaaaactgagatcacgagagaaaccgagaaagagagccaagaaatgcatgagttaggatgataatccacgtgtcactatcctattgcatgaagagtatacgtgtaagctcgtcacataaagtttccctcttcttcttcctcagagtttttaattggccattttattacttttccataaataataatataaaaattcaaaatatttaattccccatttgctgttgtctttccttttcttcttcttcttcttccttccttttctcgtgcaatctccaacaccttgactacgcttcttcatcccaccaacaaaaaccctttctctatcaaaaccaaaccaccgttagtttttctttcccggtgatacgtttagatagcttctttttttttccggtggttaacgttgacgattgactacttcaattctaaacggataagtattagatagcttcctcttcttcttctccagtatctggcgacgaattcaactagagattattttctctttttcttgtctcctcttgatcgtttgtttttgtttgtatctggattcaatgacgggatttggttaaacgaagaagattcatttctctgttcgttcgatctgtaaatttttgctttcagagtgagattttaacgaaatg

SEQ ID NO: 20147 - DNA, 3003 bp, Unknown; identical to SEQ ID NO: 20146
  misc_feature (1)..( 3003): 2750-1469P.txt file - cDNA_ID_1824573; gDNA_ID_2926185; Annot_ID_140758

SEQ ID NO: 20148 - DNA, 3003 bp, Unknown
  misc_feature (1)..( 3003): 2750-1469P.txt file - cDNA_ID_1824577; gDNA_ID_1620712; Annot_ID_49042
aaatcatattctgtacaaaggcatgttatttcttctcccttcgtttctctttcaaagtttgactctcaatgttcttgtatgaatattaattgttattctcttttgcgcccaggattggtaccgtgtcagcgaggcttacagacctcatgatgttcagtgggcattgcaaacaaaagcggtccttgaccgtttacaactagtacttgctgatagatgtcagcattattttacaataatacagcctactgcaaaatatcttggtcaactgttacgtgttgacaagcatggggtacattgcagttaaactccaacttcttctttatgtaagaaagtctaaaagatatatttattcatttgggtttcttattttttacagattgatgttttcactgaagaggttataagagcagggccaggagccgttttatcaactcttgtaaacagatttgatccttctctaaggaaaatcgcgaatttaggctggtaagatatgttttaccatgaatttgaactaaagaactatatttagatttgttccttgtagaaggtgattactgaaccctttatcgtatttttgctctaaaccaaaatggttctggttgagaagttggcaggttatcagctcggctgatgcatatgggtttgtggtttgtgtgaatgagttaattgttgttcagaacaaattctactcgaagccaactgtaattattgcaagtaaagtcacaggagaagaggagatccctgctggtgttgtagccgtgctgactcctagtatgattgatgtcttgtctcatgtatctattagagcaagaaacagcaaggcatgttatcatcagacaatgctgcaaaaagaagaactaggatcttcacaattttttcagggaactcatcttaagttcgtctgatgcagatatgctttgctacatgcttcgatcagaatgttctcagcaatctgaagtcgaaggaagggagagcaatatctattcatacaaagtctactggtttagttatcaggtaatcgaactcttattatgtcactgttctttacgcttagagaaggagtttctaataactctgaaattatatcacttgcagtgatggcaacaactctgatgtctctgttcgtcatatttttatttcctctgttccacggggagtgatctctaaggggaagaagttttgtggccactatgtgatttcatctaaggaattcactgatgaaagggtaaataagaatcaaatacatgaagataaaagttttcattttgagaataccatttggattttcatttctatgagatattttaggttggctcaaaatcatacaatataaaatttctacgtgaaagagttccatcatggatcaagatacctacctcagctgctcttccattcggaacatttgagaatatactctcagatgattccaataaggtataacctttaatcatttgcttctttctggaactctctaaaagtaatccaagggacggctcctcactgagcttgcgatccagaagtctcttaaatagatttggtgatccatcgcttttcaggatgtagcacgcaggatttctgtccttaaagattctcttaacagaggagacctgacaaaacttaagtccattcaagaagctatcttacaaatgagtgctccaatggctctggtaataactgggcatataattgtctttctttctctctgttcatgttccatgtgaatctcatgttgggttttgaactctttggtagagaaatgaactgatcacaaaattgagaagtgaaagaatgccttatcttggtgatgaatcaggctggaaccgctcctgggtggcaattaagaaggtaagaatctctttgaacgtttgtgtacttatagttaaaggaaccaagtgtttccctgatctccacatctgcataggtctgggcttcaaagtggaacgagagagcttatgtcagttgcaaaaaaaataagcttgatcatgatgcggtctgcatggctgtgctgattcaagaagtcatttgtggcgattatgctttcgtcattcacacaaacaatccggtctctggtgactcttcagaaatatacacagaggttaaagaactatctccagtttccacacttttgagtaaataatatcaataactcagttatcaagaaactggcgttctcagattgtgaagggtttgggagagaccttggttggagcatatccaggacgagcaatgagcttcatcaccaagaaaacaaacctcaagtctccaaccgtaagaaacaaacagatcctagttggctcttaagttgagttatatattaaccgagtgagtggggaatttgggttgtacaggtgatcagttacccaagtaagaggataggtctgtattctaaaccctcaatcatattcagatcagattcaaacaacgaggatctcgaaggcaacgcaggcgctggactttacgacaggtttgttttgtgtgtttctctctgtttccgtcttttatttcggaactcagaagctgaaagggttaagtgctgcagtgtgataatggatgaagcagaggaagtagtggtggattactcaagggagccactaataatggacaaatcctttcgagtgcgtctattctcagcgattgcagaagctggaaatgtgatagagtcaatctatggttgtcctcaagacattgaaggtgttgtcaaaggtggacatatctacatcgtccaagctagaccccaagtttaagctctctttttctacttgtaccattccctaagttttcaatcaaatcttataattacaagctaatcttttatatgtttgctattacacatgtaatatttctacatcatggcacactcctgatacaaacaaacatgattcaaagtttcataataaatgattgtgtgataaaaatccaaaactcgtttaaacgacatcgtatgaagggtcgcataagcgaagaaggatataaaaacagtcgccgagaaagtctcccgctatg

SEQ ID NO: 20149 - DNA, 3003 bp, Unknown; identical to SEQ ID NO: 20148
  misc_feature (1)..( 3003): 2750-1469P.txt file - cDNA_ID_1824577; gDNA_ID_2926185; Annot_ID_140756

SEQ ID NO: 20150 - DNA, 3003 bp, Unknown
  misc_feature (1)..( 3003): 2750-1469P.txt file - cDNA_ID_1824589; gDNA_ID_1620712; Annot_ID_49036
cgtccattggctttcctgtcacgtggtcaggcctatggcgacccattatgcaaagtctaaacacagtaagctgcgggcagttctccgacatggctgtcacagctccattggtcatattctggcaaaagtacaggatagattccagtttcctacagccctctgaaattgcttggaggcctactcccgagacaggaccttcactgtcttcacgaggatcaaaagggaaaatccgaagctcacggagctccttgcatgtggcagccactgcctgtagtccttcatcacgtatcgagtcaagagcctgcattataaaagtttcaagatacgcatgtaactcaaagtcctcggttaaaggatattacactatactatacaatgagatcaataaagatacatacccagaagactcggatattgtgacagttgcttatgatgggcttgagcatgtgaggagaaatgttagcataactgaagttaagagaggtgagattagcacaaactgaagagatggctaggaggtattccggtctaaattccctgaatcctgagagacaaactatggatttacaagcacgaaaagcagctgcataatccggttgttgttctccctgaggcacattgtctggactaaatgaccccgtcccaagactcgttaactgcggcgctcgaaccattagtcgatgcagctcttcaagggaaacaaacctgttcgttctaagtttcttcaagaatggtgacctaaccacgagctcctccaatgccttgaaattgataggggattcaacacagtcaaaagacaaagactccagatgagtttcaccctcaggaaaacaagaaatccaatccaactcatcatctgtgacttctgactccatcaaatcaaggacctttagctgcctgaaaacaaagtcccacttgataagcatttctagaagactctgagaacaaacaaacaaacaaacaaagagaagagatctacaaagtacctgcatttgttagcaacaatagcaataccactagtcccaaaaccttcacagcagaccaaagtaagctctttgaacccaggaaacgactcagcaagaagagccaaatcatcatccgtaacaaacatacgcttcaaatgaaccttctcgagccaaggataagccttagctgtagcagcaacccaaggagagaattgagctccccaattaggaggcatgagattaaaatcagcaaacctaggtttccctttaagcacaagagacctaacacgcttgaaccggtgaataagccgagcaggagagagcgagtaacagtttccaataaaaacctctaatcgagtctgagcctcgacgcgataccacgatctgcagaccaatgagactgcgttgcgatcgcatctggaagtgaggaactgaagcacgttctctaaaacgttctcaaggacatgatctggacacggcgggggagaagatttgaaatttcgagacttgttcgtgaatgtagcggcggaggaagaagaggaggaggaggagcaaggtggatttaagttgagatatttctcaacatcctctgacattttagctgagctatcttcttctgtcatacaagtaagtgatgaaaaacaagaaagactctgactttgatcttatccagaatttatgagctcaggtgctctctttctgatacaaaatctgattcagatgaagaagagagataggtgaaaaaggagctggtcttggtgtttggactctctctctctctccattttcacctccattatttaggagactatgtaaaagaaaaaaaaacaaatatttttggttttgcacattatttttgttgatgaagaaataaaaagaatcatcaagtattttgtgaccaaacatgatttttaatcctattaaagatttgtacttctattttaaggtgtgacaggtgacatttagagttttatgtaagtggtaatcatgtaaacttgttgaatcttaaccaaaattaaaaggatttaaaagtgttttgtactgtttctttaaatgaataatactaatatctaaagtcactttcatccttttttaagttaatgcattttacatgaatttaatttttatcatacaatcaacttttcgattgtgttctcttaagaaggcctcaaggctttcgtgtaaaggaaaaatgtttgggcttattatatctcataatatggtggccaaaacaagatcaaaggtgattaatggttggtttactgccaataatgggttttgaagataagtgtactgtatgccttattcgattatcttttcaaaaatgtgtttgcttaattttccacaaggcaaattgttatagatatcttcaaatatgcttcttaaaattttcaaaaggcaattatttagaatatggataaatttcaaataagttccctaaaagaagaaatttcgaagtcaagttttatagaataagtcataacgacgttgtatccatagtcttggtcactaactactaataaatgggtcataagtctatagatatttttcaaaagctaggagtcgtattagtgtgaaattatggtataaatatactgaccttccattacaaagaatgacgtgtaaacaaccaaatattagaatgtggcaagtagtcgccgaacacgtctccttcgtcaaagtctccttttctgacttctctttaacccccaaccccttgttactttaatttggctctacatagatttgtaatcaaacacaaatcacaaatctatatattttcccttaattactttggctttctattgattaaagcttctttaattccaatttgcaatttaaacacctatctctttcccaaatttgagactttcctaattaattaaaagctttgctctgtatatttgtcgttataaatttaattttaaaattcgaaactttttttctgcctttcctctttctctctctctatctatcaaacactagacttgaagaaatgcagtgaaattgaaattgagtagaagcagaagagaatatg

SEQ ID NO: 20151 - DNA, 3003 bp, Unknown; identical to SEQ ID NO: 20150
  misc_feature (1)..( 3003): 2750-1469P.txt file - cDNA_ID_1824589; gDNA_ID_2926185; Annot_ID_140750

SEQ ID NO: 20152 - DNA, 3000 bp, Unknown; identical to SEQ ID NO: 4523
  misc_feature (1)..( 3000): 2750-1469P.txt file - cDNA_ID_1824593; gDNA_ID_1620712; Annot_ID_49035

SEQ ID NO: 20153 - DNA, 3000 bp, Unknown; identical to SEQ ID NO: 4523
  misc_feature (1)..( 3000): 2750-1469P.txt file - cDNA_ID_1824593; gDNA_ID_1620712; Annot_ID_165482

SEQ ID NO: 20154 - DNA, 3000 bp, Unknown; identical to SEQ ID NO: 4523
  misc_feature (1)..( 3000): 2750-1469P.txt file - cDNA_ID_1824593; gDNA_ID_2926185; Annot_ID_140749

SEQ ID NO: 20155 - DNA, 3000 bp, Unknown; identical to SEQ ID NO: 4523
  misc_feature (1)..( 3000): 2750-1469P.txt file - cDNA_ID_1824593; gDNA_ID_2926185; Annot_ID_200552

SEQ ID NO: 20156 - DNA, 3003 bp, Unknown
  misc_feature (1)..( 3003): 2750-1469P.txt file - cDNA_ID_1824597; gDNA_ID_1620712; Annot_ID_49031
gccaacccgtcccgtaaaaaaactcatttattttattaatgttgatcttatttatcatatgtttatgaatcatttatttttaaaattatctagtaattaaatgctatcaaatatctctgcggtttgatgattataattgaattgtaatagtcatgcagaaaaacaatatcaataatgataattttgtagtaattaaatgatattaaatattttgaaagttttattttagtaaccaatcgtgtagttaatgtagagagattttagaaaaattgttaaatgtcaaatatttaattcgaagattttttttctaattattaaaaacaaatattaaaatccagtggcaaccattgtaaataagtctcaactacagaatttatttcacaaaatggctgcaaaaatgtatatatagatgtttaaagttaatttaatagccaaattaatatcttctttctatccataaaatcataccctaaggtttactgagtttattaggatgtatcaattaaagcaaaacatcccttctaattaatcattttgagtgactgattaataaggaggacatgttaatatatgtagaagcattaaaacacgatggtcttaaggcattaagctattaagaatttttaaaaagtttatgcatggtctcacactgacgaataaaatacgttatcatctttgatcacgaataaaaaatattaatgaaacgagaatcatgtgtaaagaagaaagttcatactagtttcggctcatgtgagccttgtagaggtttgacttggatgctatatatatgtagacatgagctaggcatttatctcaaaccaaccaaccaatatatcagatggcttccatggatcacaatcattttctttttcctctcctcttcatcatcatcatctcttccttgcacgttttgcgtgcttcgaccacaccttcacactcacacaaactaaaatccgccactaccattagaaaaatcaaccgtagaggaccttacattggccttgtgacggtctttgagaccgaagaagatgcttttctcggcagtgttgatttcagactcgatcctacgcatcctttcctcgatctctctggtatctacactgatccctaaaattaccacttgaattggtttctattaagtttttctaccttgagagagtctctagactcttgttcctttgagatgaaaatgtaagtagtttctgattttaatgagtaaatgaatgcaggaagacgttttcgtatagggaagattcatggaaagaaggttgtgtatgtcagatgtgggataggaatggtgagtaagttgaccccaaaataaaaaagtacaacgtgaaaaagagtttatttggttattgtaatgttatttcacggatcctaataaaaaattgaaatgataattaaaaaacatttatattaaaatcacaaaataaattgatgtactaaaaaacatttatattaaaagtatcaaaccaaaactttctataaaaaggagatggtaaatttttcttgaattttatttgaaggtgaacgcagcagcagcaacacaacaaatgatagatgtgttcagtgtgaaagggattgtgcattttgggattgctggaaatataaacaactcgatgtccataggagatgtgagcatccctaagcaaatcacgaatgctggcttgtgggattggctggtatatacaaaatttacatgcacaagttttgttattgataaataattgcttctccttcatattgtctgatgattttagttctgatcgtcaaacagaatccaggcaaagcaaaaggaaatgaggatgtagcgtacttagatgtcgggaactataatgttccacaaggaaacaataagttaggaactattggatacagttacgaggaattatattcagtcagtggtcacatcaattcaccaaagaaagtgttttggattaatacaactcaagagtggcttcatcttgcagctgatcttgaggttgttaagaatgacatatgattagattagaatatattttttctaacaaaagactttattccatggttgatggttgttgtatgaatgtagaagatggagctattgcagtgtgtgaatgcaagtctgtgtcttccaaataaacccaaagtagtagttggattaaaagcagccactgctgacatatttgtggataatgcagcctatagaaatttcttatacgatacttttggagtttcctcctcagacatggagagttctgctgtggccatggtaattattcacgtttctaacattgtgattcattcctttcactccattttttttttcattgaactttcacttaattttgtttgcatgtgttttggattcgaccagacttgcgtgtcaaatgggtatcccctaattgtgataagaggattatcagatttagcaggagtaggagataacactgttcgaaagtttggatctttggctgccactaacactgccaaagctgttttagagttcattaaaaagctcccaccgtcataattcctacgtgtaacctatcattatggatgtttgaatctgtattttccctagtttttctacgtacgttaaaaataaaattaataaaatctgtttttcttttctttaatcagcttcttgcatggaacactttaatttcagccttcaaaactagaattacaggtctctttgttcatatcaacgatcccgtgacagcaacaattcaaatatgggcaaaaatattttgtgtttataaaatagtatttttttggaaatttgtagagcgtgtattatcgtccacaaaatttattttagtggtattgtaggatatttgtcaaaaaaaaaaaaagtgcgcagccagcagcccctcatgtttaatgcatacacaaaggttatatcagctagtctagagacgagaagcacgtggaaagaagaaactatcaagttggacttggatgatatatatatatatgcagctgtggatttgaatcgtaaaccaaccaaccaatcagatg

SEQ ID NO: 20157 - DNA, 3003 bp, Unknown; identical to SEQ ID NO: 20156
  misc_feature (1)..( 3003): 2750-1469P.txt file - cDNA_ID_1824597; gDNA_ID_2926185; Annot_ID_140745

SEQ ID NO: 20158 - DNA, 3003 bp, Unknown
  misc_feature (1)..( 3003): 2750-1469P.txt file - cDNA_ID_1824601; gDNA_ID_1620712; Annot_ID_49030
tgtccacatctacagacatagatagcaagagtaggtgacgctaatcatgcaccaattgaaaggcaactgtgtcactattgacaaataaaattgagatatatttttaaaatttacgagaatgaaacagtagacataccgcagcaacggcattttcaaacatcagagaaaaacacagtattcaaatgctcttttgaaacttttaatgtaagcgagaggaacattatacacattacatactagtgcttcacccatatcacattcacaactcaggtagtgatcctttaacaaatccatcgagccaaaatatatcatgacaaggggaacctaagaaatttttcagtacatcataattattcaccctacatttctacacagtttgacaacgaggctaggcagttggattcacaccaaaataagaagatgttatggaacttagcaaaaggaactgcccagctatagttctaagctaagtgatcagtgatcactggagttcttattctgatcaagcgcctccctttggagtaaaaagagctcatttttcttattcaacatgattagagaaaatcaaagtcaccaatgaggccagggcatatagggattggagtcaaaaccagttactctctcaaaacttcctatgaactttcatgttcatccataaatcaaatgtttaggctgaagtccaagaagaaactaaactaaactgctaagattgtcaatcatcaaacaaacaaaaaagcatctgacctgatcaagtacaacatcggtgatcatatctccagctacctccttagactcagagaccacagctaactcctccgttacccacttcctcccgccaggactgggaaccatccctccaaatctctgcagatccctcagctccttgtgcatcgttttagccgccttcttcctcgccatagcaaacacaatgtgatccatggcttcatcattcatatacacctcaaaactaatctcatctttacaaggcacgacagagttgaatagccttgagatcagatcgtgtctactcttaagctccaaagtcgccaaaagcccatggcaatacctacgcccactggcatagaacttaaacacattcgtcgcttctttcagcaacaaaggagagtcttctccttcaccaactccaagcaaactgaagttcttctcaaaaatcgtatctttaagaccaaatttggaagcccaagccaaagcgaggttctcattttcacgtttaccagtgaagtaattgatagcgtaaccaatcaatatagagacgcaaacgatctccacagtgtacgattgcatcttcttcggaatgtcagtatctggagtttctgaagcagactcaagatccggcgtctgtggatcggcaggagaggaggcgtcatcggaaaaaaccggagactccgtagatttctcgtcctccggcaatccttcgaactcatcttcatcccagtaatcgaaggagatggaggacgaaggcttcacggtctgagtgggaggatcagatttagatgcaggagtagaatcagaatcgggagatgggtccagatccagaaccgttgactcagactgagtcagaagaggaggacggagagagtggtgaagctcagtggaatcttctgaaacatcgtcgtcttcagcatcgaaaccttcgaagtcggaagaggaagaagcgagaacatgatggtggaggcagaggaaagcgatcagagctatggagaagagagaaaagagacgattcatttttggatccggagagaagaagagtcagagctccggagaaaaagtttaaaacttgttaattagctggttgagtcgtcgtgctatagcctaagccttgcttggccaccaccaccagatccttttttttttgttccaaaaattcatctgacaaattaaaaatattaaaggaaaataagaataaggttgagttataatattttctcgttggataggatatattaagatttctaccaaaaatcataccctaactaaattttcatccgcggtatatcgcgggaacaatttatactttaaaattaatatatataaaattttgcaatttgtaactatctatgtagctatctataaaatatttttattttatagtttagaattgttattaagtaacgtcctgccaaacccgtcccgccaacccgtcccgtaaaaaaactcatttattttattaatgttgatcttatttatcatatgtttatgaatcatttatttttaaaattatctagtaattaaatgctatcaaatatctctgcggtttgatgattataattgaattgtaatagtcatgcagaaaaacaatatcaataatgataattttgtagtaattaaatgatattaaatattttgaaagttttattttagtaaccaatcgtgtagttaatgtagagagattttagaaaaattgttaaatgtcaaatatttaattcgaagattttttttctaattattaaaaacaaatattaaaatccagtggcaaccattgtaaataagtctcaactacagaatttatttcacaaaatggctgcaaaaatgtatatatagatgtttaaagttaatttaatagccaaattaatatcttctttctatccataaaatcataccctaaggtttactgagtttattaggatgtatcaattaaagcaaaacatcccttctaattaatcattttgagtgactgattaataaggaggacatgttaatatatgtagaagcattaaaacacgatggtcttaaggcattaagctattaagaatttttaaaaagtttatgcatggtctcacactgacgaataaaatacgttatcatctttgatcacgaataaaaaatattaatgaaacgagaatcatgtgtaaagaagaaagttcatactagtttcggctcatgtgagccttgtagaggtttgacttggatgctatatatatgtagacatgagctaggcatttatctcaaaccaaccaaccaatatatcagatggcttccatg

SEQ ID NO: 20159 - DNA, 3003 bp, Unknown; identical to SEQ ID NO: 20158
  misc_feature (1)..( 3003): 2750-1469P.txt file - cDNA_ID_1824601; gDNA_ID_2926185; Annot_ID_140744

SEQ ID NO: 20160 - DNA, 3003 bp, Unknown
  misc_feature (1)..( 3003): 2750-1469P.txt file - cDNA_ID_1824619; gDNA_ID_1620712; Annot_ID_49024
tcgtagttgtaaggattagcggagagctccgactccaaggttacaatctgctgattcgactcggcttcatcttctgagtcggaatcagaatcgccggaatcatccgatgaggggggatcagctcgggcagggttttcggctgaagcgtcttccatcttctggtcagtgttactgacgagttcagtgtcatcagccatcatcttctcaagtttaagagttggggatttctgggtttagggttttaagctccaaatacaactttgcaaatagcaattcctctcaaacaccactagtccttgcgtcacatttagacctttttatttcagttcatttcggaagatttttcactatttattctttttacgtatagtattttataggtttttgtaaaatcaaaaataacgaagattactgtaaaaatattacaaattgttttttggtcaaaataccacaaattcaaaaactatattcaaagagcacataatatatgttatccttcttcaaataccacaaactatgaaactattaataaatgagaaaactaataatccgttttattccttataaatccaagtttctaagattttcacacatattaagcaaacaaattaaaatttgattacagatgcatcatttcaatagtattcaattatttgtcttggagtatacaattcatcattattaattaataaaatgcataggaacttaaaataattctttttaaaaaaaatctatatttttaaataaaattttttttctaacacttggattaattaggaacactgtaaatatgtcttagcctcttaggatatgaaaaccaatatcttcaattagtttgtcttttattcctctctgccatattacatttgaaattcgttgttagtttattactcaaacaaagtgttttttttttatggatatgttgctataatttataaacgacaaaatttaacaacggatatttctgttgttaatagcatgttttcttgtagtgatatatatatatatatatatataaatcatatagtaacgaataagtaattagagacaacagatatttctattgttaatagcatgttttcttgtagttgtagtgaataaatcacagagtaacgaataagtaaaagttgtctctaatctacactattattgagtaattgactattgagcagctagcataacgtaaatcttttcacctgtttgtctcccaattattttattttaacacatttttgagacaccaagtatgaatgctatatgtaatgccaaacatttgccagacaagtgcacatgccctgtgttaaaaacgttgcttacaatctccaccagctgtaatattgtgcggatctcattctgataaaaattactctattcatgaacctctcgacacatttatatatatatgcgatactactatagcttagaagtccattcactatcaaaacatatatcagaagaagaagaagaagaaagagagaacaaatcatgagtggctattccaagatggattcaacagaccagaaacttgagccggaccacccggtggtcgatcctcagattcagaagcccgatcttgaacctgctgaaatgaaaccgaagctgagcaggaacaggtcagtgtctgcatcagcacaagcggttccttcaccaataaagatgtctatgagaagatcttcgtctgtctctgaacgctactgtagaatctatgaccagagctctgccacgacttggccgcttcctttccatgaaggagatgaagacgaagatgatgatgataaagagaaggtgcacaagaagaagaagagcaacaacttcaagaaaaaagcattcgtaaaggcttgtaagcgtttttttgggatctcgtgaaaccagtttttgtttcctctacctccatatctatcatataatagatctcattgttattttcgattagagtccatctttttcatgaaacgtttaatacaagaaatttttctttatagttttatcgatcgctttgtgtattggatcagtggtttaacgtattttgcattcttgatgactagtgagatgtgatatattacacgatttagattttcttttatgtatcttttactgaaagtcacaacccacttacttctataactatagtagtagtagacccattgtggtttgtgcgtctgaatccgtcgaaagataacaaagaaagaaaactgtgtaaagatagaatttaacaaattatcatacaagcaataagatgaataaactaaatattactttatttggaagatgatgaggatccttgactccaagattgtccttttgtgtaaaactcgagagagagtcgtccagcccaatgcacttgcacatggagttcgaatttatttatttttattcgaatttatttggtaactctttggtccatgaactttgaggtatatacagtaattagggataatacccataatcaaaagacaagtttatgacaaaaatgtcgccaccgcatttaccaacaagtattccaagagttaaaaaaaagtctattgctattgtctcagacatcaaactggatcggtagtgtaaactatgtctatatgaacaaaaacggtcgtataaaggttctagcaaacaacccatcaaataccatcatcatttctctttcttggttggttcacccaaaacgtacctcaaaatctcaagctaagtgatccgtggcatttgagaggtttaagagatggtgggctttagtgaaaagtgtagatgtttctcaccacaagtctctagtaatgggtgtcaaactcacaaacacttgttggcctattgaagcccatccatcttctcttctcgaaacttcaagtggggtccacaatttctctccctctttctcccaccttcctcttatcttctctgccttctatatctcttcctcctactttcccttagggtttttcagcttcaaaccctccttgcactctccgcttccctccgttacctttacttctctattgcttagctcgaaaaatg

SEQ ID NO: 20161 - DNA, 3003 bp, Unknown; identical to SEQ ID NO: 20160
  misc_feature (1)..( 3003): 2750-1469P.txt file - cDNA_ID_1824619; gDNA_ID_1620712; Annot_ID_165473

SEQ ID NO: 20162 - DNA, 3003 bp, Unknown; identical to SEQ ID NO: 20160
  misc_feature (1)..( 3003): 2750-1469P.txt file - cDNA_ID_1824619; gDNA_ID_2926185; Annot_ID_140738

SEQ ID NO: 20163 - DNA, 3003 bp, Unknown; identical to SEQ ID NO: 20160
  misc_feature (1)..( 3003): 2750-1469P.txt file - cDNA_ID_1824619; gDNA_ID_2926185; Annot_ID_200543

SEQ ID NO: 20164 - DNA, 3000 bp, Unknown; identical to SEQ ID NO: 4515
  misc_feature (1)..( 3000): 2750-1469P.txt file - cDNA_ID_1824635; gDNA_ID_1620712; Annot_ID_49019

SEQ ID NO: 20165 - DNA, 3000 bp, Unknown; identical to SEQ ID NO: 4515
  misc_feature (1)..( 3000): 2750-1469P.txt file - cDNA_ID_1824635; gDNA_ID_1620712; Annot_ID_165464

SEQ ID NO: 20166 - DNA, 3000 bp, Unknown; identical to SEQ ID NO: 4515
  misc_feature (1)..( 3000): 2750-1469P.txt file - cDNA_ID_1824635; gDNA_ID_2926185; Annot_ID_140733

SEQ ID NO: 20167 - DNA, 3000 bp, Unknown; identical to SEQ ID NO: 4515
  misc_feature (1)..( 3000): 2750-1469P.txt file - cDNA_ID_1824635; gDNA_ID_2926185; Annot_ID_200536

SEQ ID NO: 20168 - DNA, 3000 bp, Unknown; identical to SEQ ID NO: 4514
  misc_feature (1)..( 3000): 2750-1469P.txt file - cDNA_ID_1824639; gDNA_ID_1620712; Annot_ID_49016

SEQ ID NO: 20169 - DNA, 3000 bp, Unknown; identical to SEQ ID NO: 4514
  misc_feature (1)..( 3000): 2750-1469P.txt file - cDNA_ID_1824639; gDNA_ID_2926185; Annot_ID_140730

SEQ ID NO: 20170 - DNA, 3000 bp, Unknown; identical to SEQ ID NO: 4512
  misc_feature (1)..( 3000): 2750-1469P.txt file - cDNA_ID_1824643; gDNA_ID_1620712; Annot_ID_49015

SEQ ID NO: 20171 - DNA, 3000 bp, Unknown; identical to SEQ ID NO: 4512
  misc_feature (1)..( 3000): 2750-1469P.txt file - cDNA_ID_1824643; gDNA_ID_1620712; Annot_ID_165458

SEQ ID NO: 20172 - DNA, 3000 bp, Unknown; identical to SEQ ID NO: 4512
  misc_feature (1)..( 3000): 2750-1469P.txt file - cDNA_ID_1824643; gDNA_ID_2926185; Annot_ID_140729

SEQ ID NO: 20173 - DNA, 3000 bp, Unknown; identical to SEQ ID NO: 4512
  misc_feature (1)..( 3000): 2750-1469P.txt file - cDNA_ID_1824643; gDNA_ID_2926185; Annot_ID_200530

SEQ ID NO: 20174 - DNA, 3003 bp, Unknown
  misc_feature (1)..( 3003): 2750-1469P.txt file - cDNA_ID_1824665; gDNA_ID_1620713; Annot_ID_49054
ttaagttgcatcatgagaacaaagctaaggagcttgaagtgagtaacaaacgcttgcttgaggaatgtatgaaagagagaagggagaaggctaaggttaggaagacttttgaggagatgaagaagacaatggagagtgagagaactgctattgttgatgagttgaagtcgaagaatcaggagcttttgttggggaagaagaaagaggaagaagagttagtgaagatggagaataagtatgttgagttagctgagaagtttgatgttgttgaaaaggaatgtgcttacttgaagtcactctatgatgcggaagtagtagcttcggttactcaaagtgctgtaatctcaggggttggagagactgataatcttattggtcaaggagagaacgaggctaatcagaatgtgaacaatgctgtgacaggtatacatagacatctctgtacccaagtgttgtttagtttacaatgacatttcttttgaatctatctttgtgtgcagatgcgataatgataagtgatgatgaaaatgataataatccacctattgagagtaacataagctctcatcggtctggtgatagaaaccaagaagaagaaggcaggaacagaggaaactcagcgactgagaaccgagcttcgggagaaacctttactccggtatctgctaatcatccaccgcctttttctccttcatcgtcatcttcatcatcatcatcttcagacggcgctgagattgtgcttaagctgcctcgtaattggcctgaatgggcaatcccgaaaggtcccgggaaggattccaacaagccttagaacatttcagatgcaacagagagccaaaagaagtaaatttgaagctgcactcttaagttaagctagttatggaaatcttcttacatattgctttctgtttttgtcaggagtttatttaacaatctctggaactacaacaaactattctatctactatcaaatcaattattcattcatgagtataataatagctgaaactttctgtgttacaacaatttcaccataactaaaattgcatttgcatttgaatactgcaaacgcaaattggctttgtatacgcatcttgtttatatatggattagttttttctacataattaatgaaagcttttgtaaactaactcttgagtactaactaataagaaagttccgtggcaaaataatttccgaatcatcggataatcatccatttacgaggttaagttccgggaactgctggtgttaaggttctggaagatctccggaagattggcattagtgagtttgattctcttgctgatctgttgtttgccatgccatgaatatgtgcaacagctcttctctgtgtagtgttcatcacacatgcttcaaactaagcttatgcagctccttctcgactagcttgtcgcttgagttgtctatgccgcggtatagaggtttaaagtcgtcataaacctgaatctgacccttgaaatcagcattagacagtccttaaacttttagagccagcaaatatgaaagacaatcctgaaaaatggataatcataagaccacaaaagtcttttgaaaccatttaagatcaggagccagtacactatccgtctatcagaatctggcaataaatattatcagaagcttattgattatgaagttaatacatcttaaatagaatcagttaagcgttttttgtaaatctaaatcacatgtgaaatttctttatgtcacgttttcatttgtgtaaaacaatatcttttgatttattaagcaaataatttgcagctaaagctctcaagattcaaataaattgaaatgtaagtagtgtaagtagtgatttcttatagaaatagttgaaatctaaaagtattaggacactgatgtaagtattgttaaactaaagagatctatcaggaaatcaaatcactatagttttttttttttttttaaattccttgagtttatcaaacaaaaaaatgtaaatgtccctagcaagtactgtaggttcattttttttgtttcaaaagagtatgttatttcttaaaaatcgccaaagatagataagattcgaaatttgcataaatgtggcaataaatattatcagaatctttttattgaataatgaagttaatacaccttaaatagagaattaagcgttatttagatctaaaaccacatgtgaaatttctttatgtcacgtttttgtttgtgtaaaacgatctctttgagttaatttgcaactgaaagctctcagcattttacattaattgcaatataaatagtgatttctcatagaattagttcaaatcttaaactattaggacagttacgtaaacattgttaaactaaagggaccaatatggaaacacaaatcactgtagttaatttttattattatcttgagtttatcgtctatcgtgttcgaattctctgtcgcttacttaaacacagtcaaattcattttctgccttagaaaagatttttatcgaaaatcgacgtttttgaaaaaactcaaattatcgtcgttttgttctcagatttcttctgctctcttcttcttctccttcttcttcgttccaccgcctctgttgctttatcttcttcttccttccttcgattgttgattacgtcggtggatctttgttctcctctgtgttgttttcattgctagatttcgtcaatgattggcttctcacgattcgatttttccggctcctgttcttaatttcctctgaggtagattagtaaaactctttgtctcgtaaacattgttcgatgatgaaattagaaagttctcactcttgtttgccaaatttgggatatttctggaattgaaaatgaatcgtcatttttttcaatttctgaggattttgttacaattgttttttatttatgttagaattgagattgtgtgatgaatatcagtaaccctagacaattgtgaaatcaaagctatgaaaatcttttgatgctatgtttcctatgatacagagaatgatg

SEQ ID NO: 20175 - DNA, 3003 bp, Unknown; identical to SEQ ID NO: 20174
  misc_feature (1)..( 3003): 2750-1469P.txt file - cDNA_ID_1824665; gDNA_ID_2926152; Annot_ID_139342

SEQ ID NO: 20176 - DNA, 3003 bp, Unknown
  misc_feature (1)..( 3003): 2750-1469P.txt file - cDNA_ID_1824669; gDNA_ID_1620713; Annot_ID_49053
ggaattggagtttccggtcaccgacacttgaactggggaaaattggccgaagcggaagacgaagaaacgaaaagcgagacaagttataagtgttgcagcgacgagttttatgagatatgtgttttgttgaagattagagattgattcccattttagcttcatcttcttcttcttccctcgcgctgagagatatacgattttttttttttggtcagaaagtggaatgtttttgattccgtacttattgcctaagcgataaaccaatgaataatagaatccaaaaagattagtgagtaatttaatgcttgtggggttaatgatatacagaaagttaataaatgaaacagagaatgattaatgaggattctaaacaaccgtaattattctctctctgattttaagtaatgtttaaggttttttacacatattacaaaagtttagtttaatttacctttttttgcataagtaactatatctaagtcaaccaataaaaaatatactatagaatattattggtcaaaaaatattaaatacatttaacttttatattgaaagttgaaagcatcatttaaaatcggaaaaaacattctctaaattatcatttttaatgatatgaaaccgtcatcaattgtgtcaatatcaataaaaacgatctcttcagtagagatgaaaaaaaattgtatcgcatatgtcacaactaatctaatcgtttatattatttaaagttttaatttctaaactcataatttttaccaattgtttcaaaattttcacatctgcaattttaactgcaaaagtctctatattttctacggtcaaattccttacaccaaaattttctacaaccaaaattgatatagttagaaataacacttgttaccaatcggtcctaacactttcagattatagatattgcggttaattagataaaaaagattcaaaaatatatttgatttctaaggacaaactaaaaaaatttaggagctttagaaaaattatgtttgatttccaattattctacgtggttttagtaaaagatgtgtttactataaaaaccttgattgtaattgtttataactcattactaaaagttgtgactgcagaaattacgaaactaaactactacaaaaaaatgtggagaaatgggttaaaaaaaacaaggaaaaaaattcaatgttaaatcaactgaaatttttttcatttaattattcagctaattttagggaagttatcatatcactatatatatatatatatataaataatacaaacaaacgatgcgtagaagaaaaaaaactgttgtccggttcactgtccagatcgggtttaaaaacattgattttcatattatattccgaattttgttttgccaaaaatccaattacttaaatttcaggtcaatttatgttaattttttaacataacccgatccaattcaaattgaaacaaatttatatttctcttttaatagtataggaatttgcacaaatgttatgtaaaaaacggaaaattggttttttcatatctttagtttgaactatgctgcatttatacacgtattataccacagttgatttaacctaaacttcaatttgatatttaaactttcatttttatacgaaaacatacattaatgttacaatgttagaatacctttaatttctgttgttaacctgaatgttagggctgggcaaaatattcgttcgatccgctttgattcggtatatgatttggtttgattcgaaaaatccgaatatccgtaagattttggaccaaagcaaataggaaaatgtagtattcgtaaaaaccgaatcaaataacaaattttaaaaaaaaaaaaccgaatatccgcttcgatccgtatctttttatatatatattagaaaatatagttatatctatatatatatcataatagtttgtgtattgttgctattttacgtttttatgttaaaatgtttgtttgatcatttttctcatgttatgttttgatcaacgacatcaaaaactatcgggttttagttttcggaattagtttgataacattttgtagactggtggtaccaacaagtatttagtttttattttgaaagcatgttaaataaaaactttgaatatctgatatagttatatagtatatagattttttttaatatttaaatatatcaaagcggatatccgcaaatatcacaaaaaattctggatattcgaaattccggatatccggaaattttcgaagcaaagcaaagcaaatcacaaaatcaagtattcgtttaaaacgaatcgaataacaaatatcacaatttttccggatatccgtttcgtacccagacctactgaatgccatatataaaacggtaaaaacagaaaattaaagttctagtaaaaaaaacatcgcatcagttacaaggtttggattaaattaaaaaaaggtttgggttaaattagcttaagaatgaacaatttattaattatttttttggtcacatggaataaacaattaattaatttgaataatattacttaaatacatacaaacattatctgtcatcttcgattacgttatcattaaccaacgtttaggaggactttgcttcttcgtcttcttctctctttaggttcttcaagttcgcaatcctggtaagattttctcgagaaaattccatttctttctatctgattctgtttacattgttgaatgcttgaaagaatctgagttttaaccacactctctcttccctgttactcaccattttctctctgaatcctccgaaacccatttcgatttccacaatctgagctcataaatctggtttaattctcatcttcgttgcatttcagtcataaagagaacataaagcttggatatttagggtttttgcagaatttttgattaagcttatgagtttggtaataatctgtagaaattggttgatgttgtttcaggtttgggtttaggacaaatcagagaagaagatgatgtttggtttagagaaaacgatg

SEQ ID NO: 20177 - DNA, 3003 bp, Unknown; identical to SEQ ID NO: 20176
  misc_feature (1)..( 3003): 2750-1469P.txt file - cDNA_ID_1824669; gDNA_ID_2926152; Annot_ID_139341

SEQ ID NO: 20178 - DNA, 3000 bp, Unknown; identical to SEQ ID NO: 4554
  misc_feature (1)..( 3000): 2750-1469P.txt file - cDNA_ID_1824697; gDNA_ID_1620714; Annot_ID_49082

SEQ ID NO: 20179 - skipped

SEQ ID NO: 20180 - DNA, 3003 bp, Unknown
  misc_feature (1)..( 3003): 2750-1469P.txt file - cDNA_ID_1824700; gDNA_ID_1620714; Annot_ID_49081
gtaattattgataagaaaatcatttgaatcctttagctgctgttcgattaaatacatgtgtctaacaagataaattatttgagggaaaatctcgaatctggttaaaaggaaacgttataaatttagtaaacaacacgcgaattaacatttcgttccagacaaagaagacttaaacgaaactgtttcatcaaaaaagtaaaccaaacgaacgataaccaaaccagaagtggtgacacaaaaccaaatctaaaccaaaaacagagcagcagcacgcaaacaactctatctttgattaccagccgccaccaccgcctccgtaacttccaccatcaccgcctccgtagccacctccctcacggcgtccaccaccaccgtatcctcggccaccaccgcctccaccagatccgtaacctccgctacgtctctcgtaaccaccaccgcctcctcctgagtatccgccgccaccgcctcctgagtatccaccaccgcctccgctgcggtaaccaccaccgcttccaccacggcctcctccgccaccgccgctacctctcgactgagcctcgttcacggtgatgacacgtccatcgagctctttaccgttcatctcttcaatcgcatccctcatggctttctcgtccttgaaggtgacgaatccgaatccccttgatcttccactctcgcggtcgttaatgatctgtaaacaaacaaaatcatacacatcagcaaaaacaatcgtggaaggaatataaaacaaagcgatgaatataaagcaaaaatcgatcgatctccgagctcatagaagcaggaagatgaacgtaccgatgggacaaattaagtaacagtaacaaagaacgagagagaacatagtaacagtaatcgaatcaagtaacagagaaacagatcggaatcagatccgtcgaggatcagaatcatcggaatcggctcgatccgggagaccgatctctcgtgtaacagaccttagaatcgataacgtcgccgaactgtgagaacgtcctttgaagatcttcatcattggtggcccaggcaaggccgccgacaaagcaccggtactcaacttcagacatttttttttggggaaaagaagagaaattagggtttcaaaatgtaagagagagacttatgtgatttgaggtgataagacgcagccttaatttatagaacaggtgtgacgtaataactagggttaaacatgttttctagggtttgctgaaagatttgtttcaacttactctgattaagatgtgtggttaattgggttagtggttaggcccacatcatgtgagcattttcgataactaatgattttttctcctcgtttcgagcaaaaaatatctttgtaagaatatcttttattccttaaatgacaattttgtccttcgtctcgtcgtcattatgtcatacaatagttgggtctgagtttcgtttattgggcctatctaatttaattggaaagattataacttccggcccaatgaatctgacggcgaaattagtaaaacaataaaatgaaataatatgcaaagactatgacgataatgtgctatggatttacatatttgttttgtcattaattatgacatgcaataaattcatatgaaaagattcttatcgcaatagcatcgtggacatgttacagtctgtaatatccaaactttagcatagacgttttttgttgtacaaatattttggtatgttaagtgatattcaaatgaaagctagatgtgcagatatgtgaacatataaatctttcaatggaattcaattttcaatcattgaatatttggatacactcgctctgtacttgaaatattttgactgtctgaatattatttttttacaggattaattattttgtataccaaaattagacggatgaagaatgaagatgtagtagttatacaaagtcaattacaaatggttcagtatcttgatttcgatttttgtgctgaaaatgctgactaaagcgtgtagaagagctttttcaacaagaaataacctggctaagatttttttaagaaatctgattattaatatatcgcaggtaatatgaaaaagtatcgtcgactttttataagagtgacaactaaatcattttgctcataataaagccacaattattattagtatattttggtcgttttaatacgaggaaaaataattgtcatacaaaatttacagaaatggagtagcatcgtagctcctaggaattcaattatttatttgcaaaactactaaaatggtggttatcatattaaacgtcagcagaaactttaagtatttttgaaatgatattaatttaagagttcgttaagctgtcttgggcgggatcgttgagagtcaaactcctcaaacgacgccgtattcagaacttcactttcaattactgtatctgcgtctcggtcacgagatcgaaccataaatcttgggaacgtgcacgtatacaacgaaagatccaccttctctcactttttttattttcttatactttcttctcttttcttcgaacggccgctgttcttgaccagtctgaagctttctctgtccagaacagttctgtaagaagaagtttttatcaaatattatataaaaatatctgtttcgtattatatcagactttccatctttctctctctaaatctaggacaaaaaaaaacatggaagagttagagagagagagaggcagcagaaaatgattggtaaacaacaatgaatcgtttttgattctgaagtgcacagagaaaagtaattgccagagaaagtcgcagaggtaacagagtgaagaaccttttttagtatatatctttgttgaataatcacaaaaagaaagtttcctttattgatcggattcgaaggaaacccaaaaaaaaaagagatttgattatttccataaatcgcgaagcttttttccaattgaatcttaggcaatgaatggctttaagtttttcgaagtactagtcgtcaccagggtttagagaaaccatg

SEQ ID NO: 20181 - DNA, 3003 bp, Unknown; identical to SEQ ID NO: 20180
  misc_feature (1)..( 3003): 2750-1469P.txt file - cDNA_ID_1824700; gDNA_ID_1620714; Annot_ID_165577

SEQ ID NO: 20182 - DNA, 3003 bp, Unknown; identical to SEQ ID NO: 20180
  misc_feature (1)..( 3003): 2750-1469P.txt file - cDNA_ID_1824700; gDNA_ID_2926217; Annot_ID_142297

SEQ ID NO: 20183 - DNA, 3003 bp, Unknown; identical to SEQ ID NO: 20180
  misc_feature (1)..( 3003): 2750-1469P.txt file - cDNA_ID_1824700; gDNA_ID_2926217; Annot_ID_203083

SEQ ID NO: 20184 - DNA, 3003 bp, Unknown
  misc_feature (1)..( 3003): 2750-1469P.txt file - cDNA_ID_1824713; gDNA_ID_1620714; Annot_ID_49075
ccgtatagatattgacctcaaacttagggaaaccctaatataagagcaaaccctagcagcgctatctccctcagcctcatctttcacccactactattcgccgttcgcttttccctcgccgtcgaaatcaacatggtatcgttttctatcatccttttctctaactaatcacctgtattcattttcttctttctcttgtctgaatcgttactttcgttgtcatggttacaggcgccgaagaaggataaggttccgccaccgtcatcgaagccggcgaaatccggaggtggaaagcagaagaagaaggttcgtttccgaatataatttaggtttaattggaatgtgtagagagatctggtttgtagtttctgaaattgtgttgtttaagtgaagcttgtaaatggatttgttttgcgattgatgttagattagtgttggagtttgcattgtctttgtacttaaatcgttgctctctttgtttgatggtaaacaaaaaaacagaagtggagcaagggaaagcaaaaggagaaggtgaacaacatggtgctgtttgatcaagctacttatgacaagcttctcactgaagctcccaagttcaagctcatcaccccttccattctctctgaccgtatgagggtatattatcaatctatcaactccttgtttcctcaattactaatccagatctagaaaatgatagttatatcatctggcagtgaattggtttgagcttctattgaatctagtagagaatattgtgaggtgttgataacttgatctactttacctaaaagctgtctgatgttgttggtatgcttgttcaggatatggttctttactttcacataggcttactgtgtgtctaagtagatactcatgtgttatataatgtcaatttggagcttgtcctcaacgtcaagcttattttattctctgtttctcctccctgttttttttttttttctttccataacttaacagatccaaacttgatgtgtttgatgttgttgaaaattcagatcaatgggtcgctagcaaggagagcgattagggagctaatggccaaaggtgtgatcaggatggtcgctgctcactcgagccagcagatctacactcgtgccaccaacacctaagatgtttggtttctttatccacctaagatgtttggcttctttttcttatctcttgttgtttgattcttcaggaacttgttagaatcttttgtttcgtattccgtttttttgagatatatggttatttaaaacgcatcaagacttctaaaattgagtcaatcctttgatatatccgttctagaattcggtaatggagttgttccggtttagttatgcatcaaataatttaaaccgtagttctttattatagggatttgaactaattgaacgaattcattcaaaatattatttgaatgcttggatttattttataaaggaggttatgtaatgtagacatttagattgatggactaatatgaatgaatatgatgaaatgaaaataacgcctacagcccatttgacaagtttcagtgtcccttaatattttgttaataaatacatttacttttcttatttttgtcttctaactaaagaattttagtgtttataattatgctaattggttttgcacttaaagagtaggatttattcaaataatttcccgacataatccatgcgtgatatgtcctttcaatttcgtcttctcacccgttaatcaaatgggcccagcttttcaatccatttgctaatctgatcaaattttcctataacgcttacaaataacaatttgcaaaacatcgtcgtcgatcacaggaaaacttccctttagacatttatttcgccatctcggaagcttagacgttggaatatatatctattttcttaactaaccgctgatttttgtattttcattacaaaaaaaaaaactattgtaatgccatattcaaaatagtatatgctttggtacagtagaaataatatcaaccaattaggataaattttctttccattatataattagtctccctagcttagaggcaaatttgtagtttgtgttacgacgtgtacggactatatagcacctcaaagttgggccaatgagatgaaaatgggcctgggtccacatgcaagcagacaaaagaaatcgacgtgtcccatatgagtctcgtagcaagagtatgggagaaaccagagtcgtccattttttgggttcagtgactgtcattgtcagatatctatagctttgttggtaaaatttcacatgaaaaaattacataataaatagagaagagattttggaagagagaaaatgcaatttagctcctcacgtattagcaatttaagttcttgtcttggtcttccctcgatttcaaacgacattaaccaaaaccagagaactacgaattattcggtgagttctctcattgatacgatcctcttctatatatctccgtgttcttctagcttgaaagcattttaaaagtttttacttttggaggtttcacattctctccctgaacgattttgctttattttgttcagcttcggttctcgtcgaatcttctgtttctctgtcgattcattgatctgaaaatctaaaaatggattcattctgatttaacttttatcttgttcaaactcatttatgatcccaaatttgttcgtttcattctttataaattagaatccttttttgttcttgtggcaattatcttcctccttttctctgttttgaaagatttgttacctgcagaagttaattccattgatttcttgaagatgcagtatctcttgctacttaaaagagttagattttttgtctgatacgttaaaattatgagaggctcgttcgttctttaatctgtgtggtcaaagtttcctactttccgagaatttctttattgttgtgttgttcactttgcatttataatagtttttactaacgagctttacgattctgttcttgtctcattccagctaaaaaaagatg

SEQ ID NO: 20185 - DNA, 3003 bp, Unknown; identical to SEQ ID NO: 20184
  misc_feature (1)..( 3003): 2750-1469P.txt file - cDNA_ID_1824713; gDNA_ID_1620714; Annot_ID_165570

SEQ ID NO: 20186 - DNA, 3003 bp, Unknown; identical to SEQ ID NO: 20184
  misc_feature (1)..( 3003): 2750-1469P.txt file - cDNA_ID_1824713; gDNA_ID_2926217; Annot_ID_142291

SEQ ID NO: 20187 - DNA, 3003 bp, Unknown; identical to SEQ ID NO: 20184
  misc_feature (1)..( 3003): 2750-1469P.txt file - cDNA_ID_1824713; gDNA_ID_2926217; Annot_ID_203076

SEQ ID NO: 20188 - DNA, 59 bp, Unknown; identical to SEQ ID NO: 4584
  misc_feature (1)..( 59): 2750-1469P.txt file - cDNA_ID_1824741; gDNA_ID_1620715; Annot_ID_49111

SEQ ID NO: 20189 - DNA, 3000 bp, Unknown; identical to SEQ ID NO: 4573
  misc_feature (1)..( 3000): 2750-1469P.txt file - cDNA_ID_1824783; gDNA_ID_1620715; Annot_ID_49096

SEQ ID NO: 20190 - DNA, 3003 bp, Unknown
  misc_feature (1)..( 3003): 2750-1469P.txt file - cDNA_ID_1824787; gDNA_ID_1620715; Annot_ID_49095
tggattaattaagatatcatacaaactaatcataatttgtagtctagtaccaaagtttgtattatcaccaattccagaatttatgcaagtttgccgataagtatgacaaacatgcatacatattctctttgtcttataaacccaaaatgttttagtatactctattcgtgccaaaaaaaaatatgaaagaaggtatcctccaactataatcaaacatcaccttttaaatgatttactaaaatggcacaagatcactcttgttctgaagttggttactagtgaaacatatatagaaaaatgaaaactggattagcaaaaaaaataatgtggaattaaaatgaattttaatcttctattttataatgaattgtaattggataaatggaaatgtttttcctatataagtttaaaaacataacgagacgaaaattttctaccgttaacaacaaagatgttcttgcaaataagataagcgtttttttattgcacaaatatatctataaattttagataaaatataaattcttacccattgagatttgcataatactattcagagtgttttttttccctttcgttaaagactactagtcagagtgttaatctagtaattcaccaattaatttaactatacttaaaaatattacagtttttaggaaacatgctagaaaaaacatatataattttgcaattatattattccatgcatacacatgtagagccaaaaacggagaaaaatcttctatataaacacaagttgaaaccattcatgtttattttaagcagttgcagtagactcttccacttctgtattcaattcttccttcttttttctcttataatataaataacatacaaagaaaatacttgcactcacaaatattgattaaagttaattagtgaaccctaagatttataaatctctagctatactctaccatatcatatatattacataatgtctagcagaaaatcacgttcaagacaaactggagcttccatgatcacggatgaacaaatcaacgatcttgtcctccagcttcatcggcttctccccgaacttgctaacaacagacgctctggaaaggtacaacgttctaatcaatttttcattatgattccttttaaaaaatttaatttcctctttcaaaccttaaatcttttctaaacctttttaaatcttccttggattagtagtgggtacttaaaagaacaaacctccggtttaaaaaaaataaaaataataactaatatatatcctccatcaaagtttaacagtaattctttcatctttctgttgttgcaaacaaacgagagtctttagttagaattataaataaatattaaactaatattccatatattccaatattgcatgtatgtattgattcatttgattgtgatgcattttgtgacgagtgctaaattttaatttccaaactaatcgacaataaatagcatgctgcatgcatgataattaaattgttaattatatataagatccttcttcttatcaatatattggttactttcaggtttcagcatcaagggtattacaagagacatgcagttacataaggaacttgagcaaagaagtggatgatcttagtgaaagattgtctcaacttttggaatcaactgattcagctcaagctgcactaatccgaagtttgcttatgcagtagaattagtgcaataaacgaaggatatttttttcttttcttttttttgaaaaaatgtcttctcagttttaattccccttcttattgtatttataatgtctggcagcttgtgtcccctgttaattatgcaatgttttatttttaatatatgtagggttttgtttttgtcagttgttgaacgaagcaaatggtttgggtttacgttcacattatttaaggcaacacactcaatatatgggcttaggtatttcttagattctaggcattccaaccaaatccatcacattttagtagcaaaaacattgattaaattttgaatttacgagaagaacaatgttttctagtgtcatgcatatacgattataacggtgtttttgtagttaatatcgataggaactaaactaacgcaagtcaaattttctgatcaaaattagtcgttaatttcgcttaatggtataaagtatattttaagaaggaataaaatatgctaataagcccccacggtttccatttctggtaacaagaataccattcaacgtctcgatcagcagcaacgttgaatcgttgatatctatatatagaagtatagaaccaaggggtaatttggtcattccagttctaacccacttctattacaagagcagtttactacgtaaaaacgaccggccttccactttcccgaaaacagccagcgcccgcacgtagagatttactgcatattcagttttcagtaaataaatagtccacaaaattagtggccttgcgtgtaaaaaattaaatttcgagatgctgtttaataaatgtatttattgcaaataagaaatcagatagcctttaatagttgacaaaaaatagccttttatatttacaagttcgtgtatttgttaataacgtgggattaatgagtttaatgtaatcgtgacaaaaacaaaagtgggattagtgtaatcgtgtgaatgtggacacttctccttcacggcaaaaggcacaagacgcaacaaatattttaatagaaaagaaaaaaaacgaaaacagacaacaaaacccaaaacaggaagacttaaacaaatcagaacacagtgtaagaaaaatcttttccataactgtatttttaactattcatatatatatgtttagtctctctgcagtttgaattcaaacatttgtgctctctcatctcaaaaactacactaaagctataaatcatcaatcatctaaaatcttcaaaaaggttttgattctgacttcttggttttcttttttgtaacgaattcatgatttttgagtctgattctgtgtttccttttgtttctcagcaatg

SEQ ID NO: 20191 - DNA, 3000 bp, Unknown; identical to SEQ ID NO: 4571
  misc_feature (1)..( 3000): 2750-1469P.txt file - cDNA_ID_1824794; gDNA_ID_1620715; Annot_ID_49093

SEQ ID NO: 20192 - DNA, 3003 bp, Unknown
  misc_feature (1)..( 3003): 2750-1469P.txt file - cDNA_ID_1824798; gDNA_ID_1620715; Annot_ID_49092
gaggttcatgaagcttgatccatgactatatggatccatagactagttctctggttggtgtaagaaggagcgggaaagattgtttttggtgtgtgtttctagtgtgtttctggttaggtgtttaaataacaagaacaagagttaatagtgtctggtaataatatctggttggtgtttaaaagttaatggtgtctgttttaagtgtgacatgacaatcaactaccaagtatcaaccacataccgacaacaagcattcaataaaagccatatatagtcatctaatataattcatgaaaagtcagaggttcaaagatataaggttaagattgttttaccttctatgagccttccattcggtaattgtatccaattcttacacaacagacatcaatcattctagcaactgtatccacttctccatttaacctcaacaaaaacagcataacaaaaacaagtgttatgtcatgaacgtaagacacaataaatctacaatcaaatacaaaacaagtctgtaatcaaatacaaaacaaatctgcaatcaaacataagataaatttacgataacaagcaaacatatatgtacttaaccaacataaaactgtaatcaatcaaaataaatctgtaagcaaattgataaaattaaatctgagtgtactaataaacaaaattgcaaacaaatccaacgacaaaatcctagttctacgaacggcaaacgacggcaaatcccaagaaatagcagcaatcaaaggaagacaagacaaaataaaattgtaacaaaaaaaaatacagattcgttggaaaagacaactccatgagaacagagaattggacagcaacctatgagaactaattttcctatcatcaattcccaattgtgaaaacccctaatttctgaaacaaatataaaccctaatttactatctacaactgaaaacaaagagaaataacacagatttgtaccatttatcatgcagatgatgataatagcggctcaaacaagtaattatgacttgcaactctctcaattcgaaggatgaaatgttggagagattttgccggcagaagcgagagataaatatcatgatggagaagaacaagaaagagagagagagagatgaatatcacgatggagaagaacaagaaagagagagatcgtcggattacaatggtcgccggcgtcttgagagagatggagagaaagagagaggaaaaacagaaagagaaacacgagtgtttttttgtttcctccttttatttattttttctacccactcaaaacacaacatgtgtactcttcttagttttaagaaaatatcttaattaagatgtttatcttagctaagatttgttgatctcattaaatttaatcacttttatacttaagaattagctaagaattgtctaagaaccaaggttggagttgctctaaagtcacaacgtatttctgacttccacgtcttctatctatttacaatttacaaaatcaatcaagcttttcaaatgcggtttaaaattgattaaatcatagttttagatcacataatctaaatcaaatttatgcttgtattttcatttgattttgacagaaaccaaaattttggaaatgaaaattgcaaacaacaattacataacaaaagaactgttatggttttgctgttctttttgggcaaactagttatattgatagaagaacaaacttgaagtagcagacaagtagagagtgcagttttagccaaaacgttagctaaccgattagacttgcaggaaacaaaagagaacttgatatgaaaaaaaaaacgactaagaaaggcaatatcgtggagaatcccttgtagattgttcgtagaggtctttgtatttagcagagatataaagacttgagagtcggagaaaacgttgatggaggtcaattccattctagtcgctgcgatcaacactgatttcatagctaaagccgaggtgagtgtgtgcgtgttgcagctccatggtggaagactcgattgttctaagttttgaaaagccaccccattccgcacaaacctgcatttgcagtctagaccgtatcaataaagcaagaaacaacctctctaggagataagatatgtatggaatcctccgtacaaggaagaaagatcaaagaaaccttagtaataaaaaaactgcatggatctggatttttggtgtcaacatcctccattacatgtattctgtatatttctcaacaaccttgaaataatgaaattttcaaattggattttattaatttgagtgaaagactactaacaaaaagttcttatccacctttatcaaattttctccattgttatgtaatccaaataaacattgtcctgcgtacaacgcatcaagaacgtatgaaatcaatattgcaatttgcaattgtattagcttaatgaaaaccaaatttggtgaggattatattttgaaatattgtggtttaatgaaaacccgtaaatcttgacaaaaaaacaaaacaaaaaaatgagaacccgtaaataaacgttgtataagtaaacgtggcattatattttagtagatttacgggtttgagatattttggttgaggtttactatatcatttaaattgggattctatactaaatttggtgatttgaatttaaaaatctttcaagaaatctatcaaaaatattctcatataatatgagtatttgtttttttttgtaaaagtgttggtcatatagaattaaataattaaaaattggccatctttccagttgccgttgccagccgtttcctacttgtgctttttcacttttccgttctctcaaaccttttttctctgcttccgtttcgtttctccgttcaaaacaagatcgaatcataaaaagtttcctcctttttttcttctcgaaacaaaagagaattcttgacgtcttctactccattttccatcaatacccatttcttctatcgctctcgtttccaagaaaaaagagggttttagagagaagcaaaactcaaatg

SEQ ID NO: 20193 - DNA, 3000 bp, Unknown; identical to SEQ ID NO: 4591
  misc_feature (1)..( 3000): 2750-1469P.txt file - cDNA_ID_1824809; gDNA_ID_1620716; Annot_ID_49124

SEQ ID NO: 20194 - DNA, 3000 bp, Unknown; identical to SEQ ID NO: 4591
  misc_feature (1)..( 3000): 2750-1469P.txt file - cDNA_ID_1824809; gDNA_ID_1620716; Annot_ID_165653

SEQ ID NO: 20195 - DNA, 3000 bp, Unknown; identical to SEQ ID NO: 4591
  misc_feature (1)..( 3000): 2750-1469P.txt file - cDNA_ID_1824809; gDNA_ID_2926190; Annot_ID_141003

SEQ ID NO: 20196 - DNA, 3000 bp, Unknown; identical to SEQ ID NO: 4591
  misc_feature (1)..( 3000): 2750-1469P.txt file - cDNA_ID_1824809; gDNA_ID_2926190; Annot_ID_200975

SEQ ID NO: 20197 - DNA, 3000 bp, Unknown; identical to SEQ ID NO: 4590
  misc_feature (1)..( 3000): 2750-1469P.txt file - cDNA_ID_1824833; gDNA_ID_1620716; Annot_ID_49117

SEQ ID NO: 20198 - DNA, 3000 bp, Unknown; identical to SEQ ID NO: 4593
  misc_feature (1)..( 3000): 2750-1469P.txt file - cDNA_ID_1824833; gDNA_ID_1620716; Annot_ID_165644

SEQ ID NO: 20199 - DNA, 3000 bp, Unknown; identical to SEQ ID NO: 4590
  misc_feature (1)..( 3000): 2750-1469P.txt file - cDNA_ID_1824833; gDNA_ID_2926190; Annot_ID_140996

SEQ ID NO: 20200 - DNA, 3000 bp, Unknown; identical to SEQ ID NO: 4593
  misc_feature (1)..( 3000): 2750-1469P.txt file - cDNA_ID_1824833; gDNA_ID_2926190; Annot_ID_200968

SEQ ID NO: 20201 - DNA, 3003 bp, Unknown
  misc_feature (1)..( 3003): 2750-1469P.txt file - cDNA_ID_1824837; gDNA_ID_1620716; Annot_ID_49116
aaatagtaaagactgaggtagtgaaaagcaatggacaggcattggttgaggcgtatgagtacacagcacatagcagcgttgctcatagttactatttaccagtggccaagtttcactttgagctctcaccgatgcaggtaggcttaaacattttttgtttgctgcctttctcacatgtgttacacagattagggatggtaagatgggttggaattacactctgctcatctttctctttgtttgtttgcaggttctcataacggaaaactccaagtccttctcacatttcatcaccaacgtatgcgccattattggtggtgtcttcacggttagtaaagaagtttgaagcctcttcttcttgtaactattcattaatgtattcccatatgactcgtatttttgcctcttttcaggtggccggaatcttggattctattctccatcactccatgacactcatgaaaaagatagaacttggtaaaaacttctgaagctccctaagggttttatttcgttttcctctgtaacgagtcagaaatttttgccctagttataccagacgtcacttaaataattcggttatatatattcacaaactgttatccttttgaacatatataagtattatcgatgtctctgaagtctttgggagttttagtagaacaaattgttatcacttaaatcaggggaatttacttccaaattctccaataccaaaatacagcttcttgtgagttggttcatactgatgatggagaaatgtaatttttagccaacaaggtttcaactttcaacgtttgaaactagatttgagcacaaatatagcaatcaactttcccccatggctgcttatagcaatcatcgacggaagtcacagcagaacggagagtcctctcgttccctttggacagagttgcatcctctactagaattttacttaggtagaagtaagtatccacagtaaagaatctccttcttgttacaattttcaattttgtgttctcttcaagctaattattagtttagttagcttagcatgattcaactttagccttggtatagaatcataacatagaaccatataaacgaaaataagactaagatcaaaagaacaaaaaactttgagttttgcaaacaaggtttcaaacttgaataatgtctgataattgagcacatactgatattgatagttccaaaaacactaatttccgaatccaaaatcaaaaaagaaagacaacagaattgtagataatatttgatcaggcagtgatctccttcttgagttttgcaagctcttgcctgacaacaccagctttctgcaaacagcaaaaaaacccattaacatttcagttctgacatgaatgaacactaccacagaatttcaaacatctaacaatttaacacactgaccttgatcttggccaacatgatcttgaacctatcaaagtcgttaaggttagccctacgtttctgcacgataagcttcctaccccatgagcttttctcccacttgttcttcacatctgcaagacttttccagttaagattgaaacacttcaaaattcaaatatttacattacgcagcactcaccagccttttccattgcctcgatcaaagccttcttctttggcacacggttgatgtcaatgacaatatcggtaagagacaacctcttgaagttcatctggatcctctccatatcaggggcatccaccaaagcctaaatgacgagaacataataagaactccataaaaacaactagacaatattcagctcaatattcaccaaggaaatgcaataggctccaatcaatgatgcaaactgagttataactgtaagccaattatgcaaccaaagtctcaagctaaatcaaaattttccttaatcaaacaatttaccgaaacatacacagtagcattacggaatcaagcattaaaacagctgaaactcatcaatacatacatgataaagagatggaaatcttcataacctaagaatgaaataaacttactctgttctggtcaacaacgtcgacgataacgacgagctttccatgatcttctccgtagttcacaagtgctactctcccgatctcaacgtacctcttgaaaccctaaacaaccaatcaccagaaaatattaaatctaacaactttggactctaacctatacacaaacgtaacttgattgagaacgtcaaaagcctaatccccaaaaaaaaagatctagaagaaagaaatccgaaatgtgctatgaacatgagctaaatacaggagataatcacgtagaacacagacgaactaaccaaggtattagctcaataagagagtatatctcaccattttcgccgccggtagattggaaggtctaagctccgagtgtaaatgtagacgagcgacagcagaggaaaaaatcgattaggttttgcactatatataatcttcattctagggttttgtggtttgggcctatctttactaaataaatatcacaaaggcccaacattaaacgcccaatatggtaaagagagaaaacggcgtcgttttatgttggatatttttgggggaaaaaaaaaaaaagacacagtgtctctttcatgtggaagaagataaattagagagaagtgatggagaaactccgttatttgtggaggcaacaactattgtgtaatgagaccagctcatcaatcatcatctccagaaaaaaggaatgatacaagaaacttagttgatagatagacgacaggaaaataatatacgcagaaagaaacctaaaaaaaaaagtttctgtctttagactccaatccactaagctccaagctgggtccccttaaattctcaatctttttctccctaaatttcctttaatttcttcattgatcattgctcattgatcgatcttctgagttttgaggggaccccgatccaaagtgtatctctttctgttttgctcagcatttggatttgatttcttttttttcccgggaaagtttgatagagatg

SEQ ID NO: 20202 - DNA, 3003 bp, Unknown; identical to SEQ ID NO: 20201
  misc_feature (1)..( 3003): 2750-1469P.txt file - cDNA_ID_1824837; gDNA_ID_2926190; Annot_ID_140995

SEQ ID NO: 20203 - DNA, 3000 bp, Unknown; identical to SEQ ID NO: 4614
  misc_feature (1)..( 3000): 2750-1469P.txt file - cDNA_ID_1824862; gDNA_ID_1620717; Annot_ID_49137

SEQ ID NO: 20204 - DNA, 3000 bp, Unknown; identical to SEQ ID NO: 4614
  misc_feature (1)..( 3000): 2750-1469P.txt file - cDNA_ID_1824862; gDNA_ID_2926189; Annot_ID_140915

SEQ ID NO: 20205 - DNA, 3000 bp, Unknown; identical to SEQ ID NO: 4603
  misc_feature (1)..( 3000): 2750-1469P.txt file - cDNA_ID_1824872; gDNA_ID_1620717; Annot_ID_49134

SEQ ID NO: 20206 - DNA, 3000 bp, Unknown; identical to SEQ ID NO: 4603
  misc_feature (1)..( 3000): 2750-1469P.txt file - cDNA_ID_1824872; gDNA_ID_2926188; Annot_ID_140912

SEQ ID NO: 20207 - DNA, 3000 bp, Unknown; identical to SEQ ID NO: 4622
  misc_feature (1)..( 3000): 2750-1469P.txt file - cDNA_ID_1824899; gDNA_ID_1620718; Annot_ID_49155

SEQ ID NO: 20208 - DNA, 3000 bp, Unknown; identical to SEQ ID NO: 4622
  misc_feature (1)..( 3000): 2750-1469P.txt file - cDNA_ID_1824899; gDNA_ID_2926154; Annot_ID_139420

SEQ ID NO: 20209 - DNA, 3003 bp, Unknown
  misc_feature (1)..( 3003): 2750-1469P.txt file - cDNA_ID_1824911; gDNA_ID_1620718; Annot_ID_49152
ttttttttgaagcaagccaagagggttaaaaatcaaaactaactataggtgttgtttacacatactgtatttacctgttaatcagtttttaattacttaattaagccatatccacatgactagaagatatctttaactcagattgcaacatttatatattatgttttagttattgatattcttacttcattataaatccaaaagatcagcagaagattgatacaatttttattagatcacaatactataagcattatcattaaattgtgagaaatctagcttagacatttgcttcttaattatttcctttaatttgacttgtttttgtttttgatatactgatttgatttttgaaattttaatttcagtatacctaaaacagtagaaagatatcaaaagcgaatacaagatctcgggtctaaccataagagaaatgataattcacaggtaaccaaacttcatagaattgttagtttatcatggttattttcatatatatacatttgctaaaaatatacttatccagagctcaagtaaaaagaaattctatatcaatatctagtacaattttatggtgtagatcctttggtgtaccacttttaaaaaattaatatacatgctaaagtgtatgctttatttatcgaacatgggtgataattttttatattaatatttgtacttacaattttggttaagaaaatatgttttgcatttctcatgatcaaaccttgttgacagcaatcgaaggacgaaacctatggcttggcgagaaagatcgaacatttggagatttcgacacggtttttgaactcaaaatacttatacgaatattttgttatgaatgtaacgtttacattgtaagcgtctatttaccatatgtttaaaaaatatatacatttgcagaaaaatgatgggagaaggacttgacgcatcttctatagaagagttacaacaattggagaaccagttggacagaagcttaatgaaaataagagccaaaaaggtaacttctagattattgtatatgtgatcatttcttagttttaaaataaaatcttcactcttatcatatggttattgtttcatcgagatttatgacaatgacgtggtggccgcctggttcgattatcacaaatgagttgattatgtaaacaatataaacatgggatcatcctataaacactccaaatacacacatacacacacacacacacacacacacacacttggaggcatgcatgcatgcatgcatatgtgttgagaaaagacttatatgttatcttcttcttcttttttgtcatcaccttatatgttatctttaatgagtcttttaccaactaatttagctatttaattccttaatttcagtaccagttattacgagaagaaactgagaaattaaaagaaaaggtaacatgtagcttttttattaatttagtacaaatgtattggtcaggtactaatcatatttcccataattaaacggttaaaccatatttcatggtttattgtcaatattttaggagaggaacctcattgcagaaaataaaatgctgatggagaaggtacaaattaatattaacttacgggctgatttatgttctcaattctcattctattattatgaaattatctgctttttttcaaaaagtgtgttttaatttgaggaaatgtgtgaatgaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaacatatatagtacaatgcttatatagatattatgtagggaattacttttttccctgaagaaaaattgatgttacttactgaatttagcagttgcataaaaaaaaagattactgcatttaagctttgctttttttttctttttgtttttttcttttgtatcgtctcacccaactttgcaatcctaaaataatttcagaataaattgtttaacaggttttttatttaacataattttttcatatctttttaaaaataattgtttagaatataactaatttgatcgatatattatatgttcgggacaagttcttggagagtgaaaacaaatccgggtgcgtagctaggtcggttccctataatggctttgcggataagatctccatgtttcatgctagacatgaagatgatgtatgatttatatacgaataatgggtcagttggaaagatttttgaatcctagtagaggtatggtcttttgaactcgggaaaagttgcattgcaccgacctcttaaagtccttttacacttggtctagacccaaaaatcgttggctttctatgatcggtctttgtcagcgtgtcatttacgtgacgtggttggtttggttcgaaatttctaagtagctgaaaattcagttccgttccttccaagaacatcatcttgaagtagaattctttgtgacaaacaaaaaaaaatggtagaattctatggttatatatatatatatatatatatatatatatatgtttattataacaacagacctaatatcttctatgttttatgtaatatctatttattttttgttatttattgaacctacatacaaataaaacaaaacaaagtaaacttctaaataatatatttttcattttcattttagttgaaatataatttgattttcaataccaaactatataatatcaatattcagaataagttaattgttacgtattaaaaacaatgcaagaacaaatgaagaagccaaaatatccaaaatgaatagtagaagtcaaggtcaacatagtggactctaacaatatcaacgaagtcaaccgttgaagaaattaaataacttgtctaataagttcttcttttttcttggattaaatacttgtttgaagcaaattcagagacactgtcttcgtcttcatctttgctatg

SEQ ID NO: 20210 - DNA, 3003 bp, Unknown; identical to SEQ ID NO: 20209
  misc_feature (1)..( 3003): 2750-1469P.txt file - cDNA_ID_1824911; gDNA_ID_1620718; Annot_ID_165723

SEQ ID NO: 20211 - DNA, 3003 bp, Unknown; identical to SEQ ID NO: 20209
  misc_feature (1)..( 3003): 2750-1469P.txt file - cDNA_ID_1824911; gDNA_ID_2926154; Annot_ID_139417

SEQ ID NO: 20212 - DNA, 3003 bp, Unknown; identical to SEQ ID NO: 20209
  misc_feature (1)..( 3003): 2750-1469P.txt file - cDNA_ID_1824911; gDNA_ID_2926154; Annot_ID_198254

SEQ ID NO: 20213 - DNA, 3000 bp, Unknown; identical to SEQ ID NO: 4621
  misc_feature (1)..( 3000): 2750-1469P.txt file - cDNA_ID_1824921; gDNA_ID_1620718; Annot_ID_49149

SEQ ID NO: 20214 - DNA, 3000 bp, Unknown; identical to SEQ ID NO: 4621
  misc_feature (1)..( 3000): 2750-1469P.txt file - cDNA_ID_1824921; gDNA_ID_2926153; Annot_ID_139414

SEQ ID NO: 20215 - DNA, 3000 bp, Unknown; identical to SEQ ID NO: 4620
  misc_feature (1)..( 3000): 2750-1469P.txt file - cDNA_ID_1824925; gDNA_ID_1620718; Annot_ID_49148

SEQ ID NO: 20216 - DNA, 3000 bp, Unknown; identical to SEQ ID NO: 4620
  misc_feature (1)..( 3000): 2750-1469P.txt file - cDNA_ID_1824925; gDNA_ID_1620718; Annot_ID_165716

SEQ ID NO: 20217 - DNA, 3000 bp, Unknown; identical to SEQ ID NO: 4620
  misc_feature (1)..( 3000): 2750-1469P.txt file - cDNA_ID_1824925; gDNA_ID_2926153; Annot_ID_139413

SEQ ID NO: 20218 - DNA, 3000 bp, Unknown; identical to SEQ ID NO: 4620
  misc_feature (1)..( 3000): 2750-1469P.txt file - cDNA_ID_1824925; gDNA_ID_2926153; Annot_ID_198234

SEQ ID NO: 20219 - DNA, 3000 bp, Unknown; identical to SEQ ID NO: 4619
  misc_feature (1)..( 3000): 2750-1469P.txt file - cDNA_ID_1824929; gDNA_ID_1620718; Annot_ID_49147

SEQ ID NO: 20220 - DNA, 3000 bp, Unknown; identical to SEQ ID NO: 4619
  misc_feature (1)..( 3000): 2750-1469P.txt file - cDNA_ID_1824929; gDNA_ID_2926153; Annot_ID_139412

SEQ ID NO: 20221 - DNA, 3000 bp, Unknown; identical to SEQ ID NO: 4618
  misc_feature (1)..( 3000): 2750-1469P.txt file - cDNA_ID_1824933; gDNA_ID_1620718; Annot_ID_49146

SEQ ID NO: 20222 - DNA, 3000 bp, Unknown; identical to SEQ ID NO: 4618
  misc_feature (1)..( 3000): 2750-1469P.txt file - cDNA_ID_1824933; gDNA_ID_2926153; Annot_ID_139411

SEQ ID NO: 20223 - DNA, 3003 bp, Unknown
  misc_feature (1)..( 3003): 2750-1469P.txt file - cDNA_ID_1824937; gDNA_ID_1620718; Annot_ID_49144
ggttctaccaagtccatccaaatgagtttcacaaattagcctaaatttacaaagtcattcacatggaacatccaaatgattcatctaaatgatctgttaatttgtaaaaaacaaacatcatttttcatctccatctagatgatccatatggatggagaaacaaacaaggcctagtaactttttggatttgagctctcactttttatttttgtcaatatcttttagatttcgattatgttttcatggattcaaatcatttgaatgagatgttaacaatgtttaaaaaggtttcttaattatatcatcaactattcaactttattcttagttagttatatctgtaactttatattttagggaactttatacattattggctttagaaaacaaaacaaaagtcttacgagttttaaagttatattaagctatcttctaatccacgtgggtgcattgctcaaacaaagaacagaagaacttattattggcttattaatttactactacttttgatatctttttcatcacatgactgatcactagtcattgtttttgttaccaccgatattgcgaatcgtggaattgtcagagtaacatgtaggatcattatatcaatatctaatactgatagctcgaatatattgtgtttcttctggttgttcgaattttttttgtacataacacaattcgagattcaaatgatcagattttagatttctagttactcctaagaaaaaaaaaatgcttagcaaatcagattttataacattactactataccttttttgttttaatgattacttcgaatgattactttcgctgatataaaaaaataaatcgtgatctaaactttcatatatctactggaattttacaaaagctacgtaacaaaattgataaagtgatgagcatgttacgttgccacgtttcattttttctataataaatagaactgttcattcgacaatgggttagtggttgtacgtatatatatatatgctcgctaattggacggtgcgcaacttcaagcgttttaaattatgtggcacttaacttgtctgtcgaattagtaattactttcgctgatatatatcactctccgagcataattaatttcatgctatcaaacaaaaaaagattcatgttatacttggtttggttgaatagaaactgcgtggactttaaattgatagataactttaagtataaaaataagaaaattaaactgctgatgtctccaaaaagacaaagtaacacatctaaaatctacgtatgtggatgtcatttgatacacgtataaacaaggtgtagttaatccaattaattaaaggaggagaaagtggtacaatggaccaatatggatatattttatgctttacaacgattgatgcaaaggtatcttcgtgttacacttcattattacatttatagattggacttgggcctttgctgattgtgaggactgatgactgatgagaagcatattggttgggttttatttgaatcataaagaaattaaaagagactagaatatgacccgcggtatatcgttatattctgtagtaaaaatataacgattaaaagagattacatataattgcattttggtaaacaagaaaaaatattataattgtaacttgttatttagatttctgtataatgtcttataaatatttgaatactgtaatttactcgatataatattgtaacgaaccttaattttttgtagctataatatttttgacaccgatacatagaatttaagaaactataatcgataagttaacattacatggtagttaaatttaagttacctttttaacaatgcttgtccaatattactacctaagaagatattcaacgaaaaatagattgttacaaatctaaagtttaattttgaaaattttcttctcaatatatacacaaaaagatacttattcaacaaaaactcatatctctcctatctcaaaaaggaaataaaaataaaaggataacgacacaaacatgaatctctatccgaatctatctgtcccgtttataaattaccccacagagctcagggccattgttttttttttcttggtgaaaatagggttaagagaaaacccgaaatattagcgttattgataactaagcaacagagaaaatctggggctctctttctctctgggcttttgctatataacttttgaggtatatagtctcttgatttttttttctgtgcatgaaaaaaatgatgagtttttcagtaatctttcgaagccgaatttgaattctttgaagattgtgacatttattgtagttcctcctccatttaaagctggtaaacaaaagtgctcttcgttgtttgcattttggttttccccattttgctgccggagataacgagggaaattataactcactaggatacatatttttttttggttttattgaattctttcatttgttttcttgttgcttattttattttataattttgtttttcctctggaatctgttgtatatgctgagaaaacactggaagatgccaataaaatagaaaaatctcgtttctttttgttaaaagtcgtcgttattacttatcacgagtattatgtgatgctagacactcattatcaaatagccgttttcttaaaagttacaatttgtttaaagctgtgtatttaatcgaaattttcaatttatttctctttgtgtactaatttcttctgcttttttcagaatctaaattcaccaaaaatacgaagaagaacgagaacaacaagaggtaccacacatttgtgattttgcttaacttttgtttgattataagttgactctttaattaaagaaaatcaacaatcaagttaataacttttgacttgaaaattttaagtccaaattgatacaaaggtataaacaaagaagtttgtagtatatatatacttgtataacaagtttagtcttaatgtaactagtctttctctagacatgtctctgattcttgttttgttgtagaaaatg

SEQ ID NO: 20224 - DNA, 3003 bp, Unknown; identical to SEQ ID NO: 20223
  misc_feature (1)..( 3003): 2750-1469P.txt file - cDNA_ID_1824937; gDNA_ID_2926153; Annot_ID_139409

SEQ ID NO: 20225 - DNA, 3003 bp, Unknown
  misc_feature (1)..( 3003): 2750-1469P.txt file - cDNA_ID_1824945; gDNA_ID_1620719; Annot_ID_49169
tatgcttgccgtaaaagtacggttacgtacgtagcgggtttgaaccaatcactaatggtaatagccaatcccaattggcagataatgttataaccgtcagattcaaattcgaattaaagggagccttggcatctgaacggttcagatttgatctttcttcttttctctctctctctctctctctctctctcagtttcagagatcaaaagagaccaacgaagaaaaaagcaccgcttttgcagaatcggtgacgatagaaagagaaagacagagagagagggagggttagagagtcaggggctatttgattcccctggaaaatttcagatatttgtttcttcatcttctttccttatttctctctttctcgtttttaccagatttgtcttacgaatcaattctcaaagatacccaaaagtggtagggaagcaaagtactgttttattttgcttttgattctatcaaaatcagcggtgaaagaaaggaattttttttattatcagagaaagagagattcttgataatcgaatagacctagatttttttttgaatttagggcttttttgatttttgagaaattgattgtggtaatggagacagatagtatggagtgcgtctcatctacgggtaatgagatccatcagaatggtaatggccaccaatcttaccaattctcttcgacgaagactcacggcggagccgctgctgccgccgtcgttaccaatattgttggcccaacagcaactgctccggccactagcgtgtatgagcttctggagtgccctgtctgtacctattctatgtatcctcctatccatcaggtgaatctccgatgctcttttggttgtttggttctcaattgattcctaatgatacgttttagctttatgtgtttgtgttcttctctgcctatatgttgtgtagcgtttaatggggatatagattatataatgtggttgttcataggttttgatgttgcttgtatcctagaattgagccaggggaagtaattgatctgaaaagtgtgtctcttttttgttattgttgttgttgcagtgtcataatggacatacattgtgctcgacctgtaaagtgagggttcataacaggtgtcccacatgtagacaagaacttggagatattagatgtttagctcttgagaaagtagccgagtcgcttgagctgccttgcaagttttacaatctgggatgtcctgagatctttccttactacagcaaactgaagcacgagtctctctgtaacttcagaccttacagttgtccttatgctggttcggagtgtggtatcgtaggggacatcccttttcttgtagcccatctcagggatgatcataaagttgacatgcacgctggttccacttttaaccaccgctatgtcaaatccaatccgcgtgaagtagagaacgctacttggatgctaaccgtgagcatatccttctttgtctaggaaaacatgattctcttcaatgttttcggtaactaaactgactgtttcttatgtgggttcaggtattccattgctttgggcagtacttctgcctccatttcgaagcgttccagcttgggatgggtccagtatacatggcattcctgagattcatgggggacgaggaagatgcacggagctacagctacagcttagaagtgggaggcagtgggaggaagctaacatgggaaggaaccccaagaagcatcagagatagccacaggaaagtaagagacagcaacgacggtctcatcatccaaagaaacatggctctctttttctccggtggagacaggaaagagcttaaacttagagtcactggtaaaatctggaaagagcaacacagtccagattctggactttccataccaaacctatcttcttcctgatcattcttttatctttttgttttttctctctttgagaaggaatgttgtatgatgattcgtttgcactcttcttctttgtctgtatctaaaacatatcatgaatgaatgtttcatcttatagtctcatattttggcagatgcattacaatttagatacatggagataggagatttgatcaagtgaaacaaaaaaaaaactaagtgattccgtggtaacaagtaacaacttgttcaaacgcaactaaaatgtgtttatgaaaaaatggaggtgcggggaatcgaaccccgtgcctctcgcatgcgaagcgagcgctctaccatatgagctacaccccctgtttgatttctgataacattaaactaattctattttttgctaacactgtgattaccataatacaatatccaaatgtatagtgtgagacaagaccatatatgtaaaatatttagtctatgttaaacaagttgcccaatcgacaaattattaggaggattgttgatgtatatatgcatttatcttaaaaataaaatctaccaatattttcaaaagtgttcaaacattaaattgatatcaaattaataaatagaaaagataaggttaaatatgaagttattcaattcatataagttttaaagattatgtaagattttctcttaacaagatttcaacaaatctttttaaaagatatacgagtatgaaaacaaatcctaagcttttttattttccaacaaacaaattcttgagctttaaaacaatttaaatgtcctaaattgtataatctaatctaatgttagtgaattgcaattattcaaattattaacttaatagataaataggaaaaaaactaaataaggaaagttaggaattgaggaaaaggaaaaatcttagaaattgaattcgagagggaattaaaggaaaaaggcctaatacaaattgaaaagggtttttaacttttaagttctgtttcttctagaactttactttttagccttcgtggctttccctataaatttcccaatctttggccatcggacgatcaaagaaactcattctgatttttaatctctgacgagcaaagaaccctacagctaaaagattaaaccaatg

SEQ ID NO: 20226 - DNA, 3003 bp, Unknown; identical to SEQ ID NO: 20225
  misc_feature (1)..( 3003): 2750-1469P.txt file - cDNA_ID_1824945; gDNA_ID_1971690; Annot_ID_175081

SEQ ID NO: 20227 - DNA, 3003 bp, Unknown; identical to SEQ ID NO: 20225
  misc_feature (1)..( 3003): 2750-1469P.txt file - cDNA_ID_1824945; gDNA_ID_1620719; Annot_ID_165750

SEQ ID NO: 20228 - DNA, 3003 bp, Unknown; identical to SEQ ID NO: 20225
  misc_feature (1)..( 3003): 2750-1469P.txt file - cDNA_ID_1824945; gDNA_ID_2926191; Annot_ID_141070

SEQ ID NO: 20229 - DNA, 3003 bp, Unknown; identical to SEQ ID NO: 20225
  misc_feature (1)..( 3003): 2750-1469P.txt file - cDNA_ID_1824945; gDNA_ID_2926191; Annot_ID_201081

SEQ ID NO: 20230 - DNA, 1518 bp, Unknown
  misc_feature (1)..( 1518): 2750-1469P.txt file - cDNA_ID_1824945; gDNA_ID_2926192; Annot_ID_201113
aatgttttcggtaactaaactgactgtttcttatgtgggttcaggtattccattgctttgggcagtacttctgcctccatttcgaagcgttccagcttgggatgggtccagtatacatggcattcctgagattcatgggggacgaggaagatgcacggagctacagctacagcttagaagtgggaggcagtgggaggaagctaacatgggaaggaaccccaagaagcatcagagatagccacaggaaagtaagagacagcaacgacggtctcatcatccaaagaaacatggctctctttttctccggtggagacaggaaagagcttaaacttagagtcactggtaaaatctggaaagagcaacacagtccagattctggactttccataccaaacctatcttcttcctgatcattcttttatctttttgttttttctctctttgagaaggaatgttgtatgatgattcgtttgcactcttcttctttgtctgtatctaaaacatatcatgaatgaatgtttcatcttatagtctcatattttggcagatgcattacaatttagatacatggagataggagatttgatcaagtgaaacaaaaaaaaaactaagtgattccgtggtaacaagtaacaacttgttcaaacgcaactaaaatgtgtttatgaaaaaatggaggtgcggggaatcgaaccccgtgcctctcgcatgcgaagcgagcgctctaccatatgagctacaccccctgtttgatttctgataacattaaactaattctattttttgctaacactgtgattaccataatacaatatccaaatgtatagtgtgagacaagaccatatatgtaaaatatttagtctatgttaaacaagttgcccaatcgacaaattattaggaggattgttgatgtatatatgcatttatcttaaaaataaaatctaccaatattttcaaaagtgttcaaacattaaattgatatcaaattaataaatagaaaagataaggttaaatatgaagttattcaattcatataagttttaaagattatgtaagattttctcttaacaagatttcaacaaatctttttaaaagatatacgagtatgaaaacaaatcctaagcttttttattttccaacaaacaaattcttgagctttaaaacaatttaaatgtcctaaattgtataatctaatctaatgttagtgaattgcaattattcaaattattaacttaatagataaataggaaaaaaactaaataaggaaagttaggaattgaggaaaaggaaaaatcttagaaattgaattcgagagggaattaaaggaaaaaggcctaatacaaattgaaaagggtttttaacttttaagttctgtttcttctagaactttactttttagccttcgtggctttccctataaatttcccaatctttggccatcggacgatcaaagaaactcattctgatttttaatctctgacgagcaaagaaccctacagctaaaagattaaaccaatg

SEQ ID NO: 20231 - DNA, 3003 bp, Unknown
  misc_feature (1)..( 3003): 2750-1469P.txt file - cDNA_ID_1824949; gDNA_ID_1620719; Annot_ID_49168
tcaatccatttatgatttaggcattccctgcctttagtactgcaaaacggtgattcccgtctgctaaacttcagtggctacttcggtgtctaggagaattaaatttgcaatgaatctccttttgtactcactatgatgctgaaggaggtttgtaacatttcagcattagcattgaatgtatttattttgtgttgtcaaggtggggcatcatctagtgtcttggaagctaatccgccaccacgtgagtccattgtcccagtagttaatccatcgcgtggtaacctaagtcctatgcgaaaggatacgacaggctcagccgttgttcagcctgatgcagccacttcgattcaaggtacatataagcaatgtcactcttagaaagtggaacccatgttcgtgtgttgtagtttgagcttttgacgttgacaagcaactttaataaaaataaaaaacgtgatagccaatacttcttctcttatttagcttttgcgtctctcgtttgacttttaaagactccagcactattttcttaatatgatggcagttgcaaaatcaaacgatacaagcgaaattgtaaacaatggagctattgttggagacgggcaaaagtttctggctcctatggtggaggagcaaacacagcaaaagattgacaatgatgattctagtacagcagacgggaatcacacgtcagacaaaggacgtctctccccaattcaaccatctcatggcatgagtatactaaacacagtgactaacggacccgacggattgaaagtagaaactacaattcatgaagaaggtgcccctcttctgtttgaaggaaaagacactcctgacacaagcacggcagattttggtctgaccaaagtaacaggtaatcttaattctggttataatgatgcgaggaaatcatattcatagcttcagtgccaaatacgtagaataaaaccggtttctgtctctcctttgtttgaagattaacttcttaccgttctgtctagtaattcctattcataccttgcaaactttccgcttctgtttaggtgtgatggacacaggtgacagaggagttattaccggtccagcaaatcctgaaattgatatttcagcagggaatttgctggaagaagggtctctaagggaaccgttaatgagacgagttgttgttcaaggacgtaaactggaaatcttgaaaagcattgtctacggaggtctactagaagccatcacaagccttggtgttatttcatctgccgctggttctggtgcttcaatgtgtaagtaccgcttacccctagctatccattttcatttgtaaaacacaaaacacttttttcttgcttgaaaatctaaatcttgcttgaaaatctcaacacatgtttgtattgttgtggttgcagtgaatattctggtcttggggcttgcaaacttgcttggcgggcttattcttattattcataatgtgagtgatcaataaaacctttgtaatgaacttggtaatgaaccatgtaactggcaaattcaagaaacttacagagatacttcttctgcagctccaagaacttagagaggaggaacccataagaacaacaacagaagataaccagactaacggtagagaagaagaagaaggtcggtataagcgactccttggacgaagagaaaatttcacacttcacgcaacagtcgcaatcttatccttcataatcaccggaatactccctcctgtagtctactatttctcattcagtgaaaaacacaacaaagactacaaagttgcttcagttttcggggcatctctattctgcatcgtcttgctcgccatagccaaagctcatgtgaggtacccgagaggcagctacctgaagagcattctgtactacgggtcaattgctgtatcggtgtcggggatttcttatgtggttggtaactttctggaacagttgcttgagaagcatggatggtctgatggatcggaaacacctgtgggacagatgatgctttcatcacttatgggaagaaaagccggctttggatactcatcatcgtactgaaactgaatcttgcctggagaatgatccaaactgaaacttgctgcttttctcttttactctgcttttgtgagctctcgttccaaatctttgttgtcggcaaatctttgttgtgacttgtgagtgtagaagaaagtcgtttccacttgtagaataaactaaaataagcataacataataatgatggaagatctgtgccttttaataagtttaaatcatttttaaaaaatgacaaaaagaaggttctaccgagaattgaactcgggttactggattcagagtccaatgtcctaaccgctagaccatagaaccatttgatgacagtcctgatataaactagtatatactaaatattatatgcttgccgtaaaagtacggttacgtacgtagcgggtttgaaccaatcactaatggtaatagccaatcccaattggcagataatgttataaccgtcagattcaaattcgaattaaagggagccttggcatctgaacggttcagatttgatctttcttcttttctctctctctctctctctctctctctcagtttcagagatcaaaagagaccaacgaagaaaaaagcaccgcttttgcagaatcggtgacgatagaaagagaaagacagagagagagggagggttagagagtcaggggctatttgattcccctggaaaatttcagatatttgtttcttcatcttctttccttatttctctctttctcgtttttaccagatttgtcttacgaatcaattctcaaagatacccaaaagtggtagggaagcaaagtactgttttattttgcttttgattctatcaaaatcagcggtgaaagaaaggaattttttttattatcagagaaagagagattcttgataatcgaatagacctagatttttttttgaatttagggcttttttgatttttgagaaattgattgtggtaatg

SEQ ID NO: 20232 - DNA, 3003 bp, Unknown; identical to SEQ ID NO: 20231
  misc_feature (1)..( 3003): 2750-1469P.txt file - cDNA_ID_1824949; gDNA_ID_1971690; Annot_ID_175080

SEQ ID NO: 20233 - DNA, 3003 bp, Unknown; identical to SEQ ID NO: 20231
  misc_feature (1)..( 3003): 2750-1469P.txt file - cDNA_ID_1824949; gDNA_ID_1620719; Annot_ID_165749

SEQ ID NO: 20234 - DNA, 3003 bp, Unknown; identical to SEQ ID NO: 20231
  misc_feature (1)..( 3003): 2750-1469P.txt file - cDNA_ID_1824949; gDNA_ID_2926191; Annot_ID_141069

SEQ ID NO: 20235 - DNA, 3003 bp, Unknown; identical to SEQ ID NO: 20231
  misc_feature (1)..( 3003): 2750-1469P.txt file - cDNA_ID_1824949; gDNA_ID_2926191; Annot_ID_201080

SEQ ID NO: 20236 - DNA, 3003 bp, Unknown
  misc_feature (1)..( 3003): 2750-1469P.txt file - cDNA_ID_1824953; gDNA_ID_1620719; Annot_ID_49167
tcgtttcgaaaaaagatggaaaagagacaagagtacaaggttttagctgtttacgcagtgtctctactctgcatcgtcttgctctcaatagcgaaagcttacgtgtcgaagaaacgcgattatgtcaagactctgtttcggtacacgacgacggcgacgacggcgtcgggattctctcaatttgtgggatacttggtgagtcaatggcttgagaaaagcgggttttatgatgattctccagaaactcaacgagtttgaaacgagttcttgttcgtcttctcttcacttcccctgttcttttcgtactctttacgtggcccaatttattttccttaaaagtggtagaattgtttgattttgaccccaagaaaaaaaactttttttgtgtgctagacttggctctctttcaagttagttttggatcaaacacttgttgttgctgagaaggttccgtgaacaagaattctgtaacatgttctagtgccaaaaataaccagttcataaggttttatagtgcatgttaattaataaatgttgttaccttatgtgtcttttaaacaatggcgattacaaacaattagacatatgcatggaaatgcaaatagcactgcgtgcgaggagaaaattagggtttatcaattagattcaattggtcggacgcctactaaaaatgtggaacttaaagattggtggtggtggcaaatacagtttcatagatatggaaaacaactgatacacgttctgagataagcaaattttgtgactaaacaagttgtataatatatggagattgaacttatgttcaccttgataccaaaaaaagaaagaaaaacttatgttcaccaaaatacataatgtatcatcagcaaaaggggaaaaaattacggtgactgaatgatgaagaatcaaagaaaataagaaaaagttgatgaaaaatggcatcacatgaaaaacgcttggttaattatttcattttaatcatggatcaaattcagggatgagtgaaaacataaacaagcaaaaattattcagcacaaaaaaattcaactacattaagcaaatgatgagagtttttggcactttgtgccattccagaagctacagtttaatatctaatttgaactaaagtttaaccaacgtgtactattttcatcttgttgattctttctactcgtatgggaccatctaatgcgaatacctaacaattattatatatgatataaaattataaatccatgtgaactcaaggttacgttcacattcatgactcatcatattgagtgagtcgatcatataattaaattcaacctacattcttacacgattctaatatagagttaagattttaattaaaaatgatgacacaaattagtttgaacacaacataagcatgttagtaacgtgcttttggggttatatatcattattttaggtggtattattgatagaatggttaagattttaggaatcatggggatttgggcaaatattgtgtaactaagtatctatgtgtcacatttcttatttcctttcaatttctcctgataaacgtaggaaaacgaatatatactaatggtgatggtgattgatcacaaccatatcatcgagaaacttcacgttcaaacgtaaaagacgagaccattatcgaaacaaactagtatgaagaagttttttttgttaatgaagaaggttttttttgtgtgtgaagaagttatatatctgaatgcaaattataatgcaaggaatgtgtatctagccaattttgttgataaaagattagccataactgaattaaatatggattttttttttttcgaaaaatgaaatatggatgttattatgttagcatgattaagttaataatgttgacatgttgtaatggtactatgtcagcaaacgtgttgcatgaaaaatttatacggaatatttctatcgagtattaatttcaagatgcgactttcttattagaatattagtatattaaaaacaactagtggtggataaacaaacattattgtaagatgtgttgttaattcttaatttgagtactattattgtcttttattaatatttttgtcaactctatgtgtttgatgtagataagaattctttggccgtattgattattttccacgtttgaggcatcgatgtagttgggacgtgatcgtgaaatgaatgcagtcagtgtctccaatctgtcatccatgtgccaataaatccctgaaaagaaggtgacaaaatcttcaactaatttgtttgttaatttttactactaagtatacaattttactagttacaatatactatttcccataatgaataatcagttgtaaatttgtaataggaaaatatagtaggtaagcatttagatggtaaatttaaataaataatttggttaagaacaatactgataaaataaactatcaaatactaaacaagttatttaaaataagctaagttattttgttgtgtattttcgaaaagtctatatatctaaaggtgtcaaataaaagtcacataatgtttcgaaaatcccataatagtaggtggtatttttagaaataatgaaatttgggaggaaaaaatcactaatactacttactttgtcaactatatgtagtaaaggtaaatattaacaaaattacaaaagaaaacaaaaagtcctacagttttagtaactaactaacaaagagctttaaacacgtgaaaagtttttgcataaaactagtactagtatattagaactaggagtagtgctcaatcaacggccaagtcaaaacaaacaaatcaccatcaataatcatataattaataagcagaatcatcatttatgtatttgataatgttcaagtgaggaagaagaaggagacaaagacgaccccaacataatatctatcaccttctctatagatagttagatctcagaatctctccttttttgtttgctttacccttatttggccattcctgtcttccactttgtcatcttttccctttctgatg

SEQ ID NO: 20237 - DNA, 3003 bp, Unknown; identical to SEQ ID NO: 20236
  misc_feature (1)..( 3003): 2750-1469P.txt file - cDNA_ID_1824953; gDNA_ID_2926191; Annot_ID_141068

SEQ ID NO: 20238 - DNA, 3003 bp, Unknown
  misc_feature (1)..( 3003): 2750-1469P.txt file - cDNA_ID_1824961; gDNA_ID_1620719; Annot_ID_49165
gagagtgacttggtgaatccaattagttattcttgtcaacttttggctttaatacaaataaacattaatggatctcaaaatggtcatgaagaaagctcgaaaggtcgatctcccgagaaggctttggaagagatacgtaagcaagacactcatgatctctattgccctaagtgtactagtaacatcactaaaacagctctaatcgttgaaaagggagatgatttttctcccgacgaccagaaacctttcgtgctctggatccctaccttcaagttcctttcaagttctcccaaaggtatccatatgtacacgtaaacatgtatatatattgttctctatgatgatgaagataactttttttctttgaatgctgagtgaccggttttttttatctgtaggatctgtcgaaagtaaaccattgaatcctaatctcagtggtatgtgtagacacacttttttatgatggatgcacttttgctttgaactattgcttatatgatcgattttgtatctgtgtaataccagtcgagaacatttgtttgtttatgatgaaaacgtacactttcgtctttaattcctgaatgatcgatttcctattttgtaggaccagacgaagaaaactcatctcaacctgaatccagtggtatgtgcactcatatttctttatgatggacacgttatatctttgaagtactcatggttaaatggtcgattttctatatgtagaaccagtcgacaaaaactcatcgtttaatcgtagtctcagcagtttaggtatacatttccttatgatgatgaacaaaaactctattaaaaaaaattccctttgtcgtccttcatcttcaatgacacaattgccatatatatatatatagctaaaaccttggaacgattgcctactcttttacggaattcaataattattcgtagagacgaaaatagtgctactcctctacaccaagatggtgcaggtcatcaaagttctacgagcacatcaggtcattcccaatgctttcgctgcttcatttctttccaatacaatataaaacaaagacatacgatattttcaaaagaaataatcccatttttcttgtcttgacccctggaaaatatgcagtgtctgagcaacgtggacgttggaaaattagtcccggtggatggataattcatcgttaaacgcccagcaaatagacaacgaattgactatcctctcttcttaccccctaaaatgaacgagttttttgtttgattgaaacccatagtaagtgattgatgatagtgtaatgatcattttgtactgagtttaaagcatagaaatcattgcactattactggaaactaattatttcttaaactaataagtttcataaatatattgcaaaagatgcaatagagtgctagagttttggtaattaattttttattttatgaatgaaatattcttatccaaactcatgtatagcttattggatattaacggttgatgatttgaattttagtttttacttcgctggaaacaaggaaatcatattgatcaaattttccatgtatgataccttaaaaagatcgtttataattgttttgaaaaatctagaaatttaacaaataaatattatacttttgagtaaacaaaataataataattgaacttatatattatcatttttgattccaatcttgtgaatttgaaacataccaccaagaaaaaatcttgtgaatttgaaatagaaattttccctcaaaaatcaacgaaacaaacaaatctaattaactaaaagtctaaaatacaacttaatgaaataaataataaatcctaactaaaactttgacaaaaaaaatcctaactaaaataaaatattagattattgttttgataaccaactccatttatatgcacgatgatcttcggtcatttgattaaagaaagacctcatctttagaaaagtctacatataattaagaaattaatgtgacaatgtcatatttcttattatatataattaaacatggttgatagcaaaccggacagaacaaattattaaataaaacccttttataaaacttctaacgaaaatccgtaattctaatcaagccataaccaaatagaagccacataatcccaatacaggtcgtatatgtattatttttttatgactcggtctgttaaatacaagcacaacaaatttaaagttcgaaatattatgttaatagtcaactctactaatattcctcaagtcacaaaacaatgacgaaaataaaattcacataataagaatattccccaagtcataaacaatgaatgacgtaaattctagaggcattaaaatgaaaaaaaaaaaaaagaagacattttcaaactctaaaacatacagtcacattcattgtacaaaagcttttgattgaataaaattttgcattcgattcaaaaaaaaaaaaaagacattgctataacaacttcttaaaatgcgtgacttttgcacccttgactttacagggtcataaaatattacgtataattaacaaaaagaccaacaattggaataatcaatttcttcctattattgaatgttaacttttctataaacctgaatcttatgatagaatgtacatgaattgtgtcccattgcataagaacttaaagcatatgcagtaggagattttcaaagaggtacaacaatataaaaaaaagtaggatagagataaaaatcggctattattgaagaactttttagtttttagccatctccattgacagaaacgagaagattttttcaaaaagaataaaccacaagtgatatgacaactgtcaattcagttgagaaccattttctatttgagaaccatctcattcacggtatattaaaagaatacgactatgaaaaatcaaatgttagagaagtagatcagcgaaatataaaaatgagatagtaagcaggtcgtgggcatataaataagcgtccttctgttttctttgtcatcattaattcattaccctcaacaatg

SEQ ID NO: 20239 - DNA, 3003 bp, Unknown; identical to SEQ ID NO: 20238
  misc_feature (1)..( 3003): 2750-1469P.txt file - cDNA_ID_1824961; gDNA_ID_2926191; Annot_ID_141066

SEQ ID NO: 20240 - DNA, 3000 bp, Unknown; identical to SEQ ID NO: 4642
  misc_feature (1)..( 3000): 2750-1469P.txt file - cDNA_ID_1824967; gDNA_ID_1620719; Annot_ID_49163

SEQ ID NO: 20241 - DNA, 3000 bp, Unknown; identical to SEQ ID NO: 4642
  misc_feature (1)..( 3000): 2750-1469P.txt file - cDNA_ID_1824967; gDNA_ID_2926191; Annot_ID_141064

SEQ ID NO: 20242 - DNA, 3000 bp, Unknown; identical to SEQ ID NO: 4637
  misc_feature (1)..( 3000): 2750-1469P.txt file - cDNA_ID_1824971; gDNA_ID_1620719; Annot_ID_49162

SEQ ID NO: 20243 - DNA, 3000 bp, Unknown; identical to SEQ ID NO: 4637
  misc_feature (1)..( 3000): 2750-1469P.txt file - cDNA_ID_1824971; gDNA_ID_2926191; Annot_ID_141063

SEQ ID NO: 20244 - DNA, 3003 bp, Unknown
  misc_feature (1)..( 3003): 2750-1469P.txt file - cDNA_ID_1824977; gDNA_ID_1620719; Annot_ID_49159
atgggtgggttgggttttctcttcatgagatgctcatttgagcaagcaatgtttggaagtgggactatttaatatcatgtatgagttttatcttttgttataagaaaaaaagttgggatttcattttcgtgcccacttcacgtgaatctaatgccttcaagtttgtggtctaccttattttctcttatggatacatgtcaatttacgtgtcgtatgagtcaagcctttaatcatcccaacaccatgcacgtcttctagatttgttttcgaccacgattccaccacaaaatttgacattgttattgaattcattaacttttttacgtgttattgtgaaatatttatttaattttgttggtaaaaggagcaaaaaagattagggtacaacacgtcgacttcttccccaattagacccatatgtgatctgtcgtcactcgtcgccaagtttttttatgtgtcgtcttttaaactttgatccaattcattaaaaagtcttaacgcccacaacgaaaaggaacttctctttttgtttggtgactgaatcggtggaaaacaacacaagtttgttcctttttgtctctccagatcccttggcttccttcttcttcttcatcctcctcgtgagactctgtgttgaaatttctctagggttttaattatcggcgttggtttttcgtttttgagaatttgatttcgtttttagaaataatgggtgattgggctcaacttgctcagtctgtgatcctaggtttgattttctcttaccttctcgctaagctgatctcgatcgtcgtcacgtttaaagaagacaatctctctcttactcgtcacccagaggagtctcaattggaaattaaaccggaaggagttgactcgcgacgtctcgattcctcttgcggtggtttcggtggtgaggcggattcgcttgtggcggagcagggtagctcccgaagtgatagcgttgccggtgacgacagtgaggaagatgatgattgggaaggcgtcgagagcacggaactcgatgaggcttttagcgccgccactctttttgtgactaccgccgccgcagatcggctttcgcagaaggtaccgagtgatgtgcagcagcagctttacggattgtataagattgctacggaagggccgtgtactgctcctcagccatcagctctcaaaatgactgctcgtgccaagtggtatctctctctttcgttgaatctgctgtgccattaacttctatgtatcattttctggtgtttttgttcaactgtttgagatttgatttgaggtggaaatttttgaggttttaggttcttcatagacaatcacctagtttgcttcttagcttatgcaactgctggacgatgatgtggtttttactgttgtaacagttgattgtatatggaattgtggtttgttgtaagattgcaatttcattgattgggatgtgccatgatcttgttctatctcaggcaagcatggcagaaactgggagctatgccacctgaagaggcgatggagaagtatattgagattgtcactcagctttacccaacttggttagacggtggcgtggtataaagctttttccccttttctttgtttgattgcttcggtttcttcctctggcctgttcatgtgagcttcactaacagaaagccggaagtcggggtggggatgatgcagcctccaactcaagaggaaccatgggaccagtttttagctctttggtttatgatgaggagtccgaaaatgagttgtaaggttctcttcttgtattctcatgtgttttatatcctgatccttgcgttcatgtctagattagatataagtatcctgatttgtgaaagaggctcataaactcggtgaatatgtaacattactgtctcgttctagctgtagcaaattttgatggtgaaatggctacaattgtctcatggaactttgagctgttcgtttcttcctgtctatctgaatgaaacactaatcctctgctcattgaacttttgttttatctctcaggaagattgatgccatacacggatttgctagagaaggagaagtcgagaatttactgaaaagcattgaaagcggcattcctgtaaatgcaaggggttagtctctgcttgtatattccgtttcttggaagttcattctcgtgatgttggatctgcattctaattttcccataaactgcagacagtgaaggtcgcacaccattgcactgggctatagaccgtggccacctcaacatcgccaaagttctggtcgataagaacgccgatgtgaatgctaaggtgacgaaagagaaattcctacccagtcattatctgcaaagttagcaacttctttatttatgtgtttttggttcttgtgttgaacaggacaacgaaggccaaacccctttgcattatgctgttgtatgcgacagagaagctatcgccgagtttctggttaaacagaacgcaaacacagccgctaaagatgaggatggaaactctccccttgatctctgtgaatcagactggccctggatccgagattctgcaaagcaggcagactaaacaaatactaaccacgtcttctctaaatccgcaatgtatatgatcaaatgacttagtaagaagcttttctttactttaaactttctttccatccctaccacatcactgggatgttccaacactatatcacttggatgttaccaagtcttgttctttgatttctttcttcttacattttaacaatcttttgttcctttaggctttatgatatgtcgtaaccggttttgttggtttgctataaatacacacatatagacagaggaagagtcattggatcctcaacgaataaataaccgactttggcggcaaaaacggttgatagaacataatttaatgatttaaggaaagcccccaataaagcaaatacaaaaacagaattagcaatcttcgtggccctttcgtcttctctccctaccccaccttggactaccggaaaatg

SEQ ID NO: 20245 - DNA, 3003 bp, Unknown; identical to SEQ ID NO: 20244
  misc_feature (1)..( 3003): 2750-1469P.txt file - cDNA_ID_1824977; gDNA_ID_1971690; Annot_ID_175070

SEQ ID NO: 20246 - DNA, 3003 bp, Unknown; identical to SEQ ID NO: 20244
  misc_feature (1)..( 3003): 2750-1469P.txt file - cDNA_ID_1824977; gDNA_ID_1620719; Annot_ID_165739

SEQ ID NO: 20247 - DNA, 3003 bp, Unknown; identical to SEQ ID NO: 20244
  misc_feature (1)..( 3003): 2750-1469P.txt file - cDNA_ID_1824977; gDNA_ID_2926191; Annot_ID_141060

SEQ ID NO: 20248 - DNA, 3003 bp, Unknown; identical to SEQ ID NO: 20244
  misc_feature (1)..( 3003): 2750-1469P.txt file - cDNA_ID_1824977; gDNA_ID_2926191; Annot_ID_201070

SEQ ID NO: 20249 - DNA, 3003 bp, Unknown
  misc_feature (1)..( 3003): 2750-1469P.txt file - cDNA_ID_1824997; gDNA_ID_1620720; Annot_ID_49178
ttagtatatacagtttatcttgttctcattcgagatgataaatttgtaatttttttttaattttcttacatattttggcattttgctccttttccaataaattatacattattgctttaatcaatgagagtataggtgcagtatttatgattgtgcatgaactttctaatatgattttctttttttttaaatgaaaataaagatatgaaagttgttaaatgtggagaggcgtgagagtagggatgtgtctatgttaatttatgaatatgtagctttcattttgttatccacaccacacaagtcgtgttcgatgaatagttcttatccccatcttcatttatatcatttctcactcaatattagtcccagctagcaaacatcgttaaaaaaaacaaagattctatgaggcaatttcgcattctagtgtcatttgacatttgtagtacaaccatttttggttggctaaatcgctctagacaggaccatctcaagtctcaggtcccaactcttgagctatttgttacttatgtgcaaaaaaattatccaatcgtataattaggatcttagaacaaaatattttctaattataaaaataaaatttggaatcctattctaagtgaaaaatacggttttggctatggagcatataagttgattagattcctactaattaatagagccaattgtatacttcaactttgaaaaactccggcaaaaaactattgatataaatggcaaggttaaactcacacattccgttttgatgcaatatttggctatgttaagctatcatgtaataacaatgtaaaatacaccctggatttttttgcatgaaaacgatggttatcaaaagaattaagtctaattaatatagaaggagacacaacattggacaaatccacatggaagtaagaactatggataagtaattgacagactccataaatttcatgaaacaaagctctatgtttttttgattaaaaaaaaaaagaagaagaacgaagactctattcgactcaaatttaatgtcatgtctttgaatgattttaacttttgcattataatttatttaatatgatatccatctttttcatccatttgccacctttttcttgtcgtacttgtttaaaaattaaaatagtaacataacacggccgacaataaaaatgatttgagctatattggaaacaaaaaacactagtagtagttttctttttcgttaatagtagatttggtaaacatatcttaaagtttttatagatgtcaatttctgtgaatatcaatactctgcacttaatgtcgacactctgatgtatccaaataaactgaaaaaaacaatttagttttcctacggtaagttttaaagcattttagtattttacacaagattggggatttttgtgggtttagccagttttgtatgtgctgtacaaattgaagaaattgcatgtactatattatatatgtaattgctgaatctgttgggtctttagaaattgagaatatgccaatgatagacttttcgtaaatgggctttcttcggctttttatacaatcatgggctttgtatgcccaacagagacatatattactcacatatattcaaccaaaaaaccttgtttacaaatgatgcatctttgttttgaatgttaatactcacatgatacttcagtttgaatgctttttttttttgttaaatagtttatcttaaaataaagcataatatatttcaaagttaatgtgtcttgtgcctgaatttcaaattaaagtatttcaaatatctataacagatgggtttatacatttttgctagtatcatcaattaaagaaaaaatgtttaacagcggttaactggacatatccattgagcatataattgattaaatcattggaaaaagcaattgggaagagtgagcgaaacgtgttgagacagttctatataaatattttagataaaatatgacccataaattacatatataaaatatataaaagtttttggttagaagaatacgaaaaggcaaagaggcacggtattggtcggtcaggtgaagtagggtcctttctactgctccagtcagtctattaccacaagaaaccgcagaaaccagaactcaaaaagcaactttcatatttttttataacaattgtacaatacaaaattcttatagacaaaaatgtattttagcatattgcttttatttatttttgtttgtgtgtattgtattgtcacttttaaaacaagaaagaaatatttatctgacgaccaaaaaaaaaaaaatttatgtattttgtcgtcttcaaaactttgattttactattggcttgggcttaagtatttaacattagaactgttcttttacgttaaaattaattattcatcctgctcttttgtacctacgtaatttccttttcacctgattcttgttttattcgactcttgtagtcttgtagacatacgtatcaatcaatacatacacgttaaatagaatctgactacagttaattatacatcaaattatttcaagaaaattaattttccttgtacttatataacataattacataggtcccgacatatttttgtttgtttattattcaaatactgactctgtaatagttttttatttttttttatttttgactctgtaatagtttaatacatactgtgtaaatctgtgatgatacaaaaaagtgtatataaataatattcataaaaagacattactattattaatgtcaactcatatataaaagagaaacgattacgtgtataaatatgatatatccatgcgtgtagtactctttaggaaaaatttatttgcccttcatagggtagtcactttcctttttcttctttacttacaaatcttcctctacacatcaacacacagagaaagagagagagagagagacagatagagagagtgagaatagaagtgagtgagagaaagtctaattgtttctcctgtaaactgcaaaccgatctcgtgtctgaaaatg

SEQ ID NO: 20250 - DNA, 3003 bp, Unknown; identical to SEQ ID NO: 20249
  misc_feature (1)..( 3003): 2750-1469P.txt file - cDNA_ID_1824997; gDNA_ID_1620720; Annot_ID_165779

SEQ ID NO: 20251 - DNA, 3003 bp, Unknown; identical to SEQ ID NO: 20249
  misc_feature (1)..( 3003): 2750-1469P.txt file - cDNA_ID_1824997; gDNA_ID_2926214; Annot_ID_142121

SEQ ID NO: 20252 - DNA, 3003 bp, Unknown; identical to SEQ ID NO: 20249
  misc_feature (1)..( 3003): 2750-1469P.txt file - cDNA_ID_1824997; gDNA_ID_2926214; Annot_ID_202836

SEQ ID NO: 20253 - DNA, 3003 bp, Unknown
  misc_feature (1)..( 3003): 2750-1469P.txt file - cDNA_ID_1825007; gDNA_ID_1620720; Annot_ID_49173
atttgatgatcttcttctcagtttatctgggtaagtacacacttcaatcttcatggattcatgatttccccctcaaatttctcgggaaaataatgatggattttgacttctttatttttgtttgattaaatctttattaggaggttatgatatggaggagaaagctgctcgagcatatgatcttgctgcactcaagtactggggtccctctactcacaccaatttctctgtaaatcatcttttctaaactttatgtctctttgaccttgttgtatgatttatttatataatatgataatggatatttgaaggcggagaattatcagaaagagattgaagacatgaagaacatgactagacaagaatatgttgcacatttgagaaggaagagcagtggtttctctaggggtgcttccatctatagaggagtcacaaggtccttttaaattacatttatataactttatataatacatagtttaataatgtgaatattgactttgtgtgagttttttgtactagacatcaccagcatggaaggtggcaagcacggattggtagagtcgctggaaacaaagatctctaccttggaacttttggtaattcatcatgccgatgattttgattgttaaaacttaacattttcaattgcttgtgtcttacgaaatcttttgacactatcataggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgaatctcctttgctaagtccttctctcttcgttacgtattttcgatatattatacttattcatgtgctaaaaaaggtgaaaacaagggaaatatgttggaacaacacaaaaggttgcatgaatatatctaaactatgcgaactattatggctattgatagaaacatgaacatttagtagttgattttatggctttgatagttttggcaattgattagaatgttaatctctttatagagaaatagtaagaaaatatgtaaagagaatgtgcatggagctgaaatgacccatatctaataattaggtttcttgtcactttatttatctttttgaaacacattgttcttttaagtacagagaaataataagatgaataatggtaaatatgtaatgtctctccaataatgcgatatgctttattgaccatatcgttccacaacaatccaacataccttcaccacctcatttctaaattccctccttttgtctctttttcacacccccaccgtatcagcttttccctaaagtttcaccaaaattttaaaatattccctcctccatcatatttagtgattttttttctttttgatatttattaaagttagtttatactgtatctaaaaaatggagaatttattggttggaacttttaagagccatttactatgtcccaaaataaatatgggggcagcaaatttactgtaacccatacgtggggtaaatgaagtgagtagttcaaagttgaaacttgaaaacctttgatctttaaacataatgtccttcgcacgtgttttccacacgcgtggagtagtttgcagaaactcggaagcgaaagatggttattgggccttggaccattataatcacaaatctggcccacttttatcttttattcgaagcacgtttgcaggacattaatttgatcgtgcttttcactcgtgaggaagagttggtttagaatccggagagaaacgtagttattgggctccggcccaagtttaatttcaaaactcacttctcataaacccaaattttgggcatatgatttgagttggacaggatgtgattctttttttttttgtttctctaacaatataatgtcttgggttattttgtggtgaatatgttgtagggttcaaaacattatagtccacatgaaatcatatttttgggccttgatattttcatatcaatcaatcgaattaataacacattaattgcatcgaaaatgtggtttttgtttgttataccaaaatacgaaggcaaaactcttccacgcaaaaaactcttccacgcatgcctctaacttcatccagttctgttcgttatgataaaaaaaaaaaatataacaaaatctataagatttctaatttgatcagaactttataaaagtctaataacttttgtcacattataagcttttaggaaaaaataaaacgaccgaccttatttaattgcattgtcctaacttcccaaacgttttaatgagattttgcgtaatagagaaacaagccacgagttcgattcacagccacaataatctttctctaccaaataaagacttgatctttctcttctccttctatatccacgcgtcaattcgtaaaaccaacggcttgaaccaccggcaatagccgcgggattgcggcggaggattaatcaaaaaacgcaccacctgaaatctctctgtgtacgctaatg

SEQ ID NO: 20254 - DNA, 3003 bp, Unknown; identical to SEQ ID NO: 20253
  misc_feature (1)..( 3003): 2750-1469P.txt file - cDNA_ID_1825007; gDNA_ID_2926214; Annot_ID_142116

SEQ ID NO: 20255 - DNA, 3003 bp, Unknown
  misc_feature (1)..( 3003): 2750-1469P.txt file - cDNA_ID_1825011; gDNA_ID_1620720; Annot_ID_49172
aaaaggcaagaaaactattgtcgaaaagacataaatgacactaaaattggattattaaaaatggtatatatgtttggtggaatttataatcattaccaaaatcaaaggaaggagagagggacctcttcgtgcttatgatttccctcctaaacaactgctcccactatccttttttacttccaacaaaatcattcacacgagaaaatctgtctcgtgatcactttcatgcaaaattaaactaaattttggtattttttgtcaagttcttgctgttttaagtcgattatttggtaatactatatgtgtggatatacacatccaagctaatcaataattgatctccttctcttatcaataaattacaccacattagctaatcaagctaataaattacaccacattctcttatcaatttttatatggtataaataaaacaaccgactataggctacagagttggtattaaggcattattgccttctagtcgaaggaatttttttgttatgataacactcgtgggaaaaaaatccagcctaatatgctcatttaaaggataattgatttaaatgctttaatcattaaaataaaaggtttttgcttttaaaggttaccaccgcttaattcatcattaggagaatattaactttgatcgaaattccaaaatacttttttaacacataagaaaattttcagcatttttaaataaagggtacatttattgggttcaataaatatgtttccacgtaaagtttggaggtttaaccacatgaatgttttttgatttaaaaaacacataaattttcttagtaattacacatttttaaccgtccatccagattgtaataagtgacaaatctgaaaacatttttttttttcttgaatcttgtttaaattctctctgctgcatacttgcaggcatttgaccaacgactatacatattgaaagcaaaatatccaccagggatgatagggttagatcccacattcaatatcttttgtctttgttatttatgaaaaacaaatatttatcaggaaaaaaacgtttcttctctagtggtataagataataacaaaatttaatacttagttaatgtatttactatcttcaaacttaccatccttcaacattaatattgatcaatttttattttttttactaaactacttccactaaaaaaatgcaaaagaagagatatatatttaagtcaaagtaattaaagatggatgggtgattcttcagcaaaacggcgccgtagaggtgtcttatcctacattacagctgggttgtggcagacatcatagggcctacgtatatttgagctttactgtacgtaaagctttaacatatctagttagttctcactgtacaaacaaaacaaaatccaattcgtaacatatatacaaatactactagtactagattacgctacgtatacatcgctttttcgcaaatttctaaactaatctatacaacaaacttgaatgtttgttttgtaatttatcttaaaccaaagttttgaattgtgcattgggagctacactctagtccccttttttccccaaaataatctccttacatcgaccggttaaagtatttaaaccaacaaattttaatttgttgctgaaggtacaaacatgtcacatatatagagacagcatcgtttatacaaataatgttcgatgtattggaaatcaaatataaatacgagtagcgactcacttggtttaatagtttggaagataatgaaataaaaagatgaattcaaaggatacagagctatatatgtcgggtcatttagagccgtgaccaaaagtttcgtcgtaatttctacggtcggtcataagaaattttggacttttcttcacccttttatgaacttctgtatagtttttgtcggattatatatttgtattcgtatattttttgtttctaataatgatacgtaaattcacgataagaaagacttctttttatttaatttgatttaaaacttttgtttttggaaatgactcatacacaaggttaaagtttgatggtatccaatttacaaaaatgtttcgagagtgcgttcgagtgtcctaccaccatcgtaccaactcgtatgggtttattattaggtttttttcttctttttccaatgtctttataattgaaccactctaaatttctttttttaaattaggttaagaatcttgaattttctgttgattttaaaccaaggttttcaattcttcttagcacaaaaaaaaaaaaaaggttttcaattattaaagaatctaaattttttgagttcaagagtttaatgatagctgaaaagttatgaatgattgcaagtttgcaacagaatggtcgatgtagtacatatcaaaaacatgcatcaaaataaatattcgtgcttagcaagagaaacgattgaaataaacagaacaatcgttaaccacttaaaaatcttagaataattttgtagtgataattttctgtaagagagaggtatcatatcttacaaaaaaaaactcatttcagataaaataatgttgtccaatcgttaccaagtatgtttttgctgtcatcagttgtattgtaactcgtctcttagccatatagttctaagttttaaatgttttcaaagactttacaaaaataaaataataataaggtggaatttgtagggctaaaagcgaaaaataaaaataaaataaaagtaaagaaacgtctttctcaataagaacacagatcccaacggattcaaacagcaaatttgtgctttgctcttctctcttattataatatcctctcaaaaaccctctcctatatcctcctaaagccccccttccttgtttctctaccgcaacaaagaaaaaacaaaagtttgagaaaaatggtgtgttcgttgtgtaaccaatgattgggttttagcttactacttcgagagattataagaaagaaagagtgaagatacattatagaaagaagagaagcagaaaccaaaaaaagaaaccatg

SEQ ID NO: 20256 - DNA, 3003 bp, Unknown
  misc_feature (1)..( 3003): 2750-1469P.txt file - cDNA_ID_1825011; gDNA_ID_1620720; Annot_ID_165768
tttaaattctctctgctgcatacttgcaggcatttgaccaacgactatacatattgaaagcaaaatatccaccagggatgatagggttagatcccacattcaatatcttttgtctttgttatttatgaaaaacaaatatttatcaggaaaaaaacgtttcttctctagtggtataagataataacaaaatttaatacttagttaatgtatttactatcttcaaacttaccatccttcaacattaatattgatcaatttttattttttttactaaactacttccactaaaaaaatgcaaaagaagagatatatatttaagtcaaagtaattaaagatggatgggtgattcttcagcaaaacggcgccgtagaggtgtcttatcctacattacagctgggttgtggcagacatcatagggcctacgtatatttgagctttactgtacgtaaagctttaacatatctagttagttctcactgtacaaacaaaacaaaatccaattcgtaacatatatacaaatactactagtactagattacgctacgtatacatcgctttttcgcaaatttctaaactaatctatacaacaaacttgaatgtttgttttgtaatttatcttaaaccaaagttttgaattgtgcattgggagctacactctagtccccttttttccccaaaataatctccttacatcgaccggttaaagtatttaaaccaacaaattttaatttgttgctgaaggtacaaacatgtcacatatatagagacagcatcgtttatacaaataatgttcgatgtattggaaatcaaatataaatacgagtagcgactcacttggtttaatagtttggaagataatgaaataaaaagatgaattcaaaggatacagagctatatatgtcgggtcatttagagccgtgaccaaaagtttcgtcgtaatttctacggtcggtcataagaaattttggacttttcttcacccttttatgaacttctgtatagtttttgtcggattatatatttgtattcgtatattttttgtttctaataatgatacgtaaattcacgataagaaagacttctttttatttaatttgatttaaaacttttgtttttggaaatgactcatacacaaggttaaagtttgatggtatccaatttacaaaaatgtttcgagagtgcgttcgagtgtcctaccaccatcgtaccaactcgtatgggtttattattaggtttttttcttctttttccaatgtctttataattgaaccactctaaatttctttttttaaattaggttaagaatcttgaattttctgttgattttaaaccaaggttttcaattcttcttagcacaaaaaaaaaaaaaaggttttcaattattaaagaatctaaattttttgagttcaagagtttaatgatagctgaaaagttatgaatgattgcaagtttgcaacagaatggtcgatgtagtacatatcaaaaacatgcatcaaaataaatattcgtgcttagcaagagaaacgattgaaataaacagaacaatcgttaaccacttaaaaatcttagaataattttgtagtgataattttctgtaagagagaggtatcatatcttacaaaaaaaaactcatttcagataaaataatgttgtccaatcgttaccaagtatgtttttgctgtcatcagttgtattgtaactcgtctcttagccatatagttctaagttttaaatgttttcaaagactttacaaaaataaaataataataaggtggaatttgtagggctaaaagcgaaaaataaaaataaaataaaagtaaagaaacgtctttctcaataagaacacagatcccaacggattcaaacagcaaatttgtgctttgctcttctctcttattataatatcctctcaaaaaccctctcctatatcctcctaaagccccccttccttgtttctctaccgcaacaaagaaaaaacaaaagtttgagaaaaatggtgtgttcgttgtgtaaccaatgattgggttttagcttactacttcgagagattataagaaagaaagagtgaagatacattatagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaaggtcagtagtagtaatgttggagtttttagttttcttggtgttgatgttgttgtgtcttgtttgatgggaacatgtttggttttagggatttatgttttattttttatactaaggacattttctgttttttttggttgttatttagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatg

SEQ ID NO: 20257 - DNA, 3003 bp, Unknown; identical to SEQ ID NO: 20255
  misc_feature (1)..( 3003): 2750-1469P.txt file - cDNA_ID_1825011; gDNA_ID_2926214; Annot_ID_142115

SEQ ID NO: 20258 - DNA, 3003 bp, Unknown; identical to SEQ ID NO: 20256
  misc_feature (1)..( 3003): 2750-1469P.txt file - cDNA_ID_1825011; gDNA_ID_2926214; Annot_ID_202829

SEQ ID NO: 20259 - DNA, 3003 bp, Unknown; identical to SEQ ID NO: 16173
  misc_feature (1)..( 3003): 2750-1469P.txt file - cDNA_ID_1825035; gDNA_ID_1620721; Annot_ID_49206

SEQ ID NO: 20260 - DNA, 3003 bp, Unknown; identical to SEQ ID NO: 16173
  misc_feature (1)..( 3003): 2750-1469P.txt file - cDNA_ID_1825035; gDNA_ID_2926191; Annot_ID_141055

SEQ ID NO: 20261 - DNA, 3003 bp, Unknown
  misc_feature (1)..( 3003): 2750-1469P.txt file - cDNA_ID_1825039; gDNA_ID_1620721; Annot_ID_49205
gttcctttttccctacttactttaagagatgtcaataggcttccttatttactactcagagcgttcttaagctcatacaagattaaggcttaaatcagtaggatcatttgaggcacaatgttgaatcttactttttgtacagatggaagttggaattgaggattgcctgcacatcgagtttgagtacaataaaagcaagtaagacaaaatccgtttcatgatttaaggatttgactgattgattgggaaataagacagatatactctatgcctctggttgcaggtatcacctaaaagatgtcatccttgggaaaatatattttcttcttgtgagaatcaagatgaagaatatggatcttgagatcagacggcgggaatcaacaggtgcaggtgctaatactcatgtcgagacagaaactcttgcaaaatttgagttgatggatggaactccagttagaggtatatttggaatctgatgttttagtgatttctttaagatattagataactgagtgaagatttgcattacaggtgaatcgatacctgtaagactgtttctggccccatatgatcttacaccaacgcatcgcaacatcaacaacaaattcagcgtcaagtattatctgaatcttgtactggtagatgaagaggatcgccgatacttcaagcagcaagaaatcacgttgtataggttgaaggaagacgcatcatcttgatgataataactactgtaaggattctcattatccttttgagactttttttgtaaaaagctttagactttgtgtactcagattgttatttgggtcggtacttagaatgaagttttaacagtacttgtttagtttgttcatcaatcaagttccttttctctggattccggtcgagtttgctggatttcatggtaaagtctgaagttttacaaacctcaaaacactctctgaaaagccaaatctctaaatgcaactaactgaaatggacagatatacaaaactggacaactctagagtaaagaagttggttagtcttcttcaattgtttcaacaggaagaccttccttgccccatgtgtagattccaccttctaggtgaaatacgttcttatagccgttaaggaccagaagataagcagctatgagagacctgcaagaaccctaattatatgagcaccgaaacaaatgctttcttcgcacaaagttgtagacttttggcattacctcgattgttggccttcgggaagattttgtgtcggcttcattgtacccgcggatgaacaagctactatgatctttgcctctttgtcaagtttagcttctacacctgcaacatttccgaaacaaaacattcagccgctggattcaacggcattgtgtaaaaacagtccaaagcttattatctcatttcagtgcatactttgaataaactcagggttctcttctgtgccagagaagataccaaagaaagcaaagccaagacggcgagctatgtcccatgccgtccattcccttatgagtctgtacatctccacattgatagctcccggaggatgacccttcaaaaacaaaacaacaagacaaatgtcactcacatgaatttgccattaaaattacaagcgatcatgacacgacgagagagagagcatagtatcactcaccgccttgtactctgcctctggtcttacatcaagaatcacaaagttgttttctttttgtaaccgttgagcttccttcacgtccacacttctcacctacaacaacaactaaaagctaagctctatgttcacattttgatcgaaagttttagtaaattagagccaatcattgattacccttttctccaatagaagctctctcttctgtctccaatcgacttcagctaaaccctccaagagacacaaacagaagaacgagaggttaatctaaccgaactttaccattcacaagatcgatacacaagatcgctctcgctctacaagttgtatacctgcaggtttggcaggtttggttgaagtgcattgaatcttaagcgttttgtgaccggaaaccattgctgccgatcgaactccggcagagaaaagagtgtttccggaggatttcagacgcaaagcctgcgatgaagatgggtaaggcgtggctattgaagtaagtgaagccatctcttgatcgaagctgcttctgttaagtttctgttttttcagatattttcttgaaaatgagagaatttaattgcacgataatggaagaaagacgatgaaactgcgacttcttttcttcttgttaggaaaaaatctgaacatgtggtgcttattttattttcccgattttctatcttttgtattcaaacgatcaaaagttgacacaacataatcttctcttatcttcttttcgaccaaaacataaaataaaatatttctcttatcttctttagttttctcattgcgccattcttgagtttttgattggatcgcttagatttggttaacctggtttttacgttttcggttataccggtttacctctttttgattaattttctttcacaattacaaaaccaatggtcccatactcccatttgctagtttaccaatttttaaaacggtaagatttagtcgtacaaaagctgttattttcagttttttttaccgccttatcttattgtacttttttttttcatcaatcttattgtacttcttactaatggttatctctctatctttcatctaaaaatatcttaccctttagtgagctcttaaattatgttgttcaattttcttaacaactttaattatgttttaggtattaccgatcacatcattgttcaatagtaaatgttatgttgttccctttcgatccagaacttggtcgtgtacattactaagatacatttgtttttaactataaccagatttgcttatccagatcggaaaatataagtcaactacttgtgttcttgctaccaaaaaaaaagaaaaaaaaaagagctacttgtgttccttcttttaatg

SEQ ID NO: 20262 - DNA, 3003 bp, Unknown; identical to SEQ ID NO: 20261
  misc_feature (1)..( 3003): 2750-1469P.txt file - cDNA_ID_1825039; gDNA_ID_1620721; Annot_ID_165831

SEQ ID NO: 20263 - DNA, 3003 bp, Unknown; identical to SEQ ID NO: 20261
  misc_feature (1)..( 3003): 2750-1469P.txt file - cDNA_ID_1825039; gDNA_ID_2926191; Annot_ID_141054

SEQ ID NO: 20264 - DNA, 3003 bp, Unknown; identical to SEQ ID NO: 20261
  misc_feature (1)..( 3003): 2750-1469P.txt file - cDNA_ID_1825039; gDNA_ID_2926191; Annot_ID_201063

SEQ ID NO: 20265 - DNA, 3000 bp, Unknown; identical to SEQ ID NO: 4680
  misc_feature (1)..( 3000): 2750-1469P.txt file - cDNA_ID_1825043; gDNA_ID_1620721; Annot_ID_49204

SEQ ID NO: 20266 - DNA, 3000 bp, Unknown; identical to SEQ ID NO: 4680
  misc_feature (1)..( 3000): 2750-1469P.txt file - cDNA_ID_1825043; gDNA_ID_2926191; Annot_ID_141053

SEQ ID NO: 20267 - DNA, 3000 bp, Unknown; identical to SEQ ID NO: 4678
  misc_feature (1)..( 3000): 2750-1469P.txt file - cDNA_ID_1825050; gDNA_ID_1620721; Annot_ID_49201

SEQ ID NO: 20268 - DNA, 3000 bp, Unknown; identical to SEQ ID NO: 4678
  misc_feature (1)..( 3000): 2750-1469P.txt file - cDNA_ID_1825050; gDNA_ID_1620721; Annot_ID_165827

SEQ ID NO: 20269 - DNA, 3000 bp, Unknown; identical to SEQ ID NO: 4678
  misc_feature (1)..( 3000): 2750-1469P.txt file - cDNA_ID_1825050; gDNA_ID_2926191; Annot_ID_141051

SEQ ID NO: 20270 - DNA, 3000 bp, Unknown; identical to SEQ ID NO: 4678
  misc_feature (1)..( 3000): 2750-1469P.txt file - cDNA_ID_1825050; gDNA_ID_2926191; Annot_ID_201059

SEQ ID NO: 20271 - DNA, 3000 bp, Unknown; identical to SEQ ID NO: 4676
  misc_feature (1)..( 3000): 2750-1469P.txt file - cDNA_ID_1825061; gDNA_ID_1620721; Annot_ID_49198

SEQ ID NO: 20272 - DNA, 3000 bp, Unknown; identical to SEQ ID NO: 4676
  misc_feature (1)..( 3000): 2750-1469P.txt file - cDNA_ID_1825061; gDNA_ID_2926191; Annot_ID_141048

SEQ ID NO: 20273 - DNA, 3000 bp, Unknown; identical to SEQ ID NO: 4675
  misc_feature (1)..( 3000): 2750-1469P.txt file - cDNA_ID_1825069; gDNA_ID_1620721; Annot_ID_49196

SEQ ID NO: 20274 - DNA, 3000 bp, Unknown; identical to SEQ ID NO: 4675
  misc_feature (1)..( 3000): 2750-1469P.txt file - cDNA_ID_1825069; gDNA_ID_2926191; Annot_ID_141046

SEQ ID NO: 20275 - DNA, 3000 bp, Unknown
  misc_feature (1)..( 3000): 2750-1469P.txt file - cDNA_ID_1825081; gDNA_ID_1620721; Annot_ID_49192
gccagaaatagaggtagatgtgatgttttactacaatctctgttgcaactgaacattccaaattcaatgaaaggtctttgatctaactgactgatttttatatataacaaacaaagagatagccattgttaaagcttacaaagcataacatagaaacaacctaaaagaagtaataacaccaagagtcctgacatgatagagatagagagcaacatgcagagaaagagagtcatcgttaaaagacgaagccttcaagaatgtcgacacattccttaagattttgaatagccttgcggagattatgaatacaacgcttctttcgccttgcgttttcttcttcttcctcgtcgatcacttgagtcgaatcattctcttcctcttccttcttcttgttcagcgtgttctgcttgggacgagaagactcccccacgctctgacgaggacgacgttgagttctcacttccgttgttgtagctaccgagtcattgtccgattctggattcgctgattctgcaacggcgatgggaattggatgcgagggaacagatctggtcttggttgatcttccgctgcgagttcttattatagtttttgtgtctgtcacctctgtctctgaaagaggaactagggctttgtccgagaaaatagtggatgatctcctaagttcagtacagtggactggaagataaagcgttatcactttatttttctcgaaagactcggtctttttttttcttgataacctcttatgattgttttaaagactaaccataattaaaattaaagacattcgaatataaactaacttcagagttgataagcgtcatacaactgaattacatatgtgtcccaagaaagattttacgaacaatgcggtgaccattgaactacgtaccatcaatccgttgcgagatgcaaaccttatcaactatatagaaactttggtatttatgtatatattaagagatccaatgaaagttacgtacgtgatttcttggagctttattagaaacttagtagagtcatatatagacgtgattcaaaaggaaagggatctagtgaagaccttcttcacggctttccatgtgaatgaagaggttctaataagtgacataggaggtcttatactgaatctcggaggcgttgtagaatacgtataaaacgccgatgatttatcggtatcaaatgaagttttaataatagtgtcttcttttacgacaatgcaatcatcaacgctctctggattattattctcctcttcctctacattccaaaaccgagcttcttttcgcttctttttcaccatcgctaacacatcgagtttgttacaaatcccccacaccgtcaccttctgattgtagtagtctactttcactgaatatattcctgattattcgttataaagaaaatataataagcttattaattatttatgcatagtcgtctatgatatcataaccattaaaactattgattacgtacctttgagatgagaaagagccctcttgactttcttctcgcaaccgtaagaatacaaaggcaccatcatttctacgtactgtgcttccaccttgttgtacaccggcacgatttgaagatcacccattatactttaactatgtattttggtcgaattccaatttctaactcaaactatgcacacttacctttatatatagtagagatacacgaacttaggtgtgtgcatatatatattgacgacagtgattgggtttcatgcagaagagatgaggtgcatgttgttgaagtcgtcatgttataagctttttaggatctagtgacttggatttagtgtaaagtgtgtcaccactattctctttgttagatatagttcacaaaatataaccttctttagactttggatcccatgttacatgttcatcttttactttatcccaccaaaagaaaacttggattgaatcttttgaaatctaagcaaaagatagaaattattttcttagaaaagattagacaaaagaaagagaagacacttttgaaaggtgaaatgcgcttcgtcattacgaagcttttaattgttgccattttatttcttgacgtcggtatatctaaaagggaacggcgccggatctttgatgactcacacacagttcttcaccatgtgaaacccattagacttgttttttccatgcattctgaattttaaaccgcttttttccattatagtaaagtttaacaccccttcatggcttttgtaatgtctaaatttttcaatatccaaaacgtcgtataataatgaattaatgactatctacaactatcaaaatttcatgatataagtttattttcttgaaataaaatatgtattttattccttacaatataaatattcattataattcactcacatcattacatgatttttagaaactaaaagaaaccattacccaaattttttatattggctccgattggtgaccaaagaaatgaacaataggaattttggggaggaacaattttgttctatcattctttttttttgaggaatgatgaggaaaaatgtaggatccacctgtctgaaaatggatcaaaaattccttgcaaatggtaaaaaataccgaggaacaaaaaggaacacgactttcctattcattgttttcctcaaaagtggttaccaatcggagccattattttcttgcaatttctcgattcacaatgaattttggattcaactaaaaaaaactctttaaaataacaaccaaaacaatgaataataaattaataacagatggatatttcaggcgtctgaatgggctagagataagcccaataataacagcaggtaccaaactatccactaaagcccaataaaatatttgcctcctctccacgcatattgcgtgaaatcttcgtgatccggcgaagaaacagtacctgaatattgactacgcattataagaggttttgttttggggtttttccttcttcacatatcatttttctgattctcccacgaagatg

SEQ ID NO: 20276 - DNA, 3000 bp, Unknown; identical to SEQ ID NO: 20275
  misc_feature (1)..( 3000): 2750-1469P.txt file - cDNA_ID_1825081; gDNA_ID_2926191; Annot_ID_141042

SEQ ID NO: 20277 - DNA, 3003 bp, Unknown
  misc_feature (1)..( 3003): 2750-1469P.txt file - cDNA_ID_1825183; gDNA_ID_1620723; Annot_ID_49242
agatgtacgtaatctgtcgagttaggatataattaagagaatggtggaatttaattcgtacacatagaattaatggtataattaatttactattgttggtgtgagtagcatcaaatagatgatagaatagtattttgaacaaaaattctgatagatagtataagccttcaaactaaaattgtttccggacgaatacacgaaaagaaaaatgaaataatattaactttctaaaaactcatcgattgatgggtatacacaaaatggttaaaaagaaaaaaaaatgattaacagattttgagattatataatactgaaaatttgagtcggaaattgatttgcaatatgcaaaagacaagaaacatgaggcaaaggaaaaaccatttttcagagaaatctaaacatgtgaaattcgtttttctaaaagtaacaatttgcgaatttatcagcgacggatattttttaaaaataatatgtaatgtttctgttagaaagtacttttggttgacaaaaagaactgttacaaacttactttgttgtgtacgcactgttacaaaattatcaaatttgaatcttgaaaatggttaattagggttgtgtgatacgcactccagatctgtaatcacaaattagctaatgactataaagtcgatgcaaaaagtaaaacatagggaatgtatattatatgccgcttagttgaaaaccgctacatatctatgatcgatttaaatatttgaactctggaactgttgacttttctcttagacttaaattttggtaaacaatttcagcaactaaaatgagtgagaaaacttggttgttgaaaaaaaaagagagagtgagaaaactttggtttagttttctacagtgaccagctttggggttttgggcggaattaattagccaagtagggtctagaaaatgtgatcttttaacacatggccaaagtcgtttatatttggtgattctgtttaaaactcacaatttgtttttttcttttcttaaattttgaaatcatatctatttagaactaaagttcatcataaattttgatgaccctaataaataatatagcgtcaatatagagaacttagctggagatatattgtaaatatgttgttgtaacgatctattacgaataactattgaaatacaatacaattatttaaaagagcaatatataattgtataatttaccacatcattaggatacttcgccccaaacacatattttaattcgtttgaacgaacttaaataaaaaaaataaaaaaaatcattggttaaaactttttattgcagaaataattggttgttactgtagaaatagcggcttctattcgcaaccgtcagatatacaagtctaaagagatgtctttagtttagtcgtgactcctacaaggcatgtgtgtacgatcgcctgatagggaataatttaactttgcataatccatattttccgacaatcatcgagttgacatgattcgacatttggtcatacacgtaaatataacaacgtgcttctaattttaattttataagattaaaactatcagatagtactttttgggatataggaaaaatgcatctcatgtaataaaactatagcagaaacgtgtcttaaaaataatttacataataaatagttaacttgttttatcatgactataatatgcaaacattattgcggttgtacgcatgtaataatattactgtatataaactgttatataccagctcttataactttaaaactctatccattttcttaacgtaatgtatagtataagtgaatgaaatttttctctttttacaaatttatctggtttataaaagttgctaatatcaggcataatatggcttatggcgtatattgagcatatcagcatacaacacacatccctaaagaaaagactttggtcaaacatccaacgagattatcttttatagtatagtggctcttaatatgcgtatatacatatatataaaaaacaagggattcgtgacagagaagaaggatttgctttgccttgaaaggataacctttaccaaaaggattattttttaataatggaaactgtggagggatgtcatggtttttatattcaaagcatattatattgaaatagtatcttcttaagaacagtatatctttagcattatatatctgatacgcaatggatatggacgtttaataaacatgtgaaaagactagttgcagtgtgagcaggtgcaaataaaaagaaaggatcggagcccacatgcgaccatcgcaacatcatcaacggttgagatttgaggttttgttttcatgtatccgaatcttaagacatggttgcactttcacgtcgacatttgtcaaatagttatattctccagttcctcctagttgtatgagaatataattttgttttagagaaaatgtgcattatggtttttttttttttccaacagtttgcgttttagatactaattctgtatttcatggaaagagatggattcgcaatggtatttcacataaaggaaattttgtgttggatgatggtatgacaaaagctgtttggagggtataaattattaagttgacattaatttcaaaaatttataattatgtgttttaattctcttaattaaataaactgtagaggattttattttgttatgtatatatattgactataagttgtattctactagtttgttacaaatcaagcccgaggctcatcccataaatgaaataaaaaaaaactgataactatttcaattttatttaaaaaaaaaaaaagagtaattccgtaacctgcattatttggtcctcctactgtgtatctatttaatatttaaataatggtcctccctctcacctaaggagacatagagaaccatctggttctttaaggcaccatcattcaacaagtaaacaataaaggaaattaaattatcacaagacagaaccacaaaatcctttggagatctgacactggtaaagctcaaagtgtcaaactatg

SEQ ID NO: 20278 - DNA, 3003 bp, Unknown; identical to SEQ ID NO: 20277
  misc_feature (1)..( 3003): 2750-1469P.txt file - cDNA_ID_1825183; gDNA_ID_1620723; Annot_ID_165865

SEQ ID NO: 20279 - DNA, 3003 bp, Unknown; identical to SEQ ID NO: 20277
  misc_feature (1)..( 3003): 2750-1469P.txt file - cDNA_ID_1825183; gDNA_ID_2926187; Annot_ID_140847

SEQ ID NO: 20280 - DNA, 3003 bp, Unknown; identical to SEQ ID NO: 20277
  misc_feature (1)..( 3003): 2750-1469P.txt file - cDNA_ID_1825183; gDNA_ID_2926187; Annot_ID_200715

SEQ ID NO: 20281 - DNA, 3003 bp, Unknown; identical to SEQ ID NO: 15825
  misc_feature (1)..( 3003): 2750-1469P.txt file - cDNA_ID_1825193; gDNA_ID_1620723; Annot_ID_49238

SEQ ID NO: 20282 - DNA, 3003 bp, Unknown; identical to SEQ ID NO: 15825
  misc_feature (1)..( 3003): 2750-1469P.txt file - cDNA_ID_1825193; gDNA_ID_2926187; Annot_ID_140843

SEQ ID NO: 20283 - DNA, 3003 bp, Unknown
  misc_feature (1)..( 3003): 2750-1469P.txt file - cDNA_ID_1825197; gDNA_ID_1620723; Annot_ID_49237
tacgcgtaaatcgtatcttctacatcggttgacaaaaaaaactggtatcttctacacttttatcttttgagcttctctgttttgtcgccacctaatgtgtaatgtcttttattcaatgcaaaacccgtatcttctacatttcgttgacaaaacaaattggtatcttctacactgtgtagtgaccacaatgtatcatcaactggtattgcatcagctcagaagcgagtcatttgggcattgtatattctacggaccaatttttttcatttttagcaaacaaattttacaaactacatatcggttgtccataaagaaaacaagtacgtagaaaaataagaaaacaagtacgtatacttaacgctaataaatagcaaccgacttttgaattatttgatttaactctttaaattatttcttagaaagagttatggaagaattaaaagttttaaaaacatttgatgctaatctagtttttctttggtgactttttttcaaccaatttgagatgttttaaatggggatctgacaagtaactattgtaccaggaatacgcaccatttcctttttttgtgcttataaatacatatttatttattttatttatataataatttgaaaacttagaaattacactaatttattaattctttacttacaaacaattggttttagtttttaaaattatccaaggctgatttcacctaattaaaataaccatgactagattttaacccgcggacaacttattttttaaattagtatatataaaagtttgcaaattaaatctatttatttttattttatagtttacaattgttattaaataacgtcttaccaaacccgtctcgccaaatccgccccgtaaaaaaaaaccgcggtacaccgctaatttaaatatataattaaaagaaatattttacgggattgcaattgtattttggtttgtcaaacaaatatttgtttaaaatagttgccaaaatctagttcaaattttggagaaaaaagatttattggatagataaagaatatatttaggtgggttttgctcattttaagggattgcaattatatttttgtttgtcaaacattttttgttttaaatagttgctgaatatatttggaatatttttagtttattaatcaatttattgctggaaaaaaatcaataattaatactcaatggcagcctagtaaataagtcccaactctaagatttatttcacaaaatggctgcaaaaatgtatatatagatgattcattatttcattttatgcggtaggagtaaaaacaacattaactagcaaaaactataatacacacacaacagtaactactcatcgagtatggcattcatggatacgaatcaaatctcaaatcgtataagcctggccattattttattttacaatatttgataatgtgctacctaaatatcaaaattttagaatattctgaaataaaatgtcgaatttttgtgatagccttaaattactacatgctcacgtatgtaaattttctattctttcatagttaattttctattaaaatgtacaatttccagtttgatggtatgaagatcaacaaagtaccataaaaatgtataatttctatttcttcctaattaatattctttaaagtgtaattttccagttcatccttgttaattttcttaaataataaaatgtaaaacttacaaatttcacggactttattaacagaaatgtaaataattgtaaataaatgtaaacatactgtgtcacaagaagacatgacaaaaaataaaaacagtagaaataaacttttttctgggtgcgtgtggtaaaacaaacatggggactgatccaatgaagtttatcgcaatttctggaatttcagtcggtgtattaatcatcatcgcactgatagtggcttatgcctgctatcgtgcccgaaaggaaggaccagtcagaggcgacggacgactcacacctattgtaatgatgatatgatatatcacctattttcgatctttttctaataatttattttatgatgcaactttttagattactatatactatagaagagcatattgtaattctattttacctatataataataaataatatttcggcgattttgtcatatgctggagtgttacattagatgatgactagtagggtttttttttttatgtgaaaacaacaatcgttgtgtcatataacgcgaagtgacaaacaaacaattcgaaatattagcaatgttacaaaattcgaaatatacgcaatgttatggtggtgttgaccgaagggtagtttcgtaactttacatcatcgcgtggtcgtatacgcgccgatgagatcacagacggcattaatgggctccggaagaagaaacaaatgattaatttaaggaataaattaccactaaattcgtttgattatttccggaaaacaattaactaataaaactataactaacctttgtttaattttttgatttcgcgtcttcactgttgtggatttcttctgaatcttctgagctcgcttcacctacaagaagacaacaaggatcattttctctaggttcgtagattctctttcttcttcttcttcgtttggatctgcttagtgaagaagataatcttctgaaaaattgtttgttttttttctgaaaatctgaatacgtaatgatttgagctgaatctgagttagattcacatttatattctggatttgtgctatttgatgatttattagatcgatcatcttgttttcttctttcgcctttaagtatgtttgctcatagtgttgctcttccagattccagatcctgaagaaggtgaaatcttatctgtgatccagtggaagattgaatcaagtaacagattcacttagttcacttgcgtattgcatgcccctgaagataacattttgaataatgttgatattgaattatcacctataagctctggttcttgttgcttgtattggttctgggtatctactagtgaagaaaccatg

SEQ ID NO: 20284 - DNA, 3003 bp, Unknown; identical to SEQ ID NO: 20283
  misc_feature (1)..( 3003): 2750-1469P.txt file - cDNA_ID_1825197; gDNA_ID_2926187; Annot_ID_140842

SEQ ID NO: 20285 - DNA, 3000 bp, Unknown; identical to SEQ ID NO: 4698
  misc_feature (1)..( 3000): 2750-1469P.txt file - cDNA_ID_1825205; gDNA_ID_1620723; Annot_ID_49235

SEQ ID NO: 20286 - DNA, 3000 bp, Unknown; identical to SEQ ID NO: 4698
  misc_feature (1)..( 3000): 2750-1469P.txt file - cDNA_ID_1825205; gDNA_ID_2926187; Annot_ID_140840

SEQ ID NO: 20287 - DNA, 3003 bp, Unknown
  misc_feature (1)..( 3003): 2750-1469P.txt file - cDNA_ID_1825212; gDNA_ID_1620724; Annot_ID_49261
agaaaaagatatttaattgtgtggtggaacagatgatgtacgaagacatgaagagtagagtcgaacatgtggtcgagagcggaaaagttgagactgcgtttatcgcatgcgatcaatttagttgtgtgttcgatctgtggacagataaattcactcgtcatgaccatcctaccattattatggtatgtaactattttgtaatgcatggtaaaagtttcgtcacaaattaatgtttctaaaaactcgtttttatctattaatttgtggtgaaggtgctacaacataacgaaacagagatgatgccaaaccttatatatgtttcaagagaaaagagtaaagtttcaccacatcatttcaaagccggtgctcttaatactttggtatcaactaatccatatctcggttaaactgtcatttctatatttgtaatatttcgttaaccacaacatgtattttctttgtagttacgtgtatctgccgtgatgacaaactcaccaatcattctaacactagattgtgacatgtactcaaacaatcctacaacaccacttcatgctctgtgctatttgtcagaccctaaaatcaattttgatttaggatttgtgcaatttcctcaaaaatttcaaggagtaaacaaaaatgatatttatgcatccgagctcaaacgcccatttgacatcaacacggttgggtttgatggacttatgggaccagttcatatgggaactgggtgtttcttcaatcgacgggcgttttatgggcctccgactactttgattttgcctgagatagaaacatttgggccaaatcggattgccgataagcccattaaagcccaagatattttggcgttggcacacgatgtagcaggatgtaactacgagtgcaacaccaattggggatccaaggtaagattaaaatgaactttagctttcttttatgtatgttgattttttggttatgtttacagattttgtttcttttacatcaactagtcttctcaaaatccatatttataaacatattaacaaaatttttgtgtaattaacataaacacaaaacacacataaaaatgaaaaaaatgaaaaaaaagtatgtttgcattcacatgtaaaacaatcgactctccaatcttgatttctgtgacattgttttgttattacttactagccatttgtcaaactttacagataggtttcagatatgggtcattagtagaagactacttcacaggatttatgctccattgtgaaggatggagatcaattttttgcagcccgacaaaagctgcattttatggagactccccaaaatgcctaacggatgtaataggccaacaaatccgatggtccgttggacttcttgaagtagctttttcaagatacaatccacttacctatggaatcaagccattgagcctattaatgagcttaggttattgccactatgcattttggccattttggtgtattcctctcgttgtctatggaattttaccccaagttgccctcatacatggagttagcgtctttcccaaggcatcggatccatggttttggctttacattatcttgtttctcggtgggtacgcgcaagatctatcagactttttattagaaggaggaacttatcggaaatggtggaacgatcaaagaatgtggatggtgagaggactctcttctttcttctttggttttacagagttcactctcaaaaccctaaacctctccactcaaggatataatgtcacgagtaaatccaacgacgataatgaacaaatgaagcggtatgagcaagagatcttcgattttgggccctcttcgtccatgttcttgcccattactacggtcgccatcatgaatctgctagcttttatgcgtggcctatatggtattttcacttggggagaaggacccgtccttgaactgatgctagcgagtttcgcggtggtgaattgcttaccgatctatgaagccatggtgttgaggatcgatgacggaaaattaccaaaaaggatttgtttcttagctgggctcctcagttttgttcttaccgggtcaggctacttcttcctcaagtaacttcaccattaggccattgtaaaaaaaaaaaaaacacttcaccatgagggttaattttcaacaagaatgatatgaattaatgcatcttgctcaagctgaagcaagagagaataatgtaatgaatccttcttaatatttacttttttatctacaattagcgcgcgcacacactatataacctatttgaatcttggttatgattggtcacttcttggattcatatatttttgctataaaagtatacacaaacgtagtatacattatacattttatccatatatacgaatgtcttaatcatacaatcgtgtggaagtaatggtggttcatattactatatcgctttaagtaaataaatctcgttttcaatgtaattggaacatattgctatgtgttagattacgacattatgaggtaactatttgggtactattttaatattttttcatctcctctctcgccgacgccaagatatgtgaagactgaagacagttgctctcacaacccctatcatcagccacgtgtttttttctcctttttattcaacattttctccttttaatttctcaacaaataccatcttttagaaagaaaaaaacaagtcaatatatatttttattatttatatgtatgtgtttaaattaatttgctttcacacaattttactaatataactgacttttaatacaaaaatggtttaggtatttaaaacaaatttcagtaatagtctagtgaaagaactaaaccgtaagcttaaattaaccattcattttgtgaaactgttgaaaattgaaatcctaaaattgtctgggagaacatatcgactctttttgacaactaaactataaatatcatcaatctagtagaggtaagtttaccagtcttctccaaaacaatttgtaaaaatagagtaactaaaacgatg

SEQ ID NO: 20288 - DNA, 3003 bp, Unknown; identical to SEQ ID NO: 20287
  misc_feature (1)..( 3003): 2750-1469P.txt file - cDNA_ID_1825212; gDNA_ID_2926184; Annot_ID_140712

SEQ ID NO: 20289 - DNA, 3003 bp, Unknown
  misc_feature (1)..( 3003): 2750-1469P.txt file - cDNA_ID_1825216; gDNA_ID_1620724; Annot_ID_49259
aaattgaaccgtttgtaaattcagaaaacgttcccaaatcagttatgctgaagaacaaaaggccccgtcaagttagtgaagtatctgcacttggtgaggcacaatctaaccgccactgatttgctagtacatagcttaagtttccttgctaaatctcacatgctgtgtttagatgtaggcataacagcttcaaacctttggagctctgttttgacgcaaccccatgagtttgcacaatcgtgcatcacctcacagtggagttctcctcagcaatgtcatcgtgatgcaaatgaggatgctaagaaatctgactggctaaataactcttactctgtgtcaaatgtagcaaaagactcaacactgaacgaccaaatggtttccccagtcgagcagaagaagcctgagacaaccgctaattatagattatttggaattgatctgatgagttcctccctagcggttcctgaggagaaaactgcacccatgcgaccaatcaacatatccaaaccgactatggacagccactcagacccaaaatcagagatttcaaaagtatcagaagagaaaaagcaggaacctgcggagggatcaccaaaagaggtccaaagcaagcaaagcagttctacaagaagccgtaccaaggtatatatatgcctacatggctaccgtgaagtgtatatacattgtgtaatctgtgagttgcaaaacagatacacattatgtataatgtttgcgggactgaacaggatcctgaattctttatcgctgaacaggtgcagatgcaaggcgtacctgtgggcagggctgtggatttaaatgcgctaaaggggtacaacgagctcatagatgacattgagaagctgtttgacataaaaggggaactgcggagtcgcaatcaatgggaaatagtgttcacagacgatgagggagatatgatgcttgtcggtgatgacccatggccgtaagtaacttactctttatctcttagtcaatagaatcactacacaaaactcatatctgttgacttaatttggtggtgcagtgagttctgcaacatggtgaagagaatattcatatggtcgaaagaggaagtgaagaaaatgacgcctgggaaccaactccggatgctgttaagggaagttgaaacaacactaacaacaacttccaaaacagataatcattccaactaatttttattctattctctatcagtcttcgtctccttcttatttgctttgtctttcggaattatcttgtttgtgtctgtgttttgttgcgcatggcttaaacaagaaactacatcccctgaggcaaaaaaaatggctcgtttttttggagcctcttatggagaaagggggtttatggggagagggttttctacttttaaaataggcttttggaagtttctttttcttctaggaacttgtgtgtaagagaaacaaatatgtaacgaacagaaagaaaaaaaaaaaaaaaaaaaaaaaaagagaatgagatttgtgaataacttgatgaaggacttttgggactctgggattataagagattaaagagggattatacctcatggctctcgtgttttctgattctttttcgtagttgtgttttctttgattttgtttttcatctaagttttaatgtatatataaaatttcaaacatggctttcttgtatttgtcaaatccccaaaggtacatatattatcaatatttaaaatgttaaataaacaaaactctagacctaaaactatttcaggttttcccactaaccttaacaatgattcaagattattgatgttttgtctgtgaggacatgtatgtggccgctcttgccaccatattcacaaacgtaattgtatgaagtatggaccaccttttcgctactacttctggatccccttatgtttgtaaagtgtatcattcccttatatcactattcactcacatgcattaaaatatcgaatgctgcaaaggaaaaaagagttatttttctctttagatatcatttgggttatgcatattacttggattagtccaatatgtcgtgtacaaccattctcgctgcaaaacaactacaatatgtcaacatagtataacacatgctgatctggtgagattataaattgtgaagtttgtctttataatatgtacatatagtatttctttgattatgacaagtgtgtagaaaatgttaggatattattctaaatcccacatacgaaagattagataatgattatccaacatataagttcaatctaattttaattagtgtatcatttggggaaaaaaaatcgtgcatatctggttgcttggtccaaatatctatattttctgacggtccaatatttatatacgtaccacataaatacacctatacgaatctctttactaatacgtcgataccgttcatagttaatgacgttatttactgccgagataatgaagtgatgatgtaggttatttattgccgagatttgtgaaggcagtggatctcacaatccctatcttttcctcttcttttttttctttttttctttccatatatagagaagtttaaatttaattgtaccattaaaagctcaccaaataccaacttatacatacagtcagtatctatatcaggaatttatatgtatgtgtgtataccgaataatagtaaactcattttactaataaataactttgttttattatatatttgataaacaacttgttataaattattttaatatgttaaatttgaacttattaaattttaagtaatattctagtgacggaagtatacattgtatttaaattgcatagatgtaattacttattttaaaaacttatagcactattcagtgatttacttttccaacctaaaatcgaggtgtagaatgtctactctggaaaaaaaaatcgcctataaaatatcaatatcaatggtgagttttgttctatgtaccaagtttctctaaaacaatttgtctttctattaaaaataaagagtaccacgatg

SEQ ID NO: 20290 - DNA, 3003 bp, Unknown; identical to SEQ ID NO: 20289
  misc_feature (1)..( 3003): 2750-1469P.txt file - cDNA_ID_1825216; gDNA_ID_1620724; Annot_ID_165907

SEQ ID NO: 20291 - DNA, 3003 bp, Unknown; identical to SEQ ID NO: 20289
  misc_feature (1)..( 3003): 2750-1469P.txt file - cDNA_ID_1825216; gDNA_ID_2926184; Annot_ID_140710

SEQ ID NO: 20292 - DNA, 3003 bp, Unknown; identical to SEQ ID NO: 20289
  misc_feature (1)..( 3003): 2750-1469P.txt file - cDNA_ID_1825216; gDNA_ID_2926184; Annot_ID_200492

SEQ ID NO: 20293 - DNA, 3000 bp, Unknown; identical to SEQ ID NO: 6203
  misc_feature (1)..( 3000): 2750-1469P.txt file - cDNA_ID_1825220; gDNA_ID_1620864; Annot_ID_51316

SEQ ID NO: 20294 - DNA, 3003 bp, Unknown
  misc_feature (1)..( 3003): 2750-1469P.txt file - cDNA_ID_1825234; gDNA_ID_1620724; Annot_ID_49251
aggttgattcgtggttgtcggttttgcgccttgattgcaagtctgaaccagaagaaaggttatcaaatggatcagtcgaagctccagaataaattgaagagcggtcactgctctggatagttttcatttatatgtatataatgcttctttttagatgtagtagaattcacgtcaatgaaaggttcttttactgaactggtggttacaatatttttggtttacttcttttagctgctaaagacattggaatatattcgtttcttgaataggcaataattctagttggaaaacaaaagtgattagaaaggcaataaatcctgagcctttaagtccttgtctgatccgacccgatcaaaacatgttggtataaaatcttccaataggttcacatttttgaggtccctgtttgcacatcactcttctcagtcctcacgcatcgtatcagagaaaatgagctcccaaatctgcagatctgcttctagagcagccaggtctcttctttcttcagccaagaatgctcgtttcttctccggtacgtaaattttctctctgatcctcttttttcctgaaaatgtgataaacgtcatgggatgatacatctagatagacgtcaaatattttatgaatctacctgtggttttcttcgttttctagattctcgattgtattgaatcagtgatctgttgtatcgtttccaatctaaaatatttgatcgaagcttttacttgatcctacgtgtgttcccatcaagaaaataaattgtttgtttcttgtgagagaatacttcttgctaacacattttatgtgaaactattggatacacaaatttagactctcatattccggtttttgtctcatcgttgctttgcctacataagacttcttattgattttcccattaatataaagaggatgtttaagatctgttggttttattattcacatatgaacagaagtcacaaaccgtgtttcgtttacattttgctgatacgttgattattatatgttttcagaaggccgagccattggtgcagcaagtgtggtgcatgcgactggaaaagtccctcagtatgcatccaactttggaaaatcgggttctggcttcgtctctaatagctggatcaccggactccttgctcttcctgctgcaggttttacatgcataatgtttcctataaatctgtgatttactgttttatgaatatattctacaggacacattcaaatcttcacttttgtaacacagttagtgtaaattaagcctttcaacgttttgactccaaaatgatgtctaatatcagttatacgtgcaagacttatagctgatgagcttttttgtttatctatattcatgttttactttgatgtgatgattaacagagccttattatattcgccttgctttcttttttatcatttctgttatagccttcatgctccaagatcaggaagcacttgctgcagaggtaactgatcaccaaaccaaacacacatatctctatatctttctcttgtgttatccctggtttctctgtttaattggatttctctgttcgaatcagatggaacgcactttcatcgctatcaaacctgatggagtgcagcgaggactggtttgttacttgttattctcttgtaatttcatgtcttctttattcaaatgctcaaaactcttaaatctttaaactccctccagatatcagaaatcattacacggttcgaacgcaaaggatacaagcttgttggcattaaagtcatggttccttcaaagggtttcgcgcagaagcattaccatgatctaaaggagagacctttcttcaacggcttgtgtaacttccttagctcaggccctgttgttgccatggtaaagaagcaactctcacataaaaccgacttgttttagctctaatgatccaataagacattgtttttaggtatgggaaggtgaaggagtgattagatacggacgtaaactgattggagccactgatcctcagaaatcagaacctggaactatccgaggcgatctcgctgttgttgttggaaggtaccattctatttttatgacatatgtatatatgattgcttgtctgttttctcggagattatagttttgcttttgttttttgggaaattgcaggaacattatacatggaagcgatggaccagagacagctaaagacgagatcagcttgtggtttaagcctgaagaactcgtttcttacactagtaacgctgagaagtggatctacggccagaactgaactattccctctttctcccttattttcaaccgttagatcagacataaataattacttcttttgttttttcttttacccaaacactgaaaacgtaccgggaataacaaatttactgcatttgttatcaagtttgttctaatagacccaatgaaattaggccacgtgtgcgatcatgtaaccggtttaccgtaatgtggacttgaaatccgattagcaagcgtaatgttgttttaatttctcgttggaatccgccgactccattataaaatctcagagaactagttcagctgcgagttgactcgttcatcggcttcttcagaacgatactttagcttcgacctctctctccgatcatcttcttcgtcgctttccctaatcgttttctcttgcaaggttcttacttcataattcgtaagagtttcctcctttcttgacgagtcctgatataggttttgattcgtgttcaattgaattgttagggtttagtgcttctcagggattcggggaacatatacttaattgttttcatttcatgcttggattaaatttctttatcttccctggattcgattcttcctttatcttctatcttttgactctcttgactaatttctcactattgtaacggagttttgtttgatttgtgtcaaatttttaaagaacagtgtataatttcttacatatcgtataaaagtttgtgtttttttcggtaaaagaatttgctttgtttgtgcagatg

SEQ ID NO: 20295 - DNA, 3003 bp, Unknown; identical to SEQ ID NO: 20294
  misc_feature (1)..( 3003): 2750-1469P.txt file - cDNA_ID_1825234; gDNA_ID_1620724; Annot_ID_165898

SEQ ID NO: 20296 - DNA, 3003 bp, Unknown; identical to SEQ ID NO: 20294
  misc_feature (1)..( 3003): 2750-1469P.txt file - cDNA_ID_1825234; gDNA_ID_2926184; Annot_ID_140702

SEQ ID NO: 20297 - DNA, 3003 bp, Unknown; identical to SEQ ID NO: 20294
  misc_feature (1)..( 3003): 2750-1469P.txt file - cDNA_ID_1825234; gDNA_ID_2926184; Annot_ID_200485

SEQ ID NO: 20298 - DNA, 3000 bp, Unknown; identical to SEQ ID NO: 4708
  misc_feature (1)..( 3000): 2750-1469P.txt file - cDNA_ID_1825242; gDNA_ID_1620724; Annot_ID_49245

SEQ ID NO: 20299 - DNA, 3000 bp, Unknown; identical to SEQ ID NO: 4708
  misc_feature (1)..( 3000): 2750-1469P.txt file - cDNA_ID_1825242; gDNA_ID_2926184; Annot_ID_140696

SEQ ID NO: 20300 - DNA, 3003 bp, Unknown
  misc_feature (1)..( 3003): 2750-1469P.txt file - cDNA_ID_1825262; gDNA_ID_2926151; Annot_ID_198058
ttgtccactttatgaaattatagtccactaactcacatgggcatggtctcatcatgcacttctagtctctctattctctaatttagattactaactctaaatccaacctaccaattcctcctaataatagtgacaaaaaatgttcctctttaagagaataaactttaaactgattgatattagagatcccttgatattatccatattaattgtcttaaattcgatgttcatcttgattaattctatgtatgaactactcatatatataccaaatgttaactgcatgatttataccattgttaactttttctatcttataactgaaattaaatatttgatattaaagaataaagaaatggggttcatgcattacaaaagaattagaatcttatcggtaaattaaatatagaattcttaggagctttatcaaaaactaccaaataaaatgtgcctaaacattcactgccaataactttttgacatggagattttgactagtccaagcaaaactcattcatatatgagaccttttctcgatgctacataagttaataaatattaaaagaatctcagtttcaaagttgtatttttggctaaaaccattattttgtagtcttcgaggtcttgtcgtccttcatttgcacgcctcgtttttattatcgttcgtatttcgtatctatcatgtatgcattaggatcttatgtttgtatgagtattaaattctgaaataagtttttgattgtgtccgtgacatttcaattaagcataaacccttattactagccaaattggaagttggttggaaattagaaaattaattttctgataagagtaatgtaaactgaaaaatacttttgagcattttcctcctactttttatgaaaaatgtataaaagtattccgtgtattatcattttttctctaaagaactcccaaatattggttaatgtatagtgtgatcattagagtttgaacaccttgttggagagtgatctaaactgatctaccaagatcgaacaaaacaaccttagatcatattaaactgattgagactaaccaaaattacaaacttatactgcaaagccatagtaaaaaatcttagataattgtgaatatatattatttatattattatagtttaggaatttagctttatagtatgtatattatttattctgtagtgatcttgaacttcaatttattttcatctttgtataataacagttaatactaattattttgtaacatacacaccttttttgttttgtttttattctcatcaaatttattgtttttttttttttttacagcaaatttatttgttttgttcaacatagcaggatagagaaacactgacccactaaaatacatcacctatgatttctgattactactataattctgatccaagaaaaaagcaattactctaaattcatatatatatatatatatatatatatatatatatatatttttttatcaatagagttgaaaacttttaaaaatagcttctgctagttttagcaaaaaggtgaaaaccagagtaaaagcattcttccaaataaaatagggtaaaagtattactctaaattacactttttctaatcacaaatatattaaaaattgaattttgtagattattattataaaaataattaataattattctcacacatttttattaaactctcatcatattaattaatttggtttaacatatcataaaaagagacaaactacgatttctaaccactataagattacttatccccaacataacagttcttgaagactacattctctagccacccaacttctatagattatcacaattttaactattacaggctctcttttcattttgcaatttcctaagaaacgttctatattgtgtaaacacgtgacaacaccaatgagctaaatcacaatttacaaaagaactaattcttttttcaaagaaaacaataaaaatcatgttgggaactttggattcttggtacaacgaggcattaaagtctgtggctctctccttcttgaaaatatttacaatgtcatcttggaccgtcaaaatcttcatttactatattacattaatggtggtatatatttaataatcccatgtaacatctgtgcaagtgcacttgcttattaatatagaacataaccagaaagctgcaacaattctgatgcacccttgtttgttatataatcatcatcacaaatatttttagtctattcttagttcagttatttttgttttatcataagcatcattttcatcaacagctgttatattttctactctgttcagtggagatagtgaaactgttgcttttttttggacgtttgcgaaactgttttaaatgtaaaataatcaagcacgagagagattatccctccttaattttcttgattaaacttaagctaatcgacaaagaaaaataaaataaacctttaagacgatattccttattttagcacataatttatctaagttataatttcaaaacaaaattcaaattacagtatttagtctctacgaaaattaaaactaggaaaattaagaaagttacaataagtttttttccaagtataaatatattttatgagagatgaggtttattcttttatcaaaaaaaaaatgagaggatgagaattatttatgtaatttatagttttttttttgttatacgagcttaccgtatatgtatttacaaaaggattgtaaaacacaatcgttttttaatttactaatatcagctagttaacatattgttaattactattatttgtttgtttaagttatataaatttttatttaccaaattaactcatttatttatgatgtttgtcgtgtatactatatatatacacattcatgctatcttccttcgtctcgtggtatagttacttacatgagcatcaacttcacttatagctaacttttttcttctctttctttctctctggctcgtcgcttttagaaaacgttaattcaatatg

SEQ ID NO: 20301 - DNA, 3003 bp, Unknown; identical to SEQ ID NO: 20300
  misc_feature (1)..( 3003): 2750-1469P.txt file - cDNA_ID_1825262; gDNA_ID_1620725; Annot_ID_49272

SEQ ID NO: 20302 - DNA, 3003 bp, Unknown; identical to SEQ ID NO: 20300
  misc_feature (1)..( 3003): 2750-1469P.txt file - cDNA_ID_1825262; gDNA_ID_1620725; Annot_ID_165940

SEQ ID NO: 20303 - DNA, 3003 bp, Unknown; identical to SEQ ID NO: 20300
  misc_feature (1)..( 3003): 2750-1469P.txt file - cDNA_ID_1825262; gDNA_ID_2926151; Annot_ID_139295

SEQ ID NO: 20304 - DNA, 3000 bp, Unknown; identical to SEQ ID NO: 4731
  misc_feature (1)..( 3000): 2750-1469P.txt file - cDNA_ID_1825277; gDNA_ID_2926149; Annot_ID_139239

SEQ ID NO: 20305 - DNA, 3000 bp, Unknown; identical to SEQ ID NO: 4731
  misc_feature (1)..( 3000): 2750-1469P.txt file - cDNA_ID_1825277; gDNA_ID_1620725; Annot_ID_49266

SEQ ID NO: 20306 - DNA, 3000 bp, Unknown
  misc_feature (1)..( 3000): 2750-1469P.txt file - cDNA_ID_1825281; gDNA_ID_2926149; Annot_ID_139238
gtgaggcatagaggtgtcttacgcgaatccatgagagagtctggagatatgctcggaagcgtttagtattgttgctcgaaggaaatgagggtcccaacgactcgtgaggagcggggtatgctcctaaggtaccggtaactcgagggacatggtgtctttagagtacgaggggtacggtggcttcgggtgacgatccgagagcacgctttagggtgacgatccgagagcgagttttgtggtattattttctccaagtgtcgtaactcgatgactttgtggctgagagtgagccgacacaactcagggtttgactttgagtggggaagataatatgtgtgatatccgagataccgtaggccgaggcctgagagtgacggtttatgctcgaagattgcggtctgagagtggagagtaagttgtgagcaacaatgactagtaaatcgtgagtatatcgactggatagagagacctagagggggtctggttggagggaatgcagactgtagtgatggttgcacggagttcctcggagtggaagggtgaagctagattcgaagacgaatctatgttagtgggggagaattgtaacgcccgtgaaccagaaaatcggttaggatttgtttttaaatcatccggtttaattggttgggttaattggaaaccctagagtgtgcctataaaagaaggaaactcgaaattagggctttagttagccacttttcgttttataaaggagaaaaagagagaaaaggagaatgagcagaatcgttagggtttgggagaaatcagtttcgtcatatcaaatcgtggtaaaaggtaacaaaatttggtagagttattcccaaatcctttatcgttattctccagtttacagaattgaatttggattaaaattggttgagttattcgcagtttcgtgagacacgttttctcagacgcgaattaggaccagcggagattgaaactgagatcgtggtctcgtctgttttccgatcggcacgagattttgtgggcagctttgtgacgtctgcagctaggattttaccggagcgattgaatagttaacggttagcttgtattttagggtttcgtctttgagactgtttgtttctggtgttttcctgtccagtttgcttcaaggttgcttttggttgtggacttgttgtaggacgtttctggactgtttccgacgcaaggagagtctctcctgggtttaattgctattagaatcaatttgttaaggtgagtgcgtgaccatgagcttatctaagcgattgggttgtgtgatttgttttgtgtgatgatatgtaagtgttgtgaatgtgttttgggtgaattgttcaatgactggtttgtttgtattgtattcgtgattatacctttgtatttgcttgtgtgtatagttcgtagatgggagtatcgcctcactaagtatttatgataatacttacgcatctcattgtgttgttgatgcatgtaaagataaagtgtgatcgtggaatcataacaaggaagagaggatgatctaggaactcgtttgttttatttttggtgtttttggttattggaacccggttaggattgtcagttattcttggttttgttggtcgatttatttatttattcataaaatagtatttttgacttgcagtttaattattatgttattagttggtttaattaaatatttatgagaatatttaattatatttaaaaaaaaaaaatgggtcaagttgtttcacaaacatttaaatatttctagatgtacctttgctctttttctcttttcattcattttagaaaatgatgaaattattataaaaaattcaaaaactgtattaattatttcaagttacaattctacgtattagtatacaaaaaagatcattataaaaaagttgtcagccaaaatttaatattaaacatcccgtaagtttaacgaatccaatgtatttcaagcagaagtccacatcagttgtctccgtgtaaaatggtatatgtctttgaaaagcatcacgtttgtaaatggaaacacaatgaacacgattacacgaataataagttaataacaacaaaggaaacatgatgtgtttgatgaactttgtggttgtggccatatttttgagaagaaacaaatctatttggtattttctatttaatatgtttgaaacattttatttatactgatatccgaaagcttaatataacaataataagtaatgtaattgtaaaataaaattttaattcatcactttaataaagaatatatttaattaatcatttttaatttatctatttttacattatattaactaataattaattataaaatagtaatatttatcaaaatgatcaaataaaataaaaatattaaataaatagtttagtaatagaaaattgtatttttattatgcttctgttcctttttgtttgatcttttaggaaaaatacaaatattaagaaaacgtattaaatgttgttttaaatgtattattttttgtgatttacaatttttaagaactctaaaccaataatatttaataatttgtattgaagtttacaagttatcaattataactaataattattgcattgaaaacctaaaaactcaatttttttgaaataatttgtttttcttaaaaaaaaaaaaggacaaagggagtattaggtaaaagtttgatgctaaaactatactcaaatggtgtatactgtattggcaatggttcatggttgcctggttggtagcaaaaaaacacagatataattacgttaaggctatcattaaacaaagagggtctcgcaattaaaactacactaattcattgtttacaagaaaagaaattgttacttctttggaaattggccattgttaattggaaatcgtgaatccaaccaacaagacatttctctgactctcttcttccttcttctcctccaatttagggttccttcaaattctctctgatttcgtttgaaattgggggctcctcttcgaagatg

SEQ ID NO: 20307 - DNA, 3000 bp, Unknown; identical to SEQ ID NO: 20306
  misc_feature (1)..( 3000): 2750-1469P.txt file - cDNA_ID_1825281; gDNA_ID_1620725; Annot_ID_49265

SEQ ID NO: 20308 - DNA, 3003 bp, Unknown
  misc_feature (1)..( 3003): 2750-1469P.txt file - cDNA_ID_1825293; gDNA_ID_1620726; Annot_ID_49299
gccaaaagaggagacattaatggtgaagaaagcagaagattgggttatgggtagacaagatgagatgtttatgagttgggaagtgaaaacgaagagagaggtttatgtgaaggaaatgaagtggggttgcattaatggagatgagagagagaatgtggttgaagagttggctaatggtttcttcacttcctttgtggatgaattcatctacgacttagtgttgtgataaagttagtgttttgggaggaaagttaagattttgattagattcataatgtattagatatatgctatctcaataaaactatatgtagttttgcataaggggaatgattcgtataaaaacttatgtaggtcatatgttcgttttccatttttaaaatctagaatgagagttaagagtccatagtcatttatgtgttgtttgtttttctaactagatcttaatatgaattattagttttctttatggtttatttttcgaattatctaaatcaaattcaatagccaaaatatttgaaagtcaaacgaaaactgtgtccttactcattgtatgatttaaaaaaataaactgaaaagacatttataatgtttcacaatcttataaaaccattattaactctaaacaaaatgttatgttcaaataagtgttaaactttgtataaaaaattttagtagccatttttgtaccagagatgtcaatcagctttcttacatcatagtataacttaaagacttgagatctcaatgaaatgaacacatttgaccaaagttatgtttttggaccttttcttgtttattcgagtattttcagtatctattaatatgtttttttcactattttcgaaatacatagatgcataattaattaacaaatgggtgtgctctgtataatgtaggcagtcacccataatccagcatctaaaacgtttaattaaagtttgttattttatacaggataagtgttatatcataatacaatatattttttttttgtcaaaaacataatacaatatataagatatataatctaaatatcttagattatttacggaattagtcaaatggttgatcagtagtggttgtgtttttgggaaaacatcgaatatactggattttagacccaaatatgagaaactcggtcgtgaaggaaaatcattctttatgatgcgatgccttgttgcatcttatttcttgggaagaagcatttgcgaggcccctaacatagtaaaaaatgcatctattcatatagagattatatctcaacaccaattgagggagatgatgattgtttagttgagagttaacctcttaaaagtctcgacaatattttttaaagcaaaccattcagattattttacgaatagttaataataataaaaaagtgtaaaggtatgattcaaacttctggtttagtttgatgtcgacttggttcagctggttaaattgttaaattacggtttaatgtcgcttagacattgattggagaagaatgacttcggttttggatttacaaggaatcaagagaaagactcttctggtatagagggtttgactttgacctctgcatataaatagtcttcgtcttcttcctttgttcgttgtaacagaaaattcttatttcaattcttctcccttgtaacacgtttttgagctctgggttttgagcttaagtaaacattgattcatagtggattgctggattgaatccggctccagacgtaggatcatcacaccggtgatctgaactgagtaaacaatcgtgtgttcgtttcgttctttgtttgattgcgttcttgatcgatctattgagtgttccgcgaattgaagcttgatcgagttgtgttgtgttgaatcgagttgtgttgaatcgatttttgagtcatcagattgtaacaaaaagaatagttgcaattttctaactttatatatctctatcatttcaccaattggctattttcaatttttacatcggacatacaaacctgaaacctatgtaaattggaaaaatcatttgtccggtgccctgatatatatttttcttcttaccaaaatcggatttgttagtaacaaacctgtcaatcaaagtgtttcagcttctccagcttaaacatcagaaaatgagtgtgtttttagtgtgtcagacaaatccccgtgaaccttgccttaaaaataaaataaaatcactccaaaatagaaattatttttacaaacaaaaaaatgaaaaagaatgcttattagtattttccacaattgaaatttaaaaagtatatttcccattatttttcacctaaaaaaaaagcatctaaaaagaagtattttttttgttcttctctttttaaagttcgtattttttttttaaatgtttatgaagaaagacacaaaaaaccctaaatataatttcacgcagctgcctctcttttcttcttccgatcctccttccgccgagtgaagccgcgactgtgaaatcatgagaggagtaaaacgcgccgccatctccgaatcgaatgactctcccgtgagtttttccttccgattgttttcgcagttttgttgattgaatctcgtgataaattcagtattgtatcgattctctgtttcgggggtagacgagaaaaattgacactttgggtatttcttggtggttgattgatgattggtttagctaagtttctatagattttgggtgattattgaataaagtcggcaactttataatataacaagttgtgggcattgtgcataatggtatggaactataggatttagctcaaggtatttgctttagatccattaccgagttagttgatgactggtttagctagtgtctacagaatttgagtgattatcagtaaagtcggcaaatttttaatgtaacaagttgtgggcatcgtgcattttgatatggaactataagatttagttcaaggtgtttgcttgagattcattactgagttcaattttgagcaattcgatattcaaatctgtgaggtcatattcatg

SEQ ID NO: 20309 - DNA, 3003 bp, Unknown; identical to SEQ ID NO: 20308
  misc_feature (1)..( 3003): 2750-1469P.txt file - cDNA_ID_1825293; gDNA_ID_2926153; Annot_ID_139407

SEQ ID NO: 20310 - DNA, 3003 bp, Unknown
  misc_feature (1)..( 3003): 2750-1469P.txt file - cDNA_ID_1825312; gDNA_ID_1620726; Annot_ID_49294
gatgacgttccttcgttgaagaaagcggatgttggtatcgctgttgcgaatgctactgaagctgcaagagctgcttctgatatcgttttgactgagcctggacttagtgttatcatcgacgcggttctagctagtcgagccattttgcaacaaatgaagcactacacagtgagtgagcaatgctcttattaaactatacacagcgttttgtttttcattttttctgatgttttctcatgtatcagatttatgcagtttcaataaccatccgtgttgtggtaagttaatcaatcttgaatgttttctttaatatcatcaaataatctctgtttatataatctctctttgtaccttttttacagtttgggttcatgttcatcgctttaatatggaagttcgacttttcaccattcatggttttggccattgctttgttaaacgaaggtgagtttttcttctttataaactttgtttacttgctataaaagccaaacaataaaaaaacattattaacaattactcaacagaaaccaccaaggctatcacaatggataatgtcaccaatccttctcctacaccagatagcttgaaactcaaagagatcttcgcaaccggcgttgtttatggcagttacatggctttaataactgttgtgttcttttgggctgcatacagaaccgatatcttcccggtatgtataaacaaatctctcttcaaatctcccataacaacacaagcatactataaagttataacctcttgttttgttttttatatagagaacgttccacgtgagagacttgagaggcaatgaagcagagatgatgtgtgctttatacttacaagtgagtattatgagccaagctcttttcttcgttattcaatcaagaagctggttttttgtcgaacgacctggagagttattgtttctctctttcgtgacagtacaaactgtaagtatatagaaaaacatgattctgtttcttcttttttatttttcattataaagaagtcttcattgactcataaacttgaccttgtagattgcaacaacactcgcggtatacgcaagttgggaaactgcgagaatcgagggaataggatggagttgggctggagttatttggctctacaacatcatcttcttttttccattagacataatgaaattcggaatccgttacatactaaccggaaaagctcagagtctctttgacaacatggtacacttagttttgaacagttatgcaaaactcagcaatggaatatacaaccatactcaagctgaccatacttactcactcttggaagtgtcaactcctccatcccaggacttgagaggcgttgggtgggtttaatatcataccgtggtctagtttgttttgttttagttctttttatttgtttttggtgtaattttttttacttttttttttaattgaaattttagttaaatagaaattagcataatttttctactactccgtcttcaattttaattttcttcaactcttttttttttctttttaagtgtttccttaagttatatcactaaattgaaaacaatatatatagtatacttaaaacagcatctccagtgataacacaaggaagaaccaaatttggtgttttggtatctcaaatctcacactaaaactgaatttattattattttattattaaatctaaaattattttatattttgataaacattatttatttatttttttaaccctcaaaaatcatttattgattatgaatattttatctattttgtaacccacaaaaacaataattattttataactaatataatattataatcggtaattaaaaataataataaacaaattattttagacatgaaaaattgaaccctgcaaactacatgattaaataggtagaccagtattttcctattttgatttatgaatcaattaaaacttacaattacatactagtgtataacaataaacctcaaaaacttgtgatgaatgatgtaggaaataatagtactcttttgaatatcaacttaaatgtattttagcaatttgactaacaaacaattgttcttcacttttaataatcatccaatagaaccatagagaaacttcaagactttccacaaaaattcatcatcatcacataaccaagaaaacaaacgaggaaaaaagcccaaaaaataagagaaaagaccttaaaacgacgagtttcaccgatccaatcttccattgcaattttcacataacaaatctttttctttccccttgctcactccaagtctccaagcccccaaattttttcacaatcaatcatttctttgttgcgaaccaaacttgtgatatggcgacaccgaatcaggaagcaatcgacactttcatcagcatcaccggcgcttctgacgccgtcgcccttcagaaactcgaggtgattcgaatttcttgattcatgtccttgttcgcgattccttatgattcagatgtttgatttcgaagtttgtttagaatcggtaaagtgaaactgaaagttcgatgagacgacgatcgtttgattattctgatgctttttcccttactcgttttgatatttgatgttttggggttgaaattgaagttgattttcagaattttaggttataggatggtctgattgagtttctagaaggatttttgttcttacattgcttttttcgctcaaacgatatctcctgaattctcgcgtttattacttgttcattgatgattgtatgattgtctccaatgttgacagagtttttaattcgaatttgagagctgattttgattactgcaggagcatcgtggtgatcttaatcaagcagtgaatgcatatttcagcgaaggagatcgaaatgtgtatgacatctctatctcactgatgattattttattatccttctctcttgcaaatttatcaatttttttacgttgttatgctctttgtgtagagtacgtgaagcgccggttaatgatgatgatgaaatg

SEQ ID NO: 20311 - DNA, 3003 bp, Unknown; identical to SEQ ID NO: 20310
  misc_feature (1)..( 3003): 2750-1469P.txt file - cDNA_ID_1825312; gDNA_ID_2926153; Annot_ID_139402

SEQ ID NO: 20312 - DNA, 3000 bp, Unknown; identical to SEQ ID NO: 4743
  misc_feature (1)..( 3000): 2750-1469P.txt file - cDNA_ID_1825324; gDNA_ID_1620726; Annot_ID_49291

SEQ ID NO: 20313 - DNA, 3000 bp, Unknown; identical to SEQ ID NO: 4743
  misc_feature (1)..( 3000): 2750-1469P.txt file - cDNA_ID_1825324; gDNA_ID_2926153; Annot_ID_139399

SEQ ID NO: 20314 - DNA, 3000 bp, Unknown; identical to SEQ ID NO: 4742
  misc_feature (1)..( 3000): 2750-1469P.txt file - cDNA_ID_1825339; gDNA_ID_1620726; Annot_ID_49287

SEQ ID NO: 20315 - DNA, 3000 bp, Unknown; identical to SEQ ID NO: 4742
  misc_feature (1)..( 3000): 2750-1469P.txt file - cDNA_ID_1825339; gDNA_ID_2926153; Annot_ID_139395

SEQ ID NO: 20316 - DNA, 3003 bp, Unknown
  misc_feature (1)..( 3003): 2750-1469P.txt file - cDNA_ID_1825346; gDNA_ID_1620726; Annot_ID_49284
aaacctctgatcttgattcacatgtataaggagaaagatgggaaagcttttaattcatttttgcctccgtttccaacattcaagctttgaacttctcacttttttactagagagagatagtgatggcacgatgaacgagggttgaaatggaaatcgcagattatgagatttattttctatacatcttgattcatataataaacacagtactagttgataccatgctatttgtagatttctagataattattgtttttagtaaaattgactaatggtaaaaccgataataaatagtgtattttgtgtgtgaatgatctaagcaaaaccactaaccggatataataacataaaatttgttaactaacacgtccaaaatctatgttccttcaaaaaaaacatactagataaataaaaatatacaatttggctcgaggtctcagtcaaaatcaatagtttagttatcaaccctatagtcctgaatccataaatgttggataacaagtttgcaatgttatataataaaaaaaaagattgcaatggtaagaattaacatcataagaattttattggagattagttagctgtttagttcatatataaaatgctttttagtgaagaaatagtcaactatcatatgaagatttaagatttaatcagtgatcattatacaattctatttctaacttgatttagattctctgccgatcttatctcatctccacttgttctctttctcaccttgttttctaatttctagtcttctagagaagtcaacgtaaacaaaaaatgtacatggactaaaggaatgtgatagttttatttatttagataagcaatgcacgacgtttattgtgcaataaaacagcgtggtgttctttttttctagctccgtgctgtcttctcgaatctgcaattccctgtaaacagagcaaactgaaatccccaaatcaaaaccctaaaccctaatctctaatttgagaaattaggttagttcacctttttgtcgattcctcttgcggagagatgcaatcgattcgtggcagtacacggttgcttcagaggcatcgtttctccatctccaacactcttcgtttcacttcttcttcttcttgtggaagctggtctgaaaatgaatccagaaaactagggtttgattcttgcccttctagcagagctgcgacatatctcattagctcgttgaaaaatgcaggcttttcctcttcagctatacctgtaagccactttcgttctctatcttggtttaacattgtcgaaatgtagaagaggtttggttggtaatggagatcttatatcaaatgggtttgaaaattgcaattagtgtagaaaaacgcaaactttgctcttgtgtggtagtaagagttatgtagatatagaagaaccagctttgacacaagttttatgatttcacaagttgttctactttatatgtttgggtcacagtgatatctatctagtatgttaatgtacattaggtttctacgtgtttacgatgttcttggaaatattttggcagaaacaaaactttacgtatgcgtcgaggtgtttttccaccactggagattcttctgttcaaggatctcctgagtcagattgtgttgtgcctcagagaatcaagtttaagcggcttgataaaaccgctaagcatataatgcaggtactacaactcaattactagacaactgtcatggataaatcatgtcatatgacacaatcttctgcagattgtagacaaggaagcggttgaggaagtgagatctcttagagagattcctgagataaagcccggttacattgtgcagctaaaagtggtaatttcttttttcttggtgaatgggattgaactatctttgtctttaaagtgaaaccttttcataggcttgccatttacttttgtttttaacaggaagtgcctgagaacaagagacgtgtatcaatcgtgaaaggcgtcgtcatagcaaggcgtaatgctggtctgaactcaacatttagaattagaaggcttgttgctggagtgggcgttgaatccatgttccccttgtaagtaacttgaagctcaaactgcaactacttattctttttttctttctctcagaatttgtatatgatatgataactcaagccaccatgttttgtgtgccttaaattgatgtgagtgagggtgtttggtgacaggtattccccaaacctgagggagattaaggtggtggacaagaagaaagtaagaagagccaagctatattacctcagggacaaggtgaatgctcttaagaagcattaacaacctcagtaaaaaaaacaatctactcgtgtcttaaacaattttccaatgttttagttgcactctctcaaaaggagacgatttgcctcaaatttcacgtattgaatttgtgcaatggtgaatcttcttcaattctcttctctcccttgttggaaaaagcacatgggctaaagacatgttatagttttatatatggagacaagtaatccacgacgtttcttgtataataaaacagcgtgacgttcttttttttagctccataacacaacgctgtctttgagtaaatgtatctgtcctctcgaattctgcaatttcctgaaactgggcaaattgaaattcccaatcctaaaccctaagctcaaatttgagaaattaggtttgttttcatcctttctttgtctcagtcacttagtttttgggttttagtagactcctttgtattttttaacccaaaaattgcaatgtcaaaagtttcagtcttttgcaacttctgctgtgttcttttgtgatttgagacagaagagaaacttaatttgtctttaaagctaacatttttaggtagcaaaaattagtatattgagcataaagttaacaaatttgaagttatttaagatgattgaggatatggttttctattctgataagtaggaagttgatgaagtgataatgaagcttctttgaaatgtttttactttttagaaatg

SEQ ID NO: 20317 - DNA, 3003 bp, Unknown; identical to SEQ ID NO: 20316
  misc_feature (1)..( 3003): 2750-1469P.txt file - cDNA_ID_1825346; gDNA_ID_2926153; Annot_ID_139392

SEQ ID NO: 20318 - DNA, 3000 bp, Unknown; identical to SEQ ID NO: 8914
  misc_feature (1)..( 3000): 2750-1469P.txt file - cDNA_ID_1825365; gDNA_ID_1971923; Annot_ID_58564

SEQ ID NO: 20319 - DNA, 3003 bp, Unknown
  misc_feature (1)..( 3003): 2750-1469P.txt file - cDNA_ID_1825387; gDNA_ID_1971923; Annot_ID_58553
tctatcatgaacttttaaattatgactttaatcaaatatatatttaaaaaaaaaagtatcatgcaatttgtgaaatttgacaggtgagatttggcggatggagcacgtttttatttagtccatgctatatatacaaaaataaactacccttggttggcagagacatggcaaaaataatccacatgcatgattggttaacttttttcccatcactaagataaaattacatacatttatataaaattcgaaataaagaaagcaaaaaaaaaactgatgatataataagcttttattcatcaaagtgggtatggtgataggactacactctctgggttgtgttttggtattactgtgtaagacttcctagattcatgaaaaagtatcgaaagttagaatcgaattaatccaaaaggaattattgtggaattaactaaagcaatccatacaaatcacaacaaaagctcgtcaagtatatataatcagaatagtcaataatttagctttgaatgccgaacttgactaaaactcagacatgttatagtaccaaaatatttgtaatttagggaatatcattgctaatacaatataaaaaagatcatagctagattcaaaatgttgaacatgacctacgacattgttgaattcattgatctggtcttgctaaaaactttaaaattgatgagttcaacatcttcaaatgcatgataacgggtccaacggaaattgacttttttttcatgctcctgatatataataatatctaacgattacgggttccactaattgtcattactcattaacattcctatttaaaagttgtgatagttttagggttttacgtagtcgtgtcatatagcgattaactacgtacttgtagatttatcaattacttctgttgtttacgagaacctaaaaaaaagaagcagatgcctagtttatagagcacgtgtactgtcttgaaaacttaggtaggttggtaaggttaccaaaagaccttaaaggaatataaagttactaattaacttaagtaaagttggtattgcttatatattgcaaagtattacaaaccaatcccctctgtatattgttttaaaccatagatttttttacaattaagtttatgatcaatcaattatttcaccatttctattaaattatgtaaaaagaaaaggatatatatatatatatataattaaataagaataaatcaaaataccgaaattttttattatccattctttgtggacatcgcccctaatatataaaaaaaaaaaactttcgtataactgatttatatttttttgtaaaaacttaaaggaagcctaagaaatatcttgtgatatttttgacaaaatgtggtatatatctttttataatatcatttataaagaaaatattgattacatggtgaaaaacattttgctagcgatcaacaaaattaaataggcacatgttaactgatctcatacgaccttgaaattttaatctttgtgtcgagagaccgatctttatgcaaattatgaaactacacatggtttatgcacggaagatcacattgcatgtataccatattataaaccaaaaatgatcaagaagaaggcgaaaacatttgggtaaattttaaatttcgatcatgcgattttttagctcatcatcaacagacaagaaactatcttttgtactgtaaatactaaatacaaaataaaatcttcatcattttttgcatgtgtcaaataaattacgcgaactttttttttttatcgactattaatagagaaacctgttttatttgccttgatttggaaaaatggagaaattgacttaagacttagtctcggtcacatcggcaacaacggagcttaaacggcgtccgcaacatggaaactcaagccacgaatctgatatattgactatagaagtagtaagtaactttgactcgtcccacatcagtttcaatttccacgagggtatttggcaggtgaactctctacgtacccaaaacataatggctattttatttcataactgatatttagcaattaattattcgtcctttttaaaccaatttctatagttgggaaaataatcaatttttacactttcaatgtatacgttacagatttttttttattagtcatgcacatattttcaatttttacactttcaatgtaaacaatcgattcttaattgttaaaaataggtttacgtaaggaattaaagatttgtttaaaatatgttccggccggtctaataatttacttgacgttaatttcttaaacacttttagataggaggctttgtttatcccaaatgattttgtaccactgcgacaatactagctagacataaaatgttaataaatttttattaagtaatataatcgaagtattagatcaatgtagtagacagttaggttaactaaaacaagagtaaacacttttttttttcttttcaggataggtaaaacaaatttcacactattttgcgtatttccttaaatttgttgttcgttttctcagcaaagatgaatattttgtttcatagtaattcacaagtataaactcgccagaactcctcaaacagtgaaatataatatagcttttaactgtttttcggctggaccgggtttttaagtgcatatataacacgaggaattttggcaggtcaccaacaaaacttttaaaaatattaaaaattcccatcaagaatagaaattaataaacaatgatatctctaataatatagatattttgaaacgttaggaataatcgtaataatgttcaacgttggtggtggtactcaagatggaccctccctcccacattttcctcactccttcgtaagtcctttccacgcataagggtattatagtcatttcacataaactaacgactactagacttgtatataaataggaaggtgaagctctctctttatccatgcagagacaacagaaaccacaacaaaaactttgagtcctcttcttctctatacacaaacatg

SEQ ID NO: 20320 - DNA, 3003 bp, Unknown; identical to SEQ ID NO: 20319
  misc_feature (1)..( 3003): 2750-1469P.txt file - cDNA_ID_1825387; gDNA_ID_1971923; Annot_ID_177204

SEQ ID NO: 20321 - DNA, 3003 bp, Unknown; identical to SEQ ID NO: 20319
  misc_feature (1)..( 3003): 2750-1469P.txt file - cDNA_ID_1825387; gDNA_ID_2926219; Annot_ID_142365

SEQ ID NO: 20322 - DNA, 3003 bp, Unknown; identical to SEQ ID NO: 20319
  misc_feature (1)..( 3003): 2750-1469P.txt file - cDNA_ID_1825387; gDNA_ID_2926219; Annot_ID_203214

SEQ ID NO: 20323 - DNA, 3000 bp, Unknown; identical to SEQ ID NO: 8911
  misc_feature (1)..( 3000): 2750-1469P.txt file - cDNA_ID_1825394; gDNA_ID_1971923; Annot_ID_58549

SEQ ID NO: 20324 - DNA, 3000 bp, Unknown; identical to SEQ ID NO: 8911
  misc_feature (1)..( 3000): 2750-1469P.txt file - cDNA_ID_1825394; gDNA_ID_1971923; Annot_ID_177200

SEQ ID NO: 20325 - DNA, 3000 bp, Unknown; identical to SEQ ID NO: 8911
  misc_feature (1)..( 3000): 2750-1469P.txt file - cDNA_ID_1825394; gDNA_ID_2926219; Annot_ID_142361

SEQ ID NO: 20326 - DNA, 3000 bp, Unknown; identical to SEQ ID NO: 8911
  misc_feature (1)..( 3000): 2750-1469P.txt file - cDNA_ID_1825394; gDNA_ID_2926219; Annot_ID_203210

SEQ ID NO: 20327 - DNA, 3000 bp, Unknown
  misc_feature (1)..( 3000): 2750-1469P.txt file - cDNA_ID_1825398; gDNA_ID_1971923; Annot_ID_58548
ttacatgaacttgatattattgtgtacatagttaaatatcttcgagatactaaatgtgcttgatgaagtgcctagtatatcatatcttgtcatcatcatttagataattgtatgctagtcattctgtggaaaaaaaagagagggtgtaatcataagtctgatcatagttattcattctgtagataagttcccagaagaagaaaacaggtgttattgcgcctaagcgatttgtacagaggttgaagaaacaaaatgagctgtttcggagttatatgcaccaggtgatctttgcaaatctccccatcttttcgggagctattttacagaagatgcgagataagcaattaacatttgattgattttacgtttcttatctcatgtaggatgcacatgaattcctgaattatttgctgaatgaagttgttgacatactggagaaagaggcaaaagctacaaaaactgaacatgaaacctcgtcatcatcatctcccgagaagatagcaaatggactgaaagttcctcaggcaaatggtgttgtgcacaaggagcctattgttacatgggtgcacaatatttttcaggtcagttgtttctaatgaaaaggttcacttctccttataaggtgcgactatgttgtgctatttttggcttattttaaattcggggtatgtacacagggcatacttaccaacgagacaaggtgtctgcgatgtgaaacagtgacagcaagagacgaaacattcctagacctaagccttgatatcgaacagaacagttcgataactagctgtttgaaaaacttcagctccacagagacgcttcacgctgaagacaaattcttttgtgacaaatgctgcaggtaaaatgttggttcaaatatcaattcctcacctttcctttatagtagctgaaactgaaaactggtctttaagctccctcttaatccttcaataagcgctccacagtgttagactttgttaggcgccatgggagtgaagcctgattattgaatgtttatatttgcagcttacaagaagcacaaaagcggatgaagatcaagaagccaccacacatcctagtgattcatctaaaacgattcaaatacatcgaacagctaggccgctacaagaagctctcctatagagttgtcttccctttggagctaaaactgagcaacacagtggaaccatacgcagacgtggagtactctctgtttgcagtggtggttcatgtgggaagtggacccaaccatggtcattacgtaagccttgtgaaaagccataaccattggctcttctttgatgatgagaatgttgagatgattgaagaatcagctgttcaaacattctttggatcgtctcaggagtattcgagcaatactgaccatggttacatcctgttctatgagagccttggaccgaccaagtgaaagctgagaaagcagaaagaaggactttcttcgttttttttctcttaactattattagtaatggtatatgtttgtcttaaaagtcaaactcaattgacagtaacttttttttttttttggtttttgttctttctctgtgtctctctcccaaagatatttggtgagttttaaaattggaagttttaactggaatttgtatactttgaaaaaggccatgtacagtttatggcaaataactccttgtctttgtatctttagcaaaggaagaaggttacaatatgttgaattactttggctacaattgtgttgttgaattagttgtttagtgttaatgtcgtcttatcacaacaaaagagagtcagagtacgaaattgttgttgactaatttctttatcagcccaattgttcttaatgggccgtatcagtcagtatgatggaataaatataaagtctgatacgacccattaagaaaaattgggctgataaagaaattaggcccagcgataatcacgtagtggtggtgagaataaagttaaaaaagaaagaaacaaagagacaaaactcaaaaggaaagatcacgggagaagttgacgaagaagatacagacagaggcccgtgagctctgtatgtgcctttttctcatacataaatgttttgattttgtgatttttacagattcaagagttattaagattagctgagtagtactacttcaaaaactatgccatatttctttttatatatatatatattttatttagttaagaaagagtgagtcaataaacaataaaaagctggcaatggcacgggagaattaaatgcatatgacatttacacaatttagcaaaaaagaaaaaaggaagtgcatgggtggattttatatggtctgttgattcttgtatataccatttatcatattgtttcctccaaaaataaaataaaaaatgatgtgtttttgtgcattacaaaaaggtagtagacagctcataaatagtaaattgtaattatgactgatagtatagtagtatcaaacagcagaaatctacagacatgcatttatttgtcagtaaatgtcattatgttgatgatgatcccatatgtagtaataattaaaaaattatgaaatccctaactaatcaagtttaattagtaacatgatcgaggagataatagaaaaagtaaaagggtagattggtaatttaagggaggacgaagaatgaggatttgtcgttatcccgtgaattgatgtcgcaatcagatgaaggagaagccatcacaggagaagagagcgtcttcctcatctctctctctctctctctctctctctctctctctctctctctctctctctctctctctctctctctctctctctttttacttcttcttcttcactttctctctgaatctgccgtcacgcggaagcttccgattcaaaacactctctacatgcattgttgttgtacaactacaacactatacgacgagtcttcaagcttccgcgtcttcttcctcttttgagaatcgcttcttctttcctccatcgttggttcacgattctctctgcaatg

SEQ ID NO: 20328 - DNA, 3000 bp, Unknown; identical to SEQ ID NO: 20327
  misc_feature (1)..( 3000): 2750-1469P.txt file - cDNA_ID_1825398; gDNA_ID_2926219; Annot_ID_142360

SEQ ID NO: 20329 - DNA, 3003 bp, Unknown
  misc_feature (1)..( 3003): 2750-1469P.txt file - cDNA_ID_1825410; gDNA_ID_1971923; Annot_ID_58543
tctcaatcctatgcctctcatcgctcgtcaccggaatcgaaccactcaagtttctctacgcaacatcgagctcaacatacgtttgcttgcagatcctgcaaaccctaggctacgtcttctacctcttgcttcttctcatgtacctcgttctcgtcttctccacggattgtggtttgggccttaaggtattgggcttggcgcagacctttgtgggctttgctgtaggtctgcattattacgtggcggtgtttcatagggtggtgcttcgtcagcctccgaagacgaactggaagatacacggtgtgtatgccacgtgtttccttttgatttgtctgttatctaatgctgagaggaggaagaaagagtacttggaagaaggcggtgacgaagggaagaaaaattgaaattttctttattttattcttctctatctttgtatttttatattttaaattttgaaaaattcggcaaaattttagctgagaaatgcaatagaaagaacaattactggtggatggttggaaactttttttaaaaacttcaattgtatttataataaatcgataaatgtggaataaaatttcataatctcattataattgtctcttttttttctttgtaaaaattacaaatatgttgtgaaatgtggacggcgagaagaatgaattaattaaatgtttttcttgataaccgcgaaaattaaatgtttctgtttgaaataaaaaaaatatgagaagtcaaaaattaaataaggtggggtctacggaatcgtagagtcgacgactttcgtgaggatggggcatttcggtcattgaaggagttaccgacggaactgggtgctgtagtgttttattgacttgtgtcggtggattggcgattgagtgtggggcgtatggtgagaaaaatggggcttttgtgtcctaacgtgttgttgtatgggccactcatttctcaaggcccatcacctcacctcatattgtgccggaatgttgttttaactttatgacgtgacgtgtgtattatgaaactgaaaatagagttcctccaactttgaatctattttacaattttattattattttttttttttgtcaaatcatagaaattacatgcacaactatcacgacgatagaaatttataagcacaattagccaaataaaaaaatcgaggaaaaagtttctaaatgtaggcaatgcccaaatgtcataaatagcctacttattttgtcaatcttgtcacttagaaactcggcacttgtataaaaacgtttcattcaacttttggtatcacatgtacattattcaattgtgaattcctaaatttattgtgtgctgtgataattcaccagatcaaccagtttaaagacccgtgaacaaaaatgcccataacatttttttgtattgggtttcaatcaagttaaggcccattttggtttagtatacggattgtgttgggcgaaaggagtgatgtaatatgtacttatcagaaacaaagtaggaagacatcacagtatcacaacattgatttgtgtgcttcaatcatgcggtgtacaatttgcacttttcccacttcacaaaattcacaccttaaatatcaatttgtgaaaagtattgacttttaactttaccaaattaaactcttttagtgaacaatctttaacaaccattttatttcacatatctgatgactcaataattcgtgcaaatttcaaatgtccttgtatattatcgtgtttgaatttcaactttttttccaaacatgaaataacaatccatgattttattgctaatatgtctatcatatatttaagtttacagaccaatcacaatttcctcaattagaaaaaacaaacttaccaatggaaggatagcagtgtatgtccataggactcgacacttctatacatagtactatttgtattcaaattatacataaaggaaataaatctgtctatacatggttttagtaccaagttttttaataagaaaaaagaaacaattgatagtttgatacattaccaactaggctaagatattttatttatttttacagtacagcgttaacattttttttaacgagaatgaaacggtggctagagttacctgagtaaaaaatctaaaaaataaggtaaaaatatctgatagcattcgtaacgaaatcaattagtactagacaagaagatggtataaaaatagaagaaaagtaaaaaatggcacgagtgaatatgttcgcacgtgtaaaataagcgtcatcatcttctcctcttcccaagtttcggctctcactttctctcgttctctctctctctctctatctctatctctcgatttgggggagttccgtcacggtggactagtacgtctcgttgccgttggtggcgtagtcggaattaatttcctcggcgttgagattcacatggtctagaattctagctaagtggttgttgttgttgttacgatttccgatttctcgagttttttttttatatttagcttctgtttcgtttatccctcccggagacactccttggtcgaatctctcatgctgaggtaattcgtcatggatttgtttaattgcataagcttttttgcaattgtctaagcttttatcggtttgttttgttttttgatttacgaatctagattttgcgctttcttatgtatgtaatcaggatcaaatttgctgggttgttaaacaatttttgtctgtgttaggattctaattacgcgtgttactatacatgaatcattttcattgtttttcttcttgatccaaaagtgtgagaatcttactttaggcgtaattcacattttttgcattaatttcaacggttacacgttttttttctttgctttagatttgttataatttggttgttctaatattcataaccttggagttttggtattacttcaggtgttttggacacttgttgtcaagaagaaaccagttttggttctgattaatcgttggttggaaaatatactcaattccaggccatg

SEQ ID NO: 20330 - DNA, 3003 bp, Unknown; identical to SEQ ID NO: 20329
  misc_feature (1)..( 3003): 2750-1469P.txt file - cDNA_ID_1825410; gDNA_ID_2926219; Annot_ID_142355

SEQ ID NO: 20331 - DNA, 3000 bp, Unknown; identical to SEQ ID NO: 4754
  misc_feature (1)..( 3000): 2750-1469P.txt file - cDNA_ID_1825465; gDNA_ID_1620728; Annot_ID_49342

SEQ ID NO: 20332 - DNA, 3000 bp, Unknown; identical to SEQ ID NO: 4754
  misc_feature (1)..( 3000): 2750-1469P.txt file - cDNA_ID_1825465; gDNA_ID_2926173; Annot_ID_140224

SEQ ID NO: 20333 - DNA, 3000 bp, Unknown
  misc_feature (1)..( 3000): 2750-1469P.txt file - cDNA_ID_1825469; gDNA_ID_1620728; Annot_ID_49341
aaaataaataaatttgtcagtccgcatgttaccatatgaaagcagtaattaattcgcattagaaatgtactattatattattattgaaattaaccaaatcgtaagcttgtttatttatttattttccaaaaaatgatagaatggggaggcttaagcaatgttggtcaagtctgctagtattggcagtgttggtgatcggaactggagccgttcccatcacttatctccaaagcgccgtcgctaaaggagccggtaatatgcaacaacggtttacataatacttatattcatatttacacaatttatcggataattcaataagtttttgagaacatatatatatatatatatatatatatatgtttattatgtagtgtgtttggatgggagtgcaccagcttaccattttgacaaagggtttggttcgggtgttaacaattggatcgtccacatggaggtaaagaaacttgttttttgttgcaaatttctggaccacttgatatatttttttgtcgttgaaatgactgtacatataaatcgagttcttttttttttttttttaatatatataaatcgtagttctttatagttgtgtgattagttaaaacttaaaaacattgcggcgtttatcgttagcatcttatgttttttttttaataattattttactgaaaagaaatgtaacataaaaataaggtagaattagttgaataaaatttgaatgaagtgtatatgttgtttatatgttagggaggaggatggtgtaccgacgttgcttcatgtaatgaacgtaagggtacaatgaagggttcttccaaattcatgaacaaagactttggattttccggtatcttgggtggcaagcaaagcactaacccaggtatattactgtttttttttttgtttctaatgatccagaggtttgtgggagagttatgatcaattaatgctgttgaatctatcttgattttcataaaaaaaaaatgattttcttttgctcagatttctacaattggaacagaatcaaagtacgatattgtgacggatcatcctttaccggcaatgtagaagccgttaatccggtaatttagtgactaaattgtgatatttcataaatattatttttagtcaaaacattcacatttttcttgaagtactataaattcttgcagtcaaaattgtatgatttatatatagtcggaaccttgaataatttcaggcaaacaagctgttcttccgcggtgcccgagtttggcgtgcggtggttgatgatcttatggctaaaggaatgaaaaacgctcaaaacgtatattatatgtgcatatttcgacatctctctttctttaatgtgtatcacttaaaaaaaattaacatcttataaaacttttcaggctatactctccggttgttcagctggagcattggctgcgattcttcattgtgacactttccgtgccatacttccccgaacagctagcgtcaaatgtgtttctgatgccggttactttatccacgggtacgtgtacatactcttaggcgttggccaaaaaagtatatggaaccaaaccgaaagtctaaactaaattactaaacccaacctaaactgataacaaccaaaataaacaaaccggttttatttgatgtcaacagtgattattatcactgaattcgattttatgaaacagtaaagatatcacaggaggatcatacattcaatcatattacagcaaagtcgtcgcactccacgtattactctttatctaatatatctctcaattgctaattctcttcaaccatgaggtgaatcctaaagtcagtgttgcttaatatctttttgtagggatctgcaaagagtcttcctgtttcttgtacctcaaaaatgaaaccagaactcgtacgtgcttaactaaacataccaacatcgttgatcttgacacttttttccatctatatatggaccgatatcaaagacttctccgatcgttttttgcagtgtttcttcccgcaatacgtcgttccttccatgcgaacaccgctctttgtcatcaatgccgcttttgattcttggcaggtcatatactaaccatgatatacttatatacataaacattcatttcattataaaatatacacaaatcggatacatataaactgaatttggtgattttttcagatcaagaacgttttggctccaactgctgttgataagggaaaagagtggaagaattgtaagcttgatcttaagaaatgtagtgccgctcagctcaaaaccgtccaaggtaattccataattgttccggtttatattggtttggttttgaatacgatcagttcggtttatcgagatttaaatttaaaccgggttggttaaaacatttcagggtttagagatcagatgatgcgagcattgtcaccggttcacagtacaccgtctagaggattgttcttagactcgtgtcacgctcattgccaaggaggaagcgccgcctcttggtccggtgacaaaggtccccaagtcgccaatacggtaaaattcaatcctccaatacttttaaaatcttttcaattcgattttagttctgattttgattatttgtttttgcagagaattgcgaaagcagtcggaaactggttttatggccggagtgcatttcagaagatagattgtccgtcgccgacttgtaatcctacttgtcctgctatctctactgaagactagaatcatctctaaatgttcaattttttttaatttgaaattgaaagagctcgcaaacattttggatttgttttccaaatcggatcaataataatcactgcaatttgaataaagagtatatctttactttgtattataatcgagtttacctataaagtttttaactttttatacgaatccagagagaaagagagagactgtgtactactcggtgctctgcttctctcattttgtagtgaagtgaagaaccctaaaaatcattgctttattaaaaagcatcgatg

SEQ ID NO: 20334 - DNA, 3000 bp, Unknown; identical to SEQ ID NO: 20333
  misc_feature (1)..( 3000): 2750-1469P.txt file - cDNA_ID_1825469; gDNA_ID_2926173; Annot_ID_140223

SEQ ID NO: 20335 - DNA, 3000 bp, Unknown; identical to SEQ ID NO: 4757
  misc_feature (1)..( 3000): 2750-1469P.txt file - cDNA_ID_1825476; gDNA_ID_1620728; Annot_ID_49339

SEQ ID NO: 20336 - DNA, 3000 bp, Unknown; identical to SEQ ID NO: 4757
  misc_feature (1)..( 3000): 2750-1469P.txt file - cDNA_ID_1825476; gDNA_ID_2926173; Annot_ID_140221

SEQ ID NO: 20337 - DNA, 3000 bp, Unknown; identical to SEQ ID NO: 4756
  misc_feature (1)..( 3000): 2750-1469P.txt file - cDNA_ID_1825480; gDNA_ID_1620728; Annot_ID_49338

SEQ ID NO: 20338 - DNA, 3000 bp, Unknown; identical to SEQ ID NO: 4756
  misc_feature (1)..( 3000): 2750-1469P.txt file - cDNA_ID_1825480; gDNA_ID_1620728; Annot_ID_165998

SEQ ID NO: 20339 - DNA, 3000 bp, Unknown; identical to SEQ ID NO: 4756
  misc_feature (1)..( 3000): 2750-1469P.txt file - cDNA_ID_1825480; gDNA_ID_2926173; Annot_ID_140220

SEQ ID NO: 20340 - DNA, 3000 bp, Unknown; identical to SEQ ID NO: 4756
  misc_feature (1)..( 3000): 2750-1469P.txt file - cDNA_ID_1825480; gDNA_ID_2926173; Annot_ID_199669

SEQ ID NO: 20341 - DNA, 3000 bp, Unknown
  misc_feature (1)..( 3000): 2750-1469P.txt file - cDNA_ID_1825482; gDNA_ID_2926148; Annot_ID_139189
acagtcttctattagtattacttttccatttagtggcgatggaatagctagctgctcatcgaaccctaaggctaaatcgaggagattcaaagaacgatccatggagaaatttggacggagaagaagaaaaaacgaagcttgagagtacaaaggagaggagattttaggtttttgcgaaaagaagactttaacaaaaaagaccttaagtttgatcgaatctatttttttaacccggaagaatactttttcttattttttgttaaattattgtcatatttgtatgaactacatttggactaagaattgaagtatggttcacgtttactttcttgttaaaatttgtttattctttaagaatttaaatgatatattttgtaagaaaattatttgaaacatgaaaaatatttaaaatattttaaagttgacattatttaatatgtatttgagtatcacttattttacccattttatactaacgatttgcttaaatgttactcgaagcggactaaaccattagcagattacaccatccaaattttggggtagacaacaatccgttgtaacctaagtttatttctagaaaatgggtatgtagttttagcggggttttttctataatttttggtttacactattatatgataatttattcataataaataataaacatttcaatctacagaaagatttattcgcctcaaccgctcgaatctatattcttctaaacatctccaatgtccatctctattttttttctccatttagaggtgattctatgttagatacattttgcttcaatatatgtctctaaaatagatttttctctaaaataaaggaatcttacgttttaatctatataaagagtaaaatctatttattttctctattttggagaaaaaaactattttagaagaatacattggagcaaaatctaatttcctctaaaataaatttgtctctaaaatgaaagaaaaaaatagaggtgtgcattggagatggttttagaccgtctactctattttaactgatacatcccctatatattaattgagaagtattttaaataaaaaaccttacattcacgtgtgatttacaagactatcatgctgacatgtcgtaaccagaaaaactttcaacaaacttaatagttatccaatatttactagactaattacatataatgccattagtggtacttatgcatatttttcctctacatttaagagagtagcaattaataaagaaaattaatcaaaaaaccatatatatttgagcaaacaagtaaaaagtatatatcataaattatgatgaacaacatataatataaatgtttattatatgtttcgtactttatttttttaggttttatagaaaacatttagaattttaacatatatgacattctatttttttgttataaattgcaaaaaatctaaatgtatatgtgagcccatatgattcttgaatatattcggaacatagttttacataaattagttagtaacatttcatttattacacattcactatgaacaatatttcaatattaatctatgttaaaaatgtatccgcttactgattactttcaatattatttcttttcaaatttttaccttatcaatttattaaaacttttacacagtttattcaatttaattagtcatttactcattttagttaaaatttatttacaacccaaaaccttatcgtaacaatataaattgattaataaaataagggatatgcaataaatcaatcctaactacatagaattatgaagaataataaaagataatcaaaaatttattacgtttaaaacataattattcatactcttttcagtttttatattgaattgtttccaaaataaaatcttataaaatacaaaaaatattcgaatatatttctgaattataggaatgatatttcagattttcttttgggtcaatattttaatttaaaatcttattccaaatatagaatatcctaattcctaactaataaaatctccaaaatatatcagttactaaatcatattcaaatattcacacttatatatcaagtgataatataaaatctgtttccaaaaacttgtttatatatttcatataactatttctccctgtacatagttcgggtaaatcatctagtatttgattaattcatttgatctgcaccatacgattcgtcgtgaaccctaattaaatcattgtgaaaaaccaaaaaaatgaaagaacaaaaggaataaataccatacttctctcaatctaccaacctttaatgtcaaaagatctagttgagtactgagaatgttacgtgaccaattagatacctctacataactacttcctcaaagtggataagaaccattcttttcgaaacaaactaaactattagagactaaaccatttaattttggagcggacaataatccgttataaactaaatttatttctatataaaatcggtctaaagtttttaccgattttttttttctatatttttggtcagtactattataaatactaatctataaataataaataagaaaatatttcaatctaccgatggatttatttgcaaaacccacctcaaccgtttgaatcttgattatatatatttttcttacatcgtctactctattttaaccgatacatatttgtttaattcatttgatccgcaccatacgatttattgccgaatcctaattaaatcgttttaaaaaataaaataaaaatgaaagaacaaaatgaataaatactatagttctctgaatctactaaactttaatgccaaaaaatttagttgaggactgagattgacacgcaaccaattagatacctccacgtaattactttctcaaagtggataagaaccattcttttccatcatcaaccgctctaatttgttgcgatccttttccaatatttggggttttatccattagggtttctgattattgcaatcccaatctgaaatcttcgaattcgatcatcaatg

SEQ ID NO: 20342 - DNA, 3000 bp, Unknown; identical to SEQ ID NO: 3853
  misc_feature (1)..( 3000): 2750-1469P.txt file - cDNA_ID_1825482; gDNA_ID_1620729; Annot_ID_49368

SEQ ID NO: 20343 - DNA, 3000 bp, Unknown
  misc_feature (1)..( 3000): 2750-1469P.txt file - cDNA_ID_1825485; gDNA_ID_2926148; Annot_ID_139188
ttagttgaggactgagattgacacgcaaccaattagatacctccacgtaattactttctcaaagtggataagaaccattcttttccatcatcaaccgctctaatttgttgcgatccttttccaatatttggggttttatccattagggtttctgattattgcaatcccaatctgaaatcttcgaattcgatcatcaatggatgattgggagcttcttcatcatggctctgatacagaatcaactgattcaatcacatcggagacgaaattagagagttcaagcgtaatcgatgacggtatgattctttctgatcatttctctgctactgatcgggtgattgaatcgggttattttgattcttttcgggttgattacgggtcggagtgtctgaatccgggtgaggttagtgttgattctggtttggatcagttcagtgttagtcaatcgggtgatgattgtgtcagaaatgaatttggggtttatgattcagaaactggaattttgggtgatggtgaggttaggcttagtgattttgaagctgccaatgagaaatatgttgagagcgaagctgctactgaattaactggtggaaccgtatctcactatgaaacagagaatctcgaagaattcgttgatggaaggcacggtgagaacgaatcgggtgttgaagaacctattgaggattcgagcaagttgtgttctgatttagggggaaatgaattggtttctcgagattctggggttgtgaatggtgaaaaagaagttgtttctgatagtgtagttgcttctagtgaagtaattgagggaagtggaggagatactgtggaagttggaggcgtgagttctggtggtgagggtaaaagtagagagactgtgtggtggaagatgccatttgtgcttcttaagtactctgtgtttaggattggtccggtttggtctgtctctatggctgctgctgtgatgggtttggttctcttgggacgtagattgtataatatgaagaagaaagctcaaaggttccatcttaaagttacgattgacgataaggtacactatattatcattgacccttgtgttttcattttgcttgaagttggtaagctggtctagattgatacgttttaggagttagctacactctatgttgtgttgatgcaattggtctgacttgagccgtagaatttcaagtttagtttagttcttgtcttgtcctgccttatattaaggtgggggtattggacgcatgaatttgatagacttcaatagaatcttaaattctagtgttattcaattagacatttcacaaattcttttaaattcttgtgttatttaacttgctcatttcttaattctattagttgcaagtgttattcagttttcggtagttttgtttgacaacgttacttcacaagaatttaatagaaaaattggtctaaaatgtgaagaacaaattctgagtttttgagttgagatttggatagaatataacacatccatcctttttttctctttcatcgatttgcttcaaccatacaaaaaaaattctcaaatctgagggagagtgtttaacacatttattagaatctgtgatttcgatccggtttattcttcggatcatcattcgttcgattatatatgaggagagtgcgttaatctatagagagcagatgagcggaggttgtgatgacgtcgttgtcgttgttgtcaaaatatggatctcttccatttcatgtaaacgtcaacgtagattgtttctgggttaagaggtttgtgaaggaaaaagtacagtttttagagattgggcatggtggctgtcccgataaagagcattgtggaacaaaagatttcagtaatttatcttcttaattctagtagaattctattaaaaatactgcaaaatatttatttgaattgagaagaaagattcgaaattcttttattatacctgaaaatctagaatttatgtccaatacccccctctaagatatagattttgtagttaatatgttcttgtaatctgtctgaattaagtacaaaaatactgaggcatcatccgctgaaaatgctgtgatttgatattttcccttagcgcacatctctttgcttggttggtatttgtttggtgttggtttacttctatcattatcacgtcttgggttgtttatgatctgtgcagaaggcgtcgcgggtgatgagtcaggctgctcgactcaatgaagtgttcacagaggtaagaagggtccctgtgatccgccctgctctaccatcgcctggcgcatggccggttttgagccttagatgagaagccgttttctacaatacctagacacagtggagaatcaatcatacaatgtccatcactttatgtaccgtaagaatacaaatacatgtgtttatgtcgtacctatgcataagtagtagtttaccatcttatgaaatcgcgtatgtgagtcgtgtcccaaccgtgggatacactgcagagtgattaccgtagcgatttatgtatgttcagagactgaaaatcccagttggtaagcctttttctatgtttgatcttaagaatttcataagctatatgtgggttttgttatggatttcattggggtttcaagcttgtaaactattatagagaggaggacatagtccaaagtcgataaaaccactacaatggaaataaagaccctacaaatttctactatgttgtcgattctacaaaatttgagtagaagctatcgtctcaacaacatcccctcgacgatcaacaaagaaaacatcattatttttgataactttaaaaaaaaaactggtagcccatttttaggcccaataaaagcccgaacattataaatagacgttaaagccttaaacgttacttctccaccaccgttcagagtcgcaacccaaactcttttcactgccggagataattctcttcttccccaaaccctacagtactcagctttccctaaattcctcgccggacgattcgtttccagatg

SEQ ID NO: 20344 - DNA, 3000 bp, Unknown; identical to SEQ ID NO: 3858
  misc_feature (1)..( 3000): 2750-1469P.txt file - cDNA_ID_1825485; gDNA_ID_1620729; Annot_ID_49367

SEQ ID NO: 20345 - DNA, 3000 bp, Unknown; identical to SEQ ID NO: 3861
  misc_feature (1)..( 3000): 2750-1469P.txt file - cDNA_ID_1825493; gDNA_ID_2926148; Annot_ID_139186

SEQ ID NO: 20346 - DNA, 3000 bp, Unknown; identical to SEQ ID NO: 3861
  misc_feature (1)..( 3000): 2750-1469P.txt file - cDNA_ID_1825493; gDNA_ID_1620729; Annot_ID_49365

SEQ ID NO: 20347 - DNA, 3000 bp, Unknown
  misc_feature (1)..( 3000): 2750-1469P.txt file - cDNA_ID_1825505; gDNA_ID_2926148; Annot_ID_139181
gcagatattggaacaggaggaggaggattcaatatttttccaccgagtaatattcccacaagtgttccacatagccctgaggccgagcttattgcagctggatggccttcttggttaacttctgttgcaggtgaagccatcaaaggttgggttccacgacgagcagagtcttttgagaagctggacaaagttagttccttatactctctttgttactatttttaatgtttcttgattgctataacgtttctattgtgttgtctcttttaacagattggacaagggacttacagtagcgtgtacagagcccgggatcttgagaccggtaaaatggtagcaatgaagaaggtcaggttcgttaatatggatccggaaagcgtgagattcatggctagagaaatcaacatcttgcggaaactagaccatccaaacgttatgaagcttgaatgtcttgtgacctctaaactctctggtagcttgtaccttgtgtttgagtacatggagcatgatctttccggtctcgctcttagacccggtgtaaaatttactgaatctcaggtacgttcaagggtttgattatagtgaaaaaggtaacagagaaatcttggactaatagggagacaaatcttgtttcttgttgcttcttgcagatcaaatgttacatgaaacaattgcttagcgggcttgagcactgccacagccgtggaatcctccaccgcgacattaagggtccaaatctcttggtaaacaatgatggagtcctcaagattggagattttggtctggcgaatatctatcatccagaacaagatcaacctttgacgagccgtgtagtaaccttgtggtacagagcccctgagcttctactgggagctacagaatatggtccagggatagatttgtggagtgttggttgcattctcacagaactgtttttagggaaaccaatcatgccgggaagaacagaggtgagttacatgtagattcatcagacaatcagttctttgaatccattaagcacaaattattgatatctttgagaatgtctcttaggtggagcaaatgcataagatcttcaagttttgtggttcaccaagtgatgattactggcaaaagacaaagctaccacttgcaacaagtttcaagccgcaacaaccttataaacgtgtccttctagagactttcaagaacttaccaccttctgctctagctcttgttgacaaacttctatccttagaaccagcgaagcgtggcacggcttcttcgacactaagtagcaaggtagctttatatttcttcaactagcagttcctgattcacctcctcaatgcaaactcaattctttcttcttcttttgttctctagttcttcactatggaaccactcccttgtaatgtatcaagtttgccaaagtatcctccaagcaaggaacttgatgcaaaggtccgtgatgaagaagcaagaaggtatgtgataaaaactccttatacaagtattattgcaccaaaatgattcatgtgaattcctaaacacaagttctatataaattcaggaaaaagtctgaaacggtgaagggtcgtggacctgaatctgtgagacgaggttcgagagacttcaagagtactgctacaacaccagagttcgttgcttcagggcagtcaaaagacacaatcaccaccaagagattcaatcctcaggaagacagtagaacaggcttgagaggcgacagagatcagaaaggcttttctcataccaattcaatgattcatccaagcataacagcaacatggagtaaaaatgagagctgtaggaacaatgtagttgagctaaaggctactcgatcaagcaatgtgcccatgactgggagatacttgtctccttcacataaagaagatgtagccgtacaaaccacaacggtaatatataaaagatattagcaatacacttttttcctattagattacatggatcctaagatgttctttttttcgtgtggtttcagacatacgtacgcaagaagaacagaatgcattgttcgggaccattgatgcctcctggtggaaacattgaggacatattgaaagaccatgagagacaaatccaagaagctgtaaggaaatcacggcttgagaaatctgctacaaggaaaaataacaaaacatgtgtaaagtgaaagaagacatggatgaaaccttgctaacatcgaaacaagaaaaaagattacctgaactggaagaacgaagatcgaagatggtatcatcggctctgctattcgattctgcggtgaaatagacattagtcttacacaatgttaagcaagccaaagccacagttatgttcgtggtagtaagatctgttagtactatgtggttcttgtacatggaaatttcagttttctctgtctgaccagcattacatgtggtttgaggaaggaaacaagtgtgcatatttagcaatcgtgtttagttgtgcaacttaatatgtagctagaagattctacagtcattaacctctatacaaacaagccaactaaataagctaacagtgacacacctaagtgatcaatcaaaagcaacatgtcttgtacataataaaacccatcaaaggtttttaacccttaaggctgcaatgtcgtcaatattcttcactacctctataaccgaagaaggcgacccaaaacaagaaatttcacacgaagagccaacagaaccatcgaaaactaaagttcaaactcgaatggggactgaagaaagtgaaactattgtgagagagaagaagaaggacatatttacgtgttttgcccttctttataacggactttatttgtatcttgtcgaatatctgagggtaaatatgtcattgacatcgagaactcgtcgactgtgttgtttcgagtcaagccaagcgccaaacttttggaactttggtgaatcgattgttctcctttcttcgatatcgaattagggtttctgtagaatccagtttttgataggaacaatg

SEQ ID NO: 20348 - DNA, 3000 bp, Unknown; identical to SEQ ID NO: 20347
  misc_feature (1)..( 3000): 2750-1469P.txt file - cDNA_ID_1825505; gDNA_ID_1620729; Annot_ID_49360

SEQ ID NO: 20349 - DNA, 3003 bp, Unknown
  misc_feature (1)..( 3003): 2750-1469P.txt file - cDNA_ID_1825516; gDNA_ID_2926148; Annot_ID_139178
attaaatagaagatttaaatctatatacacatttttgcagctattttaacaaataaatcctggatttggacttatttataattcactgccattagcattaaatctttctccaaaataattaattttactttaaattcttgatttaaattgttaaccacattatcaatcaaatttaatccaaacaaacttcaaatcaatcccttaaaattagcataaacatatttgttaacaatattttaaaacaaagtttttgtttaaatttaaataaataaatcatgtatttgaacttatttacaatgtcatgacactgacattaattatttaggaatgaaaatatttaatcttctaaatccttgcttttagaattattatgtcattacttaaaaggctcaaaatataaaaactttaaatattattatttatatatctaaactttataaaacattattaatatttaaacttataaaaagtttaatatatcatgattttttaacattattatataatatataaagtttaaaaaaatcttaattctttccgtcatattttgtgactcaaaattttaaaaatgaacatatattaaccaattggcgaaaaagtgtgagttctacgtcccacatcgactaaaatatttagacaatgattcataaacatatcataaataagattaacattaataaaataatggtttttttacaggacgggtttggcgggacgggtttagcagaacgttacttaataacaaatgtaaactataaaataaaaatattttataaatagttagaatttgcaaaattttatatataataactttaaaatataaattgtctccacggtgtaccgcagattaaaatctagttttttaataattttctaaggaagtcatggacctttgtcattcgtttatttcggttaaccaaaaattcacataaaaccaaaaaaaagaaaggatttagaatctttcttaacataatatatataaactatgtacggccacggcaatgttactaattcaacgtatttagggtgtgatattggttggggttgttactgaagtttttaactataaaattggctgcaagaaatttgattattgcaacttgtttgttgttaactatgacaaaaacaatgaaacaagaaaatatgaaccagaaataaaaatttgaactttgagtaacgttaagaaatgtgagaaattttagtaaataaaaaaattgattggtaaatcttccctatataattaataaacttatatcggtctttatatcaactcttaattaaaatataatgcctcaagatgtttcctaaggctttatatactagttaatcaaccaaaaaaatgtgattttagttaggttgaatttacatatgttttcttgtaatcgatcattaaaacaaagttgctcttcttgtattatgttcagacaacttggctgtattaatgacgagttagaaaagatgtagaagttgtgctcgaacttattttggaaacacgttttcataaagttaacaccaccggtctggcctaaacatagcaacccaataatacatagaacaaatactttttctttctaaacaaaactaagaagaaaatgattcttttctcctatagttttgtgtataacaggttcatcaaattaagtcttttagcacaaaaataaaacaaaagagatcatgtaatcgaggcaaatgagcttttgtttgcgaatttaattgatagagaaatagatacttgagaaaaataaaaaagctactagagaattgttacaaccttcatgttcacgaggatcttgtttctttttgttgaaccaacacatcaaaatcactcactgtccactcagcagtttcttgtctattgctaacatatatatctgtaacaacattgatcgatgtccacattcgctttgctggtttggttcccgggtactcctgtctacaaagacagattagtttaatgctaagtccaagtcttaagatatgtgcacataatcattataacctggtagaagtagagacggcttgatagagctccattgacctcccaagttcttgaatcaccaatccaaccatttccttgcttaattctcgggataaaattggctgtttggtcctgtggtgggtttataatgttgtagagaacattatagagacaaagaagtaaactaaaattggattctacaaactttaaaagactatttataaactaagtctcagtaacttcttgtacacgcaactcgaaatggtatgaagtatgaacacaatgattctcatgcttcatgatctcgtttcgtagagaatcgcaaaataaaatgacgaaagtaacgaatgatcggcgagcaatacctgcgaggatcaggcaagagagatcggcgcaatcagcgagtctagggttttccattgaaggagcttcgttatcaacttcattacagagattccaaacttctaatacgattcttcatccctctgtctcctaacgctgagacatatctctccgccgcgcagttttgaacggaggaagaagaactctccggtaggagaagcagagcaagcaagagtgaaatcgcaggcattgaaggagcaaacttaaaagcgcgtgaagttgaaggaatggtataggcgcgtgagagtggagaaattcgcgcgtgatttattgcggtaaaaaggtaagatgtcgcattctggaaaatctgaatgattgcttttctctgcttttggaagaatctcatttactccgtttagtatttatatttacatccctacactcttcataaattacaaatagacatataaatttcacttaattacaaacataacccggtactttttcacctagagatattccaaaaagcaaaaagaaacgtcattttcagaaacagaggaccctctgtttcgttcagtgagtgtttgagctgtctctataggcaaagaaacgataattggggaccatatgttcttctttttccagatgaagacgaagccttttagtccacgaagaagacaatg

SEQ ID NO: 20350 - DNA, 3003 bp, Unknown; identical to SEQ ID NO: 20349
  misc_feature (1)..( 3003): 2750-1469P.txt file - cDNA_ID_1825516; gDNA_ID_1620729; Annot_ID_49357

SEQ ID NO: 20351 - DNA, 3003 bp, Unknown
  misc_feature (1)..( 3003): 2750-1469P.txt file - cDNA_ID_1825531; gDNA_ID_2926148; Annot_ID_139173
gtaaataagaatatgcaaatgtttaggaaaaaaactgaaagtatattatacattctgaattcaagattttctatttttaaggaatctgtgctatttcaagaaggatcttgtgaagagactgaggtttagagaagaatgggcaatgatcacttcctttgatcttaaaaactgcttcgggactattctctcgaaccagtttctcttgaacgtccggtgaaagagccaagtcatcgagcgtctggacatagaatctccgacctttcccatatctttctgcactaagtgacaacttctccatcatgggacctaatggtacaggccgcatcgagatcattgacaatgcaatgtcctgaaacaattttaagtaaagacaaattgatcacttgttgcattaggcctatccataaaaacagaacatgaactacactctagattggggctgttactgatcacttagcttgattagtgtaagagtttaccttatttggtgactgattgaagtacaagcctttcatgtgttgtttctcgaacatgaaccctgtcgcggggttgtccttgccgtttccatagatcaagaactgtgactctttcatgaaccgttctgcagaaccaagctgcaatgaagacagtttccaaagtgtgaggggaaacacataaacaaggaatattcacaagatgagaagagaactaactacagaattattcattattggtttcattgcgatgaaatgactcaacaaccaattttgtccacaatttcttaagagatgaaaatacgttcaagaagcatgtgtcaaggaaactttgctagtgttacctcatcagcgaagacatcgaagggtctttgtccatcagtaaccatagttgcacaaatgaatatagcttttgagattttctctggaaaccgctctaacgcatatgaaacacatgcccctccagtactgtgacctaccagaatcacctgccacaattcttcatctgataaatgcttcctagttcatattacaaccaatacaaggaccaccattttcatctaaatcttagcaagacattgacacttccttccaagttccaacataaacctatctatctaatggagcattttctaaccttttcttcagcaggaagattttgaatgagctcgatcaacggttttgaatattcttctaaggtggaaacactatttgcgtctgtcatattaaatccagatccagcgaggtcaaccgtaacaggagacagtccagactcctccaatgacgcaatagttttgtaccaacaccatgccccaaacccttcaccatgcaccaaaacgaatttcttaaccttcaagctctccaaaaactcaggaacctaaagagataaaaaaaaattaactagcataagtaaaactgaacataaaaagcaatgacaattatgtgtgacaggaacaatcatgaacaaattctcgagtgttcgaacaaagtcctctgctttcaataaccataaagaagcttcttttctcactctttgttctaaccacaacaagacaggcccgtagggtaataagacaataactatcatttgagaacaacactcaacaaacgataaaaagatactagcatcagtaaagtcaaaacataaattgtgtactgatctctagagacctggtttctcatagtcataggcagtctcaattacaaagaagtaatatttacacgaacaaagttcactgccttctccaacaaagaagcttcttttctccatctttgttctaatcaaaactagacagacccataaagtaatatgacaacaacactatataaacattttaaaaagcaaaacgcactacaagaccttttaagaacacttattctgttcttttggtcccaaccacttttaagaacaatatcaaatttaaaacctttataaatacttttgaattctctcctcaaagtttaaaaatccaaactttatcattactatcaaaaagcttggacctgcttgttattagaaaatgagtcagagagtgttcctcttctagagctagtagacccgattcgtctagacatggatccatcaaatctctgagaaacttgagcttgatgaatagccatagacaaagctcttcgatgcaaattctcttcatcagcaagcaacttcctctgtgaacgattcactctcttgcttctggacccatctcctccacttctgataacaacatctttcttcttcatgcagattactctgttacccattcttcacaaaaccctgaatttagcccaaagaagtggactttaatggaaactcaagaaaattctcaaaatttattaaggtccattaattgaaaaaaatcttgacttgatgatagagagaagaagaagaagaagtaaaacggtgtcattgattaggatgaataaggacgattcagatttaagacaaagcagccaaagtttgttaattgtttcgtctatttgtgtgggatatttgatttcttgtgtgtttcgacatttttgttctcattattatttctctgttccttcacaaaaattgggacatgtatttgtctgactctcagcatattcatatattttttttttcattatttcatgaaagagtctaaaagagaagaaagagtcttattagcaggcccaaagcccaggcccacttaggtagcaaacaattctcaacgaatctcagtgattgtgagtttcttctgctaccttcttcttctttctccctttctcgatttcagaattgtagattttccagaaattcttccgcagagttcttcaggcgcttttgattttacctctaattccggttcagaggcagaaaaatcgagcatttactgaatttcactggaaatagtctcatcaccacctaacaatccagagctttctagggtttatctctttttcctcggtgtgtggctgtgttttttttttcttgtttggttggcttgagataatgattgtgtttctatttcagggtcggtgacattttcttgatttttgtaaagagatg

SEQ ID NO: 20352 - DNA, 3003 bp, Unknown; identical to SEQ ID NO: 20351
  misc_feature (1)..( 3003): 2750-1469P.txt file - cDNA_ID_1825531; gDNA_ID_1620729; Annot_ID_49352

SEQ ID NO: 20353 - DNA, 3000 bp, Unknown; identical to SEQ ID NO: 4776
  misc_feature (1)..( 3000): 2750-1469P.txt file - cDNA_ID_1825553; gDNA_ID_1620730; Annot_ID_49382

SEQ ID NO: 20354 - DNA, 3000 bp, Unknown; identical to SEQ ID NO: 4776
  misc_feature (1)..( 3000): 2750-1469P.txt file - cDNA_ID_1825553; gDNA_ID_2926157; Annot_ID_139584

SEQ ID NO: 20355 - DNA, 3000 bp, Unknown; identical to SEQ ID NO: 4773
  misc_feature (1)..( 3000): 2750-1469P.txt file - cDNA_ID_1825565; gDNA_ID_1620730; Annot_ID_49378

SEQ ID NO: 20356 - DNA, 3000 bp, Unknown; identical to SEQ ID NO: 4773
  misc_feature (1)..( 3000): 2750-1469P.txt file - cDNA_ID_1825565; gDNA_ID_2926157; Annot_ID_139580

SEQ ID NO: 20357 - DNA, 3000 bp, Unknown; identical to SEQ ID NO: 8528
  misc_feature (1)..( 3000): 2750-1469P.txt file - cDNA_ID_1825591; gDNA_ID_1971815; Annot_ID_58222

SEQ ID NO: 20358 - DNA, 3000 bp, Unknown; identical to SEQ ID NO: 8528
  misc_feature (1)..( 3000): 2750-1469P.txt file - cDNA_ID_1825591; gDNA_ID_2926169; Annot_ID_140049

SEQ ID NO: 20359 - DNA, 3000 bp, Unknown; identical to SEQ ID NO: 8540
  misc_feature (1)..( 3000): 2750-1469P.txt file - cDNA_ID_1825595; gDNA_ID_1971815; Annot_ID_58221

SEQ ID NO: 20360 - DNA, 3000 bp, Unknown; identical to SEQ ID NO: 8540
  misc_feature (1)..( 3000): 2750-1469P.txt file - cDNA_ID_1825595; gDNA_ID_2926169; Annot_ID_140048

SEQ ID NO: 20361 - DNA, 3000 bp, Unknown; identical to SEQ ID NO: 8530
  misc_feature (1)..( 3000): 2750-1469P.txt file - cDNA_ID_1825605; gDNA_ID_1971815; Annot_ID_58218

SEQ ID NO: 20362 - DNA, 3000 bp, Unknown; identical to SEQ ID NO: 8530
  misc_feature (1)..( 3000): 2750-1469P.txt file - cDNA_ID_1825605; gDNA_ID_1971815; Annot_ID_175946

SEQ ID NO: 20363 - DNA, 3000 bp, Unknown; identical to SEQ ID NO: 8530
  misc_feature (1)..( 3000): 2750-1469P.txt file - cDNA_ID_1825605; gDNA_ID_2926169; Annot_ID_140045

SEQ ID NO: 20364 - DNA, 3000 bp, Unknown; identical to SEQ ID NO: 8530
  misc_feature (1)..( 3000): 2750-1469P.txt file - cDNA_ID_1825605; gDNA_ID_2926169; Annot_ID_199377

SEQ ID NO: 20365 - DNA, 3003 bp, Unknown
  misc_feature (1)..( 3003): 2750-1469P.txt file - cDNA_ID_1825608; gDNA_ID_1971815; Annot_ID_58217
tagtttttttgaaaaaacttgaataataatttggtgtagattttgcaaaaaagaaactccataggatttggtttttgttcaataattggtaaagatttgtaaaatctagatatcaacggcaataaagggtttatgtacttgaacagttggtaagtagacactagagcaaagaacagggagaaaatattggcgtgctttgcccaacgatggcctctatatcgagcgagatcacaaaggagccagcccaaaccaaacaaagagagcaaggtgagcaggtcgaatgtatcctccatatccatcttttgcggatgagcgaccaatggaacggtgatgtgattttgtcgaaaggtaggctttggagaatgggagaacaagcctagtacaaacgcgccaaaaatttcatggaccgtgcaaaaagaatctcgttccaagtagcatttgtttccattggaaccatttgaatgccgttgtgatgtacttttgagatgatccgtttcttcttcctttttaaaaaaaatgcattgagcatttgagcatcaaagacgattacttatagtataaatgatttggaacacaagagaggctatgaaaggtttttgtttcatcagcatttcaaaatattggtatcaaaccatataagaatacatgttgttgtgatacattatcgaagtactagactatgcaatgagacttggtttttcgtccttgagccaaaaataataatgactagctttataatttgacaatcacaattagttttgagatactctactggactttgtaatttgtattactacgatgatctttgtgtgtgtatacataataataatatgatcaacctttttggtttaaacatgaatccaagtttcttttttgatatctgtattggtaatattttcctgccacgtgtggaggtctcacaagagccacatggacaagacacgagaaatctgaaatctcaaaaactcaacaacacgagaacagctgttctgttgcttaggaagatctattacctctaaccacaacactacaaagagagtactagttaattagtttaatttactggatttttctaataatttctattgatattcgaatgtaaaactcgatgtaggactacaattgtccatatatgaagttgaaatacataatgtaaaatctgattatagaaaaacaaaaaattgtaggttaactatcagccacatagaagaaaaacaggatctttctttgaagttaaatttataaactaatctccccatttcaatgagctgtatatcaactcacaagtcgtaacccgtgccatcattaatattgttcacgtacattttccttttggcagaagattacggtttgagttatactatttcgtggaattacatattttaaaaaatctttctccaaaactatttattttctcttttgtttatttcgtactaaactatttcatatgatgcagaaacttaaactgatcttaccacgtaaacgtggcaagaattaatttacacaattaataacaaatatataatctatattatatttgacagtaattcgagatctttagcatttaatttagtgtttttagtttggtgttcgaagccatcaattgatttttatttacatggcggttacatatttagggggttaacgtggcttttaattcatagaatgtgattagaacacacaatttataaaaattagttgtccccgtgcaaaaaaaagaaggtatacatgtgttatgtgtcaacgttggtacgactttgaaggatctaaaaggtcaaactttagttgagagttgagacagtgataacttggttttgactttcttacatgcatcgccacaacaatacaatatttctacgaatgcataaaaaacaaattctatgctttaatttttttttttttttcttgaatgattgttaacgataaactgtaagaggataagttaaatctctttttattgttagtaaaaatagaaattcgtgtaaggacttcacatatttgatctctttttaattagcgtgacacaataactaattctcagttctcgatgtacctactaaattccttaatctaggaggacaacgtatatcggtatatgactaagatctagttcttggaactacatgtttaacaatattggtactaattgggggacacatgcatataattatacaaatttgtatatctaaggataaaaattggatctctaattttcaaactaaaagaattatggaacgtatgttagtttaatatccttttcaacagcttttgacttatttaattttttcatcttgtgaacaagagagaaaaaagtactctttaatttattattaacttcaataattgcaagtcatgtgaaacccatcaatctaatcttttctcacttgccaaaagagaatattatttctgtagctattaaaagtaattatgtaaatttatacctatcctattatagaggtaaaaaaatgtaacaccacgagaatttttatttaccagaaatgtagaatggaacctaaaataatgaacaattattaatgctataggatcgattaatcgtaagaaaaaaaaattagaaagaataacattaggcaaattttttaaaacgatcatcaaacgaaaccgtaaaatggtgaaaaaatattttacattttgtcataaaaatgacaaaacatcaaagtacacccttaaaaatccctattttgtaaagtcataggacacgtaattttttaaattactcgaacctacaagagattctcgtagttcaaccaacacaatcacacgtattaacttttttcctctagccagctacatacatagtctacgcatcgcctacgcaaaccatagatccatcactctatatatacagaaatatatacacacacacaaagagctatatatagagaatacacaacacattattctattcttgtatactctaattacacacaaaaaaaaaaggagagagagagagagagagagtaccaatttctctccctcaaaatg

SEQ ID NO: 20366 - DNA, 3003 bp, Unknown; identical to SEQ ID NO: 20365
  misc_feature (1)..( 3003): 2750-1469P.txt file - cDNA_ID_1825608; gDNA_ID_1971815; Annot_ID_175945

SEQ ID NO: 20367 - DNA, 3003 bp, Unknown; identical to SEQ ID NO: 20365
  misc_feature (1)..( 3003): 2750-1469P.txt file - cDNA_ID_1825608; gDNA_ID_2926169; Annot_ID_140044

SEQ ID NO: 20368 - DNA, 3003 bp, Unknown; identical to SEQ ID NO: 20365
  misc_feature (1)..( 3003): 2750-1469P.txt file - cDNA_ID_1825608; gDNA_ID_2926169; Annot_ID_199376

SEQ ID NO: 20369 - DNA, 3000 bp, Unknown; identical to SEQ ID NO: 8536
  misc_feature (1)..( 3000): 2750-1469P.txt file - cDNA_ID_1825612; gDNA_ID_1971815; Annot_ID_58215

SEQ ID NO: 20370 - DNA, 3000 bp, Unknown; identical to SEQ ID NO: 8536
  misc_feature (1)..( 3000): 2750-1469P.txt file - cDNA_ID_1825612; gDNA_ID_2926169; Annot_ID_140042

SEQ ID NO: 20371 - DNA, 3000 bp, Unknown; identical to SEQ ID NO: 8534
  misc_feature (1)..( 3000): 2750-1469P.txt file - cDNA_ID_1825621; gDNA_ID_1971815; Annot_ID_58211

SEQ ID NO: 20372 - DNA, 3000 bp, Unknown; identical to SEQ ID NO: 8534
  misc_feature (1)..( 3000): 2750-1469P.txt file - cDNA_ID_1825621; gDNA_ID_2926169; Annot_ID_140038

SEQ ID NO: 20373 - DNA, 3003 bp, Unknown
  misc_feature (1)..( 3003): 2750-1469P.txt file - cDNA_ID_1825625; gDNA_ID_1971815; Annot_ID_58210
cggaacatcaagtgaaatgtgaataaccgataattcaattgaaatgaaaaccgaccggtttggttccgctcatattgacttcttgatttagtactttactaataaaccaagtgagcgatttactactaatcatgttaagtacagttgtcagtaaatatctgaagattagtggactataagtctattatgagtcttaagataatatacaatttatatagagtaaaaaacttgaagattagtggactatgataacatatacattacatacatgtctatatctcgatttttgtttgttttcaactgaagagagaaataaataaagtgtttctatcgaatgtcctcgaagatgcgaagtaaatactaattctatgatgtttatcgtcgactgagtctagtcttgtttcgtttttatggttgattaatttaatacaaatttcggaaaaaattaataaagagagaacaaagaaaaaagatgataagaagcgggtccatacaccgggtcagatttggcgtgccgtgtccaaagtgcttcaattttgactaaaccattcgatttttctttttattttttagtatttttttttttttagttttatcgtcaatgaaaataactcgtgtttatatgttcttacttcttaaactttttcctcacaattttatcatgagttaaacttaacggaacatgaattactatatcgtatatgtgagcatgcgtaatgtgaattacatttgtatttatcccaaaattaggatgaattgctataatgtagtagggattaacaaaattaacaaaggaaacacaagttatcaaagtgaaaaacaaatgtggatttggtaatatcaaggtcaagtggcgtcctttttcaaagtcaatggacaataaatcgcatgtaagacttgtgtgttcctattcaaatgactgcatacgtttttcaaaattgtcacaaaacttatcaccaatacaagatttatagtatcaatagtatgtttcatcttttctatttaagaaaaaaacaaacaaattggtatcttcatccatctaccatcatgcatgacaaatgaataaaagctgttgttatcatatgacgtctatagaatgcatattatatgtctcccttttattttatttccttgtcgtcattcttttattttattatactacattatatgcatttaaacatatattaaagacacacattatatgattcataaggtagaaacaattatttatcattcatcgggccaacaaattctatatccgcatgaaacacggaagtctaaatttaacaacgcaatgagtagactcttgtataaatgaatttcaacaaataattccatgtttcacctatcagagatttagaacaaaacacaaactgttgtaagaacagaaaaaaagtgttagttaaaatttgaattcaaatgtgacattacgtttaggctttatgaaactaattgtactttcatttcagatgagacatgacagcgatattcataaaagttttgctgaattaaattatgtgtatagtatgattttatataatcaaaggacatgagtttaaaatggaatttccttttcaagtgatgcatattggaatagttagtactgactttgcaatgttaatttacctaattaattagaacaacaaccaaacgcaagcactaataaacaaaagggtgtgttatctatataataacccatcttttgacctaaatttctgcattaattttctctttaataatttaacaagtgataaacaagtacacatggattaggttattatgtccaattcatgagcttgtctccgcttattgctcgctttaaaagctataacaatggaatctaattattgatatcatccatcttcttattatatacaaatacacaccaataataatgagaacaaagtataaagtgcgattcacacttgttccaactcattcttatgcacatataatagaaataacatataaacaaacacgcacatatacactaattttccataaaacgaaatttacaagtaaaaatgaaattttctttttcaacagtcaagttatttgaaaacattacgtcattcatattatatataattttttttggtgagatatctatcattgatgttatattacaacagtttaaaactatttaaccataaaagttacatgaatacatatacacgtcttagctattctagtaattttaatattttgaacaagcaaaataagtttttttaaaaatagaggaaaaatagagagaccacctgataaaacacttataatgggattctaaaggatagagatgagatgtcaaaagactcaatactacaataatggagcaatagttttctccacttggctaatataatatctaacacaaaaaaaacttcccacaatttttttttgtttttgctaaaggtaaacacatttccatattattactaaactttattttatacataaatgcaatgtgtatttaaaccaagaataatgttgtgctctaagattatgtaacgaaaaaaaaaatctagttatatatatatatatataatgatttatttctatataatatcttataacattgcaaaatattaatttataaacatataaaatattaaatcttgataaaccggaaataaatattattttgcaagtgagattacataatttgaagatttttttgtagagtgaatatgggaaaaatatatagagattctctctattggtaattggtatattatgagaaagatattgattttttttaattttaagtttgattaaagatattgtaaacatttatataattaaaaaaaaaagagaaggaaagaggaaggaggttgggttggtcgactttgctaagataagagaagagagactgactctctctctctctaactcttcattcttctctcttttaccttctctccaagaaatcttcactttctctctagaaaaaagttggaagctgactcgataaagactctctttttcttcttcttcctgcaaatg

SEQ ID NO: 20374 - DNA, 3003 bp, Unknown; identical to SEQ ID NO: 20373
  misc_feature (1)..( 3003): 2750-1469P.txt file - cDNA_ID_1825625; gDNA_ID_2926169; Annot_ID_140037

SEQ ID NO: 20375 - DNA, 3003 bp, Unknown; identical to SEQ ID NO: 20373
  misc_feature (1)..( 3003): 2750-1469P.txt file - cDNA_ID_1825625; gDNA_ID_2926169; Annot_ID_199365

SEQ ID NO: 20376 - DNA, 3000 bp, Unknown
  misc_feature (1)..( 3000): 2750-1469P.txt file - cDNA_ID_1825641; gDNA_ID_1971815; Annot_ID_58204
taaattaagatatgttctagaacaaataatccttcaataaatacgttaattttcaaggatttacctcgaaaaaattagtaacagcatctgctttcctttttctagagctggtttcttcatttcctttttcttctcgcatttcatctacctctttagtgcagtcatagcaagaccaactatcgggaaccttatctattttttccatcatgcaataactacaataacaaaaaaatgataacagatattcatataaaaacaatgctactatctaatggcatagttaaaagttacgtatattgttgacaaaaaatattacgtatgttctgcaccaactccgcagttgcaacagatcacaagtaaatattcatatccttgatcaccacatgtatcacaaacagttatctgcaaaatcattatttgatataccatcatatatcgataacatgcataagctaatatccgctaaattaattaaaataaaatcattatatacttctcgctcaatatgagacagttcattgttatcattgagtatagcctctgcaacttctgcatttttaacactatcgccatcaccatcatgctgcacatacgatgtcatttgctcctcattctaaaaacgtaaatacgtaattaactaattatattcatttttccatggaaatcaaagatatattcttccatcatgatgaacagaaatggataatatatatctacttctgagaaagatgttctgtaatatcagattcgtttaagtcatatgtgttcttagaggaaaataatggtgtcacctctttagatacaacaatatgatcatagtcatgattgttcaaaatcatagttgatattctatattatttcttgacaaatctattagagtccaaatccctgaatctttaagaaaaaaaaaactaaaacattaatgaatctcaaacatcaatagtaatgaaccacgatttaaaacctgattcataagaagaactaactaatagaattgatgattgtgattttctaacgataaaagaacagagcaaacaaaatcaacacaattgaaggagagaaaagggaaaaaatcttcataaataaaactagagaagtgatcaatcttaataaatttatatttcactccttgatatcatcaaattttaagataaaaatgaaaaatcttggaatccttgatccaatttgatttttgattcataatcaggatacaagttataaacaaatgatcatcttgaatcataattagacttcacaaataaaatttccaaatcattcataactttgaaaaaaatataaaccatatataatatcctaaatttatagaataacaataaaattattttagccaaaataatcaaaacaaaaaccataattcttcgaaatttaatacgtttttcacttgatgcaaagaaaaatccaaatcaaagtgaagataaatagatgaattttgaaaaatacttacataaaagtccaaacaacataaaaagtgatgagcaaagagggagaagatcacaaatatttaaagaccaaatttagagccagtacatcaattcattaacttattatgttaatatatcttgtcttattttattttctttgtaactaaagcaatttaatgatgaattgtatttcgattatctattttaggaattatattcagttagtatttgctcttattatctcttgattattattttaatttaatttaattaattttagaccatatatgcttgttaacttttaaatagaaatagatttatggctctatttttgttatttttgttatgacatgtgtttgaattaagaatacatataaattgagatgacttttgtatttgcatgtgtaacctaagttatgaaaacaaaatgtaatatcgtcgtaatgtagtttttatatattgaaccgcccacaagtatattcatgatttaactcaacgatttagtcctaaaactggtgggcctactctacaaatggctacattaggatttgggaaatattatattaactcttataatcaaaaactttaggttacatatagttacatagtaaaagagtttcctattgtatacgatcaagtagtatatattgttttgtcttttaatcgtgatagagaagtacatatatgtctcgtcacaattatatgtattttttaaaaactagtcgttatatgtgttaagtatgaaatagatgacataaaatgaattagtatcctttggaatcatgaagtttctatattaagtatattgatggacgtcaacaattaccagatcctaataagtgcacatcatgtatatctaacatttcatccctatgttaagattagagatatgcacctcgtatccattgataattaatgattgtttgtgatgtcaatttttagtaaatgtgtgtacgtctattaccagatgcatgtaggtcgaattgcaacatagagtagcacatttttttcttgcattgttccttaaataaaataagcaaaatacctttgaaataaaatcattttgcaggcttaataggtggctacatgattagcagtatatgaactcgttggatgatacaatgtttatgtttttgaaataaaagcattcaaaccaatctcatacaataatagatagttccatatccagcataccatctccctgaggtgttcgtggtgctccctcccaagacacttgtttttagagtttttttttttttctctttcagaaaaccaagacatattctttatgagaatttccctagctcatacactccatcaaagtcattcttctctttcaaacatacttaagatccctctaggcacaactcttgtgtatcctttttcgtaggataaacttcacataattaacaaaacccaacattttcttgtgtaaaaaaaaatacgaagaatgttacatatgttgtaatagtaacgcctcccaaaagaaacaccttatgggaaacccacatgatacatatgttatacatgctcagtctcattcatatatgttaagatg

SEQ ID NO: 20377 - DNA, 3000 bp, Unknown; identical to SEQ ID NO: 20376
  misc_feature (1)..( 3000): 2750-1469P.txt file - cDNA_ID_1825641; gDNA_ID_2926169; Annot_ID_140031

SEQ ID NO: 20378 - DNA, 3000 bp, Unknown; identical to SEQ ID NO: 3323
  misc_feature (1)..( 3000): 2750-1469P.txt file - cDNA_ID_1825652; gDNA_ID_1620732; Annot_ID_49417

SEQ ID NO: 20379 - DNA, 3000 bp, Unknown; identical to SEQ ID NO: 3323
  misc_feature (1)..( 3000): 2750-1469P.txt file - cDNA_ID_1825652; gDNA_ID_1620640; Annot_ID_47457

SEQ ID NO: 20380 - DNA, 3000 bp, Unknown; identical to SEQ ID NO: 3323
  misc_feature (1)..( 3000): 2750-1469P.txt file - cDNA_ID_1825652; gDNA_ID_1620732; Annot_ID_166127

SEQ ID NO: 20381 - DNA, 3000 bp, Unknown; identical to SEQ ID NO: 3338
  misc_feature (1)..( 3000): 2750-1469P.txt file - cDNA_ID_1825652; gDNA_ID_1620640; Annot_ID_163008

SEQ ID NO: 20382 - DNA, 3000 bp, Unknown; identical to SEQ ID NO: 3323
  misc_feature (1)..( 3000): 2750-1469P.txt file - cDNA_ID_1825652; gDNA_ID_2926178; Annot_ID_140413

SEQ ID NO: 20383 - DNA, 3000 bp, Unknown; identical to SEQ ID NO: 3323
  misc_feature (1)..( 3000): 2750-1469P.txt file - cDNA_ID_1825652; gDNA_ID_2926178; Annot_ID_199982

SEQ ID NO: 20384 - DNA, 3000 bp, Unknown; identical to SEQ ID NO: 4786
  misc_feature (1)..( 3000): 2750-1469P.txt file - cDNA_ID_1825656; gDNA_ID_1620732; Annot_ID_49416

SEQ ID NO: 20385 - DNA, 3000 bp, Unknown; identical to SEQ ID NO: 4786
  misc_feature (1)..( 3000): 2750-1469P.txt file - cDNA_ID_1825656; gDNA_ID_1620732; Annot_ID_166125

SEQ ID NO: 20386 - DNA, 3000 bp, Unknown; identical to SEQ ID NO: 4786
  misc_feature (1)..( 3000): 2750-1469P.txt file - cDNA_ID_1825656; gDNA_ID_2926178; Annot_ID_140412

SEQ ID NO: 20387 - DNA, 3000 bp, Unknown; identical to SEQ ID NO: 4786
  misc_feature (1)..( 3000): 2750-1469P.txt file - cDNA_ID_1825656; gDNA_ID_2926178; Annot_ID_199981

SEQ ID NO: 20388 - DNA, 3003 bp, Unknown
  misc_feature (1)..( 3003): 2750-1469P.txt file - cDNA_ID_1825678; gDNA_ID_1620732; Annot_ID_49410
tgatgctatcacattttctagtttgcttccatcagtttctaagtttgaaaaccttgagtattgtaagcaaattcattgctatattatgagacatagcatatcgttggatatcttcttaactagtgctcttattgatgcctattttaagtgtaggggtgtttctatggcacaaaatattttcagtcagtgtaactcagttgatgttgtagtgttcacggcgatgatctctggttatttgcataatggcttatacattgattctctggagatgtttaggtggcttgttaaggtaaaaatcagtccaaatgagataactctggtgtctattttacctgtaattggtattttgttggcattgaaactcgggagggaacttcatggtttcatcatcaagaaaggtttcgataataggtgcaatattggatgtgctgttatcgacatgtatgctaagtgtgggagaatgaatcttgcttatgagatttttgagagactctccaagagggatattgtttcgtggaattcaatgatcacacgttgtgcccagagcgataatcctagtgcggctattgatattttccgtcaaatgggagtttcaggaatctgttatgattgtgttagtatttcagctgctctctctgcttgtgcaaacttaccttcagaaagttttggcaaagctattcacggtttcatgataaagcattcacttgcttcggatgtatatagtgaaagcacattgatagacatgtatgctaagtgtggaaacctgaaagctgccatgaatgtgtttaagacgatgaaagaaaagaacattgtttcatggaatagcatcattgctgcatgtggaaaccacgggaagctaaaagattccctctgtttatttcatgaaatggttgaaaaaagcggaatccggcctgatcaaatcacatttcttgagataatatcttcttgttgtcatgttggagatgttgatgaaggagtccgcttcttcagatccatgactgaggattatggaatccaaccgcagcaggagcattacgcttgcgttgtggatctgtttggacgagctggtcggttaacggaagcttatgaaactgttaagagcatgccgtttcctccagatgcaggagtttggggaacattacttggagcctgtcggcttcacaagaatgtcgaacttgctgaagttgcttcaagcaagttaatggatttggatccctcgaattctggttactatgtgttgatttcgaatgcgcatgctaatgccagggaatgggaaagtgtgacgaaagtacggagtttaatgaaagagagagaagttcagaaaattcctggttatagttggatagaaatcaacaaaagaactcatttgtttgtttctggcgatgtaaatcatcccgagtcttcacatatctattctttgctaaattcgcttctcggagagctgaggctagaaggatatattccacagccttaccttccattgcacccagagtcatcgagaaaagtatatccggtttcaagattcattgagaaagaaatgagagatccagacaaagtatagaaaaccaagtatatatctcttttagacaagtttaaacattgggttaaatttatagaaaggaaaaaacgggtagaaaatttttcaagcgtggcctgcgcttgtctgttctcgtgttgaagcagttgcagagatgtaataagcaacagcaaagaggccgtgaacgaaacagaggatccctcctatggacagaacccgatggtgtgatatcccacagttttttctcgatcttgagtttgccatcgtccctactatcaacatcgaaaatgcaatcgccaatatgatcctgagacaaacaaaaagggatcttaatcaaatctctcggtagatttacagttgttctgtttatgtcgtgttttgacttaccacgtgaatatcagagaagccacagcgagctgtttattggcagaggatttttcaaggtcttgtcttgaggcaacacagagacacccaccaagaaaattagccgttacatgggctaacaccaaaaggatgcacgcagctaaaccgtacttgaaggctgtgtaactcgggtctctacactcgaatatccacatcttcaaatgcttcacctgcacccgaaaataaacaaattagtgaaatctgcatctcctatcgacttgtggctgtgtaatgtaccttgttctgagctatttcggcttcaatgccgagaattccagccgaaacatccatggctaggatcaagatgcagatgaagaaccctacattcctcgccattgtcgatgaaacaagttcttactagcaaacaaagaagcaggaagtattgttgttgaagtaataacttgttcttgtaatttataggcaattagagttttaagctttgagagactctcttcgttggatggaataagaataaagttcaacataagtttccttttcttgcatttgtactaaagatcatgttaagagaataaaatttagctgggatcctctctttttcaggagaaaattttaacttttataaaatcatatttgatgtttctgaggaattgaagaagtttattagtaatgtgcaatgtcctcgaaaagatttgttttctttattcctctcttccattccatgtttaataataaaaccttttcaatattcgattcttgacagagcagccaagcaaagaagaggacgtttgcgttttgaatcgctgttgaagacaaaaatttcgttttccagtcgctctggcccaataaatttaagtgggcctttacagagacttatcctaaatcccgtctcgttgatgataatgacgtggctacgtacaaaagagtaacaaattcgagaacatgacgtggcatatttctctagaagcagctccattcttcgacttggacatttgtcttcttaaaagttttcgagaaatgttcgattcttcgagagttcgaattctcaggagaagaagaagaagaagaagtgaacagagaaaatg

SEQ ID NO: 20389 - DNA, 3003 bp, Unknown; identical to SEQ ID NO: 20388
  misc_feature (1)..( 3003): 2750-1469P.txt file - cDNA_ID_1825678; gDNA_ID_2926177; Annot_ID_140406

SEQ ID NO: 20390 - DNA, 3003 bp, Unknown
  misc_feature (1)..( 3003): 2750-1469P.txt file - cDNA_ID_1825696; gDNA_ID_1620733; Annot_ID_49436
tgatgattgagtttgttgagataagtatttatagcttaaatgtttgattgttaatattaaaaaatggatataaggctcgagggaaaaagattagatttgtacggccatgttgggagagaatacaaaggttgattagtctttacgtagaaggtcttgtttttcaaagttacgttgtaattagttgaccaaagctgtttcatcctcatccacttcttgtaactgatttacttccaaaacagaacacaaaaaaaaaaaattgtcgacatgaattacttcaagtaaattgcatcttacgtacaacttctatattaagatattggataacattttatttttcgtttgataatcttatccgaactcatttttgagattacgtgaaaaagtgataagatacgaaaattgaactctaaagttagataatacagtataaattcgtcttgaaaaaatgatgtaaaaagtaaaaacaaattagatttttttttgttgtcaacgagcaacctatcctatgaccaaaaaaaaaaaccttcaaactttatccctaatatttgacttagtgaattaatgaggaccgtataagagtatattcagagatgtaccacaaaaatttagtgtccactagctttttggtaatatataatttaataattaattataactttggaaagaaaaaaaatataaggggaaaatatcagttaactgatggaagttgatgggagtggacttaaaagttgcttagttcaaataattgtctattatgtcggccgtgcccttccaaagacttgcaacttacaacaatgattttagttgttttatattctaattaacaaaatattagttgttggaaatattagtattttttttgataaccattttggtaatttagtaactttattcactaacgttatattacgaggttgggacatgatggcatcgtcaaaagatagtgacttcgaatctcttacaagatagttaaataatatatttctgcgtggttcaacaccatggtaacaaaattgtgtatcaatacctgaatcaattttttcatggagggttacgccaaaaatagtctaattattttgtatggaaaatatgtagtactttttcacgtgataaaagaaataaaagtatgaaatggcgtctaatctatgggtaaaaattttggttaaaaaaggaataattatttttgtttctttttttgactcgaaatatatttttgattataaaagaaggaacgtgtgaagtgtcacactgtcagcttatctatttgcatgggaagggcatcgctttttgactttttcttgtcttactgattcctttttcacttatataatctctttctcttcttcctccaaattcacgtgtacaatattgtacagtatattgaaattttggtcatcgtacttagttgctctgcgtatgaacagaaccaggtcaaaactacgtattgcaaatttccaccaagaaaaaaatagaatacggtcaagtattttcatttttctcgtccattattttcatccattagatatacattcaaataccaatagcaagaattacgtacagtataactaattctatatggcattatgtcatttcttttataggcattatgtcatttcttttataggcccatattgagtaactgaaataggcctgattcacagttaaagtagtgtatcgttggggagcccgtttcccccaaagagaaaaaatcgttatataccaaacattgaactaaacaaatacgaatcgaccaggaaaaaaatgaactaaacaaataagaataagtcaataaactgttcaggacttcatgcttacaaaaggaattgagtatttttaaattctaatactagataaactatccgtgtatacatgcagattttgctcataatattttctatctcactaatagacaatcaaaatttgactaatttttatactttctttacatcttataggattagaactagatttaccgaaatttatttatcttctcatgacaagttagttgacacatggttttcttaaaatttgaaatattttttttgagaaagttcgtcttaatatatgagagatttgacacacatgaactgataaaatccaatcaatcatatttcatttgttaatggcttaataaattattacatatcaatcacttggacaatggagtatgggacatgcatgtcacgtgtttatggtataagattatgtaatgaattcgaatatgaatagtggaaaaacgataagagtttgagtaatcaattgattaataaaaacactaataattgaggcaaagttaaaaagaaggaaaggacagaacaatcatggaccacatgtagactttgctagtttagttcgtcggtctccatcgttagccattcactctccaatccaacaacaccctcgtcgagtccggtctcaatctgcctattgatgggttcagattagaccacgtgtcaacgttaatagacaaaattagttggacctgcttgcaatgagtgaacacgtgtcgaacagctgaactgcgacatatcttgtgtgctttcccatgcggagatatatatagaccccaccttcagctacagagaatgaaataagccaattatatgtttatgtaattttgtcgaatctgcaccatctctttcggatacatacaaaaataccaaaaactaaattcgggggaataaactatagtttctcatttcaaatctttttttcatgtaaactcaaagcatttgccattcatatatttcacgtatgcttggctaagcttaacgactattgtacatactaggacgtgcacaaatctctaaatggtaccatgattttagttatacttcaatactgtgaatgagggttttaaatgacaagaatatcagaagtttcacggactatatggattaatatagatttgatataaaattccttacttatcaaaattaatcatcgtgtgtctcacaaatctatattgaagctactgtagaaatgttgttagaatgcatgatg

SEQ ID NO: 20391 - DNA, 3003 bp, Unknown; identical to SEQ ID NO: 20390
  misc_feature (1)..( 3003): 2750-1469P.txt file - cDNA_ID_1825696; gDNA_ID_1620646; Annot_ID_47593

SEQ ID NO: 20392 - DNA, 3003 bp, Unknown; identical to SEQ ID NO: 20390
  misc_feature (1)..( 3003): 2750-1469P.txt file - cDNA_ID_1825696; gDNA_ID_2926179; Annot_ID_140464

SEQ ID NO: 20393 - DNA, 3000 bp, Unknown; identical to SEQ ID NO: 3426
  misc_feature (1)..( 3000): 2750-1469P.txt file - cDNA_ID_1825700; gDNA_ID_1620733; Annot_ID_49434

SEQ ID NO: 20394 - DNA, 3000 bp, Unknown; identical to SEQ ID NO: 3426
  misc_feature (1)..( 3000): 2750-1469P.txt file - cDNA_ID_1825700; gDNA_ID_1620646; Annot_ID_47591

SEQ ID NO: 20395 - DNA, 3000 bp, Unknown; identical to SEQ ID NO: 3426
  misc_feature (1)..( 3000): 2750-1469P.txt file - cDNA_ID_1825700; gDNA_ID_2926179; Annot_ID_140462

SEQ ID NO: 20396 - DNA, 3000 bp, Unknown; identical to SEQ ID NO: 4802
  misc_feature (1)..( 3000): 2750-1469P.txt file - cDNA_ID_1825704; gDNA_ID_1620733; Annot_ID_49433

SEQ ID NO: 20397 - DNA, 3000 bp, Unknown; identical to SEQ ID NO: 4802
  misc_feature (1)..( 3000): 2750-1469P.txt file - cDNA_ID_1825704; gDNA_ID_2926179; Annot_ID_140461

SEQ ID NO: 20398 - DNA, 3003 bp, Unknown
  misc_feature (1)..( 3003): 2750-1469P.txt file - cDNA_ID_1825716; gDNA_ID_1620733; Annot_ID_49429
aacaaaattaaaaaagtgactaaaatattggtcaaaattggtaaaatatcaaaatatgatcaaaaattttgcatttttttaaagatatttcatattattttatttttgtaccaatatattttttttaaacgttggttattacttatagatgatatgctacgctaattttgttttatttctgctatttgttaatattacatggaaaacaaaaaaatcttttatttacagtttgccgattctgctgactatctatctaattaaattaacttttatgtttaattaaagaaataataatgattctcttttcaaaatacaatcatttggattggatgacacacatgaaccagaaaagtaacatgctattatctcagacgaaatattattttatctgtaatgaacttaaaaaataacatgttatgtagataatatatgcaaagcaattggtcgtattatattatatgataatgcactaagtaataaaataacatgattatgggaaacgtaacaaaacataataaaagaaactttgccacttgatccttttattttagtactgcagcgttagtagcgtctttatttactaatactacaacgttagttgtcctaagtgttccaccattgtgtgaacctttttgtcgctatcttaatttctcacttttaaaaaaagaagaagatgacggtttatatataaagttttatgtttatcatataaaacaagtgtgtatagtatacatgtacatatcatataaaacaatataaattcattgacagtgtgtcttatgagagaattcggacaatgtgaactgtgaagtgtttctgtaagtcgttgcccattgccagtgtgtaataagtttttaatagttgtaatattaattgtctgccgagagcatgtgagttttcaaattttgaatgtttatttatatcatattcatcagtggttagaattcaccaccaaactaaatatttttgtagacgttaaataaaagaatcaaatcgaataagcgatcttagttgaccgtcatcaattgtcatagaataaatataaagattttaaattagtaatcagaccaggtaggcaaatttcacctcacaaaaaacgtgtgagaatcgacaaaagaaaaaaaaaaatccactacacttctacctactgttgtactcttgtttgtttccaaaacgttttaccaatttttaccaacagtaatggttaactacctaaatataattctgcagaaatgtaccctaaatattattgaaactgcactgcagtactgcaccaaacattattgttaacttaaggggcatggctttgtttcatcatccgtgttatgttttggcaatggttttcctagatggtacgaggcccgacaaaaacatcatcggcatgtgaatgaatcatcatttggtgttacaactttaattttggatcttcaatagataactttttttttctttgtaatgacattaggggtcaactttactaattgaaccatcaatacattttagtttaaaattgagtaaaactaaaaattctgatcgaggaactagaatttcaaaccgtatcataattatgctcgaagttacgaggctcccattagtaacgattttctaaagcttggtgagtggtgacgagtgatattttaaacccaaaagaaaagaaaaagccttcagttttttaatttcaagggtaaagtgatgaatgtgaggattttggttagttgagacgagtttgataaagtgctcatgcgtaagcagaatttaacttcagatccagcagccatcataggatcggatgaactagcgaaagaaaagcttcttagtgggccaagcaaaccaccagggacatgaattttttcctttcttttgcttgattataaattcgtttttaacataagagtgatagaggcattacaagttttaaaaggcttatctctttaaaagtttttcttctttaacttaacgtcttatatttaatgtccatttggatcctccctttttttttttttcttcttataacccacttgggaatattaactatttttaatggttttgtttttgtctcacatgtaaggtgagattacacgtccctcaacaatgtgtgtaaattggtgctacgaacactactgtgaacccccaaccggatgtttaactaacccaccctggaggacattgacctcaatctctataatgaagctagagctaaggttaagattgtatcacatttacgttacctgtcttcaacaaagaacctctagaaaacaatgtaaacaagtgtataaggttactggacctagcgctaaaaactgcttcgtcgattgttggtatgtatggcgaaatttgcatagtttatcggaacaagtagaatagcagcaggttatcttccacgacctaagggctctataaatgaagctttccatgtgacttcaaatgctatcttaagcacaagacgcattcgatgaccatggagaatatgttccacaacatgagagtttaagagaacatccaactggctttacaatagtatgatgcatccaaagccaaaagaatagagagatataaaaagcaagacaacccataattcgaatatttcggggtggtcttggacctcttggtgcatacccatgccaaaactctggttgacaccaggtgctttgagtcatttcttaaatcattttatttttctctgcaaactagtaacactattaactttaccagcctgagaaaaatctgccatgacgatacaaaaagtctggagactttattcaacgaccttattattaaccatcaaaagtaaacattagtctcacagaaaaaagacaaaaacacagtacgagagagagacagaagcatcacacaacacacctatattatcacgtctttttttctgtgatcatattattacagggtcggattctctggtgtgaacttgagagagatactgtttacacagtgtcgctcatcggtaggagtagggaaaccttctcctttaaaaacgtgaccaagatg

SEQ ID NO: 20399 - DNA, 3003 bp, Unknown; identical to SEQ ID NO: 20398
  misc_feature (1)..( 3003): 2750-1469P.txt file - cDNA_ID_1825716; gDNA_ID_2926179; Annot_ID_140457

SEQ ID NO: 20400 - DNA, 3003 bp, Unknown
  misc_feature (1)..( 3003): 2750-1469P.txt file - cDNA_ID_1825754; gDNA_ID_1620734; Annot_ID_49447
tcaactctctgttttgtgactgttttggccactccctttgagtgacgcccctcaaattgacgtgcaagcagattccctaaccatcgttctagaagaggaactattccgcgaaggaaaaacaaccataccctccacattggagcccaaaatccacaccctggtcctttacccacaggaccagtattgaaacggtaatagatcaagtgtttcaaatccttgcacatcctgatttgtctcataagcctgtacttataacgatacatacctgtcaattgcccaacatgggagaaaatatattgcaggccatcagccaattgaaaggcatcaacattaccaagtcggaactggacatttgcatcaactacaagttttgtcagccggaggatctcacggcagagatggaaagcatttccaaaacgcgacttctttcgttccttggttgtcagagttttcacaggcttgaggttgaagttataatcaaggtgcaggtagttcaaattcttcctgtgaatcaacaggttcagcatattatacccctgccggcagacttgcagacccacttcaacccaatccagttcggtgctctgaaaaaactttgtagctgcaagagatcgaaacaaatgcttcttcttctgagccttagggggtctatggtgcagctcattcagtagataacatttcaaaagcttctggtaactaacccgaactttgacaggatatgctggaggactgcagaaaatgagataactaagaagttaatacaatgtctagtaaatttcaaaaggggaaagagaaccacagtagcatcagaaaaattagcttaccagtgctccttaaaccactctgcaacaaggggtatatcttcagcccgccgagtcctcccagacctcatattgaaaggccgaggggcaaacaacaatgaaatgccaggagctgtagtgtcagtgtagagtggcgagttatttagcaaaggttccagtccttctggtaacacaaagtcatccccatcatcatcataaccattacttttgcgctgttctttattagtgttattagagttacttatggggtgaattaatggatcataataaaaggcaggaaggtcaggatcctcagtctttatgtacataaccataggagtgtgatagacacagagttttactttcctgggcctattattgtacagatgtgggaaagctactttgtactcagttcgcagaggggatcgaattataagcttgttgatgtcattaaattcattccagtcttcatctcctttctccatatcacgatgcaaaggctcaaacttaggaccgcctgaaaaagagtaccaaattgaatcagggaaagagaacagaaggacaacaactgtgaaaacgaagatatcagaacaggagaacatagagtatagcgttacctggtatgcacatgttcagtgcctttgcagtaaagaatgatggcatgtcaaacaagtagaagtagttgcgatcaaccaaatcagacaacaactgggctgcaagcctgtgaagggttgacataattggaagtgagagattccacgtctggtaacttggaccattgatcatttttgtttttacaagtggcttgtggtcgtaaaaccaagagtacacagcagaatcttcttcttcatctagctccaactgaattgcctctagaggatcaacgtccaacaggttatcagcatagtctagagggggctcctcatcatcaaatggtggaaaccgcattctcttgaaatgacgacgatccctcttctcccttctcatcattatccacatagaaccccactgcaaacgaaagaatcatcactagaaaacatgtctcacaaattcacaaatgcacagacacaaaagaagagagagggagattattcacccacctgagccatgtaaataggttccacaacccatcgtacttcgttcacaaatgtaatagctccagtgatgtggtacaagaccttcacgtcccggacctggaaaatatctgagttcaaaattttgagcagagcaggagaacaactaaagcgagatatagatcactaagtgaataattacctgttcccagggcataggcatattctccaggagcttgaaaactgcgtgaggaacgaacttaagtgctccaagatatacacgtttatcaagtcgatgtttctttgatgacatatcaccatgatccctgaatcaaaacgcagagtcagtttcaatctaacttaacccaaacctaataatacaaagaaattggaccagattcgtttcccagtcaactggatttcgaaatcgaaattgaaaaattagaaactcgcctgatgattttcctaacgtgctcaggtggcatgtcctccttctgagtttccacgaacccaaacttcctcttgtcgccgtaccgtttggaatttagctgcatccatgttctcgccttcttctcaagcttcgcctctgcatcctcgggagtaggaaccgtcggagtattccgattagaaggcgccgtgtaagaaggatgatcagcgggatgtgaaggtgtctgcatcctcgaaccgtcggtaccaggaggagctaaggacgtaccatcaatgttccacatagcttcagatttcaaatccaaaggcccagcaaaatcgccgaggagcaaaaccctaaaacctcagtgcgagccttgacgaacacgaaaatccctaaaatcaccgtcgtcgggtgaggttggtaagaaagacgattaaccgaacgaacatatatatacgaaggcattcatgggccttttagaaaaacaatagatacgattatgggcctaatttatggattcagtcacggctcatttagtatttaagagtaagagatgtgtggaaggggtgatttggtaatttacattcaagtcaaccaaaaccagactttttaatctctctcgatcagaagttacctttttcacttttgccgagaaaatcagagacagaagaagaagaaaagcgaaaaaaagcaaaacatg

SEQ ID NO: 20401 - DNA, 3003 bp, Unknown; identical to SEQ ID NO: 20400
  misc_feature (1)..( 3003): 2750-1469P.txt file - cDNA_ID_1825754; gDNA_ID_2926217; Annot_ID_142249

SEQ ID NO: 20402 - DNA, 3000 bp, Unknown
  misc_feature (1)..( 3000): 2750-1469P.txt file - cDNA_ID_1825758; gDNA_ID_1620734; Annot_ID_49446
atctgatgttgtgtttcatgatagaagaataccaattccggtaggttcatcttcctttctttcttttttccatctttagtgatgattccctttttgccagttcatcttgcaagttcctgagcaatgtttgtttatctctctagatgtttgatctgtatggagttggtctccgtcaggcattctcgacacccaatctcctcaaggaactcaatttgaaggtatttaatagactcaagatgctacttactcttttaactatttcaattttgacaaaattggggtggttcagattggcaggttatctactggtgactcgttggatatgtccacgcaagatgaaacattgatcattgccaatgatgctacgctaaaggacatggaggtagtgtaatgttaacaattcttattactgaatctaaccagaaaatcaatgaaactgttgttttgaaactcttttggctctggattcttcagggtgctgccgtggcgtatgtggctgatcttctgaaaataccagtcgtgttcctcaaagccgtgaccgatctagtggacggagataaacctacagcagaagagttcttgcagaacttgacagttgtgaccgctgcattagagggaactgctactaaagtgatcaacttcatcaatgggagaaacctttcggacctttaacttctgttctcttccttttttatggagagtgattttttaaaatgcgttcaacgtgcttgttgcagtttcactgatttccagtgatcatatttctcgttaataaatttcaagttataagacgttctctccctagtgttgcttaaattttggtaaagaaacaatttcaaagataacttatcgacctgaaagacgttaaatcccttgataggcaaaatatacaacactgtaaaattaattcgtaaccgagacacttggtgaaacctcaagacacataaacgatgaaatcagaggtaaagaaaaattgagctatctttcccaattagaatttccgtcaagctcatcgcaggacatcgttggggtatttctatcttttgaacttatactactccagacggtagccggagaacaagctggcctccgaaaacgctgtaaagaaaaatgttgaaacttttgagatatatacaaagagctaaatagctaaactgttgaagtgaaggactaatgcgtaccttttgacgtagtagtaacagaaatctgccaagatgaaagtttgaacaatttctgagatcagaaccattgatggccacaatccataacccaatgctacaagcaaccgtccccgcgtgtccacaacctattttcagcacattagacaatgtattcagctattcaaaatcgacttttaaggtactaatccaatcgagtataggaatcaccactattggtataacctctatccactcttgaagatcaaaactaacctgtaaaacccagtgggcacagctgaggaaccttgctactccaagtgcaaaaacataatgagccgtgaacggttcaacaatctgaaaaccaaatagacgcggattagagagtaaaacaaatgtagttctctacttgacattgtgaaataaagtagtgacctttgtgttctgcatcactcgtagctgaggtagtactgaaacagcttcaaggtatacacataaagcccatgaaattctgtttattatgttatgagaggtcgatggatggatgaacacagctaatgcaacacagggcgcaagctgcaaaaattgaaatcagatcattgtcactgtaaatgataacaaacaactcgaggatcaaaaccagattgacttaccacataatagagaggaaagttgtctttgtcctccatgtaactagctcttaacttgaaacgaatcataaatataacccagagagttgttcccaaagtagccaagtcaagaatggtatgtatatcatattccattacaatgctacaatacagcctaacagctaaaaatatcgccgtaagctcctgagatttcagtgacaatcctgcaaaatcattcacaaagttatataaacacatcgaaggtaaacactttcgatttaaaaaaagaaccatagaatgcatcttaaaccctaaattgccaattgaatccttgattataaagatgatgattctacgaattacggctaaaggctgcttccgggagcagataatagtggtaaaccaatgaaatcctgatcaaagctcgaaaatttggacgcgattatgaggaaaaacaaaaaagttgtgacgttgaaaagtaattttgctaagaacagaggaatacatacgatcagaagctgataaggcaggactgagttgaaaaaccctaaaaatggatgtgataaagacaagacacatagaatagtaccggcacaggtcttctccttcatgagtttgtagatgagcacacagatcccgatggaatgaacagcctcagcggcaacgaagagattgtcgtgatcgtgaacaatgaatctgagaagaaccaaagccgccatgccagtgaccacggcgagaaaagccttcaccttcggaggttgtctcctaacccatgaccacaccacgtggatcggagtcttcgtcgtcgccttcatgttttgctttttttcgcttttcttcttcttctgtctctgattttctcggcaaaagtgaaaaaggtaacttctgatcgagagagattaaaaagtctggttttggttgacttgaatgtaaattaccaaatcaccccttccacacatctcttactcttaaatactaaatgagccgtgactgaatccataaattaggcccataatcgtatctattgtttttctaaaaggcccatgaatgccttcgtatatatatgttcgttcggttaatcgtctttcttaccaacctcacccgacgacggtgattttagggattttcgtgttcgtcaaggctcgcactgaggttttagggttttgctcctcggcgattttgctgggcctttggatttgaaatctgaagctatg

SEQ ID NO: 20403 - DNA, 3000 bp, Unknown; identical to SEQ ID NO: 20402
  misc_feature (1)..( 3000): 2750-1469P.txt file - cDNA_ID_1825758; gDNA_ID_2926217; Annot_ID_142248

SEQ ID NO: 20404 - DNA, 3000 bp, Unknown; identical to SEQ ID NO: 4814
  misc_feature (1)..( 3000): 2750-1469P.txt file - cDNA_ID_1825762; gDNA_ID_1620734; Annot_ID_49444

SEQ ID NO: 20405 - DNA, 3000 bp, Unknown; identical to SEQ ID NO: 4814
  misc_feature (1)..( 3000): 2750-1469P.txt file - cDNA_ID_1825762; gDNA_ID_2926217; Annot_ID_142246

SEQ ID NO: 20406 - DNA, 3000 bp, Unknown; identical to SEQ ID NO: 4813
  misc_feature (1)..( 3000): 2750-1469P.txt file - cDNA_ID_1825766; gDNA_ID_1620734; Annot_ID_49443

SEQ ID NO: 20407 - skipped

SEQ ID NO: 20408 - DNA, 3000 bp, Unknown; identical to SEQ ID NO: 4835
  misc_feature (1)..( 3000): 2750-1469P.txt file - cDNA_ID_1825774; gDNA_ID_1620735; Annot_ID_49476

SEQ ID NO: 20409 - DNA, 3000 bp, Unknown; identical to SEQ ID NO: 4835
  misc_feature (1)..( 3000): 2750-1469P.txt file - cDNA_ID_1825774; gDNA_ID_1620735; Annot_ID_166244

SEQ ID NO: 20410 - DNA, 3000 bp, Unknown; identical to SEQ ID NO: 4835
  misc_feature (1)..( 3000): 2750-1469P.txt file - cDNA_ID_1825774; gDNA_ID_2926170; Annot_ID_140081

SEQ ID NO: 20411 - DNA, 3000 bp, Unknown; identical to SEQ ID NO: 4835
  misc_feature (1)..( 3000): 2750-1469P.txt file - cDNA_ID_1825774; gDNA_ID_2926170; Annot_ID_199435

SEQ ID NO: 20412 - DNA, 3003 bp, Unknown
  misc_feature (1)..( 3003): 2750-1469P.txt file - cDNA_ID_1825808; gDNA_ID_1620735; Annot_ID_49466
cttgtcagtcaaaacacatacaacaactcagagagatggcaaattaacctcacttaggaaccgtgcattagtttacatagtgcttggacttcttgtaggagcagcttgctacctatattccattggactgctttacctacctgtttctaccctttccctgatctgtgcatcacagttagccttcaccgctttcttctcttatttactcaactcacaaaaacttactcctatcattttgaattctcttttcctcctcactatatcttccaccctccttgcatttaataacgaggaatcagattccaaaaaagttacaaaaggagagtatgtcaaaggtttcgtatgcaccgttggtgcatctgctgggtttggtctactcttatccctacaacagctagcctttcgtaaagttttaaagaagcaaactttctcagaagttataaatatgataatctacatgagtctagtggccagttgtgttagcgtggtggggctttttgctagtagcgagtggaaaactttgagcagtgaaatggaaaactacaaacttgggaaggtatcctatgtcatgaacctagtgtggacagctgttacctggcaggtattctccatcggttgcacaggactgatcttcgagctttcctccctattctcaaatgcaataagcgctttgggactccccgtggttcctatcctggctgtcatcattttccatgacaaaatgaacggcttaaaggtgatttctatgattctagctatttggggtttcgtatcctatgtctaccaacaatatcttgatgaaacaaacttgaagaaaagtaatgaaataccaacaacagaatcccctgaccgaccagaagcagaagggtcaagtgagcaatcaaaataagctgttacttcaaagattgtggcacacacagtttacagactaaagcgagctgatcaagtaaacttacttttctttattggtatgaaggcagcctacaatgaaaaataaacataatagatttgtgatgcgactcaagtgaagtcacagcctgaaaatgtgtgcatcattgtaacatgaagtatattttatttaaatatatgttgtgcacgattctggtttagtttggaataagatgaccaaaatcacattataagctcactgaaatagcattaagtcattaacaaagtcaaaacagctgattacaaaaattcattgtttaaaactcaatcctgcatataaagagaaggtgtacactatgtagctttctaagtttttgtaatatatctaggtgtaagtagagttccaatcagcttacatcaggcacccaacatagtgagcccgaggatacttcttatgcagttgtggccattgaacaaagaattgatcagctattctcaacttgtaaagcaacaatccacttaatgagagctttttcactcttgctacactctcaacataaaagattgatgaccatctaattcccagcacctgtaacccaagatgaaacaagcacttatgggaattctagatgtaatggagaaaccatgactaagaataaacaaaacacatcctctgtttttggtcacaagtccattcaaggtcatccaaaatgtagaggaaagaactgcaaagaatcttgataaaatatttccgaagtgtgtataccttgaataaaaaggcgatcacacacagaggaatacaggtcccaggaccattgcaaagaatctgaaaaacttcaaccaaatctaatcaataacctgattcaaatggtttaataaagaacccttgaagaaagtctaaaaagcattcagataaaaatcataccacttgtggtctgatccggatcattagccacagagcgtgaagaatagcaacaatggtagtccaaacagaagtcacataagactgaccaacttcacgactccggtaaatttgcatgaactgtgatgatgcttccttaacagcaggctatgccacagtcataccaagcaaaaaacacacaagaaataagtaataagcaatagcaaaattcaaagaggagggacaaaactcaaacgaaattgaatttaaggatttttaactaaaccttctcagctagagaatcttcaaaactacgagctttctggagactcatgttatctgtagcagcagcaatgtaaaaccttggtgtaaatctatccttccgcaaaacagagaggagactcaacatctctgctgtgtgtccccctggtgattaacaaaaaccccacaataacatatcataatatgcagcacattacttagatccaattgaagaagacactgcattaactcttcttaccagaaccaagaacaataagagtagtaaaagactgtgaagctccttttggaagtggtttgccacatcggtatataacatacagtacacgaaccattagaagaacgatcgccaaaataatcaataaaccaatgctgaattttgaggccatccttgagtaaacacagttgcaaccttcctccatgatcgtacttccttttgagatctaaaacgtcaaaatccaagcgtaatggagaaacaactcaaaatcagatcacaaacaaaacgaatcgtcaaaatcgagctcgaaattagacaaaaaaacgaaattgaagattcaacacggcgattataaggtgggaagaaacaaaataaaaaactcaccggcgacggagaatcccggcggtgacgggaacgtaaaggattagagaattgaattttattggttacggtgtgtcttctttttaccaccgttcgatttggatattgcttagaatacacgtggcgtaaccacgtgacttttatctttgggtggacctgcaaacatgtaattccttcccaattttttattttaaaatcttaaaaagatactaagaactgatgaagaagatattgtacaccagtcggtacttagaaaaaaaaaaatgagattttttcacaaaacctccattgaagcaacttttgtagctttcttcgtttaggtatctaattaaacatg

SEQ ID NO: 20413 - DNA, 3003 bp, Unknown; identical to SEQ ID NO: 20412
  misc_feature (1)..( 3003): 2750-1469P.txt file - cDNA_ID_1825808; gDNA_ID_1620735; Annot_ID_166232

SEQ ID NO: 20414 - DNA, 3003 bp, Unknown; identical to SEQ ID NO: 20412
  misc_feature (1)..( 3003): 2750-1469P.txt file - cDNA_ID_1825808; gDNA_ID_2926170; Annot_ID_140071

SEQ ID NO: 20415 - DNA, 3003 bp, Unknown; identical to SEQ ID NO: 20412
  misc_feature (1)..( 3003): 2750-1469P.txt file - cDNA_ID_1825808; gDNA_ID_2926170; Annot_ID_199422

SEQ ID NO: 20416 - DNA, 3003 bp, Unknown
  misc_feature (1)..( 3003): 2750-1469P.txt file - cDNA_ID_1825816; gDNA_ID_1620735; Annot_ID_49464
tcatacatatgcgtatgcgtgttaagtttctatttgtctatgcgtatggggttcatgtcctccacatagttgcagaagaaagtctgaatgaatattgcctacacataatttcctcctagacttaactcatctcttggtcaacaatagaggcatctttgcatgtagaaagactacagatactaaattcatggaaagagaagagatatggttggcatttactgaatgtggggccaagaacaaagaaaacttagacggtgaccgattcctaatcccagaatatataacttagcatatctcacccatatcaaaggagcaatcacttggtagcattatcaaccaagagaattgataataagatacgttagttcctccttgtccatctccaaggtggtgattccacatccaccatgacggcggatcaagaactacaaatcattggtgagtaagcataaaccagtttgtggtgaacgtcctattctttcatcttcaaaaaaaaaaaagatggttatgatattttataattcaatatatgaaacgatcgacaacaaataaactaatttttgcgttattttcactcacttaccagttcggcagggaaaagaaccaaatccaacagttcaagatgaaagaaattcagtcagtagcagccaagcagaagtatctcactctaacacatacaaacggtggctcagggtgactttatatacattctttgtcatttcaggccaaacagttgctacaattttgggcagagtatactatgacaacggaggaaacagtaaatggctagcaacggtagttcaacttgttggctttcctgtgctacttccatattatatcttgtcatttaaaacacatgcaacaactgatagagatggaaaaagaacctcacctaggaaccgtgtattggtttacgtagtgcttggacttcttgtaggagcagattgctatctgtactccattggacttctttacttacccgtttctacctattccctgatctgtgcatctcagttagccttcaatgctttcttctcttattttcttaactcacaaaaacttacccctatcattttaaattctcttttcctcctaactatatcttccaccctacttgcattcaataatgaggagacagactccacaaaagttacaaaaggagagtatgtcaaaggtttcatatgcaccgttgctgcgtctgctggttatggtctagtcttatccctacaacagctagcctttctaaaagtcctaaagaagcaaaatttctcagaagttatggatatgataatctacgtgagtctagtggccagttgtgttagcgtggtggggctttttgctagcagtgagtggaaaactttgagcagtgaaatggataactacaaacatgggaaggtatcctacattatgaacctagtgtggacagctgttacctggcaggtattctccatcggtggcacaggactgatcttcgagctctcctctctattctcaaatgcaataagcgttttgggactcccagtggttcctatcttggctgtaatcattttccatgacaaaatgaatgggttaaaggtgatttctatgatcctagctatttggggtttcacttcctatgtctaccaacaatatcttgatgacaaaaacttgaagaaaaatcatgaaatcacaacaacagaatcccctgacccaccagaagcagaagagtcaacttggcaatcaaaataagctgatattttgaaagatgctgtcccgcagtttacagactcaatcaatctagttaagtaaacttactttacttatcggcctggaggcatcctacattgaagaatacacaatacatttttgatgcaactaatgtaaagtctcagcttgaaattttttgcatcattgtaacaggaagtagatttcatttaaataagtagtgaatgactttggtttagtttcaattacgattacccaaattacattgtaatctcagtgaaccaacaatcttaagtttagaacagctgattacaaaagttcatcgtttaaacttgggttcatagcagctaaagattaaatgtaactcaaccctgtatgtaacaagaacctgtaggcagattgataaaagtagatatttatttaataaaaaaccatgtcaattttgtgagtgtgacacctgataaaaattaacccttagccataacttaaaaagatttcaatgcactattccactttctagttttacctgaaacattgtgaaacaaggacacacagaaaatcatttctaatgaagaaagaagaaatattaatcagacaggtccaaacatccttggtgaaacagagctttgtacaaaaagtaaatgaccagaaataataccatttggcagtctccatcttagcagttaataaagtgacttcctctgccatccaatattgtggtgcaaatgtcttcttttgaaaagagaagcgagacatcatctccataaatgtgtttctaatccacatgcctgatctcataagagaaagatagtcagacggaacaagccaaagaaattaaagaagacgaataactttcaaaatagacatcctgacggtcatacaatcttacaacttgtgtgcatgcgtgttaagtttgtgtctatgcatatggctgatgtgtcacacaggtataaaatactgagtgactaatggctacacatcatttccttcttgatttgactcgactcatctctagatcaacaatagtgacaaaagaaattaaattcacagcaagagaagatatacagttggcatttactgaatgtggggacaagtacaatcaaaacatagacgatgaccgattcctaatctctaaatatatagctacagcgtgtctcacccatatcacagaagcaatcacttggtagcactagtaaccaagcaatttgataataagatacctaatacttagaatctattcagaacattgttagtacctccttgtccatctcgaaggagggggattccacatctactatg

SEQ ID NO: 20417 - DNA, 3003 bp, Unknown; identical to SEQ ID NO: 20416
  misc_feature (1)..( 3003): 2750-1469P.txt file - cDNA_ID_1825816; gDNA_ID_2926170; Annot_ID_140069

SEQ ID NO: 20418 - DNA, 3003 bp, Unknown
  misc_feature (1)..( 3003): 2750-1469P.txt file - cDNA_ID_1825818; gDNA_ID_1620735; Annot_ID_49463
tggaagccactgacataacagataaacaatgtagtgacttgcaacaaaactccttaaaataccaaaaacgtatactctaggagcttggcttcttgtatctttgttgacttctgatttaacgtcaatagacactgaggaaaaagagttctcttagagccgccattcaaaagttttaagaattttaagtcaagtgtaagcaaataagaaaggtcaatggtcagcatgagactactaaattatgatactgctgtcatctatcacctgacccatctttattattatacacaaattagtaaaagtctgccaagtttgattagtgcaacttgtatctggggtatttagttactataataaatatcattttgtgtataaagaaaggtctcttctgtatctaaaagacatatcaaacgaaagaaatcaataaacacaatattctttcttccaaattttctcatttctcatgggcatatctcaagtacactattgcaatggtaagcaaaaggtacctgatgacgttagatcatttgatcctctttcgatgaaatataataaccacgagtgttaatttttcaggtgaccagaacttagaagcaaaccttctagatcatgaggaaactgaatcattttcagtacctcaaacgaagaactgtaagaggtggctccgtgtctccatatacgcaatctttgtcatcttctgccaaccacttgctacagttctgggtagactgtactatgaaaatggagggaaaagcacatatgtggtaacacttcttcaactcattggcttccctgtactgattctcttccgcttcttttctcgaatcaggcaacccaaatcaacagatacaaatttcagtcagtccccttccttcaccacccttgcatcggtttacttgtgcactggactgctagtgtctgcttatgcttatttgtctgcagttgggttgctttacttaccagtctctactttctccctcatcttggcctcacagttggccttcactgcctttttctcatatttccttaactcgcaaaagttcactcctttgatagtcaattctttgtttctccttacggtttcctctgccctcctcgtggtcaacactgattcagaaaacacaacaaatgtatctagagtacaatatgtgattgggttcatctgtaccattggtgcttccgctgggattggattggtactatctctgatacaactgctcttcaggaaagttttcacgaagcatacatcctcagcagtcctggacttggccaattaccagtctctagttgcaacttgtgtggtactcataggactgtttgcaagtggagagtggagaactctgccaagtgagatgagaaactacaaactggggaaagtgtcatatatcttgactttggcctcagcagctattttctggcaagtatacactgttggttgtgtgggattaatcttcgagtcttcttctgtgttctccaattccataactgctgtgggactgcctatagttccagttgtagcagtgatagttttccatgataagatggatgcatcaaagattttctccatcattttagctatctggggcttcctttcatttgtctatcagcactacctcgacgaaaagaagttgaagacttgccagacaaaacctgttgaggaagaaacacaaactttatgaaacaagttgtatcgaaggtctcagaaacaaacatacatagttgtacacagtcatgtaaataacctatataaagcttgtatgtgtaatatccgtaatggtccatgcaaatgggatatgtatgtcgctcatatttcaggtatttagaacttttattcaaaagagtattgtgtaatacgagcagagtgataaaagcagtcatttatttaacagaaaaaccatgtcaattttgtgatactttcattgtgtgagtgtgaaacccgataaaaattgaccagttagcataacttacagatatgtcaatgcaatattctcctttctagttttgaaatgcacctaaatcttgggaaacaagaacaaacagcaaatcatgtataatgagagatagaagataatttgtcagattggtccaacatccttggggaaacagagctttgaacaaaaagtaaatgaccagaaataataccattttatatagcgacttcctctgccgtccagtattaagttgttgcgaatgtcttctcttgaaaagataggcgagacataatctttagctaacgtcagcatcatcttgatggcaaaaacttcatgactagccatggaaaccgaagtgtgtacccaatccaaataaatttaaaaagacaaataacttttagaaatgtcgtcctcatcaagatcacagaatactacaacttgtgtacacgttcatacatatgcgtatgcgtgttaagtttctatttgtctatgcgtatggggttcatgtcctccacatagttgcagaagaaagtctgaatgaatattgcctacacataatttcctcctagacttaactcatctcttggtcaacaatagaggcatctttgcatgtagaaagactacagatactaaattcatggaaagagaagagatatggttggcatttactgaatgtggggccaagaacaaagaaaacttagacggtgaccgattcctaatcccagaatatataacttagcatatctcacccatatcaaaggagcaatcacttggtagcattatcaaccaagagaattgataataagatacgttagttcctccttgtccatctccaaggtggtgattccacatccaccatgacggcggatcaagaactacaaatcattggtgagtaagcataaaccagtttgtggtgaacgtcctattctttcatcttcaaaaaaaaaaaagatggttatgatattttataattcaatatatgaaacgatcgacaacaaataaactaatttttgcgttattttcactcacttaccagttcggcagggaaaagaaccaaatccaacagttcaagatg

SEQ ID NO: 20419 - DNA, 3003 bp, Unknown; identical to SEQ ID NO: 20418
  misc_feature (1)..( 3003): 2750-1469P.txt file - cDNA_ID_1825818; gDNA_ID_2926170; Annot_ID_140068

SEQ ID NO: 20420 - DNA, 3003 bp, Unknown
  misc_feature (1)..( 3003): 2750-1469P.txt file - cDNA_ID_1825824; gDNA_ID_1620735; Annot_ID_49461
aagtttcgaatgaccaatcttctcttctcgatcaataattggattttgctggtaaatgaattatttactatatatcttctttgatacgtctcttcttatttaaatgacataaaacaaatacaataatccaaattttaggcacgtcaacattattaactcttaagtggacataaataatctcactcttgacggtctttcaaaggtattgtattagcatgaaattctatattaattcttaacatttacctttatcttgtttttgttcctaagaacgttttctaaaattctccaaaatgggcccaaaagtatgaaatccaaattgagcccaaagttgtgatccagtgaaacgataaagctctcacgaggttcaagctcccacaagctcagatcgtgggcggtaaaagaaacggttaactaattgtaaaaaatgatttttttttttctacttcactaaaatattacagttttttttagcaaaagtaaaagtttcgagaaactctgaaaaagcagttttcaatcttaggagcagtgtatgtgtcatgtacatcgagatggagaattttcgttacctgaaatttttcttcttcttcatctttgtaatattatctccttctgaagcaggaaatatagtagacaaaagctctgttttccttgttgatgtccgtagctttggtgctcgagctaatgaccacagagaccacaccaaggtttttttcaaacaacattagatctgtgttttttgtttttgtttttggtagattcatctgtttagttacaataaatcagctaataacttgatgttttaaaaggcctttgtagcagcatgggacaaagcatgcaaatcatcttcaagctctgtgaatcttataatcccaagaggtgaattctctgttggttctctcagattctctggtccttgcactaatgtatccaatctcactgtccgagttaaggtagttttatcaacactctccaaaatctgtctttgttgcgttgtgtgcttgatttaatgctttctttctgtccacgtaactgaaattagggtcatctcaaggcatcaactgatctgtcaaagtatagatcaggcggtggttggattcagtttggatggatcaatggcttaactcttaccggaggtggaacatttgacggtcaaggcgctttagcttggccgtttaataactgtacttctgattctaactgcaaactccttccaactgtgagattaactctacaaacattgaatttgatcttaaggttttctccttttttaaagtatattaattgatttcagagcttgaagtttgtggggatgaacagaacagttgtgagaaggataagctcagtgaatagcaagttctttcatatagcattagtagaatgcagagacttcaaagggacaagactcaacatcactgctccttctgatagtccaaatacagatggtatacatatcgaacgcagttcgaatgtgtatttctcgcgttcacatatcgcaactggagatgattgtgtctcgataggacaaggaaattctcagattacaatcacaagtatcaaatgtggaccaggacatggtatcaggtaaaaatataacagaaccgcttcttttttttggtctgtttctgctgttgagtttattaaacggtttgatttcttgcgtttcaagcgttgggagtttagggagatatccaaatgagaaagatgttaatggactggtggtgaaggattgcaagataagcggtacgacgaatgggataaggatcaaaacttgggctaattctcctggtctaagtgctgctaccaacatgacttttgagaatattattatgaacaatgtgactaatccaatcatcattgatcagtcttattgtcctttctcttcttgcatttcaaatgtgagtcttctttaacactcaaataagatttttttactgaaatgggtatgagagatttgtttttgatatattttgttgttgtaggtaccttcaaaggttgagctgagtgagatatacttcaagaatataagagggacatcatcttcactggtcgcggtgcagctgcattgtagcagaggaatgccatgtaaaaaagtgtacttagagaatgttcatcttgatctttcttcgtctgatggaggaagaaaacagagtagtaacagaggaaatgaagctgtctcttcttcttgtagaaacgttagagctaattacattgggactcaaatcccacctccatgtcactaatcatcatcatcatcattactatcgtcaattcatcattttgaagtttatctagtacttaaacttttgtgctttctttttggacacgttatcttcatatggtcatattaagtttgctacttttgttgtctatagataaagtgctactacgctaaggaatatttttggctaaataataaaagaaatatgacaagaaaaaactggttggtaataaaaatttaaatttggttcgtgtttaacggttgataatactggttggtaagtttgatacttttgtctatagataacttgctagtaccctaaggatttgttttggctaaatataaaatatggcaagaaaattctggttggtaataaaatttggttcgtttaaagataggatcctacaaaaatggaggagatgattcattccaagagtgccatttaacaattcacgggaaatggttagtaggacaaattataacgatatatgtagtacttataattttaaaaactgaaatcttaatgtaaactaatactaactttatttattaaagaataatatatgcatacgcatttgcctgttatataagtaagcaacaccatctttatttgttccctgacatatttctccttcaggtttctatgatggaactagaatcagaaactcaagaactccatcttcacgtaaatggcggtaagtattgtaacagaaattccggcgtagagattcttgtgttcttcttcttttacttatgttcttgttctgtttcatgtgttgatg

SEQ ID NO: 20421 - DNA, 3003 bp, Unknown; identical to SEQ ID NO: 20420
  misc_feature (1)..( 3003): 2750-1469P.txt file - cDNA_ID_1825824; gDNA_ID_2926170; Annot_ID_140066

SEQ ID NO: 20422 - DNA, 404 bp, Unknown; identical to SEQ ID NO: 4843
  misc_feature (1)..( 404): 2750-1469P.txt file - cDNA_ID_1825829; gDNA_ID_1620735; Annot_ID_49459

SEQ ID NO: 20423 - DNA, 3003 bp, Unknown
  misc_feature (1)..( 3003): 2750-1469P.txt file - cDNA_ID_1825829; gDNA_ID_2926170; Annot_ID_140064
atgtgtttactagaaagtagaaataaatttcataataatatctttatatgttaggcacaaatccccaaaaataggtcagacatttcaactgcagacagatacagttatgtatacgtgtaattgtaagctaatgtttttttttcacttacaggttacaaattacatagaggtccacggtctaactttgggtaatttaaatgtggggcttatggataagacaacgcaaacgattaggcaccaattacggcgtttagtttctgcctaaattaaaactataaatgtgtattaatatatatcttagtatgcattaatgtggttaggtacgagaaacagattcatataccaccattatggcattattatagtatgcaatagaagattgaatatatatttgacttcgaagattgaattttttttggtttagagattattctattactcatatggaatctgataagagttgctgtttctctttcccaaattaaagtatgtatacgccttgatgttcttggtcaaatgtgaatggttaatgtctcttttggttcaaagagaattattcggtcttcttaattatttcgaccaaagattactagattggtattgattttctcgaaaacgtttttcatcgtagtttgttttgaccaaaaagcgttaaaaacatggaaattattatgcccttctttcattgatcaaatttttatataccaaagccatagtattttgattcattccaatattttatactgagtatcactgagacactgactatatatatgtatgtattctcgcgctatccgtaatatgctaggtaatatagcagtgattattaaacgcattaagatcatcatacgtaattcacgataatttgtaatccaaaaacttaggtgtgaccaaaaaaaaaaaaagagttgaatccttcacctaccaaaaaaatggattgtgaccaaaagaccatgacatatcaaatttttagtgattaaaccgatttcttccaagatgctagtatttgtttttatcttgccatattttagtgatttttcatagtagtaaatatatcactttgaccacatttaaagttgatgtatgtccccttcgcatttgtcatgtcggttaggcattatatgtctccttttttcctgatcatatgctcctatcaatttctacaaactcatgaaaacgattactagctatataaatcaagcatagggttcataacatgcaactttaattccccacaattatcgcaaataaaattgtatataaagggtttatcgtaattatcataatgttaacattttcataatatagatacttttggtttgaccatcttttccttaatataagttaataaattaagatgctcttttacttgcaaacagaaagttctaatgtgaaaaagaaattgttattgcgtaatcatgatctcacttatccgtcagcataagtaacgatccactccacatagctacgtcacttaaagtcccatagtaactaattttctttgaatgttatagcaaattattagcaatgtatgattctttgggtcaaatcttacactaaaaacatgaaaataatttgaatatcaagagattcatatattcatattttataaccaaaatatgtagggtctaaattattgcttcttgactaggaattacctatgaataattattaaggttcgtgaaacagtgagggaaaaagaagaagaagaagagaagacagtctctagcacgtgccaggtcatgtgtcggcgacggtcaaatgccggtgcaagtgtttccacgtggcagcctaatactcccaaaatataatcttttgttttcgtaaacttttttccctttgaatctttgactgcctcttactgcattcttcacaccaaacgaccggccggtgactgagtgtttccggtttccggtaacacatagttttcgctgactaagactccttcaataacgtcgtcttcttccacgcgccgtttagtcgtagcgcgtgttatcaagcccgtccactatatatgccacgtatagagtggggaagaaaatgaaggtgagaacttttcatgtcctactttttggccccataaaaaaggcagcacacaaaaataacccaaaatttatgcatgtttatcaaatgtggaaaaataaaagtagaattttaggaaatttatacgaagatacaatgcaaagactcgaagaaatgtatttagtggtatagaaatacttgcaagtaagcatattctgaattaaaaatatagaagcttaagtatgtttcctcactagaagccagttttgcagctctatttttgtcaacttagctttacgtaaagttcttattgcccgaaaccaaaaagtcattcaaaaggcataacatgatatcacaaataaaattatcatctacttctatatcttatttcttgaatatatatatatatatatatacctatctattaagttgcttatcgttcacattattaatttataattaactttatgtacatttgactgataaacattaaaaagacttatttgaacctttttgtatatgaattcaaaattatactgataaaataacgtgaggaagaaatattatgaaagcttttaacatataaattaatttgcataggaaaaaattacacaacttaaattgagattagttaagaaacaagaaaaaacaaagttgatagaaaaataaaagtattaacacgactttggattcacacacgtaccattgaattatatctcaatacacttttacttaattaacttatttccaaaccaagtagccaaaatcatattattcttctctctcttccttttttgagtttcaaaatgcataaatacgagaacgagagacgaagaccaaattaaagtccaagcaccaatctagacctcttaggaaaaaaacctaaaaacctaatccccaaacctaaaaggcttatctcatctcttcttctttgtcttctttactctttttttacctctctcttcattgttcttcaccatg

SEQ ID NO: 20424 - DNA, 3000 bp, Unknown; identical to SEQ ID NO: 4852
  misc_feature (1)..( 3000): 2750-1469P.txt file - cDNA_ID_1825841; gDNA_ID_1620736; Annot_ID_49493

SEQ ID NO: 20425 - DNA, 3000 bp, Unknown; identical to SEQ ID NO: 4852
  misc_feature (1)..( 3000): 2750-1469P.txt file - cDNA_ID_1825841; gDNA_ID_2926157; Annot_ID_139567

SEQ ID NO: 20426 - DNA, 3000 bp, Unknown; identical to SEQ ID NO: 4850
  misc_feature (1)..( 3000): 2750-1469P.txt file - cDNA_ID_1825845; gDNA_ID_1620736; Annot_ID_49492

SEQ ID NO: 20427 - DNA, 3000 bp, Unknown; identical to SEQ ID NO: 4850
  misc_feature (1)..( 3000): 2750-1469P.txt file - cDNA_ID_1825845; gDNA_ID_2926157; Annot_ID_139566

SEQ ID NO: 20428 - DNA, 3000 bp, Unknown; identical to SEQ ID NO: 4849
  misc_feature (1)..( 3000): 2750-1469P.txt file - cDNA_ID_1825858; gDNA_ID_1620736; Annot_ID_49488

SEQ ID NO: 20429 - DNA, 3000 bp, Unknown; identical to SEQ ID NO: 4849
  misc_feature (1)..( 3000): 2750-1469P.txt file - cDNA_ID_1825858; gDNA_ID_1620736; Annot_ID_166266

SEQ ID NO: 20430 - DNA, 3000 bp, Unknown; identical to SEQ ID NO: 4849
  misc_feature (1)..( 3000): 2750-1469P.txt file - cDNA_ID_1825858; gDNA_ID_2926157; Annot_ID_139562

SEQ ID NO: 20431 - DNA, 3000 bp, Unknown; identical to SEQ ID NO: 4849
  misc_feature (1)..( 3000): 2750-1469P.txt file - cDNA_ID_1825858; gDNA_ID_2926157; Annot_ID_198498

SEQ ID NO: 20432 - DNA, 3003 bp, Unknown
  misc_feature (1)..( 3003): 2750-1469P.txt file - cDNA_ID_1825882; gDNA_ID_1620736; Annot_ID_49480
gctcaaggttgattagtcagatcactttttattttagtaatgactaatatatatcgttggcatgcaataagtctctccttacaaaatttcactaccttgataactcttttcttttggcctttttttttttgtgaatgactaataggttgtagatctatgcccacattaggtcaggactataacattttatatcgaccttctcaagtatcactcgaactggtgagagtcttaccaattgagttatcgatatttgtgtattatagtacactttaaaatgattccctacaatagctctgcttgatctttcttccgttttcttttagttctcgtaccaacggttcggtcattcattagttgttcttcacaaagtttctgatttttgatagatgatcctcactaatctaaatctttatctttagtacctactctaactaacggtatgctgtattgacatccttcgctttgatatttagatcagagtcaggattattacaagattagtgaaaacgatattattaatgatccaatccataaagcgaaaatttgtatgttcgaccacaattaaataaatgaaatgtatgtatatgtgaacaaaataaagatgaaagataataataaataaattaaaaagtaaaaataataaaaaaaaatataaaagtaagaataagaaagaagaacaaggaacataatatatatctcgataaaccaatacgttaccaaatggcgttaactaagaaaaaaaaaaagacaaaggttcactgaccgactcacgatatgaagacatcaaagagaatagatgtcacaaaacagaagattattaaacaaaaaaagacagattctaccacttcaaaatgatgaaaataataaagagatcactcaacatgtcctgtttgatatgatcaacactgaagagataaaatctgcgcaaaaagacaagaccttcattacaatctcaagaaaaatatatcatcatggattaagcacgagtacatgttcttaataactttgtttatacgcccgaaaattagcattctattgctgtaattttatatgtatatgattataaatatttacgttcgcaatgtgtctatgatgtggcacatggttggtctcttagccaaaacgtgtatcatcttacgagaatagtatgtagtgttaatcaagtgaaagaagtttccataaaaatgccatctttttttttttgtaggagttaaaaatataaaataaaaaacttttgcagttttgtgagaaaactttccatgctacaaatcttgtatactctctttgatatttttgattaatgcaaagaagcaaaaggagtaaagcaaattttgatcatatcaactttctttatacgtttaatacatttgtgattttgaaaattttaattgttttatttataacctagttttataacctaggatttgtttaaaccatagatattatttctgtgataaaaaaaaaggcatattttgtcacttcgaatttcctcaaaatacatttaagatgataacgtacaaaactatcatattcttgtaaacttatcacttctttttcatgaatcatacacgaaatatcgatatcccgaataaattgagtcatgtgtaatatctcaaactctaattcgagtttctaaatctaaaaatcatatgatttctaatataaaattcgacttagctaactgctacatttgtgcgttatttgccgctaagcacagtacttctagtgggtctatatccacgttttcgtagatcctgttatttcttgctttgcaaatcactttaaaatgaaaatagtttttccacatacaaatctctttgacagatagttaactataccaaatggtgtcgaatcatacactttaatacttccaccaaaaacttattattaccctttttgtcataaaatattaatactatataattcaatcattgaatttcaatctaataatacaaacctgcaacatctcagctaaattatagcatggtttacgtggtaaaggtcacaatacatcaagcacatagtggttttctatctctttaacaaacacgtgcattacgattaatggatatatatctgagttattggttgattgtacctgcctccacttccatttctacctgataattgaatattagtggattcttttgaaaattcagtgatacgcatagggtagaaaccaatcaaagtcatcttttgctagagtgttccgtgttagctagagacttaacacgagatatacttatcatcaactatttttaagaatcaaataaacatgttatttcatagttgaatattgtgaagatatccaacccggattttggttgggtttggattcacattttcgagttttaggacttgtcggtttatgtataaaagtatccaatacaaaacgtacttaaatatgcatgttttggtataatgtcggttttatttcatagttgagagttcttcgtcaaatttatcgttagttcatatttggcatgtatctttagattgttattctcctcacacttggaacaaataaataattaccgttgcaagacttttaacacattttgaatcatgtttatcaaaatcttaattcaaaacatatgacactgtgaaaactggatcaaaaagacttctcatcagggaggttattggcgacggcgacgtcaacaatcgacctaatggcttgctcgccgactttggataatatgtaatcatcagtgaacgattcttgatctagtaatagtaaacccttttggtgatttatttatctatgctatcaatttttatgcaagtctttctatagaatatttctctctcgtcatgattaatgctaattttcagtttttcacctccacaaacaaaagacggttctactcgcacgtgttaaaagacggttctgctcataagcatacaaaaatagaaggctaggatcataaatcttataagttacaaatcaaaataacatatatattcactaaatactttacatgagagattgaattagaaatg

SEQ ID NO: 20433 - DNA, 3003 bp, Unknown; identical to SEQ ID NO: 20432
  misc_feature (1)..( 3003): 2750-1469P.txt file - cDNA_ID_1825882; gDNA_ID_2926157; Annot_ID_139554

SEQ ID NO: 20434 - DNA, 3000 bp, Unknown; identical to SEQ ID NO: 4844
  misc_feature (1)..( 3000): 2750-1469P.txt file - cDNA_ID_1825886; gDNA_ID_1620736; Annot_ID_49479

SEQ ID NO: 20435 - DNA, 3000 bp, Unknown; identical to SEQ ID NO: 4844
  misc_feature (1)..( 3000): 2750-1469P.txt file - cDNA_ID_1825886; gDNA_ID_2926157; Annot_ID_139553

SEQ ID NO: 20436 - DNA, 3003 bp, Unknown
  misc_feature (1)..( 3003): 2750-1469P.txt file - cDNA_ID_1825890; gDNA_ID_1620737; Annot_ID_49502
attttaaaaagtcaacatcagtgctaatttcaaattgaccatacattagcacacaagaagactaacaaaaaaaatgagtgaataaagaagagagtgagtggggttgatacatgtcaccgtccaaaatgtgtctgacccttctcattggagctacaagagccgaccctttgcctcatcatttgttgacttcactctccttttacatatttaaattataacttgctcatatttccattcattgtgttcggttctagattgttccatccactttcttttttctcttactttgaaatttagaaatatatgaatacttgacaaatatttgaatattgtaactgatttgtttgttcgtaatacttgacaaacttttttgaatatacacctttacatatattttgagttgagataaaaagggaattatgttagtttatggattatattatgtaaataccacatctaactatgatcggatgaaaactaaaccagcatatctctaatcagtaatatttactaaatttatatatcattaaagattttttgaatttagcaaaaaaagaagaagatatcattaaagatttttaaatttaaagtataacataatgaataaatcaagtgttgagcttagtttcgcgttgcaaagatgttcatttgatttttttttttttttttccatttgatttttcttatactaaattgattgatgtcacggtccttctgtgaaaaaagtatattgtactgtataaatttataatagtcatacttgaagataactaatatcattttctaaaggttttgttgacatgaaatgggtgaatgatgaacatctcgtttgctaaaccacaaaagaaataattcgttggactataacttaaacttataatatatcaactgaaatgcctacaatttgagaatacgccttttcaaaaagttttagaattttataaaaatttctccaccataatattactttaataaaagcttgttattaaaatgatatattaacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggtaatggcgcataaaggtggtggcaaaggcaaggaaatatcgatgacacgtaagcagacgggaaatcttaaaccgagtggagaagcctccaaatctcttttttctctctctctctcctaaggccaccacaatctcttcttctgtgtatgtattctttttttctccgatattcgtcgatctctcaaaaatatcctcaaagccaaaaaaaagcaagagtagagataaccaaccaacaaactcataggaagacatatttactttcaggtctttcttctactacctttttcgtggtttttggttgattgattctcagatgagattttttcccgaatcatttgatgtcttttttttttaaataagttcttggtaaatcactgtttctactagcattttttgttttctcagcttagatttgttgtttgatttgacatcttatctgattgagattttgttcttctgaattgttgttacagggtttagctgtttgattcagcttcgatttagtgtacagtgtgttgattagtataaaaaggatttaaaagaatctgggagatgtgtatagtgattgttcttgctggcgaatgttaacactacgtcgtattgattctcgattgatagtagaagaaaggtgttagttagattgttcgttcatctagttggggtttagtttcggttcctggatg

SEQ ID NO: 20437 - DNA, 3003 bp, Unknown
  misc_feature (1)..( 3003): 2750-1469P.txt file - cDNA_ID_1825894; gDNA_ID_1620737; Annot_ID_49501
gttggaggaagcaaagttaaaagtaaaggctaagttagtgaactctctcatgggtcaatggcagggctggagatatgtacgagcgcactcattctgcggctttgcgcataatgtgaagctttgtcatttcatttttaacattttaccacaaaagttcaaaacatatttttatctacattttaagtttgtatgtttcatagttttcttctgtatatactttctcttatgtgacgacaattacttatgtacttaacttttttgggtcacgacttgaaaaaccacatatggattgagactttttgggctattggatgacatatctaagtttgatcaaatactagaattgatctacctacattggatgcatgttaagttgttgctactcttagctcagattcacacagaaaagtataaacccaaagaattacgttcgaaagaaagatttaaattgattatcaaagcaataactaaatcaaatccgaatatcagagatcgctcgctaaatgtttgctcacgatctacaagtaatcaacattgactactcacttgaacatcttcaggattattggctctctctcaacaactcagataaaaagcctgaatgaaagagaaggcaacaacggctatatatgtttcctcagtcgtaacagcaaagcctccctctggaacaaagtctttctcttccttctcttcttcagcaaagactctaattccttcagtgtctttcgcttccgttgactgaagctgatgtggcattgaccgcttcctataataagcttgatgaaccgtatcaatgccacaattataatcttcataaataaacggatgtgttttacacactactgtaatattttgttactccatcattcaacataccaatcatcatcatttttatattttaattaaaaagattacatttcacaacttatatacaattgaaaatagagaacatcttaacaatatccctatagtaaattttcttttagtcaactatttaaagatttcaaaatggtttattgtaatccatgtgatccggtcaaagaatccaaaatagtttaatatctctatttatagtagaagaaaaataactagctacacaaaatatcggagaatgcatgatcacacatgtcaagcatattagtgtatccctagctatacgaagtagatgtattgtatgaccacatatctgaactatacgacgtcatgtagttaacaccacagacatgcaattccggtacactaataaatttactccgttgaagaccagtgttgaccggcatagttgaggatactatagtataattggcatgggtaaattaactaaaaatcatcaatccatttatcataatccaaattctggtcaaaagaatctaaaaatagtttcataaaaatagtttcatgtttctgtttacagtaataaaattgatatcttagtcatgaccaaatcaatagccgcaagttatgctcccaaaaattagctgttcatcttttactccaatcaaaaacataaaaaaaaaaaaacaattacaatttctattctaagtaaatgttaaataaatttattaaattttacctcctaagacttcagtggttacactattagaaaataattagatttgtgtgcctaaaagccttagaagcatgcattttttatgaataaataaatttagtattgatttcggtatagaaaatgaaattagcaaattcttgatatgtgtaactaaaataaaatcttatgtaaaaaacagaagcgataaaggcaaacataattcaaaactgcgaccaattcttattatcaaagatttatgaaacaccaattagctattaatagtaaaaatcaagtgacactttccctatactaaattgttaattgttcggatttataggcttagctagttaagtataaatattaatccacactcttcacactaattcaattttatccctaataaaaaacttgaatctatatatgtgtatcaatatatgtgtatgatatttaaaggggtttgtagtctattgaaataaataaaagattccattatccatgatttttaataagttacttcgtagcattactaaacctatttacatcatcaacaatacaactgatttaatttcaactaactaaaaaattaccaatttatttatcataaattcataatctaatatctggtcaaaagaatctaaaaatagtttcatgtgtctatttatagtaataagattgatatcttagtaatgaccaaatcaatagccgcaaattttgctctgaaaaattagttgttcgtctttactctaatcaaaaacataaataaaaaatcacaatttttatccaaagtaaatgttaaatcaatttattaaattttagctcttaagacctcattagttatattattagaaattaattagatttgtgtgcttataagccttagaagcatgcatttttttatgaataaataaatttaatgttgctttcgatatagaaaacaaaattagcacatgctcgataagtgtaactaaaataaaacctcatgtaataaaaaaagaaataaaggcaaacataatttaaaactgcgaccaattcttattatcaaagattcatgaaatattcaattagctattaatagtaaaatcaagtgacattttatttatactaaattgttaattgctcggttttataggcttagctagttatgtataaatatgcatccacactcatcacactaattcaattttatccctctttactcttcttgataatcggaggaaactaaaaaaggaaaaaaaaaaatctaaataagaataaaattcctaaaaaataaataaatcaaaaattgtgaagaaacaaatcctcgagtcatgttgtttacagaaaatctctttctcacttaaaacccttacagaaacaaatcatcgaatctttgtttttttagaatcagtgattttgtttcctttcacgagacgaaaataacaaatcgtcttgtaaaaagtaaactcataatcatg

SEQ ID NO: 20438 - DNA, 3000 bp, Unknown; identical to SEQ ID NO: 7937
  misc_feature (1)..( 3000): 2750-1469P.txt file - cDNA_ID_1825894; gDNA_ID_1621175; Annot_ID_174123

SEQ ID NO: 20439 - DNA, 3003 bp, Unknown; identical to SEQ ID NO: 20437
  misc_feature (1)..( 3003): 2750-1469P.txt file - cDNA_ID_1825894; gDNA_ID_1620737; Annot_ID_166291

SEQ ID NO: 20440 - DNA, 3003 bp, Unknown
  misc_feature (1)..( 3003): 2750-1469P.txt file - cDNA_ID_1825898; gDNA_ID_1620737; Annot_ID_49500
cagaggtcgtacattgtctagacaccgaattgaatgcatcttcgagtcagctacgcgcaatctttgtcaaatatctgataactctagcaatggacaggaagaaaagagagaaggagatggcttgtgtgctcgtctctactcttggtttccctcccaaagatgtcagaagcgcattctcgatgctcatagaatctgcagacgacactgctttggacaacccagtggttgttgaagaccttgccatgttcttagcaagagctgtggttgacgaggtgttagctccacgggatttggaagaagtgttaaatcagactcccgaggcaggctcaagtgtgggcgagaaagtgattcaaatggcgaaaacattgctgaaagcacgtctttccggtgaaaggatcttacgttgctggggaggaggaggaattgagacaaactcgccgggatccacagtgaaggaagtgaaagagaagatccagattcttctagaagagtatgtctctggtggagacctcagagaagctagtaggtgcgtaaaggaactaggaatgccgttttttcaccacgaagtagtgaagaagtcagtagtgaggatcatagaagagaaggagaacgaggaacggttatggaagctactaaaagtgtgttttgattcaggactagtgacgatatatcagatgactaaagggtttaaaagagttgatgaatcacttgaagatctgtctttggatgtccctgatgctgccaaaaagttttcaattgcgttgaaagaggcaagcttgaagggttcttggacgaatcattcgcttctgaggattcgcaaagtaagaaacagaacggctcgtcttcttcctctggatgataacatttgagcaccatacctcaaacctcgagacgttggtttcacgcaaaatcaccttttggagttttttttttttttttcttataaacaaactaaaaaagttttggatactttttgatgacgtttcttacagaaaacaaatttatctttatcttagtgacgttttgttatagcacattattactttatgacctgttttttttgttcctttgtcaatgattacattgtcttgctaatattttcatacagaaattttattttatattctatgatattatcctctcttaaaagctggacaaaccccacggaccacgagtcttccagctaagactttttttagttcccaaaagatcgaacttggcgctactttcattttctcatctctgtttttccaacatcctaagaacagagttcgttgctccttttgttttctttaaagaaaaagtcagattcagatacatacatactctgaagaacatgtcgacgcgaagacgaactttactcaaagttataattcttggagacagcgggttagcttatttttctacctaactgtgttttttttttaatgtttgatccgttaatcattctcttgttgttgtttttgtgtacaaatatcacagggttggcaaaacatcgttgatgaatcagtatcctaactaaactttttgatttttctttctttggattttcttcttttcgtaattttgatttttgtagctgacggtgagaaaaaaaaaacttagctttttttttttttcaatttgtagatatgtgaataacaagtttagtcaacagtacaaagctacgatcggagctgattttgtcactaaggagcttcaaattgatgacaggcttgtcacattgcaagtgagtttttttgtttgtttttttttggtttaaattgttgtcgatcttttaagagaagagtgtatatgaattattattattattgtaattgtgttaagatatgggacactgctgggcaagagaggtttcaaagtcttggtgttgctttctatagaggtgcagattgttgtgttcttgtctatgatgtgaatcacttgaagtcatttgaatctctcgacaattggcacaacgagtttcttacacgggttttttttttttgctttctccatcacattttctcttcatccaaagattctttcttttagtgactgatagttgttttttgtggatttttgggccaggctagtccacgtgacccaatggcattcccttttatacttcttggtaataaggttgatattgatggaggaaatagccgagtggtaagttactattagtcttaagcttttaaatctgaatagtccatttcctttgtttgctatatatttcctttctttgtgttcaggtatctgagaagaaggctagagaatggtgtgctgaaaagggaaacatagtctatttcgagacatcggctaaagaagattacaatgtcgatgactccttcttgtgcatcacaaaacttgcccttgcaaatgaacgcgaccaagatatgtaagtgttattagtctttctttatgtgatcctctcactttgtgaatctcctccatatgatggatccttattaaactcaagatgaaaaaccagaatctctcaattcaaattttcatataatctttttttgcaactcggtgctacagatatttccagccagatactggttcggtgcctgagcaaagaggaggttgtgcttgctgaatgctgaagaaacatttcttactctcttgatttatgcattacttgttgtgtgtgtctataatcttaatgctgagaaggaccaataaaacttgtattgttccctaagtaaggttttgttacctttctggttcttcatctttgacatttggtggttcacgatttgtatgtaacaacagttcaagtgtacatgtaatgggttggttctgtcttctttatgtaatgggaaactaatgatgagtccggttcagccgcgctaaaccgaatccggttcggtttgaaatatcagttagcaatttggcggtgacgtggcgcttccttccccacttgtttcgctccttagaattcagttgaatctctcgaatcgtcgtcgtcaatcttttcgatttctcttcctctcgtctctctctctgttaacaatg

SEQ ID NO: 20441 - DNA, 3003 bp, Unknown; identical to SEQ ID NO: 20440
  misc_feature (1)..( 3003): 2750-1469P.txt file - cDNA_ID_1825902; gDNA_ID_1620737; Annot_ID_49499

SEQ ID NO: 20442 - DNA, 3000 bp, Unknown; identical to SEQ ID NO: 7938
  misc_feature (1)..( 3000): 2750-1469P.txt file - cDNA_ID_1825902; gDNA_ID_1621175; Annot_ID_174125

SEQ ID NO: 20443 - DNA, 3003 bp, Unknown; identical to SEQ ID NO: 20440
  misc_feature (1)..( 3003): 2750-1469P.txt file - cDNA_ID_1825902; gDNA_ID_1620737; Annot_ID_166289

SEQ ID NO: 20444 - DNA, 3000 bp, Unknown; identical to SEQ ID NO: 7939
  misc_feature (1)..( 3000): 2750-1469P.txt file - cDNA_ID_1825906; gDNA_ID_1621175; Annot_ID_57317

SEQ ID NO: 20445 - DNA, 2327 bp, Unknown; identical to SEQ ID NO: 4863
  misc_feature (1)..( 2327): 2750-1469P.txt file - cDNA_ID_1825906; gDNA_ID_1620737; Annot_ID_49498

SEQ ID NO: 20446 - DNA, 3000 bp, Unknown; identical to SEQ ID NO: 7939
  misc_feature (1)..( 3000): 2750-1469P.txt file - cDNA_ID_1825906; gDNA_ID_1621175; Annot_ID_174126

SEQ ID NO: 20447 - DNA, 2327 bp, Unknown; identical to SEQ ID NO: 4863
  misc_feature (1)..( 2327): 2750-1469P.txt file - cDNA_ID_1825906; gDNA_ID_1620737; Annot_ID_166288

SEQ ID NO: 20448 - DNA, 3000 bp, Unknown; identical to SEQ ID NO: 4874
  misc_feature (1)..( 3000): 2750-1469P.txt file - cDNA_ID_1825917; gDNA_ID_1620738; Annot_ID_49512

SEQ ID NO: 20449 - DNA, 3000 bp, Unknown; identical to SEQ ID NO: 4874
  misc_feature (1)..( 3000): 2750-1469P.txt file - cDNA_ID_1825917; gDNA_ID_1620738; Annot_ID_166307

SEQ ID NO: 20450 - DNA, 3000 bp, Unknown; identical to SEQ ID NO: 4871
  misc_feature (1)..( 3000): 2750-1469P.txt file - cDNA_ID_1825928; gDNA_ID_1620738; Annot_ID_49508

SEQ ID NO: 20451 - DNA, 3000 bp, Unknown; identical to SEQ ID NO: 4876
  misc_feature (1)..( 3000): 2750-1469P.txt file - cDNA_ID_1825928; gDNA_ID_1620738; Annot_ID_49509

SEQ ID NO: 20452 - DNA, 3000 bp, Unknown; identical to SEQ ID NO: 4870
  misc_feature (1)..( 3000): 2750-1469P.txt file - cDNA_ID_1825936; gDNA_ID_1620738; Annot_ID_49505

SEQ ID NO: 20453 - DNA, 3000 bp, Unknown; identical to SEQ ID NO: 4870
  misc_feature (1)..( 3000): 2750-1469P.txt file - cDNA_ID_1825936; gDNA_ID_1620738; Annot_ID_166299

SEQ ID NO: 20454 - DNA, 3003 bp, Unknown
  misc_feature (1)..( 3003): 2750-1469P.txt file - cDNA_ID_1825968; gDNA_ID_1620739; Annot_ID_49560
gtgatcttgctgtagggtcagagctgcaccgaagaacagttattatcgactcgatggctctgatccgcgtgaatcagacggtgagttactggttcttgaatgggaatcccgagcaccaaagagcagagtgatcctctgctcgagataggaccgggtaaagggaaaaagacagaaaagaccatagaatagcaataggaatcgctgctatccgacaactttctccgtggagcccgcagctaaaggttaacaaaagattgtagaacccatggacttactatctaaacgatacgagacgggtcagtcaagggccaccagaggcacaaagctggcgaatatccgtgagagcggaagatataaaaggtataggtaagtaagctcttttaagatcaagggcaataagacgtcgaaggaagaatccgcaatgctttgacattccttttcaaatgagttgtgcccagcccagttagtccactactacagatagtaactagcacagaaaaacaagatggaatcaaatacggtgttaattaatttactgaagtgaagcaaggaacgtagtaactcgactggttggagagaaactttgttattagggttgaatttccagtcttcgggcctcaacaccggagcttatcctgaggcctaggtaggtaggtagtgacgtctcttgctgggtctttcataaggaatggtcctgttagtcttaatccagcgactggccttgctccgagccgatatccgaagtatggttcgctcgctagttatatgcttaacacatgcatctgaggtcagaggtgccgctaaggtgaacgctcagcttcaactctgactatatattatatataagtgcactgaaggttaactatgtcaatctacaactcaatgtgattggcttcgcccgggctcagtctctttcggccggtatgtagaatcgtcggagcgagcaaagcagcggagcgaagtgggctgtgtaatcattttattttttgacttttttttaatatataagggtaagtaaggagctgaaaacgagtccttcggagggcgaagaaactcattaattcattttgatgagggcccctcattcaaatgttatgcttagtgcttccctcacattttgagttgattatttccaatttcgagagtgagattgatccgaccaagtagtagtgcggaagccagtacatacatggctagtttccaggcaagccatccatattggcataaccttcttctatgccatctagcttcatagccgatagtttccgttgatcattatcttcatccatcggatcagctccttcttttctgatttttttcaatgactgcttcttatgcttgccctcgttcttctctcttctcctagacccaccccccttactgtctgtttaggccccctgccaggtactccagtctcattgcgtaccgtcgtctgcatcttcttgccctgttttcatagttgtttgcttttcttatatggattaggcttggttaaaagcgtaccgtcaagcaagaaaaggaaccgtaaactagctttaccgagttggcttcttcgtatgagccctagcagcatctattccttactctgttttctgctttcaagcccctaagtaggatcgtctaacgaagtcaggtacgagggaatatgttaatgcaaaagaggcgaggaggctggtgaccagagaaggtctgtgatggaagcaattcctggctttctggtctgtgataaaagcaatctctctccggtcggttcgactgttaatggaaaaatgaatagatccttaggaagaaaaaggctcttttgctcttgtgtagaatcagttgttacagagaaggagcggttttcgtttcgcaatggaatcagaattagctacgatcaattaaaatatcgtagtatagtaagagccaacgaagtagctgtaacgtgaacagctaaagctccttaccttatatgggctgcaccgcgctgaatgatcaaatcccatttattcttatttttttacattacaactcccatgcctttccgttggtcaacaaccaaccgtcgatttaccttttccttcattttgagaacaagtctctcttggggggagcagagcatgcaaaatcgagcaatagatggatcttagaagaattccactttgaacggcacgactctttcgatttttgcgctggcatttgagttgtctcccctcctctttcaatcgacacactcgacgcagatagctccggtggccccggcttctgcctctatcaggcttaggctgcccccacccccacagagccacagcatggagtagctgctcccgcgctacaaccaatcaaaattttatacggatcgatatatgatgatgctaaaccgagatagagaaagagggcgaagaaactcattaattcatcgatgagggttgccgcgcctccctttgttggctcttcgagacaaaaacactcataggaatggtgctaattcccatgttccttctagtctcgtttggtttcgaaagcctccccctccctgtctcttactctttgaaagctgtcatcctggatttatttttgaatggtttctttgttctcttatttggattgaaagaaagacaaaacttcattttcttcgacgaatttcggctatgaccaatgcaccaatagctgaataggcgtaacaaagctacctgaaaaggcaaggtgcaccttgggattgaaatcgacgaattgcgttttgcccgagagatttatttagaaagattatccatcggataaagaatgcaaaaatagaaagaatataaataaaggcgtatacacgggaagggggcaccactacttccagggggagactagcctcattacttcttagtgggcgagaggtgcgcctaacccacctacccactcataaatcacggtgttcagctgacttgaactgatagacccttattgtattggaatttagcgcccatcttttgactgttgtcaacaaatctcttcaatgttcgattctactctatg

SEQ ID NO: 20455 - DNA, 3003 bp, Unknown
  misc_feature (1)..( 3003): 2750-1469P.txt file - cDNA_ID_1825990; gDNA_ID_1620739; Annot_ID_49553
aagagagccagaagctgggtccgcccgccggagcttctttcaatttccggggggcttagcttgaaccactcccaagtgccaagaaccggcgaatgaaggctccgtggcggcatcggagctgccaataagctaatccgttcccagtgagctattacgcgctctttcaagggtggctgcttctaggcaaacctccttggctgtctctgcacccctacctcctttataactgagcggccatttgggggccttagctggtgatccgggctgtttccctctcctagagaaagaagttctctagtcactaaagtgcgtttcactctcgttcctctcgtttcactcgggttgctaaagcacctctcctctgccaagctctctgtcttggttaatggttatccaaaaggatatttctcatgttaggcggtgtgagacagggggataaaggatcccccgttgttattttgtattgcggaagatgtcttatcacggggtcttaccgggcttaatcacctgggcattctttcttcaattaccgagacctgtacatacaaagatctaggcagctcatcttcttctaacgaagtcagatctttttccataccataacatatatagaatcgattttcttttctgatcgctagcctgccgggccgcccccgcgatcaaactatcaatctcataagagaagaaatctctatgccccctttttcttggttttctcccatgcttttgttggtcaacaaccaaccacaactttctatagttcttcactactcctagagacttgacggagtgaagctgtctggagggaatcattttgttgaaatcaattaatctaatcatgcctcaactggataaattcacttatttttcacaattcttctggttatgccttttcttctttactttctatattttcatatgcaatgatggagatggagtacttgggatcagcagaattctaaaactacggaaccaactgctttcacaccgggggaagaccatccggagcaaggaccccaacagtttggaagatctcttgagaaagggttttagcactggtgtatcctatatgtacgctagtttattcgaagtatcccaatggtgtaaggccgtcgacttattgggaaaaaggaggaaaatcactttgatctcttgtttcggagaaataagtggctcacgaggaatggaaagaaacatattatataatatatcgaagtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgccatcttaaaaaaattggaatcttgttaggtacccgtacgacagctctaataatgagctaacgtactcatctttagagtggtttgtgcgcaggctcgagaagttgctgcccgcttcagaagaccttagggtgccttcgattcctggacgactttgttcgtcgtgtacaggggacgggaagagatggctgttcgctgtagcaaaattcaacgaaccgacgggcgtcccggacatagccttcaacccgcaaaggttagctttgttgctggacaaccactagggtactattcttcctggcccctcttcgccctatcacatcacatggtggtgtggtatgcggcagaacatgtctatccttcctccttcttctttcagtcgaaacttcctcctagtgaggtgttcgcctatccaggtatggaagtattcaatgaatacactctgtaccatgcatgggtggatgaagctttatctggagtatcaaagatggaattgtatgctaaggcttagtgccagtatagagcttgaagtctttatggatgtgccgatctttatccgtacatattaccgacctgcgaacatggatgattcgttcaggtacgggataatatttaggatgtacgatttggctgtccagttacagtggggcaatgtcatgaaattgctactagtaactaagactcaagtggagaaaaaaaaagcactcaatttgaatgtaagtaaaacacgggatggaagaggaggcctgaaccaacagggatgaaacagtatagattcccctgggcgaagcaagtcaccgattagtaacctaagaaagagttgtcaacgggcgagtgtcctgctataaggtaaactcctactatttcagcttcttttcccgtggtcgaaagctaaatatctcaagatgatattttccaaactctcgacaagcagcaaatagaaaattaaaagaagattttgaaggatctgatttcatctaaggagtggcggttaacagaaggccatttcaacttatgctctaaaaagatagaaagcattgttgataaagccctctctttatataaagagggctttgcgccttcggataaaggaagattccgatattcgcataggtattgaagcggggatatgaacagctagcttcccctcaaatgggagccgtttaagtaatcttaaaagagtcctcgactgtattggaaaaacaaaaagttcaatatggcgggagatccataattttattgagagctttcaatcaaattagattgtaaagtagtagtcctgtgtaaaaaaaaaagctggtggggcggggtccaagcaagcgtaataaggggagggggactaggggtggaagggtcgtcgaaggagatgcatttctggtacaagtggtattggacaagatctcagggaatcatctctttcagatttctgcctttctttcccatg

SEQ ID NO: 20456 - DNA, 3000 bp, Unknown
  misc_feature (1)..( 3000): 2750-1469P.txt file - cDNA_ID_1826087; gDNA_ID_1620739; Annot_ID_49523
tcagtagcaatagaggctgctgcggtgcggcttgtgatagcaagagactttatcggcctctttgggctttccggaagacggttgagtggagagatattttgaaggtggaactttatgcaatccgccatacgggggagatgcttcgcgaataggcattcgtaacctttgggtagagtctgactcattatatgcagtcaagatgattaactccaagccccataagcgcgaaatatgctgctgagcttcactgaaaatgccagagcagtttgttttttagagtcacacattgttggagggagagcaatagagccgccgacttgatttcgggatgtcgagttatgtcttaatgtacccaagaaacctcccttagcccttaattacattattagagaggatatgcaggaacttctttatgtacgtgtatgagatattatgtaccatctttctaatattattatgtattatataataatataagacaagaataatatttcttattctaatatatagctgcaagaccaatacaacacaggatgcaaaaaaacaaaagcccttctttctaattcctcctagatacatggcttacatacccggcccaacattctcggaaaactaaagaatcgagggtccagaagagaattggccatttaatcttgtaaactaatcgagaccgaaattggaaaaagagatacgaacagagaggaataaccaatcgatgaaagaacatgaaaccattctgtttcaatagaggtacgagaaacggttaggggcaataaagtaggtgaagtggttggattttgcgagctgttccaaccactgctggatgtgattccaagagccgaacgagaatgaataccacacagaagagtcaagaccaggctccctaatggaatgtttaaccgatccattccggatcgaccgaattggtacgaaagttgtaacatgggaaaaccacagaaaacacgacttatttgaataacccggtgacccaccaattgtagaagtaggatctttggcaagcaataagtacttaaataatacaattcgagtgtaccatcttctttctcatttcgaggaaaaggtgcaggaggaaaaggaaacaacggagggatccgaatcggacctaaatgggaatgacatgaaaagtctttttcaaaacctagcattaagggcgttacgacgatatacgagaggaatgaagaaaaactcgtgattggtgtggaggagaagatcagtttatgatatagttcaagaaaaagtcgtctcatttccttacttcttctttctaattcattcacttcaaggctggttctgaacgccgcgtaacatcatcttcaaccaacctccaccgtacgtacctttcggtgcacagccactaaagaattgcttatacactaaactgctgcttatatacgcttactaaaagactgactttcgttcattaggaagcatgaaactaagaaagagagatgtgcctaaggcggcatgcaagcaaactgtgcacactacgagaaaaagagagatgttcgcaattactaccacaagagccccctatcctatctctaaaggggcccgtcacttcgttcgtaccttcttggcttaggcttccaactttacttactttatagccttgccgccccgtcgctagcaaaagctaagcgcttgaaaagcgcgctaagaaaggttgcttctgtcggcctttctgttcaacagtccaccaatagcggaagagaggggtactgtacatacaagactcttccagttcttacgttagctttttcttaccagtcaagtagtacaacagctgtatcttatagcccggcgtggcgggtctttaattcagtagatagaaaaaattattagtaatacgtagatgagtgagtgagtcctcactgacctgagcgatttcgatcacctagcaggccttttttttatttggtaggtaacatcgccgaagcctatcatctgatttgactacgaagaaaggaactcgaggtgaggcggcaccgtcttgtgcaacgcaaccatggttggccctctatcatttctatctagtagacttggtaaaagggccccgacttattttcagaattagagttcgaccgcagctcctttttttttttgggggggggaggggaaaaaagttccttgccaactatcgactccaatctcttttaatttgtttttggtattaccaaacctagcctagcgccttcgtcaatcacactaaagcagagcacccaactatggcaaggcccccttaccttaagggttaggttagtcaatccggcccgagacgcattcgttgacaaaaccgccgtaggaatggggaccattcaatagagcggaggcgaactgatcaacgagaaagaggccctactcactacaaacgaatacaccacaagatcgaactgcactcatgcctctcccgcatcaagtggaccccccatacgtagtgcttctatcaatcatgtacgtagggccttccattctgattggtatatcataaaaaaagaaagccatttgcaccaggtttataaagactggttcgaaaggaccaggcgcactgcgctttcccttgcccagatgttcgcctttctaagctaagtcaagtaatggtgacccgcctaagactggagcctcgtaacatgttggcgaagagcttcgaactgagggttcgatcagcatcaactagttaatacttgttgagacctcttctcttttccgcaccaatcttaattgactactacatctttatttgggtgtatagctcagttggtagagcattgggcttttaacctaatggtcgcaggttcaagtcctgctatacccaaacctaccttaccacactatatagtaaagatgcgtagtagcgttctaagatcactgaggggaaggttggtcataaatttggagagtacacggaaactcagactttcgagaacaaatattgtaccgggaagaaaaaagggacagaaatccataaagtcaaaaaatatg

SEQ ID NO: 20457 - DNA, 3000 bp, Unknown; identical to SEQ ID NO: 20456
  misc_feature (1)..( 3000): 2750-1469P.txt file - cDNA_ID_1826087; gDNA_ID_1620739; Annot_ID_166319

SEQ ID NO: 20458 - DNA, 3003 bp, Unknown
  misc_feature (1)..( 3003): 2750-1469P.txt file - cDNA_ID_1826121; gDNA_ID_1620740; Annot_ID_49590
tatcattaattcatgtcatcatcatcattatccttattattattaatagattacattcatattaaagattcctactagtggggagaccaacaacagttcaagattcttactcgtcaggagacaaaacgttattatttcatcttaaaaatcttgtcttaaatatcgaaacagagaatagtaattataatgaattgcattgcttttaaaaccttaaggggtcctttgattttacaaaaaggacatttttcctttctaggactagatagctaatttttattggccttaattgtttgcagattcaagattatgattgcaatttttctaaaatgaatccattatccaagcatctcaaacatcttttttttttctgttaatcgttattcaacacaatgttttttaatctatcgttgcactagttgtaaaaacgctattttcttttaaatctaatttaacattaaattaaaaaaataataatgtaaatgtcaaaccttttgtatatatttttttttttgtatgaataaatgtcaaactttttcttcacgtttacgttaaaagtagtttacaaaaagctaaagagtattacaattttaaagatattttcttttgaacatctcactttgcttgttgtttgcatccagatggtgacgcggcattagattaaactatgcctatatggcatggtttatgaattttgtgagaggttacttgtcggtacatcctgcatgttgctgattttagtaaactaggatagtgatattttgaatcgttgtttattgcctagacgtcttttacgagtgtttagcgatccattaagttttctttgtcattttaggtattacaaactcaaaaggatgattttttttacatgtactcatctaataggattaatgattttataatacacctttaataaaacaaaaacacaattcctggtcgctattaaattctcaccaacaaaaatataaatacacaatcaaccgcaaccaacgaactttctaaatgttaaagatttaacaattacaatcagaagaatggttaaaagagagaagcagaacttaatggattaatcacaaggaacagatgaatcaataacccttttgtaactaaacaaataacctattgattacttatcagatttcttgccaagtttcatccatttgaatccaagtatggccttcccgataccgcttttgcttccatcttccttcttcttcttcttcttcttcttcttatcgtcttcgttacttgaatttggaggaggatcagagttgtaatcccattgatcagcccatgatagtccagaatccatcttcttcgtctctctttaagattttgtggaatgagaaggtttagaaacaaatatgagggtgaaagaaagattttgttttacttattatagacagtattggtttgacacaatgtctataagtttcttggttgcttatttttggggtttatctgtttttagttgtgcctctttgccctttggttggacaaagaatcaacatctttcacctttgactgtgaaaacccttcaacaagaaaagaaccccttacctgaaacacttgaatttttttgagtaatcaaaaactatacgcttcaacggttcaacctaatttctcttttacattttattcaacattttcaaaggatagttgagtagattaattactgttgataaaaaacgacatacaattttttttgtcacgctttgaaattatattattacgcttgtttcgttttgtgacattgtactaccaacaataattgttttttatagtcaaccatatcattaatcggagcggtcccttgattcgttcgagcgaccctctaatcaattgggaatactgtgacaaataaccatgcatttatgcttcaacaattttagttttccttcataaatatcacgggatgcaagtgacgctaagcataaatagttcgtctgtttcattgactttgtaatagaagatgaaaaaagaaaatatatagatatttatcttccttttgatgtcatgacgtttcgtgattttgatttacagtgtcaaaaagagagattacgctagcgaaacgtcactacgaccaagatttagttggagtatttatactctgatcattctcaatttctcatcatcgacattacaaatatgcaaaattaacaaaaaataataatatatacaactcatcaccttatatatctaagagcgttttgtctaactaataatatgttagcatttttatgccactattagtaatttaataatatagttattgcttaaatatatagatttttaacatattttctcttagatatatatatatatatatatatatatatatatatatatatatatatatatcaagatataaataaattctactaaaagaaaaacaaaaaaacagctaattttttgtcggtcaactcaaaataatcattaaatgagaaagatatatttatctatcgaataaatattattttattttttaaaagcgaaacactcgttagatcaggtgaccatgaaaagaaaaattcagctctatccaaaaaagaaaataaatcatgcaaatacagggagaaaaaagtacgaaattacaaaaaaaagccatgtcaatgtaaagagaatcattgaatcaagaagaacgattgggggtaaattagtatttaaattggtctaagcatgaaacagcttccagccgatggtgccttatgcctcgggcaaaaaaaaagaccaaacacactaaacaaaactaccaaacaaactaacaaacattcccttcaaattcggaaaagtcagaatctcatcacctatttattacactctcataaacgctaacaaatcgttgaatagaataattaagcaggtaaaatcctaaaccgtcagagaatatctatcctcctcttaaatatcactcttatctttatcctcctaaaatcttcttaattgtatctaatctctttctcaaaaaccaaacactatctctcgattatatcacaaggagatatg

SEQ ID NO: 20459 - DNA, 3000 bp, Unknown; identical to SEQ ID NO: 16499
  misc_feature (1)..( 3000): 2750-1469P.txt file - cDNA_ID_1826133; gDNA_ID_1620740; Annot_ID_49587

SEQ ID NO: 20460 - DNA, 3000 bp, Unknown
  misc_feature (1)..( 3000): 2750-1469P.txt file - cDNA_ID_1826136; gDNA_ID_1620740; Annot_ID_49586
aataccatgaatcaacaatcttagcaacctttataacaccatgaatttaacattatcatcgtagtcaataataaacgtttttttctttttatacattaaaaaaaaaaaaatacaatcgtttaattaatcaacgaaacgactgtgttttagtttccgtctaaaatttaacaccgtttatttgcaacatttgatagattatgcatttaatttgttcaaattttcaagatgaaatgtcaatacttttgagtttatttttttatttatttattttttattaatttttttatacatttttattaattttgattatggacaaactagatttttgtaaaattaacattgcaatcatgaaagtgatattttcaaaacaaaagtacattagtctaaaatgatactgaaatatgaaaaggataaaatatgcactactaatttagtatagaatcgataatgaagagagaatcttcttccctattccctaattgtgttcataattagcataatataataaggaaataatgttggctctgacaggtcacagatattgaagacttgaacaaaaaaaatactttatgaaagaagttgattaaagaaaccaatttggtaacggagacctgccaacagaaagcatataatgttttatagataaggacaaaagctatttctctctacaaacattataacaacaacactcatcatcatcatccaatttctcatcattatgatctttgaaacagaacaccaaaattaaaaaagtttgcaagaacaaaaaaaaaaaaagagataagattcttctctctgtatttttgaaaaaaaatatatataaatttttttcttggctttcacgaagtctctttctctggctgcaaaaatatcatcaatagcgaaaagtcgcttcttttttcttcttccaaaatctttaattttgtgaaaccgaagagataagacgtggagaaaagcagacgtctctgttgtttgtttttgattcatcgggttctaaggatttgtctgtttccaagacacaaactttggattctcttctcttcctgttcgtcttctcttgtcttgatccttttgttatcatcatcatctcttcatcgagagaagagagacgagattagggatttaagttaaggaggatgtattatcagttgaccaagtcttcttacagagactctttgaagattctggaggctgatattgagcacgccaatggactgtgagtcatcctctgattctttctgggttctttgatttttactgggtttagggtctttagtatcgattgttatagttggcttcgatgatttagggtttagggccccacaattttacattttcggtcgttatcacgaacttagattattaaaaatcgaaactttgcagaaatggtcaaaaaattgctaaattttgtggcatgcgtggtgtggtcttgatgcatatgttgtctgaagaaatgggttaaatgtgattagaaggatggtaactgaatagtctcacaatttgtatatctgtggtgtggtattgatgcatatgttgtctgtggaaatggtttatgtgattcgaaggatatagtaactgcttagtctcagaattggtatctgtgtggtttgttcttcaggcatatgttgtctgaagggatgggttatgttagaaggattagtgtaatgactgattactctcaaatttgattcagggctgctgagattccaatgggaaagagcggtgtgcgacttcagatgaaattggtgtgcagcaatttggctccattcttcatattcctgctacaatggatggatttctcatgtctgcttccaagatattttgatttcttccacatactcatatacaaggttgttaccgcatacatagatatcgagttgtgtgtgtgtgtgtgtgaaatggtagattccctgatagtttctctcctttcctcttggcttgtttgttttataggtgtcttctttgtcttgtacaggtacgtgctgatgggcggtggaatcgatctaggtacggaaggaaagctacgattagggagttttacggtaagactaagctcttaattgtgattgtgtttcttctactgtgggcttaatcttataactatggctctggctaaatgcaggtgttatattaccatcacttgagcgacttcatatcaactttgctgacttaccggacgaaagcttgtggtatccgaatccaaaagccatcaccaagaagcagtatgacattgaaggtagcagatacatgaatagcattgacttggaaagagaagacgaatgcgggatttgcttagagccttgcaccaaaatggtgttgccaaactgttgtcatgccatgtgcatcaaatgttaccgtaactggaacacaaagtcggagtcatgcccgttttgtcgtggcagcatcaagagagtgaactcagaggatctgtgggtgctaacttgcgatgaagatgtggtggatccagagacggtcaccaaagaggatcttcttcggttctacctccacatcaatagccttcctaaggattatccagaagcggccttcttagtctacaacgagtacttgatatgattttatcccgaaacataaatacgggtgtacagagggagagagtgatcccagacctttgattaagtgtacataagaatctggtgatccattaatgttccttcgttttagattatgatttatgaagattgtcataatcttaatgtgtaccccttttattatcaaagatcaaatgagaaagatgatcttcatgtcttcttgccaacataagcatgtttgaagatgagatttaaaaactgttataagtaaaatcaattcctagagatgttcaatccggataaaccaatgcaaaccgaatcgaaccgaaccaaaccaattgattgtgcaattgtgctaactgtttcaatttataaatcctcaagtttctctctctctctcgcagaacagagagtggtgaaatcaagtgaagaacactaaggttcaactatg

SEQ ID NO: 20461 - DNA, 3000 bp, Unknown
  misc_feature (1)..( 3000): 2750-1469P.txt file - cDNA_ID_1826139; gDNA_ID_1620740; Annot_ID_49585
atcgagttgtgtgtgtgtgtgtgtgaaatggtagattccctgatagtttctctcctttcctcttggcttgtttgttttataggtgtcttctttgtcttgtacaggtacgtgctgatgggcggtggaatcgatctaggtacggaaggaaagctacgattagggagttttacggtaagactaagctcttaattgtgattgtgtttcttctactgtgggcttaatcttataactatggctctggctaaatgcaggtgttatattaccatcacttgagcgacttcatatcaactttgctgacttaccggacgaaagcttgtggtatccgaatccaaaagccatcaccaagaagcagtatgacattgaaggtagcagatacatgaatagcattgacttggaaagagaagacgaatgcgggatttgcttagagccttgcaccaaaatggtgttgccaaactgttgtcatgccatgtgcatcaaatgttaccgtaactggaacacaaagtcggagtcatgcccgttttgtcgtggcagcatcaagagagtgaactcagaggatctgtgggtgctaacttgcgatgaagatgtggtggatccagagacggtcaccaaagaggatcttcttcggttctacctccacatcaatagccttcctaaggattatccagaagcggccttcttagtctacaacgagtacttgatatgattttatcccgaaacataaatacgggtgtacagagggagagagtgatcccagacctttgattaagtgtacataagaatctggtgatccattaatgttccttcgttttagattatgatttatgaagattgtcataatcttaatgtgtaccccttttattatcaaagatcaaatgagaaagatgatcttcatgtcttcttgccaacataagcatgtttgaagatgagatttaaaaactgttataagtaaaatcaattcctagagatgttcaatccggataaaccaatgcaaaccgaatcgaaccgaaccaaaccaattgattgtgcaattgtgctaactgtttcaatttataaatcctcaagtttctctctctctctcgcagaacagagagtggtgaaatcaagtgaagaacactaaggttcaactatggcgactcttcgtttcactctacttcttcttgtcttcgtcgtcgggatcttcttctccttctcctccgtttctcatgtatctccatctcatctcttctctaaaaacccaaactttttatattttgtgatccgaacacgatccgtttcttatttcttcgtggcgtctttggtaggtacgtgcaacaagtgaaatcaatctcaggatcgaaccattttcctcgccgttcgcgacggatcttgcaaagctgcaaactcaaattgggtacagtaacttaaagtcacttcttctctgttgattttactaatttgttcctaaatgtgtattggaggatcataattagggaaattaaggccatttctataagattagatactctcttgatgtgatgattaagttgaatcactgatttggttaaattctatactcttaaagttgtgacctttcctttttttttgtttggtgtagctacaagtttaacaacatcaaccttcttcgccgtgcaatgactcatgcttctttttctcaagagaacaacaaagccttgagtatctttggaacccatatcattgaaaccgcggtctctcttcagtttctcgctaaagatatcgatatttcctcgaaagcactgggccgtttgatatcagaggtttcaaatgtggagtcctcatgtgctcttgacggagaccggttgggtttggggaagataatcagagtttctactaagacagatgcatcgaactcggccattctttgtactggctttagggcaatctttggagctatagctattgatgctggaacggttgatgaagccatcaaggttttctggaaggtacatggagctcgagctggaagactagtctctatgttgtaaattagagctttattaagtcattaaagtcatgttttttcggatgccaagttctaagagactcttctccaatgcttagaattttatggttgatgttaactattagctgctgttatgagggtgtaagtgatcatactatagtgttgactccaaaactatctatttttgttgcagtacctgcagtgacttaatgactgaaaacgttaaaatgacaacaaatcagtcaattgcaaagaattatggtggtatctccatagaaaatgtgaaagtggtccaaaatgtgagagatgtgcatgcagacttgtggatccaacagttgtgaaagatgttatgtaatcagaatgtgcaaatgatgcaatagcgacacattagtaattcgaactgttacatgtgttgcagtaagcaagtcataggaaatagggatcccatcatcatttacttgttattatgttgaatttaattgatatattttgtgaatataggattacatatgtatttaatgcgatattttgttaagaagattttatgagagaatctgtaattatattctaatttttgtcttacatttgcaatatatacgtttgactaaaattaagtgatccttaaattgcacatattaccatataaaagtcacgtgaacagaagcaaacgtttcttattggacgaaacacatcacccacttcaatggcacgacacaaccaaaacatatgtccaaaaaaaataaacgattttgggagaaaacaaaacgcaccgcgtcggtcgtgctgcaacgctttcttcttcttcttcttacctcgctaatttattactcacggatctctctgacttgagccgtttcacacacttcctttgtttgctccatttctcgactctctctagaggtcccgtctttgattaccgatattggctaatctctctctctctttaatccttcttcggtttccgaattcgtgatagatctattgggggaaaaaagggttgggatcgtatttagataatg

SEQ ID NO: 20462 - DNA, 3000 bp, Unknown
  misc_feature (1)..( 3000): 2750-1469P.txt file - cDNA_ID_1826158; gDNA_ID_1620740; Annot_ID_49577
tttattacccttgccatcttaaatctacatttgcaactcacccaaaagctttatcctttgtgttttttccactgtatactgaaaacaaatctgaggtgacgaagatgaacgtgttgatttctgcggtggtatgggtatacactcacttaaggttatcagacgtagctttagccctagtagggctttttcttcttagttacttgcgtgagaagttagtgagcaaaggtgggccagtgatgtggccagtgttgggaatcataccgatgttggcgctaaacaaacacgatctgtttacttggtgcaccagatgcgtggtcagatctggtgggacgtttcattaccgaggaatttggttcggtggggcttacggaatcatgaccgcagatcctgcaaacgtcgagcacattctcaaaaccaatttcaagaactatccaaagggtgcgttttatagagagaggtttcgtgatcttcttgaagatgggatctttaacgctgatgatgagctttggaaagaagagagacgcgtggctaaaaccgagatgcattcttctcgtttcttggagcacacgtttactacgatgagagatctggtggaccagaagctggtgccgctgatggagaacttgtctacttctaagagagtctttgatctacaagatttgctcctgcgttttacctttgataacatatgtatatcggcctttggtgtttacccaggatcgttagagacaggtttaccggagattcctttcgctaaggcttttgaggacgccacggagtatacacttgcaaggtttctgatacctccttttgtgtggaagccaatgaggtttctagggattgggtatgaaagaaagctgaataatgcagttagaatagttcacgcgtttgcgaataagacagtgagagagaggaggaacaagatgaggaaactcgggaacttgaacgattacgctgatctcttgtcacgccttatgcagagagagtacgagaaagaagaagataccactagaggaaactacttttctgacaagtacttcagagagttctgcacaagtttcataatcgcgggtcgagacactacatcagtggccctcgtgtggttcttctggctagttcagaaacatcctgaagtcgagaagagaatcctaagagaaatcagagagattaaaaggaaacttacaacacaagaaactgaagatcagtttgaggctgaagatttcagggaaatggtgtatctgcaagctgctttaacagagtcactgaggctatacccttccgtgccaatggagatgaaacaagctttagaagacgatgtgttacccgatgggacaagggtgaagaaaggcgctaggattcactactcagtctactctatggggagaatagaatcaatttggggaaaagactgggaagagttcaaaccagagagatggatcaaagaaggaagaattgtgagcgaagatcagttcaagtatgtagtgttcaacggaggtccaaggctgtgtgttgggaagaagtttgcgtatacacaaatgaaaatggtggctgcagcgatcttgatgaggtattcagtaaaagtcgtccaaggacaagagattgttcccaaactcaccaccacattgtacatgaagaacggtatgaatgttatgctccagcctcgtgactggtaaggtagttcggtttaaaaacaatatagtactaataaataattgatgttgaacgatattctaatcgttttagtatctaaatttgtttgtggaatatggttaactaaaaagactattttaactaattcggtttggattttatgtgcaccaaccctagtttacttcaagcaatggacatatgagagtcacgaattgtatgtacatgaaatgtctatttaaaaagctctaaatcttataataatgaaagctgatcacatgaacatgatactgccctccactttcttccacaatcgtcatggccctttcgataatgggtgcaaaagaagtcggccctgtgacagaagtaaccaaagatcaggtaacagaacaaacaaacacagacacagcagaaaaagaaaacagagattcttaatctcaacctacaagacgcagctgaggaacaatctctctgtaccgtgaaacgacatcttcaaacccacttaatctcaatcaaacagagattgtttacagaatatatcatccgggtaaaaactgaagggattctgatcatgtgttgtagctgcaagaatcaaacatacaaacccataaaaacaattaaatgaaacatttctcttaacacaagaaagactaacaagtctatgttctgcagtcattaccatctccaaatccataacatggaatcaaattatcttcatcgaaagcatataaagtctttccaatgacagatatcgcttgctggtacgggtttggacttgttccaatgtaatgcaagctttgcctgttgaatgatctcgctcctaaattcaaaaccaaacccaccaaaacattactttaaaaaccttccaacttcaaacacaattgcttaacatacataaataaaacttctaaaacttttgatttaattgccacagttgccacagttgggcctaacaaataaaacgggcttaacttttgccacagttgggcctaacaaataaacagttagcctaccaaagcccaaatattttaattgaaataaattaattaagagagacatagtaaactaacccgacgagattgctttcttctgtcttcttcgccgtagaatttgaagttcctccgtcgtagaagatcgtctcttgtttcacctactccgatatagcccctctctgaattctccatcctccgagcagagaaggctgttggtagaaagttatattctcaaattttctaattttgcctcctccttggcgaagcaattgcgtcaattccttgcacgccactattacgactacgaaaatctagatcggagagaagactaaattatcttcactgatcgcacggtgagatg

SEQ ID NO: 20463 - DNA, 3003 bp, Unknown
  misc_feature (1)..( 3003): 2750-1469P.txt file - cDNA_ID_1826185; gDNA_ID_1620741; Annot_ID_49623
gaacaacacaatttagcaacggttcaaaacagccgaacttggttatatagttataagctaagaaagttttgtcgtcttagccctaagggttaccttgatgaaaacagtaagggtggggtgaataacttggtccagctattatttaggaaccggacacctaaataggatgaattatgatgtgttttagtctcttttccagttatccacattacgtatagcgccacattacgtattgttatggtcccaagtaaaatgtagcctttgtaaaatttgtcatggctttgtaagtgctacatgctatcagagccgaggaaaaacaaatactaaaagttaagctaatatataacatgctacgtgattcactaaaaataagtacaactttacgctaacaattctcataaacaaaattacatatgatgttaagtgattcgtccaagtgttagtgagaacttttaaccctaaatatatggattattcctgtcaacattaaattttgtgtcaacaaattgcccagatgataaatgatgtgatacgctctaattgtgttatagtataatatttatcaaaattgtaaatcatatacaattaataactattttatatatttagctagttaaagtattaggtatataccactaaaggtggctggattgatgaggccaaactaaattgtgaccgtccggctaactaagtttgatgtaacaattgaataatcatctcaccaaatccctaaactcttgtcaccagctctagtattttgcttacatttctatgcgatattttctaataattagattaagaacagaacaatgattagttgattataagtctatgaccaaataaaatgatgggcaaatgttcgtttttttttctttgtttctagccaacaatgatggcccaatgttcagaaaacttaacttcaaaatagtatttattatttaaatatgtaatcattatttttctaataattatcttacttttgtttagctgtctttgttaattaaagtaatgttgggtgcactagagactagaggccccaattcaactcatactcgatttatacctttctccaatttctccaccttgaactaagtaactaacgcctaacggtagattagtgaaatatatcaatagaagttttaaatagaagaatagaatacccaatggtctctgtttcaatcttgtccttattttctgagtccatatgtaaacaacgattacttttaagttctaaataaagttataagttgaaaaaaaaaaaagaatagaatccatacagtttcatgaatattacaacaccatccttttttttgtcaagcacaacaccatccttttaacatctatttttttatttgtatttgtatatccacatgtttaaatagatatatcgattatcatacaaaaatataacaaaagtgattttgaaatatagaaccgttcaatttatttgaaactagcagttgaacacgtacgaagttatacgttttgggggaagtcgggcaagatcttaagttggagcaccaattgcatggttaaataacagttttcttataatataagcacagtcccaatgtacgataaacacataacgatacttaaaacattggttccgtccaaaattcttgtattattatttttcaaattgttgatatgtatccatgtttccttgtgatgttttcgattatatattcactgctttatgttaataacaaaacagtagtatgtacatataaatacattttgcgggtttactgatttttatacaaaattttgtaaagtcatgaaacctgttatagtccatgacttaggcatgaatccaaagttcaaccattatcaaatagtattcattttattattacgctacacagtatcaataaaatagcaactcgaatacatatatatgcgtaaagatgctatatataaactccaacaacccatgcataacattgcaccttagtttcataaatacgtacgcaattccccatacaatcaaacatattttttccatcacgcaattaacagttcccattatatactatgtcggtcattcatattttaaggaaaaatgggaatataaaccaaatgatataagtcatatattgtccactataaatcgaaagatccgtctattgtggataaactttaatatagctcgtatgatatatattaaaataatatcagaaaatgagatctaaaaccagaaagagtgtgtgattgatccaataatttgttctaaaggattacaaactcatcatatggatcaaaacgaggaatcaaattccattatctaccaaaatcgttgtagttttttttttttgattactataaacattttatatagaaaaattattcgatttttcaccggtttcggcttagtatatgagattaggactaagatctagtttggttatgttaaaaagtcttgttaatagaaatatgtattatcacatatctttttcaaaatgagcatttataatttctataaaaacatatacattttctaaaatataccaatacacaatggcatttgtatacaaatacaccaaatttggtataaagtgtcgtatttcaagacactcaaaatatgccttttttgtaaatatttctcagaattgtgtatattttctatcacataaaagtagatataagatgaatagttttggtatttaatacaattagaaaaggaaactcgaaacccgcttaacaagccagaagggctaggcaacaaactgtcggaaagctctgacagaatgcatgagactaacaaaaggggtgaaacagtcatttcataactccagttgttacacgttggttgattgattatttgttgattcttgtcttcttcgccactgtttgctccgctcgtgttaaaaccttatattataaaatcccttccaaaaaacagaaccaacttagccaaacgtcacaaatccaaaactcaaaaccgaatcgtttttagcctccaagagagagagagagagagagatctgcatatagagaatg

SEQ ID NO: 20464 - DNA, 3003 bp, Unknown
  misc_feature (1)..( 3003): 2750-1469P.txt file - cDNA_ID_1826205; gDNA_ID_1620741; Annot_ID_49618
gagaagaaagaactcatttccccgctgagaaagttgatgaagacaagtagaagaaccatttgtggtgtcctttatctttatctaagctattgagagcatagagcagatgtggctgaattgacgagaacaagaacgggaacgatctgatgaaatatggacttcggatgatttctgaccataacttggacacaaggagaaacctcgatacatctttcaaaggcaatctcttcacgatctcgatcactatgtctatacgaaccgaatccgaatcgttcctgatctctgtctttttagtgcgacgtctcgtcattctcatgacgtttcttgtttctcaaagcataaaccctaactttttccccacggtctcctctcttattaatgtataggagacatggacgatttggactaagaaggcccaaagagacaggatttggactttaggacaatcttctagtactaaataatcttgtgaacaaaaatattggttcaagatggtaaataaataaataaatccatattttcatgaaaaaaagtgttaccatctctgtttcattctgcatcaagacaaactctacgatccaatatatgcacataagatcaaactcccactacgatatttctcctaatccgtagaagtaagaaaaaaattaagagtaacgcaacatgaacattggttagaacatctcttgtacaccgtagatgtcacttgttttgctctttgggggaggcagtttttctaacacccagctcggagagtcacttagccagagacctacaccggtttctttgtgcttaaaatccggcgattttggggttctctacatggattagaactataaatgattagtatgttacctatatgtgaaaacgattggttaaatgtaacggaattttcaccttgtccactctattgtcccaccacttattcatgttatctaccaagtccttccatgattcctctccggcttcacatgttgaaagaagcaagattgttaaagaaaattcgaattgcatcttccgagtcagagacgaaaagattagttgtcattccaattcatagaatactgcagattcattggtaagaaaactgtttccttaccctttggttgttttgcgtattttggaatatcaaacttcacgtctttgagctcggacaatatctctgtaggagcattgttaagccaaagcgcttgactcccgtctttcttcttgaaatcagggtgtttaggattaacctgtagacagagatgtcaagaaagaaaaagaaaggagaaccttagccaaatgtatcacagaattgtaacaaatagaaccactaagacaagtttcattaccgatccattctgtttcatttcacggtaatcacaccattcattcggtttatcaacaagatcaaaccaaagattagttccaaattctcttcctctttgaacgctagctaagaacaagaagatgaatgttcatggttataatcaattttaaacagccaaaccagtaaggatattacagtaaagaaaaaaaagaaacgggaatgatgcgctagacgcttaccagaatgctttagcacaccttcattttgatccaacgttggcaaaacctttggcatggctttagaaccttcaatgtagtggagatcacgaaccattacttgatgtgaaaagctaccatgaaagcttttaaacaactgaacatgtgcttggtcagaatttgctccagattgaatcacatctcctaaaatctgtccagtaatatgaacccgatcgtttttcttcaaataagagttagccgtatgagctaaatccccttcaaacagtaccggaatcctgatgttcacaaaatcaataaatttcttatcaataacaatatagtaatgcatcatcctaacaaacatcatttcaatttcaactcaataacagcccaaaatctagcaaaatggaccataggtactcaacaaaattcagaatcaaaaccataatttcagagttcatggcttaaagtcttaaactttacacgaaccaaatccacaggtaatcaacaaaattcagaaccaaaacccataaattcacatttcatggcttaaagtcttaaactttataagaaccaacctacaagacaatcaacaaaactcagaatcaaaacccaaaacttcacaaatcatggcttaaagacttgactttagccaagtacagagttacaaaacgacaatagaccaacatgcaaaactctaaaacccaaaaaagcaacaaactttcaaaagactaaccagaagttactagatgaatcagactcagacttggaatcagaagaaggttcatgagaaatgactgtgcctgcccagaattttccatcgagtgtagagtcgaactgaactggttggtgaacgtaaccaattaaatctatagagttcgcgattttgggttggtacggtacctccatcggtctcggccactcctccgacgatttctcagctctgtttcctcctcctcctccgcgagtacggctactactttccgtagaagaagttgaaagaaattgctgagaagaaagaacccatgattttctagcagttgaatttaacgaaggtcttatcgatttcgaaattgatcttccaagaaactgcatttcgtgaagattcaaacttttagccttttagggtttatggggtttgacgacaaaaaaagaaagactacgcctttttagattctcgggttcgtcaataaacggtgccgtttcttcacaaagtcgtttcgcggcaaaaaactaaacgatgtcgtttcgcgtacaatagtgcccttacgaaacgatgctgtttttgacggggctgatttagaaaacgtagcttttgtgagggttattttgtaatttatttttgtttagtttgtcacttcgccgtgcgcggcgggagagaacgctggcggaaaaaagaaatcggaaaactggagaaaccctaaatcgacgaaaaggagagacctttgaatcgaagcttggtgtgtttatactatg

SEQ ID NO: 20465 - DNA, 3000 bp, Unknown
  misc_feature (1)..( 3000): 2750-1469P.txt file - cDNA_ID_1826207; gDNA_ID_1620741; Annot_ID_49617
gtgtttgtaaaaccgtttattatattttatttgttgcataaaattataatttggtgtataagcacttaacttaacccttggtaacccacttccaaattagacttccacgactttgttttcacgaaatatatttttgcttatatattaaaaaattgtttagacgaaaatgcttatcgatattgttcatcacgttttgtcatgtttggtgatgttcatgttctcggttatattaatgtgtaaccgaaaacttacaaaagttaatgaaaatttacaattgttgtgaattacgccaaagaattttgaaaatttggagaaatcattacttgtaagtctacataattgtctttaattaacaagaagaaaagtatacaatttgttttgaaatttcttaaaacctttttgccaaatttgtatgagaaaattacaataataagtcatgacttatatcgaatttgtagtgttttttttttgtttctcgtttgtatcgggtacgatccagtggtagtgttacgatacaaagagaagaaggacaaagataaaatcataaaaggatagagataagagaagttgttgtgtatatacataaaatgttctcattcattaatgattgttaagtgtctgtatggagctgtaaaaacagattgtactataccggtcaaatccggtcctactcactatcatcatctaactccctcctttgtatttgtttcttcttctcttatcactgatttttaccactgtcctgtccttttccggtttaatctcggtttggtttagccaaatttgaagtcccaactaaaattcttgttctggtttttattgtctttatggtctagagaaatcataagaatcttcttaagactagcccgattctgtttcatccatccatattgggccaagaaacatgtccaaatcacattctttcacaaaaaaaaaaactatgagtaacatttagaatgaagagtgaaaacaaacaaattgtacaccattttattttaactcagttttattatgctctaaaccggaaaaagaactcttaatagaaaccaaacttagcacccttatgaatttgcaggaacacgagaatcaaagaatctaacttaaaagcaaaagcacaagataatcacaactcaaagcaatgtagtgtacagaagtcaagagtctctctcacttgtagagttgttccatgacactcttcagcctcaccacatcaacgcctacaatctctgctttcttcacgccacctttgaagaattgcagtgttggctgcattcatcaaattatcataatgctccattagatggatctcaaacattgataatattagagttcatatagatgcaaagctagctcgtgcttgatcctaaaatgtaaagtattttttgaaaggaacagaggatgttaccacagcagatacatttaacttcccaatagcatttgatagaccgccctgcaaatatgtaataagagatatctttgtcaacggagcttacaatgatactcataacaagacagcttatttgtgtgtggctcaaccacaaaatttctctactaagtgacttatgtcgcttttgagaatgtgatatcagtaaccagttacaggaagcataatgtagcaacatatctcagacttaacattagttgagttctccatttggttcgacatatcgactaataaaaggcatttgatagcagatactctaaaatcttctaaccacagaacagaacaatttacaatgatggcttcggtcgcatgatgacacttgtataaacctataaaagtcatgctaatgatgcaaacacacctcgtcaatgtcgaccttatacgttgttacatcaggatatttattactgagctccaatatcacaggagagataagcctgcctagagccaaaccatacaaaaattaataacgccacacgtagaaaagatttactatccagaagctttcatggaactaaaacttacaaggtccacaccatgcggcagtgaaatagaaaaccgatggcaaagatccatctgaaaaaaatgaataacatcaagagaagataaagcagagctgaatcatactaagcaactcatataattctgaagtagttaacaaaagaaaccaatgactgtttgtttatttacctcgagctttactcaatgcactgttgaactctgcttccgatttcaacactacaaagctggatcgatctaaatttcaaattacagagatcagcaaaactcctcaaacacaaggtaccattgtaccaccatcaagcttaaagctcatatttttcgattcaattcgtttctcaacaaataaaaaaaatcatctagacaatacccttgaaccaattcatgtactatgcaagaacaattagaattaacacacaaccaaattaagcaatttacctccttctgcaaaacagaagcttcttcgattaagaagagaagtgtttaagaagttgaattcgtttgaaacgtaaacagtagaagcagctaagaaagagtttctcccaatctgcaaaaacaacgagtttgggaatagaatcagagatggttcggaattgggggtctaagatcagagaaagatgaaaaacctgatgaaaattagaccattgactcttcatagtataaacacaccaagcttcgattcaaaggtctctccttttcgtcgatttagggtttctccagttttccgatttcttttttccgccagcgttctctcccgccgcgcacggcgaagtgacaaactaaacaaaaataaattacaaaataaccctcacaaaagctacgttttctaaatcagccccgtcaaaaacagcatcgtttcgtaagggcactattgtacgcgaaacgacatcgtttagttttttgccgcgaaacgactttgtgaagaaacggcaccgtttattgacgaacccgagaatctaaaaaggcgtagtctttctttttttgtcgtcaaaccccataaaccctaaaaggctaaaagtttgaatcttcacgaaatg

SEQ ID NO: 20466 - DNA, 3000 bp, Unknown
  misc_feature (1)..( 3000): 2750-1469P.txt file - cDNA_ID_1826234; gDNA_ID_1620741; Annot_ID_49610
ttgactctagcgccttagactagttacaatggtttgttgtaaaccattttacaactggtgaaaaaacaaattccactataatggtattttgtaattgaaaagtagctgatgtggcaaatttagtgttgataaattttaacatccgtgaaagtagaagggagaagataagtgtgacaagtgttatattttgattggttgctttgatttctaatatttttgtttcatcttaattatataacttcaattatttcataatatttatatatatttatatatatataatttatataaaattttataaattttcattctctataaacagagactattttcatttgatttaaatacagaaaaaaccatttttagacccaaaaataatgtataggttaaaatatgaaataaaaatggtggggtaaggtgttgtaattttattaaacaaaactattgtaagattaaaaattatgtaggtgttgaataatgatgtggaagagagagaaaataatgtggagtgttaaaagtgaaaaagtgggtgttataaataggtaatcattgtagatagtcttagactactcggccatcctaacgaggaccagaagtggaataatatgattatgtaacttactaaacattttggaaaaatatacaattaagcaagagttttgggttctttacgaaatattacacaagaaagtaccttttcttataaacacaagagagtaaccattagctaaaatgtacaattaaacaaacattgcacaagttgtagaaaaatgtaaaagcttcggatttaagcacagagaaacggcaaaacaagtgagagccaattttgcttcaataggagaaacgtagtagtggcagttttattttaaatgtataaattgaaacaaagtgtttttctcttgaagctgaacatagatggtttcacttttgtctcatgtaaatatggtcatatggattttgctttatccacaaggtatcacactttgaaataactaaaataaaaaatatgaatcaagaaaatcaataagccgctacatgtcacttccaaaattatgaaatatgagattcgaatctaagaggagtcttaaactgttaaacagagacgtgtttacagtcaagagaaatttataacatgggacaaattttattttattttatttaatagcgttacaaatttacaatgatcatattacataaggaggatacaaaagtagaagaagagctagtttaaaagtcccaagagtccaacactgattcatgactcatcgtctcttctatttctgcgcttccactatacaaattagaaccatcgattattttaacctttagtttttccaaataatctcttgagtttaatttaaaaaataatattttcaggactatatgtatacctaaacagtgacaatgatgtttctaagatttaaaacactttattaccgaaatatatctcaaaattttactatttcaaaacgttatgttgctattttatttttcaccacattttcgaaacattagcataccgttcaatcatttgaacattccattgttaatctattattattattacactagtcaaacttacttcaaatttatttatacaaaggggaatatattttatatagttagtaaaaatctcaataatcattaaaatagattttctttgacatatttccaaaattgttagattgtttgtttgtttttaccttctgaaaaatggttacctaatgtacgacgaggtttgccgggacatcgacggtaacaattctgaaggcacgtgatcggaattcttcctgtggtggcacaacctagaatgcaatcttcatggcattgagctttcgtctctccattgacattttccattgctataaccattgtcaccacaaacaccattataatcattgaattccatttagcacccatatctttaacttttttgttgttgcaagtgtttcatgtacttaagaaataatgaatagctatcctctatttataatcttttctaatagttatctaattcttagctcttatcgtctcttcttcttatttgttataggaattgctcttctttttttttcctggtcaaagtttctttgtaatagagactagttacttttttggttaatcttcttctgtttttttctctatttataatcttttctaatagttatgtaattcttagctcttatagtctcttcttcttatctgttacatggattccttttttctggtcaaagtttctttgtaagagagattacttactttgttggttaatcttcttctgttttctcacagtttattttaagttaatttgagattaagttaatttgagatttcattggacaaagaaaattaactcttgaaagaataaaaaattatgtcagaagtggggtttgaacccacaccctcttacgaggaccaaaacttgagtctaaggccttagagcatccacattggtcacttatatgtagatgtctttaaatataaaactataaataataataataaaaaaattatgaatgtttttagtttgagatttgtgtttctgtagagacactttaaacacaacaaaagtgaaatgtctttaattttattatttatttatactaaaaacatctataaaaagttgtctaatgaggttgctcttagaccacttgaccatcctaacggataacataaccaatactaatagtatcattatataacttactaagcattttggaaaaatatataattaaacaagagttatgggttctttacgaaatattacacaagaaagtaccttttcttataaatacaagatagtaaccattagataaagtaaaaataaataaaaaacagagaatctgaagatcgtagaagaaatcgagaaaacgctttgtaccaattagaaaccctagcgagcggaggaaggagacaaagaacgagacttttgagagattggagatttcaattttgagatcaaatcttgaaatcaacaaataggagaaagatttagtgatg

SEQ ID NO: 20467 - DNA, 3003 bp, Unknown
  misc_feature (1)..( 3003): 2750-1469P.txt file - cDNA_ID_1826263; gDNA_ID_1620741; Annot_ID_49601
atttagtttgttgaagaacttaaaagctttctctttttaagttcattgagattgagacaagtctttctatttgatttgttccatatttctgtgtagatgtagaaagttctgttatttacatatgtgacagaaatggtaaatatttggttttgattcattgttttgttttgcattagagtgttactttgcattaaaggtatggaacggtcaacaatccggtgtagcagcagttttagtagctgataacgtcgatgagccattgataacaatggattcacctgaggaatccaaagaagctgatgactttatagagaaactcaacattccatcggctttaatagacttttctttcgccaatactctcaagcaagctcttaagaaaggtgaggaagtagtcctgaagatagactggagtgagtcattacctcatccggatgagagagttgagtatgagctatggactaacacgaacgatgagtgtggtgcacggtgtgatgagcagatgaatttcgtaaaaaacttcaaaggacatgcgcagattcttgaaaaaggaggatactctttgttcacacctcattacattacatggttttgtcctaaagattatgtttctagcaatcaatgtaagtctcagtgtataaaccaagggaggtattgtgctcctgaccctgaacaagactttggtgatggatacgatggtaaagacattgtcttcgagaacttgagacagttgtgtgttcataaagtagctaaagagaataaccggtcttgggtttggtgggactatgtgactgattttcacattagatgttcaatgaaggagaagaagtatagcaaagaatgtgcagagagagttgttgaatctctaggtaagggacatcacaataatttttagtaccctttcttcacattcagcgtcttgagttttctcttattctcaggtttgccacttgacaagatcaagaaatgtattggtgatcctgatgctaatgtggagaatgaagttttgaaagctgagcaagcacttcaggtcttggctctcttcttaaatgcgtctatattttaccgtctttttaaaccgattcactgagattttttttctttgttacttataggtaggacaaggtgaccgcggagatgtcacaatcttgccaacattgatcgtcaacaatgctcaataccgcggtttgtttcattccttctcattgtaaatcagttaccgaaaagttaggattcttaagttctttacctgattttgttgctcaggtaaacttgagagaaatgcagtacttaaggctatatgttctggattcaaggaaagaaccgaacccgggatctgtctaagtggaggttatagaaattcccttgtaagcttatattcatgtgtggtaatagaatgtactaaagaagtcttgttttgtttacactgttgaaacagatattgaaacaaatgaatgtctcgaagcaaatggagggtgttgggaggacaagaagtccaatgtaacagcttgcaaggtacttagaaccgatgaacttaagggactacatttttatagatatttggttagttttatacctaaaaatggattctatcaggacacatttagaggaagagtctgtgaatgccctgttgtgaatggtgtacagtataaaggagatggatatacatcatgtgaacgtacgttcttcaacttctacattgatatcttgtagaaacacttcattataaacattttgtgttctgacttgaatgttataacagcttatggccctgcaagatgctcgattaaccaaggaggttgctggtctgaaaccaaaaagggcttaactttctcggcttgctcggttagttactctactgtgttatggccttttcagtaataatgccataatgtttgaaacttacaaattttctccaattgttgagttcagaacttggagacatcgggatgtcgctgccctccagggtttaaaggagatggtcttaaatgtgaaggtgaaaacttttattttctctagaattcaaaatctctcatcatgttttcttaaactgattcatctacgacatatagacattgatgagtgtaaggagcaatcagcttgtcaatgtgatggatgcaactgtaagaacaaatggggaggctttgaatgcaaatgctctggaaatcgtctctacatgaaagaacaagacacttgtattggtcagtaaagatctaaaacttttcagattctttttgaaacaatccaagaatcatattctcatttctttgtttttcgtttctcgcagagagaagcggatcaagaatcggatggttccctacatttgtgattctagctgcagttgcaagcatatgtgtaggtggttacgtattctacaagtatcgtctcagggtatgtttctccaaacattttttttcttctctttacttaatcttcaaactcattcatcatcatgaatctattatctatctaatgatcattattttgtgtcaaaacgaaaatgcagtcttatatggattcagaaatcatggcgattatgtctcagtacatgccattagagagccaaaacacaaccgatccaatgactggtgaatctcaacaccaacagctgagattaacttctgcagcctaattttataaatcttgaaaagatgaaatttttcttaaagagagctaaagatgaaaaaatttctttgtttaatcttgaaaaatacttctttttgggtcatttttattgactcttttcattcttgtagataagatatatgcattaagatttaaaaaggaaattgtattgaaagtggtaaatcaaacagctctttggtcatctcatacagagaatgaattggttggggaaatgtaacagtaaggatatttttatcataaacaaagtttgaggctttaatagaaaaacataagaaatttggggacataaatgaaaatatactaattgtaagattaagttcttcgggagaagtcaacgttagagaaaaagaagagatg

SEQ ID NO: 20468 - DNA, 3003 bp, Unknown
  misc_feature (1)..( 3003): 2750-1469P.txt file - cDNA_ID_1826275; gDNA_ID_1620741; Annot_ID_49597
gttcaaaaagcgaatccaattcacggtggcgatcacgttccatttgcataagaaaatcggtaaacgcttgtcgtcctcgtatcttcggagagaaactaaccaccggaaaattacttttctccgatgacgacgaagtgcaataaggcctcggcgttctgataatctcgagtccaccgccaccgccgctgccattatctccagcggttcgtttcttgtcttcgttgctaagcctccgaattaggtcagcgactcgtccccatttactttctccggaatcagaaaccaaaccatgtgacctagattcaatctccaccgttcgatcagcaatttcagaatctccatcgattgatgaagattctgaaagaccggaatcttgaacactaactcctgaatcgctccgactactactactcgccgtagattgactgctactcggcgagtttccaccgttggatcggtttagcctcgcctcccatatctgaaccaaagaagaagccacaagattgtcgtttctcttcgattctaacggagattcaagaacacgattgttcttgttattgtgagtttcgatccaagaatcaactaaattctcatcggagacatgagatttcaaaacctctttcaccggagatttcagattcttttgaaaaacgccagcgttttggttacgatctcttaagattaaaccgaatctctgaggagaagacaccatttttttacgatctaagaatcgaacaaacgaacataaaatcaaataatcattagagtttttgaatcgatcgaaagaagttagaggacaactctgttttctctgtctctctacaagaagaagagaaaatggatttgtgttagtgaagagacagatttttctctctgtttttttttcctgttaaagaaacagaacaacaacaaacaaacggtggagatacgatgatgatgaagaagcaaaacagaaccaaacagtatttgtgcttatctatttagtaagaggacttataaatgttaagagtcctaaaatggctctgttttgtcccttaaactggggaacgtgtctgtaaaacaaggcaataaagaatgaggtgtaagaatacagagaaagaaaagccttatgtggccaaaagtgataaattgttatagaaaaataaaaaagctacttataattttggacaaaattgaatttgaaagatattgtataacacatgtcattatactggtaaaagcatttaattgtgtaatgcatgaaaaaattaacattggattgttatactaattaaagggtgattaaattatttaataattaaggctcctaaatatgctagagtcaaaaaggagccgttgaggaatttagccgttgtcgagtgggaaccatgcactttctggattttatgccacatcataaatcaaattgaagaactaaagataacaaacaattttaaattgtataactgacaggaacaaaaacttttaagcaaagtaaaaataatttaattagagaaaattagatgttcaacccaagtttcatgtagtgtgcgattttattgtagtgtggtcaataggcccaggcatagtggtcaatgtcgtgcttgggttagtcgaatagagagagaacttaggacgagttgtgatttgtgactcttataaaacgatttaagaaaaaatagtctctatacaaaataacgataattgaaaccaataataaggttcacaaccgatcattttcggatcccgatgagttaacgattagtcaacgatagagtaaaacgaccgattaatcgagacttagtgtctatgatattggcacatacgacatatatttcgtatatatatttcaggtaactgggtatcgtttatattagttgcggcatatgtgataatgtattcttccacacttcgtatagctagctgacaatcttttttcttaaagtttaagtattaggaagtattatccggtagataaagaagatggacgattgaaaaagcgattgatacgatttttcttctgtgatttttccgaccggccggcgttggttccgacttcgattgtactcttttctcctttataattctagcaaatattagtttacatacatatatttcagttattaacaatgagttctagagaatcaactgcttttggttggcctcttttcacactgttggcgattttcatgacccaaaaattgagttttctacaattatttgtaagaaatataaattataaaaactagaaaaatatatgaaaaagtttaaggttttgactagtgagaatttgttgtatagttcaaaaaaactcaaaatttgaacgtttgaaaacttgttgagatgcatcaattttcaataaacgtagcctatggtgaattgtttttttttttttgtcaacatgtctctaatggacctatttttccgtgctaaaaaatgtgcagaggtaatatcgctatttttgttagaggatctgagcaaattcattattaatgattgtgcaaaaaatttgttaatttcgatatatcacattttgctttacggattactcgaaaacatactttgatgtcatcatccagtgtatatatacgtatgttaattgtagacaacaaaataaaataataatagtctcacataaccgaccaaaaaacaaacaaaattaaatcaatggaagttgttgacaaataaattttacaattaatctaatccaaataagtcaaaaccctgatttcagtaatgtaaagatcattatatcattttttctcttgtaaaaaggttttttaaaattatactattaatatatatcatttgatcaaaaaaaaattatatatcataaacattatatacgacatgcaggcaagtcactcgaatattcaaatcttaaagttgtgcctcccacgtaaaagcatcacattagtttccaaacccaattgtatatataaattactacacaacacacctctcatcaaacaaattcatcaaagccaatcaaattgagagagatatcaagaaagcaaaataatg

SEQ ID NO: 20469 - DNA, 3000 bp, Unknown; identical to SEQ ID NO: 5137
  misc_feature (1)..( 3000): 2750-1469P.txt file - cDNA_ID_1826278; gDNA_ID_1620741; Annot_ID_49596

SEQ ID NO: 20470 - DNA, 3003 bp, Unknown
  misc_feature (1)..( 3003): 2750-1469P.txt file - cDNA_ID_1826297; gDNA_ID_1620742; Annot_ID_49642
gagtggaataagacaagtccagactttgcgcaacaaaatggtaagctttcttctttcctgtagcatggggaagcatatagttttaagtcaaattctcactgtaaaaacatttctctgtttctttcaggtggatgagaatttgaaggttgtaattttgcgtggttgccacagcttagaagccattcctgatttatcaaaccatgaagccctagagaagcttgttttcgagcaatgcacccttctggtgaaggttcctaaatcagttggtaatctgagaaaattgattcacctggacttcagaaggtgttcaaagctttctgaatttcttgtggatgtttctggacttaagcttcttgaaaaactattcctctctggctgttcagatctgagtgtgttaccagaaaacattggtgccatgacaagcttgaaagagcttcttcttgatggaactgcgataaagaacttaccagaatctataaatcgcctccaaaatcttgaaatccttagtctaagaggttgcaaaattcaagagctacctttgtgcataggaacattgaaatcgctggagaagctatatcttgatgatactgcgttgaaaaatcttccgagttctattggagatctaaaaaatctccaggacctccatttggtacgctgcacatccctttctaagattcctgacagtatcaatgagctcaaatctttgaagaaactattcatcaacggaagcgcggtggaggaattacctctaaaaccgagttcactgccaagcttgtatgacttctcagcaggagattgcaaatttctgaaacaggttccgagttcaattggtagattaaattctcttctccaacttcagttgagtagcaccccaattgaagctctaccagaagagattggtgccttgcattttatacgcgaacttgagttgagaaactgcaaatttctgaagtttctgcctaagtcaattggagatatggacacactctatagcttaaaccttgaaggctctaacattgaggaactgccggaagaatttggcaagctggaaaagctagttgaactgcgaatgagcaactgtaaaatgctcaagaggcttcctgaatcgtttggagacttgaaatctcttcaccgtctgtacatgaaggaaactttggtctcagagttgccagaaagtttcggaaacctctcaaatttaatggtactggaaatgctgaagaagcctctttttagaatttctgagagtaatgttccaggtacaagcgaagaacctcgttttgtagaagtaccaaactctttctcaaagctcttgaagcttgaggaactagatgcttgcagctggagaatatcgggtaaaatccctgatgatcttgagaagctttcgtgtttgatgaaactgaatctggggaataattattttcatagtcttccgtctagcctcgtaaagttatcaaatctccaagaactttcattacgtgactgccgagagctcaagcgtcttccccctcttccatgtaaactggagcagctaaacctagcaaactgtttctcattggagagtgtatccgacctttcagagttaacgatcttgacggatctcaatctcacaaactgtgcgaaagtggttgatattccaggcctagagcacttgacggctctgaaaagattatacatgaccggatgtaactccaactactcccttgcagtaaagaaaagactttccaaggtgattccaaaaactccacagaatctcatcatggcctatttaaaaaactttcttacaccacttttgatttgttactgcaggcttctttgaagatgatgcggaatctgagcttgcctggaaacagggtcccggactggttctcgcaaggccctgtcacattctcagctcaaccgaacagagagctcagaggtgtaatcattgctgttgttgtggctcttaatgatgaaaccgaagatgacgactatcagctgcctgatgtgatggaggttcaagcccaaattcataaacttgatcatcacaaatgcaccaacacattgcatctctccggagtgcctagaacaaataacgatcagcttcacatctgccgatactcagcttttcacccactggttacgatgttgaaagacgggtacaccatacaggtgatcaaacgaaacccaccaatcaaacaaggcgttgagctaaagatgcatggcattcatctcgtttacgagggggatgatgatttggaaggcagagaaaatactttacccgagactcaacaaaccgtttctcagaaacttgccaattttttcagctctttcgaagaagaagaaggtgaaaccatctcagaaagtgaatctacagttatatgatctgctagtgcagataggttaagaaactgctcacaaataatcttaatcgatacaaaatgtttgttgctcatatacgatttggtgttttggcttttgtgtttttctttgttccttgtctctttagtctttaccttttgataatacaaacaatataaataaataaaaccaaaaagaagaggaaactcttgtttccaatgatctcgggcattctttaataacaatccaacagaactgtgaaggaatcttcttctgtgttttttgttttgacggcttccatctttaagaaagtcaatggatagaaaagaataaaatagaacatgttgcttgtgtgtcctatagcactaacgaaaaagaacactgcatctgcgtatcctttttgtctttcaaaaccttaattagcagtgtgtgccgttctgatttaagatagatatggaactgcctgacgttccggtgtggagaagagtcatgtccgttgtttgggattatataaaactgtttgcgtgtgatgtaacactaaagcctaaagactctaaactataataactatataacttctttactgattgtcgtgaaagagtttctgcattctttgaggcgttgactttcaatattgatatcgaagaagaaagatcggagataatg

SEQ ID NO: 20471 - DNA, 3003 bp, Unknown
  misc_feature (1)..( 3003): 2750-1469P.txt file - cDNA_ID_1826308; gDNA_ID_1620742; Annot_ID_49637
aaaaattaagattttttaaactctatatattatataatgatggtaaaaaattgtaatatatcaaactttttataagtttaaatattaataatgttttataaattttaaatatataaataataatatttaaaaaattaatatttttgcttataaggtaatgacataataactctaaaagcaaggatttagaagatttaaatatttaattaaatattttcattaataaataattaatgtcagtgacataacattgtaaataagttcaaatacaaaatttatttatttaaacaaaaaacgtttagtaagaataatatttatttaacaaaaaactttgttttaaaatattgttaacaaatatgtttatgctaattttaagggattgatttgaagttgggtgggattaaatttgattgataatgtgattgacaatttaaatcaaaaatttaaagtaaaattaattattttggaaaaaaaatttaatgctaatgacattaattgtaaataagtccaaatctaggatttatttgctaaaatggctgcaaaaatgtatatataaatggttcatggatagacttattccaattaagagaagattcaatttgttgaggagaatatccaatctaaatggagataaagactgggtttaataataaaaagttagatttagcattcgacaagttatttgatttagcacgccgtcatgtacttacttagcttgttaattccagtttgtcgtttaattcatatatgtatatctagtcataatctttctctttgcagctttgagttttctaaaggattttgaactctattaattcattaccacgaaagaacaaagactaggtaaatgtctgccactactattagataaccacaatgtaaagttaatacgttatacagttaacatagcattgtgaccaaacaaaagatcttgaggatttaatcaaagtcacgtttccttattatctttgttgaagaagtacatcttttgccattattatcttctatacacactcaacaaattaacaacaaaaacaaagattattttataaataattttcgtgttgtggtaaaaagaagaagaatgggcctctttatataaaagtgccgtttggcgaaagttttgggcccttataagttaagaaaacccaagtttttttattaataatgttgttgcttcatttttttaaataaataaatcatattacaccaagaattagttttaacctttaatgtttttaaatcaaaatatttattgtctccatatgctcctcaaacttgttgtatgcactagtctaattcacaatatgtgaccaatatttcaatctgtagtggctaccttaaattagggtcaaaatttttcagtttcgtttggcatgcagcttgatgatagtcttttagtgaaaataaaaatccgagttaattattaataaaactgtaaaaaacgtaattaactttaaatttttttggttgtttattaactcatagtattattacattatcttataagtttaatgttccttcttgaattttatcatatttatatatatttttgaaactattcatgtgaagaatatgaactcccaccaaattttagttaaaattccacaaccctaactcttttttttttggttattgtttggtcaactgtttcttggttttaaacctgaagcctaactttcatctcaaagaaaaactaagcaacatgtttaaattatttatttcacaatttcgaattcccttattagtgtatctaaaagatcattaacttagctaaaccaattacatatgtgtttaaaagattggacccatattgttattagttactcttcgtaaagcaaataccttttagcacatggtatacagatcataatcatgggttatatcattcttacccaattttatttcccacaattccagcaaacaaatcaggttttaaatatatcaaacactcaagcttatgtagtaaaacacaacaagttcaatatttcatatatctgaaattgtaatttcgtatatttatgtggtgtatatgcaatgatttgaaaatttgaatttggaaaatgagtagtgaaagcgaaactaaacgacatggacaacgactaaataaatgaactgtaattgggccaacgaaactaacgttccacacaccgacacgaccataaacgacgttgtcatttgtctaattgcaaaactacataaaataatggttcatgttctttataactttcaaaaaataaatactaatatcaagaaaatctagttcccgatttcttaaaataatgtttgagaatgtgtggtgggtatcacattcgaaaccacctggctctctttatattactcattaaaaatattactatgataaaaaatttactttttgaacttggaatttggtccaagaaaaatataaccgaaagtataattaataacgtcattagcggttatttgtatactaatttggagttttgcatacattacacattacaccaatgtgaacgtcctaatgatcaccgtttaagtttgtacttttttttttgccgttcacaattatgaatttaaagatgtcaactaaaatttaatttcaaagcttataaaaggacgtaagtttattacacaaacaatcacaaactctaattcctaataactattatacacatcgtgaatttgaaacatttttaagcgcaaattctcagcgagataaaaacgacgttgttttaatagttattggctttacaacttcgtcgtacacgccggttaccaaatatcgctaaggctcagaattatctctgttcaaagcttttgttttgttcccaattctgaagttttgaatcaacaaatcttcaataaagttttctcctttcactatctttccatattcttcttcttagtaaaactttgcattaatggcttacccaaatttgtaagctctttgtttcctcccttcttcttattctcttcttcattctccaaatttgtttctaggtttcttcagtttgagcaatg

SEQ ID NO: 20472 - DNA, 3000 bp, Unknown
  misc_feature (1)..( 3000): 2750-1469P.txt file - cDNA_ID_1826316; gDNA_ID_1620742; Annot_ID_49635
tctttgactgataaagtaagtgatgcacttgtttgcccttgcgttcatatacatttattttgctcttcttttaataacgatttgtgcaacttcgaatgttcaggcaatgtggtatcaagactggctttttgatattacgacaatttgggcattgagtaaagttgaaaaaacttcactagcacatgaattgctcgagggcctcaagtcccggtcagtactaccgctttctcatttgtgacattttttccaaatggagagttttgtctcttgacttatcatctggctaatattattactctaacagaacatccgctatgaacccgaagaaacaaaagctgatgcagaaagcgattctggtctgttcttgctgatcctgatttacaattatggagacttttttgagttctatgtcatatcataagaaccgtctttttctttctttcaaatcagcttgctgaagctgtttatgaatacgggaaaggaaactacgagatagctttagaactgcttggattagactttgacgctgctaactataaggtaatgcgatgttcttataagatatatgtcaaatcaaaacttattgaagaatacacagcaaatgctattgtctcttttggtgacgatataggtgattggaggatcgggtttacagatggatgtttttaatgaaatctggtacaagttgctgttactcaacggcaaatcttcaactggtacactcctcaaaaacactattatatccatatacttcggctatatcttcgttttctcagctactaactctgcgtttacaacacccgaacctgcagctattgaagtactagagaaggtgaccaaacagagagatggtgctcctttcttgtggcgtttgctggtaagtcatttatatgaccagacaagacaagttgattcatatacgtctacagtttatgaaacgttgactttcttttggcaggaagagagttactcaatggaaggcaaggaaaaagctggtataagtgcaggtaagaaagcaaaagcattggaatcttcatatttcaagtctgcttgatcgccaaaacggcatttgtcttgttgttttataataagtcaatggttatggtcaatgcataagaataataataattttgttaatataattgaaatttacattctattgactttgtattagtattttataaagatgtttatgagaaaaaaactactagaagaccattaaaatggatcttgaaagctgtatgttacagttagatatgttgttcaattgcgacatggaaacatgtctaaggattaggggacgcccatttctgcattttttatatgatttttaacatgcaacttttttttatcttaataaagatattttatattttaataataaaatgacttaaatcttagtcctatacacgagattatttcaataacattcaaagaaaaattgaataccacattattgatctccaaaatgtcaagtgactgtatcgcaaattctatataaattttttcaaaaaggctgataaaattaattatttttttcgaacatatatcttataatttacaccaagcttccaacattaatttcgtaatttaatatctaaaaacttgtaacttttttttttttaatactaagaggttctgaaccgaaacccgtaagctctccagacccgaaaccacatccacatcatgtaaattacatgcatcagtgtatcacttaaacaagaagtcgtgaaacttccatgaatttataaggttgatcttatagtgattttctcataccatataaaatacaccaatgaccagacgtctaatatgtttctgaaattcactataaacaaattagtgttaagacttgtagttacatgcgtcacctaaaaacattgaaatttcatgagttctccggaaaacaaaccaatatatttatttggtgtggaaggtacaaattaagaccgagtctctcaaagccctacgtcggccacataagccaaccaatggatataaaaaaattaaaaactcaactatgacatgttgccaaaaaatctgatatcaatacttttcggcttatccagaaagataggagtcacacgtatataacaaggcaatgtgttgtgtgtatctagatctatttatatgcaactgtttagaaaatgtactaatcctaaattattctacacaaatattcacaagtctacttcatgactttcttggttctatctacggaaaagagacaattctacacaataagcccacgcgctctacattacctcttcataaatacattcttttcacaacatttaatatgaagttttattgtagtattctgatttcttctatgattatataattattccattcaattatggagctacatataacataatttaactagctgaactgatctttcatcaatattacatgatcgtcatggttttcatgaatctatgagtttacatttccctcattaatttaaattctcaaatttacattgataagatttgaattatggtgcggatttatcgacgataaggtccatagactcattactagagggatcaaaagacacttatcagttatcacgcacacaggactgtaatcacatccataaaaccttatactataaccggataccggtttaaacaaagaaccaacattgaaccacaacctaagacattttctatcaaagtcttcacatcacgttctttacgcgcgtgaggtaaaatgttcaacaagttacgtaggtggaggagaaccttcgtaatactttttcattagtcttttcttcatttgattttgcgaaatttctaaataattgcgagctgcataatccctccgactattaacttacaaagtacccttttagccaggctttttctgtcttatttttttgtcattaaactatataaccaaacacaaacatcatctttctccttcatttcacaaacttaaaattctctgtttttgtttcttcttctttcaaaatctcaagcaaaagaaaaaatg

SEQ ID NO: 20473 - DNA, 3000 bp, Unknown
  misc_feature (1)..( 3000): 2750-1469P.txt file - cDNA_ID_1826324; gDNA_ID_1620742; Annot_ID_49632
cttatttttttctgcattatgtatagaaattgaaaaccaaatatttaccttgttcatttgtcaacattaggtcttatcacgaccaattttttgtgggttgatatagttattcagtactccattttaagcttataatcatgtgaacgtttgtataattgtttgaaatgaaaaatagatatagagagaacgtactagaattgagaagagggatgcgtaagcgatggtcttgaaacggccaatgtaggcgtcggagattaatgcgccgaggagtggagcaaagttagtgagacccatccacaagtagtatacgttaaaagcttctactggctccatgtgaaacacattcctcaaatacaacataaaatttgctgatactccaatcgatcctaacttctccaacgtctcattacctttattctcatcatttagtaagttttggtctcagcagataataacatatatatggtgtccaaaatatgaagcatcttttattatgaatggatggttctggtataacttaagttggaccgttaaatacaaatattcaattaatgtataaactcaagatctgtctgaaacttataactgttatatgcaaaggtttatgcctaaacaaaaacttgaaacggtcgaaaatataaacttgaaatcagataatttgatttctgattccatttctattgctactatatattttcttagattattgaattgcatgactcgcaaaagaagtttagtgtgctcatgagtcatgatattagcatggtgttggacacaactaccgattaggaaagaaaaaagtgatggcatatcattgtaggtattgtcaatgaaatttaaatttagagaatcatagttatgaaacgtatatatttttaactttgattgactgtttgttatctttagatatcaagaaaattgatatatgaagaaaaatgtgttttttttggggtgatatttcaagaaaatgtcatattgtgtaagtactctatctaaaacaaacaaagatgtgaattacaagacaacaaatacctaatcataaatcgatagaacctgaaaggcatcaatgtggtcggtccaccataatttgttaaatgcatggctaaaatggctattcatttaatagtttaccatgtttagatatatttttttgaatggaccatatgaatatttgaggcaaatggaagattaataattctcttcaaagaaaaaaacattattggaagaaacgaaatggaaagaaagaacatacctaggatgaacgtaatggctctccagcctccaagttttttctctggcaaaattttccgattctcaacaactcccatctccggcaacgacgatgagaaaaagctatgggaaaggttcgaacaagtaacaacaagatgaagaagatgttctaaaaaaaaccaaaaaaaatgactaagaagatgaattgtgttttttcttcttcttatgaacaatctcaaagtttagaatatacaggaatattttgaagttgctttttgggtggaatggtgtgatcagaaacaatatattctgactaaggcactatccacacacggcacaacttttcaactggaagatgaggatgatttcttatttatagacacagattgagaaagagagcgagagaagaaagttattctctttcccttgttattacacatataagtgtggatctcgtttcacttattagaggttaaagtgtaatgttataaatatatataagtttattgacaatttaaaatgtcttatttgaatggtgagttgaatagacttatatatttgtatgtttccaagtccaattttaatttacaattagtaacacaattaatcatctcgtaaagtttatggtatataatagtagtgttgtgggtggctatagctgatgatatttctatttagtaaatcaaattatttgatatatatataatcatattatcggttttgatgtgatttccgaccaaagaaatgctccacacaatcacacattccctcaagagtctctaaacatttcctaggcaacctaaaaactgaacactagaactttgcaatgctagagatcatacaagttataaataacaggaatacaaatttgatcataaaagttgtatacccttttgaaaatactcaaaattacacaaggaatgcaagaacattattaccttatcagttcattatacacgttagctgattaaaatttcagttcacgaatctttcgagatatgactcaaaaagattcttataaaatgtttataattcacaaagttataacaaaaattttaaaagatttcgaacaataaaatcaacaatcgaatgagaataaaacagaccaaaaatgggcctataatcgctgccaaaaagggcccatcatataaaactgcgattttgcgcccattttaccgcaagtaaaaataatgatgttaaacagtcaaattgataaaaagactagagaaacataaaaatgagaatctaaaaagaaacttaacagcaacattgatgatcttaagaattcgattaacgtccgaataaagcatacttctttcattttcggaatcagattgaaatataaagctttggtttttgtgcggtcacatggcttctttagattactggctggcttgatcaaatcacgtactagctagtggatcactttttcccagaaggtttttgttcgttgcttggtattacctcttcttcttcttcttgatgaaggccgcgtgaatagagcgcacacaaagtgttcgtcgaaatgctccaaccatggtctctatcaactccggccccatttcatcttttgtttctcgctattcgatgattgattccgatacccttttgcatctttcttcttttggttcaacttttaatcccaattataaggccaaagcttgcatacgttttgcaagaaaagtttgtgggtctactgttctagggtttcttgaggtgaagccgaggaagaaaagttgttgttctcgttgtaatggggtttcgaggatg

SEQ ID NO: 20474 - DNA, 3003 bp, Unknown
  misc_feature (1)..( 3003): 2750-1469P.txt file - cDNA_ID_1826332; gDNA_ID_1620742; Annot_ID_49630
atcggagagtacaagtctacttctgcactacagcatgtttgtctttcgtcaatttttattaacgtatttggcaattcgacagctcataacatacattattaagcgaatgccacaatttaagcaaagcagataaaacagcgaccctagacattcacaactacgaatacgacgggccccacttggagataataatgcggggcccaataaatcaaactcttcttacatcgcaaagcggtgcacgctccttggtcagttagattttgcaacataggtggtgagaaacgattttctaaagtcaactgatttgggtatcgatataattaatacatacatttatgtgtgtatgttgtaaatgatcattaagtatgaaactatgaatgatgaaactatgattagggtttataatatatagtatgaatgggttaaagcttgtggttgactaattttaatatcataaaatgaagattgaggaagaaaagtgaatatttattaaagtaccagaaactcgatggaggcggagatgaggaaaatgacgaatgtggagaagaaggcgtcagcaaggaagccaccgaggagagcgagaaggaaggctgtggccatgaaagtggtcacttcactcgacgatctggctagagacatgtgcatgaagttcttgagatacaacaccaagttgcttgcgttcgctaaaaacgctagattctccaatatctccaccgcttgaaaacacatgcacatacacaagaaaaagcaaaataaaagaaatcaatcacatgattcccaaaagattaatcaagactagagaagttaaggaaaaaggggtaaatttggaattttgagactgacccaagacgaaggaggcggcgagcattccgccgtgacggcctctcaaggcggctttgtttctccagtcagcgtagccttcccatttggagacatcaccatgcatttctacttcctgtatttggaaataatcaaaattaaaagactttagaaaatatctatttctctaaatagaaactaacatcagcaccccaaaactgatgtcttgttcttaaacaactaaaaattgcaacaacaaaaaataattagaatgagaacaatattagatgcttgaagaacccaccatttgatttctctctcaaattttgatgagaaataaaggtaagggtttttgaagtatataagtgataagaagggtgttttcggaattacaaaaagtagattttaagaaccctaattagtaattagattttaaagacataaaaatgataatttaatcaagactcgataaaaaaaagtaagcaatctcgtggaattttctgaatagtagactcactaagatctagtattattaaagaatagtagattttctgacatctaataatcaataatacacttctttaactaaataacaaaattttctagaaaaagagagagagaataaggttttacaacgtaagtgtgacaatgtatattacaaatagagaatagtttttcagtctgttatctgaatctagacgagacagcacatttttggattttatttatttaagaggtttagctttgagtttgcttactgttaatagaggaggatatgcgttacaaaaaaaaaaaaaatccaaattgaccaaaagatataaatctaaacgtgtcattactcattagtgtgaactgtgaagacctaatggttatattacatgctacttgatttcatcgtagtaaattggctttgcaaaatcgccaaatgtcgagcattaatacttttttggcaaatgtctccatatattaactgttcactttttatatacatgcatgtaaataaatgttaaaatacctctgatagtttcactttcacccaagaaagaattacttataagattaaatttaaatgtatatatattataaatttctataaatcaaataaacctaaagttgtgattggcccattacaatacagaaaccccatttaaggacccaaatatatcgtagcccaacctaaaccagtaatagaacctaatttcgaaccacacaattcccatcggagagtctgcattggttagtttgtttcttataagaacaattgctgatatttccattctaagaaatagcaagcaaggacttaagcagaggaaggcttcaaggagatcacaaagctccacgaaaattacgaaaagaaggaaatgttataaacaatgatgagtttaaaaaacaaaagagatgttaagatagttaccactttatatgtatacgaagtgataaataaaatctgatatggcagaatggagatttttcattttgtttttattatattgattagttccgaaatcaaaagctttatagcctctataacttcatcactcattcccctcacgatatgttgtcgccaaggtgtgaaatgctaaatcatacatatttttgggattgtcaaatttataatttctatttgtttccgtcacatagcatacaacccaaacaagagaaacaagacctatagttttacgtcaataaacaaaagcaagctaatacttacagcactggacattcacaattttcacaaaaccaaaccaaaagaatctgatgtatacggaaaaaaaaaaagaatgggtcacttttaaaatttcttttttcgtcaaatgtaggacatatgtattgtttgtgtcacttaaggaaatattgtgcccacttgcaatataaatagagacaacaaaggtgattagagagcatctccaatccaacttgcgaaatcattcacaccatttaaaaaacaaaaatcacacctattgaatggaaaaatgtaaaatcaatcaccttaataattattaaccacaagtataatccctattatagcaaaacagcacattcgtctccttcttcttaccagacactaaaacaagcaaaaggaatcgttttttctttctcttgtaacttttatgtttcgtcattctacaatttcttctttataaaaagtgactcttaagagtcccaacattttcagtaaaaatg

SEQ ID NO: 20475 - DNA, 3003 bp, Unknown
  misc_feature (1)..( 3003): 2750-1469P.txt file - cDNA_ID_1826332; gDNA_ID_1620742; Annot_ID_166492
tgtaaataaatgttaaaatacctctgatagtttcactttcacccaagaaagaattacttataagattaaatttaaatgtatatatattataaatttctataaatcaaataaacctaaagttgtgattggcccattacaatacagaaaccccatttaaggacccaaatatatcgtagcccaacctaaaccagtaatagaacctaatttcgaaccacacaattcccatcggagagtctgcattggttagtttgtttcttataagaacaattgctgatatttccattctaagaaatagcaagcaaggacttaagcagaggaaggcttcaaggagatcacaaagctccacgaaaattacgaaaagaaggaaatgttataaacaatgatgagtttaaaaaacaaaagagatgttaagatagttaccactttatatgtatacgaagtgataaataaaatctgatatggcagaatggagatttttcattttgtttttattatattgattagttccgaaatcaaaagctttatagcctctataacttcatcactcattcccctcacgatatgttgtcgccaaggtgtgaaatgctaaatcatacatatttttgggattgtcaaatttataatttctatttgtttccgtcacatagcatacaacccaaacaagagaaacaagacctatagttttacgtcaataaacaaaagcaagctaatacttacagcactggacattcacaattttcacaaaaccaaaccaaaagaatctgatgtatacggaaaaaaaaaaagaatgggtcacttttaaaatttcttttttcgtcaaatgtaggacatatgtattgtttgtgtcacttaaggaaatattgtgcccacttgcaatataaatagagacaacaaaggtgattagagagcatctccaatccaacttgcgaaatcattcacaccatttaaaaaacaaaaatcacacctattgaatggaaaaatgtaaaatcaatcaccttaataattattaaccacaagtataatccctattatagcaaaacagcacattcgtctccttcttcttaccagacactaaaacaagcaaaaggaatcgttttttctttctcttgtaacttttatgtttcgtcattctacaatttcttctttataaaaagtgactcttaagagtcccaacattttcagtaaaaatggaaaactcagacactgattcagaagttttcttttggtttcagaaccaaaaccaaaaccatagccataagtttccttcttcttgttttcctccgagctctcactctgctttttatggtatatctctgttcctccattctaattttattttattttattttcttgaaatgcatctttttcacctttgacgaatcttcatccccaaaatgtaaccactcagattaaaagattgtcctttcattttaaaagagtttgaaaagaatagcaagaactttgaagaacctcatgtgacgacataggtcagattctcttctataaaatttgtgtcattcctcattctcttcttaattcaggatctagctcaatgatcaacacagagactgcaactatggacgaagaagacgtatgtgagagctacatgatgcgtgagataaccaagaaacggaagctaacaccgatccaattgcgtttactagaggagagtttcgaagaagagaaaagactcgaaccagacaggaaactctggctagccgagaagctagggctgcagccaagccaagtcgctgtctggttccaaaacagaagagctagatacaagaccaaacagctcgaacacgactgtgactctcttaaagctagctatgctaagctcaagactgactgggacattctctttgtacaaaaccaaaccctcaagagcaaggtacagtttcttaatagattaacaagccactattttcaagagtctgttcaaaattttgatgacacattcaaacaggtcgatcttctcaaagagaagctgaaaatgcaagagaatcttgaaactcagtctattgagaggaaaagacttggggaagaaggtagttcggtgaaaagcgataacacgcagtacagtgaagaagaaggtttggagaatcaatacagtttcccggagcttgcagttctcggattttattatgatccaaccttaactgcttcaaatctaaggttgtgatagtgtaggtcaacaacgttccgtgtgcctcaagttatcttcgctgtctccatcctttttatcttagacttcatattctaagaaagaaagcagtaataatattcattgatggaataaaaatgcattgtaatttaagtcgttaagttatatgaactttttatgaaaatggaaaaggtcacaaggccatattttcagtgactagataaatgaaaagtgcatgcttttcaaatgatatggacgttttggtatttacctcaataattcgtatgctacattttcatataaaccaagagaacctcgagattagaaagtgaacacattccaattagtcaataattcagcaaatagtagaagaaagtagaattgattcatttgagaaaaggactggcactatttgatatatacagtatgctgataatatatattaccattatgcaataatataaaccttatcacaacaaatctttatccgaaccaccaccaatggaagatgttcaaaactcagacaagaacctttgaaagtcacgtgtgcggatcagatgactcagatccaaatatctgacgtcacagaacctgcgagctccgcacatgtaaactcctgccggagttcatctaacgacacgcggcaatatgtgtgtgggttaacaaatgtggattttgtggggtccgctacctatctgttatacactcggatggacagtccagttactatgtgggccttgaggctatgttaatccggcccatttagcttaaccccaatttaatttctatattttcaaaggtagaaaaaaattgaagtgacacagcgaagttcgagtatg

SEQ ID NO: 20476 - DNA, 3003 bp, Unknown
  misc_feature (1)..( 3003): 2750-1469P.txt file - cDNA_ID_1826340; gDNA_ID_1620742; Annot_ID_49628
tagttaagtcggtggacaacgaaaagatctcttacgaccacttctttttcaggacatttaaggtatgaatttactcttcaaaaatttggtgaaattgtgtgcaggaggatctaaaaccttaacaaattggtcaaatatattgattagcaagttctttgcaaatacgattatagtaaatctacctatttaacaattaaaaaagtggttttatacttttaattgatgcctttgcaaatatatacttttcttcaagctcatcttgtaatccttgagatcttctaacattaacggcatcaattaaaagtataagcgctaaatggttttaattttatacttttatgtcagcaatttttgagacctgttttttctattttaccagtgtatttgttagtgggctcaaattttttaatttttctttaggcccgaaatacttggggccggcctgattgtataaattgattttttcttttttgctttgggggtgtatgggtttaggtcgatggttatggaattgattccctggcgagttttttcatggattatggatataaagttggaggcagacttgattttccaaagaagaaagtacaagttctctggctttctcctccggatgttcacttccccgataatggttacggtattggcaatggccctttgccaagacttgttatagctgagcttcttgtggaggaactaagccctgagtcacaggtattagtgatcacaaacataatgttgttataatgagtctttaataatacataataacttttttgttggtcctaatttctggttaactaggagataataaggaagtatttgaaaccggaaggtggtaagcaagctgttctttcaagtactttggggtctttaatttgggagaagccaacatccaccgatttcaatcaacttgccaagtatatgttctaagtttataatcaataatcacacagtatctttgatggttagctaatttaatttttgagttttgtaaatttttataaatgatgaagagaaagcgaatttgccgcatggacgcttgtctacggctacacaatgaaccatcttgctttcgcggttcatcgtcttaaacaccgtttcagcgacatcaaatgcgtcaaagagtattttgaagaaaacggtttcgaactcaacaaggatggaggagtcctcaaaggttttctttacttattcttcacatgacatctttcatttagattggttctattctataaccattatttaagttgtatggaaaaatatttcagtgagtgaagacagtctactgttacaagtgtcggctatgtcggagaaacttgtggttgaatttgcagacggagtaactcaaatcgtcccggcttcatacattgagttcgttgaacgtctagttcttccacagttcaaagatatgccgtgtgatgaggtaagaagcaattcacattaatcgaattcttttataattagacatttttatatatttccgttgtaatgcagatcaaagagtttcatagacgcgagggcttggagcaagctagcgcctaccacataatggaaagcacccgtttcacagcgtaaatatagaaccagcttgttttgttccgctcaatatgtcaagtatgtgtacgtactattaaaatgttttgtatcttatttggacaatttgtgtgtgagatatttctgttcttgtgttgtgaagtgacggtataacttaatattacccgttaccgacgaataatggaaaacaaagtgtcatggtggggtgtggtatttgtggtgtttttgcatgtaatatcttttgatagtaacgtgacacttgattttggtgactcgtaacacctcttggggttgaagaccaacgtgcccaatctttcatttaccttagtgtcttcttctttttgcattattggattttggtgtttcacgtagagaaactgacatcacattgtcttttgttagtttttttttgtgttgttaaccttaagtgtttttacgtagttaatatatcttagagaacttaaccttttcatttagctattattcgtttataattatagtttggatctaaattagtctaacagttgtattatgtgttttagaccatcgcattcctcgatcttaaccaaatatcttaacaattatttacaataaaattttgaaacatgacatgtaactgttttttcactcataaaaacctcttagctaagaagcaagtctttaatttttaatttgttttgatttatttttcagaatttaattttaagatattagtctaagatacatttaagatacatcattgaagatggtctactaattagtagcttagcaatttccaaagttggtttaaggatcaactttttgtatcattttatattagtgatcaaaatagttacataccaaaaattatttatttcatttaatatagtttttaccccccactagctctggaaaagtccaattatattcttgtcgttagcaatcattgatccttggctttttttcccactctttctagctgtataaaatacgaatttacgataagatattagaaaaaccaaacaaagctgtgtttctctcgtacacttaaagcatcgtcccgcaacggttctcttgacttgccaaacgtttcataattaaattttttctctaattatgatttacaaaaacaaaaatcacgataatccatgatctaactataagagggagtaagagaaacatttcacttggtttttcttactgagtactgatataaataaatatagaatcagacaaagattcgtttgctgaacgattttatataaatttagtccttacctgcgcagctaatcatcgtgagcggagcgactatgcgtcaagaaaaaaaaactaaaatactaataattaagtgactccttctctctccttttttttggggtatgcaccaacctttatttataagtataagcaagaataaataagaacaacaaagcaaacggctcatttctcagaaacaactcaaacatg

SEQ ID NO: 20477 - DNA, 3003 bp, Unknown
  misc_feature (1)..( 3003): 2750-1469P.txt file - cDNA_ID_1826343; gDNA_ID_1620742; Annot_ID_49626
aagtatctatatgaaccaattcaaaagctttttcacgaatgtgattcacagatttaaaaggtaaatgtttctgttttgataaatggcaaacatgacaatgagaagaatctttattaatcttttgtttaggtaacatcaaaacatcagaaagagtatcaatctttgcaaaagaagggtgacctaaacgtttatgccacatttcagattcattcttaacactagaacatacagacttaccaggaaaagacgacacatcaacaagacttttatccagattcagaatatataagttgccgacttgactacctttgccaagcatcaattccttggtaagagcctgaatcatacattcatcagatgtaaaactcactttagattgtaaagttttagttaaaacactaacactcaaaagattaaatttaaattcaggaataaacaaaacattgtgtaaagacaaagcatcagtgagttgaataaaaccagtgccctctattttaaccgtatggccattagggagtctaacaaaggttctatctaaggctttgtaagtgtggtataaattcctttcatgagtaacatgatgactagcccccgaatctataacccaagctctaagagacaactcagtttcaataggtatagaagaggttaacatttcataataagtagagtcatataaagaaaggaatgtaccagttatctgtgagatagaaggtacgggatttgaacttgaagctatagccttgtcaaaacatgaagtgatactaggggactggagcttagtgcttaagtatgagatcagttgttggatgtgatcattagacatagtctcatgtccagtggcagacatagtcggaggtgcctgagtctcaatctgatcagtactagccaagtttgtgcttccaacataagtgttctctttggctcgtggatgacctggaggatacccgtggactttgtagcacttgtccacagtgtggccaatccggttgcaatgagtacattttggtttcttgaagttaccttgagctagtagaatagtgttctgatcattgagaactccttgagtttgaaaagcagctggacttggacttggaactgattttgcagcaaacccaaccaaacgctgactttcatcttgatctagcatattgtagatttcattaagccctggtcgtggcttcatgttgaaaatttgactccgaatagtgttaaaatcatcactcaaacccatcaaaaattgtatcactcgacttgtctctgcctcttctagcagctccttcacttggtcacaatcacatttctttacactgcgagactttgtgttagcaagttgttcccacaaggtcttcttcttcgtaaagtatgtagagagatccagtttgccctgctgaagagtcatcacagcttgttcaagttgatacctcctaggcaaattgttcaccttaaaacgagtaaacaaatcaatccaatttcaacaccatcctcataatataagatactgtcataaatctccttgttcacaacattaagaatccatgacttcaccatactgttgcatctactccagatccgaaaagtagaatcatcaacagagggtcgcaacaaagaaccatcaacaaaacccagcttgtttttcgcatctaagctaattctcattgcaatcgaccaactgttatagttactaccatccagaatatgagctacaatagataaacctggatgatcggaggaatggaggagcagtgggttttcaccagagtcagaaaccttaaacccatttccaccataaacgtccgatcgttgagctagctgttgtttcagtgtcgtgagcttctgatcttcaaggattgctgcttcacgaacagatctgacagctgaaccttcatcatcaggtgtagaaccgcgagtcttcatttttcctcccttcttcaccatttttcttcaaatccaaggtcgcggaaagacaatcggagaagaaagaagatcagaaaaggtgtgattaagaagaaattgaagaaacgatggtgaaaatcaccagatttgtgtgaggaaatgctctgataccatattagaaatcatgaacaaagagaattgtagaatgattttctatttcctcgaagaataaatgtgttacaatgagagtatatatacaattactctaaaccatctaaaccaatgtacaatctctaaatagctaaaccaatctaatcaaaccggaatactatatacaatctaatagtataagagacaagagcttaggcagtcaaatgtttgtgcaagtttaaggcgaaatcaaaaagagtaaggaagcgaaaaaagagaagaggaaacgagaggagaagctaatggcggtgatacatcctgagagaaatgcaaagaagaaactcaagttagctgcaaagaacaaggctaacaagaaaagaaggattatgagcaataaaatggatagatggtcacactcttaagctcccataaccacattaaaccatttttgtttatgttaacatagaaattattatttgagattagactttttcaggtatttatgatccatttttggtctgttacaatccaattctaaaccattgcatttaacttgtttcttagcagaaaaaaattccgacatttatttgattacataaacttaaaagagataaactttattaaattatgattactaaaaaaaatatttaacaagattatcaatatgattacgtctgttaaaaacaaaaaaggaatttgccacgtggcgacactaaaattacgtaatgttcaagtcaatcaccggcgatgtggcttttctcgccgcgagttgaggcggttgaaattgagtttcgagacgacgtcgtttccaagtaaattgcactagcacgtttaaaaaaaaaatgcaataagaaaaataaaccatgagttcgtcttcttaatacctaaattaaattcgatttttgagacaaagctcgacaagtcgtcggcggcggtgtaaaaatagtcggagctatg

SEQ ID NO: 20478 - DNA, 3003 bp, Unknown
  misc_feature (1)..( 3003): 2750-1469P.txt file - cDNA_ID_1826359; gDNA_ID_1620743; Annot_ID_49665
aattgaattgaagaaatgaagaataatgaaaagaatatgtttaattaggttgagtatatgtctacgtcatgaaaataccctaaacggctctaaaaatgttgaactaacttcaagaaaaaaagaatgaatgagatgaaaatacattcttcgaactttttatctttaccttattcatttttttccttctcatttatgcttttgccttttaccatttggagtgtgtttgacaacaatgactatccttttagtaacttggaggaaaattcatctcaactcaacaggtgatttcttagaggaaaagagaaggaaacatgtttcttcagctgacaaattggaatcccaatttctcatttcaaagatgctttttgcttacgtctttgtgtttttctatatattaaaaaaatgattcccaaaaataaaaaaaacgattccctaaataaaaaagaaaagaatattagcaacggtcacaaacacgatttgcatattggaatggaaggccctcatgacgacgcttttaactattacgttcttctcacgtaggcccactaacactccattacccctttcatcacttcttcatatcatatgtttcttttttattaatttctgtcaccaaaattagacctcttttttctgttccatttacaccaaacttctacatttcatttcttttttctttccaataaaatgtatctaaagttatatatcatgttaaactattttcaaatccgttggaatccatcaaaaaatatgtaagaaatgctcaagccatcgctggtcgccccttaattgatgtgtatgcgtcatcgtcttatatatagtggtcatttcttttgtttacgtctcattgttgtcatcttctagacaagaaatgacatctatattgtcatttcattgatgcatcatcgattcatcgtcttatattggtcattacatatgtttttttacgttttattgtggtcttcttctaaacacaaaatgacatctatattttattgcaaaatttccttacgatatatagttattattaaattagttattatcgcaaattaaggtgcttttcttatagcatagaatgtcacaagagaagaaagatagcaattatatgaatcacaaaactaccgtttttagctacgaatgtgtttgaaaatgataaatgcattacatagatgtaatgttttcatgtagttgattgccctcttgtctttattgcgaacattttgattgttatatcacatgagtcattcagaagagaaaagaaaaattagatgtaactggaggtgcgagcgacggcggcagccaacgacccactttatcaatttttatttgacatgtctccatcgaaattgtaaactattgagtagtaaattctactacgattatttcatgactaattacgaactatcataaacagatattccccttaacattattatcgatacataaaacaaatattaaagctaaagctttcttcatacaaagcaatctcctaaagttagagacttttgttgcagcaacaaacttatatatattagtattttcaaacataatgatttaatactatggttataatttgttaatatagttaaggagttactcaacaatctattagtcaagtcttggaaaaaaaaaaatctattagtcaagtcaatctattgtacatttgtacatatctactacaaattttaaaggtaataacaaattagttcaatacattcttatatcttctctttgctagttcaattcttcttattggcaattagtaaattgacccccaaaaaaaagtacattcttgagttttaatttgttttttttttaaaaaaaaatcttgagtttaaaaccatctataatagatctacatttatttcttcttctttttattcataatataataaataaatgtattgtgtttttttggataaagcatttccatcttcttaattacatgtctattgtgtctactactgcaaatattattttaaaatactatcattaaacattaatactaggaagccaaacaaattaatctgaaaaagaacaagacagagtgaagagcacaatgatgggagccacatggagacagaacatatgcttgcatccaaacacaacagcagccatatgcacagctcttagccaccttggctttcctttttttctttctttcttttagttactgtattcctttttcttcatattatccatttccaaaatgtacatctttttttttaataataatatatggtatttattgtttatgatcacgccataattgactttcaaagtaaaagttacatgaaaatttattataaaatataatttcctatttttgctgtaattctaagacaaaattgacaaaaattagattttttttaatttatatccaaaatatgtttttcttattttcggcgaatttatggatgcttccataaattttcgtattcacatttaaaccagtcaaatcctataattattaattaattaaacactaatcatcattacattttgtagagggtatttttgtcttacaaaagtttccacacttgcacaacgcataaccgttgtaattccaacgaaattccagttctacccttggaaccttcgagcaaatctttaagacggcggccaaaaatgtaaataaagtaaaaatatagggtccacttttataataaaaaaaaaagaacaagaacgtgaacgatccgcgcgagccacacaataaaggtttccagcacagagaagagagagagagattgcttaggaaacgttgtcggacttgaaaccagtttcggtaccggaatttagaaactccgttcaaatccggagccaatctctaaaggataaagcttccaactttatccattaattggagaaaattctcagagagactgaagtcgacaaagtcagagggtttcgttttttggcttctgggttttttatttcaagtgttcaatttccgaattaggtaagaaagttaggttttgagatctgtgcgaattgtgagagatg

SEQ ID NO: 20479 - DNA, 3003 bp, Unknown
  misc_feature (1)..( 3003): 2750-1469P.txt file - cDNA_ID_1826382; gDNA_ID_1620743; Annot_ID_49657
taatggataaagtgcggaacagacattatcaggtgattaatcttaactaagacctcaaatctttttggcgattgtagcaataactaacatgctcttcttcatatgcatttatatggtaaagctcgcatgcaccttaacctttgaagctgtttatggtacatcatgtgatactggtatcaaccatcccaaccaatactttgaagaaagtcagaagattctgaaatccaagactccagctgctccggtttaatctccttatggtttcaatgtaatccgtgacataatattaaaaatttaaatctttaagttgatgccaaacctgtttgatgatagtaccatgtttttaaaagccaagcatacctatatcaagaaaaaaaaacattacgcatatgttaggcatatgcttccttttgttccaatattgtcatgttgtgcgagtttaaatcatgaacatgtttctttaactattcaaagaaatcaatgaaactgaagtgaatctcttactcacactatgactgacacatctatcctcgtgactttttaataaaatattcaactgtatgatataagatttgaccacaagccattgttattgtagttattatggttgttgttgctactactatcttagatgtacatttttgaagtggacaatgtgagtgaaggtgaatatgaagagatgttgagagtggagagaagtaagttctctgttgagttacgaaatttaatctcttggatacactgtaaaaaatgggaatatctagctagtaaccgcggttactaggcgaaacttctaaattacattagaataataatgtctattcaaaatattttggggtatatttcatgtttatttgtttttttctagaattttctcttttatttttttttacctctgttttttaagatgaaaatgaaaaaaattataactactaactttttaatatattaaaatctgtaacataaattaattagaggatgtacctctcattttgtaggtgaaccacttaaaattgtacatattgtttgttttttttttttgctcaaattgattttatgggattgggttttgatccaaattaatccttaaattacactttattaaatcacgtttaactaaatttgtatgagaaaactattttatccgtatgcaaataccaattctcaaagagttaaattatgtgtattttgaaatatttgtacttcaaatatgcaacaaaagagaggagagggtcaccaacatgtaatttattacatgaaagcaagaaggacaagattgaaccgaacttgacagatataaatgattaatgatgtaagttcttactatatttatatttctttgtttgcccaacatcgtacaaaagaaactgctagagaagataatggaatatagaataattattgatggtaggtgatcataattaaataggaagcattgaagatgacaatggaggaaaaacattcaactccatagtatatcgttaaatttatgaacaagctgttgaatcgagttttggaacattatttttcacaattttgggaaacattgtgattatgattcgtgaatgcggttgtttctctctttcaaagcataataattaaaagatagatacttagattttgaaagaatgttacggacgaaacggactaaattcttagtaaactagatcgtaacggattctatttttgggatgtacaataatttgcaggggatcaactttatttttatgtaaaagactaattgatctgtagtgaatttttttcttttaaaaagtacattactacaatagagtatatttataagtgataaataaaaatagtttaatcaataaacatatttatccgctttaactatggtaaccgttaaatttttttagagagctaataatgtcaaatgtatacgatatttaatttaggtgactttaaaaacttcatagatccaaagattaatcttcaggtccaacaaatctatgttaaattgttcgaacctcaatgaccaattttactcgaacccaaatagtagaaattacctctttttaccattgtaccaaagctacttggttcaacacaaaatatgtatagatcacatatttgttgctgataatttttttagtatatcaattcacaaaatagtaaataaagacatttaaaaaaatgcattaaaaataggacaccaatccaattttttttttgtcgatatatcttttgacttttgttacatctcaataccaccttttttattttgtcatgttcttgaataaaaccttatcacccaattcctaattcaagaaaatgctatgcagccaaatatcattttcttggacacttttttctcctttactttgatgtagattacacaaagaaataataacagattgtcaattgtaccctcaagtttttcacaggcaaattgtactacttttaatcgtcgtgccgacgtgctaatttctctacgtacactacacaagtcaaaagtcaaacgacaaagggctaattccgtaattgtcgtctaaaccaccatgatttcacacatgttaattttaatttattttaatttatttttgccgactccatagaaataaaatctgcgacactctaagatcatgccacgtgggtatcaattatagaagaactaataataaaatgagtagcgtcgcagaggataattcctttacctgtgacatagcaaccatcttcgtggctatctgtcggaaccctcctgctaatccttcagattctttatttcgtcagtccatagtcaaattattacaccttcttttgtctctatcttctcttcttctttgtctatcgtactggtttagcaactcctgtctgtctcgagctccgatccttatctctcttccgaaccaaacttgatctcatgtttgtcttgatagattgacttactctacttcaattcgtcaccagtcgttatgcaatctggtgagttttgaggggtttcttcattttcctcgaaagcatcaaactttatgtatttcgatg

SEQ ID NO: 20480 - DNA, 3003 bp, Unknown
  misc_feature (1)..( 3003): 2750-1469P.txt file - cDNA_ID_1826386; gDNA_ID_1620743; Annot_ID_49656
atcatatcgttaaatattcatataaatcattcttcacatttcacttaagatgatgccaatccaatttgtgtagcacaagttaaatccagataaattttttcttatacttgtattttttaaataggcaaatgtagaagctaggcctcttaaaacattatgaaacaaagagtaataacgatagaatacataatttattttaatgagaagcctctggatatagtttatattttaataacgatttttaaactcagatcgaactatgcggtgctccaattaaaagaagtatcgaagaacgaatatttggcgcactctagcaaaaccggtcaccaggctggtcggtcatgttagcggcgttaggtatctcgaagtgccagagcctacctacggagttgaccttatacttctcacaaaggaactcattggcaaaagcgttctccactttgcggttaacgtcatgaaggaagacgtgagtcgtgccatcacctttccggttacgtgccatgatggccgaggaaaatatcgccgccatccttcctggcgcctctgggaagtacccttttggtgcgtccaccatgatcagatcccactcggtatcatagaactcatcagggagagaagtcaacgccaagggacacttttcgttgtagcggatcgggaaagctttagctggtaaacacatgggttcgttcttgtaagtcgagagaaggcggccggcctcagaaaggtgggtccggtactgaacatggtgggccctgagggatggggcgtccttgaggacggcctctatccactcaggatcctcttccaagaacacagttgtgccacctggattgagggaggcccacatgagggagtcgcggccgaggccaaagactagaaagttacaagggagacgctccttgaggacgtttaaagagatcgagatctcctcgaaagattgttgagggacggtgtgtgaagtggcgtagtggacgatggattggagttggattggggtggctgtgtatttggctatagacgcagctgtgttcttagccgtggagcagagtgacaaggtgttgtccgtagctcggatgaagcttgtgatgagcattgcgccacctataagaccagctagagccacagcgaggaaccatggccgctctagaagcgtttgctttgcacctttagacttgtcttgaatcatgtttggtttgctttttggggtttggcgagagaggctgatgagtatatggttatacaaggtgaagagatcggatgagaaagtggagaaataatgctaatggtagagtcaacgaatgtgaagcacgtccgtctcaatcattaatggcacgtatgattgatcgatcctcgttgttcttttaatctaatttactcacttctcttaaatatagatctcaactgatcaaatatagtttatttccattttaatgaaaaaagttttaaaagggtaatagtaaagatttatagcaatttaaattatgtaataaattatcaaattttgtaagtaaatttatgacaaaaaatatcatcatacaaaattaaatatcaaaagaaaagtgtactaaaataatgataaacatagtagataatagataattaaccatatataatcatatatactcacatatccaacttagtcattgcctgcacatacagaataaacctttcttaccagcaaacaatgaatgtaaataaaaagacattcttaagagaagaaagagatacttacccttataagaccctgctttccaacctcaatttctatcgtacactctgcttcccagcctctaattctatcgcaaatgtgtgatacacttgtccaaaacagcctcctcaccttcgtttttcacaacttactgcaactcatccaacatatctccaatctctatcttcatcccatgcttgaatagagatcgaattaccttagccttgctgattgacgaactgtattcatattactttatggtaatcaactaatggtattacaaggtgagtttactcttattatcatattcgcacctatatataaagcaaaaaagtttaattaacagcaagtacaaaagagattatcatatatgacaaacagtattacacaaatcacatttgccacaatgaaagtataaggaggctttctttaaaagcaaaaacatacctcatgatgtatactatttattaactaatgtgtttataagatgtataatttctatatgttatccgatttccatcctacaaatctacaatatagacaacaaaatataaaaaattttgtattacgaaaaataggcagaagacaagaaatattatttgactttttataaaaatatacaaactcttaagaatcaaatttattcaaagttctggaaaatctctttaaaatttttgtctgctgtttttctatattgtctgtgattggaactttcaatcttgaatttgattttaactctagacatgattacatatagctgaccaaaataatatattcatttgatgtaggttagatgattattttttttttaaaaaatcacaaaacaatcaacacaattttaaatttttaatagagttttggaagttcaagattgaataaaattaaagtccatttatttttgggtcaaaaacattaaagagttttttttttagctctttaaaaaccaataaatcttcttggtttaaagttttttttttttttttttcatatgagagtaaattagtatattttcatttttatttttctcgttaaaatataaaaacatcttgagctaatttcacctcctatttctcctaccgtcgaactaaatcctagggcacaggtgaaatcgccgagtgacgtctagccaccgcaccgcctccttctccggttatctcgctactaatcagactattccacagctatgtcacaggtaacaacactgcccactatattccttgttcccgtcttatagtgaatatcgcagatctgacactgaatcgtcaccggagctttgctttgtgattgattctatg

SEQ ID NO: 20481 - DNA, 3000 bp, Unknown; identical to SEQ ID NO: 4894
  misc_feature (1)..( 3000): 2750-1469P.txt file - cDNA_ID_1826413; gDNA_ID_1620744; Annot_ID_49682

SEQ ID NO: 20482 - DNA, 3003 bp, Unknown; identical to SEQ ID NO: 16466
  misc_feature (1)..( 3003): 2750-1469P.txt file - cDNA_ID_1826416; gDNA_ID_1620744; Annot_ID_49681

SEQ ID NO: 20483 - DNA, 3000 bp, Unknown; identical to SEQ ID NO: 4890
  misc_feature (1)..( 3000): 2750-1469P.txt file - cDNA_ID_1826434; gDNA_ID_1620744; Annot_ID_49673

SEQ ID NO: 20484 - DNA, 3003 bp, Unknown
  misc_feature (1)..( 3003): 2750-1469P.txt file - cDNA_ID_1826442; gDNA_ID_1620744; Annot_ID_49671
cttctcgatttcgaagtttctgattattttgtcttaaagatccgaaatctcgatgacccggcccgttttatggcaacagatctcaatttccgcgttggattaacgggctgctaaatcactattttaaggcccatttaactaaagttggatttacgtggatctaaaaaagtctaaagataagtgaatgtgtgaatcacggattatatgtgagtaacgagaaaatcataatgaatgaaaaactttgaataagtgaattaatagctgacaaaaataaaaacaaggtaaatatataaacgacaaaacaaaagcagaattatgtttttataactggttaagtggttagtataaatgtaggaaatgaggagatggacccaaacacaagaacaataaacaacaaaagtaagtaggtttccatgtttccttggagcttttctttttgttaaccaaaacttcatttgttctcaactcttaactcttaatcctttgccttaatcatcattcattttgtttctctaaagtctaatcatacaatctatcaccatcgcatcctcttagtatttccttaaattttatcaaatatttccgcttcagaactttcctattaaatcttatactgtcttgataataaaactttatagatactttcataaatatacatgtaatatggttttaacacacatatatatacataactatttatatgatctgtattagtttcttgaaacgatattgtcaagtgttattcatgagattttacgtttcagtaaaaatattgttcgtcttattcattaacatgttattcttaagtttacttacatagagataatataatactcatgtacatttgatttagacttagaactcaacatttcgaatatagtataatatcatctatgattctatatatgtatggaaaattgaactacaactttagtgtcttgatagttgggcatgcatcatccaatccaaggtttcgatttgcttttacaatgtcgagaagagctagatcctatgtaattatgtattggctaccaaacaaatcacattcatattcgctaaataaccagttaaccactaactattttgttttgtcggtgaatgtcaaggattacgcaaataaagaatcatataagaagaataagattaagggagacgcactattatagttttcaccaaaagtggatacattctcctcgactaactccccgaaaatgtggagagaagcacccagaccaaatgggcccacttacctctccttagggatacttttgtctttttcatagcaaacggcaaccaacattcaacgtagctgcgccaaaagaataaaccttccctactagtaaattaccattgcgtgacctcgtgttagcccggacaacctgaaccggccagctcagattctaatttatatgttagggagatttggaaattgattacaagtgaaattgtaatggcaaggaatctatacaatgatattaaaagtaatcaaaccaagaaagttataaagtcaatattattcatatctaaacaaatacctaatatcaaaaaacaaatgctgcacatagctaattgaataagaaatcaatattgatcataattaaacaattaccaatttggtcaacaaacaaatgatgcacttagttatctaatttttttatttgtgtttaatcataagtttttagataaagtggttcaaaccatatactgatatacgcacgtaaagatttgtatgttgattagccaataagcttacttttatataaagtataaattaaccaaacaaacaacttcttcacaatagagaattggaaatctaactatgcaatattgatcacaatgaaagtacgtacgacgaactaaaattagttctaaaacatagaatatgatgtaatccactcccataccatatagtagttttttaaaaagaatacaacaaaaacaatttaagttcgaatgtacaaacaactgcatggggaacgcctcttcactttttttttttatttttcttttttcctaagcatcaatagagttatagggatgcctcaatttttttattttaaagtataaattgttgttaaaaacaaggaaatagaataaagtataaagtatatatttattaataactccaagaaattaaagtgtttcctttatatttatatagatgtaattaatttgtggtaaaacaattttaccgtcgagtgtctgtgactccgtcttcttcttcttcttctccctctcacatcgtcgtcactttctttttggctattcttctctctgtcatcgctgtctctgacttcattgtcttcctccttcttcctttttgcttttccgtcgtttttctccgccggatttttctctctccaccaccactacctacctcctcctttgtctcgctggaaattgtttccgagctcaaaattaagttcctgaagatcgggttctagtccttttccatctcggagaagcgtctttagatctgggcaagcactgccatcttcaaattttttaccttttttctccttctctatctctcttcaccaactggggtttggttacgggttaaattgatggtttccgaggcggctagaacctcgtgggctcttgtttgtagatgatgaacggtccttcgtgtaaggatcgaagagggtggttctcttctgctctgtttttcacatggaatggcagatcttgtgacctatagtaatgccgaccacaaccttgaacaggttcttctgctcactacctttcatcatttcgattttgctcagtttgggaaagagtttatttgttctaagcagtagaaagctcaaatctttgattgaaaaatgtaatctaaggagtttatggattgaaacccaagtttaaatatttgagattttgtttgttcaaattccagcaaatctctaagtctttctcaaattcttctttgtaataccaaagagtcaattagctggatttaaaatcaccattgagactcattacttggtgatgtaaacgaatatg

SEQ ID NO: 20485 - DNA, 3000 bp, Unknown; identical to SEQ ID NO: 4888
  misc_feature (1)..( 3000): 2750-1469P.txt file - cDNA_ID_1826446; gDNA_ID_1620744; Annot_ID_49670

SEQ ID NO: 20486 - DNA, 1694 bp, Unknown; identical to SEQ ID NO: 4887
  misc_feature (1)..( 1694): 2750-1469P.txt file - cDNA_ID_1826452; gDNA_ID_1620744; Annot_ID_49667

SEQ ID NO: 20487 - DNA, 1694 bp, Unknown; identical to SEQ ID NO: 4887
  misc_feature (1)..( 1694): 2750-1469P.txt file - cDNA_ID_1826452; gDNA_ID_1620744; Annot_ID_166563

SEQ ID NO: 20488 - DNA, 3000 bp, Unknown; identical to SEQ ID NO: 4922
  misc_feature (1)..( 3000): 2750-1469P.txt file - cDNA_ID_1826456; gDNA_ID_1620745; Annot_ID_49717

SEQ ID NO: 20489 - DNA, 3000 bp, Unknown; identical to SEQ ID NO: 4922
  misc_feature (1)..( 3000): 2750-1469P.txt file - cDNA_ID_1826456; gDNA_ID_1620745; Annot_ID_166646

SEQ ID NO: 20490 - DNA, 3000 bp, Unknown; identical to SEQ ID NO: 4929
  misc_feature (1)..( 3000): 2750-1469P.txt file - cDNA_ID_1826460; gDNA_ID_1620745; Annot_ID_49716

SEQ ID NO: 20491 - DNA, 3000 bp, Unknown; identical to SEQ ID NO: 4923
  misc_feature (1)..( 3000): 2750-1469P.txt file - cDNA_ID_1826464; gDNA_ID_1620745; Annot_ID_49715

SEQ ID NO: 20492 - DNA, 3000 bp, Unknown; identical to SEQ ID NO: 4927
  misc_feature (1)..( 3000): 2750-1469P.txt file - cDNA_ID_1826468; gDNA_ID_1620745; Annot_ID_49714

SEQ ID NO: 20493 - DNA, 3003 bp, Unknown
  misc_feature (1)..( 3003): 2750-1469P.txt file - cDNA_ID_1826498; gDNA_ID_1620745; Annot_ID_49699
aacccttctttcatttgatgatgatcagcaactcctcctcctactgcattgttgtcgtttccatgtgacatcacttgttgcaaatttacctttaaggcattaaccacagattcattgtattttgctttgtaatgccagttctgagcttccactgccacttgttttatcttatccacgagttcccggttcttcttgttcatgctttcaatctcatggtctttctcttgaagcttcttactcacatccttctctaaggccgtgacaaaggacgtgacatgtctctgtttaatatctctcacacctttcgccatttgatctgcctgttccaagagagaacaatttcaacgacatgggatatgtaagcaaaaacatacgctttgtagataaaattaatacccggaatttgataaactgatcaagctcgtcgttctgtctattgaggtccaatctgatattgtcaccgagtgactgatagactggagttgttatgcttccatttgctgaagttacagaagagttgcgctcatcatcatcataagatagtctcagaccagttgacactaagttctgctttgggacttcatcttgaacaacagtattattgttgttgtagttataattcaaagagatctgcagcttctgctgtctctgcataatattgttgttttcagtttcccttccgcgtgtgctattaagccgcatcataggagcaaggttatcattagcaaagtagtttacaggatcaatagtacaaccagctctcactgcaaccacatacaaaggaacaagcttttagctctataaagttctaacaacattcaaaccaaatgaataacaaaattcagaaacttactcgtcccaagcaagtgaagctgattcaacgatgtgtttgattgataccgaaactggctgtcgttcattagaacctgcggcacagggttatcattgttgcctcccaacatcttctctagagcttaaccgttttatgtgtatatatatacccgtaaagaactgaaacagaaaaattacagtaagaaacctgtagacatacgaaactaattagttgtaagatatgaaagctcaaatatcttcagcttttgacatgacgagccaagatgtaataagatttaactgtcctaagcaatacagattacaatccaactagagacaaagttgagatctttgaggaaactatggttcatgatcaactcctatgtgatgaactttctttgatcttgcctaggaaccaaatttagagatcatggtcaaagattcatctgaatattaaaccaagtaacaaaaaacaggcaaaataaattattatgtcaaaagtgataaaataaggcaaacctctggaacatggaagaaagatagcaactccaaagaacaagacataacctaaagatcttgtaagagagaagctaagagaagatttgtacctgttagagattgcccataaaaaaaaataaaccgtagcttccttcagatcctacaaacctaaaagaaatcattatcacaggctcacagcgatccaagtttgcttatttgcatcaattaaagtttaaaaaacaaaaaaaactgtaaaattaagaagtcgaagagaagctaaatcaatcaatgaatgattcagaatcttaagaagaagaagatgggttttgatgatagaaacgctttgaaacaataaaatccaataatttaattcaaagattttaaatttaaggagaaagaagaataaaagaaacggatgggaaaaaagaaagaatgaaatgaatgatggaaaggtgagaaatcagcagaggacaggacacagttgtgaaggagtgggaggagttgggtggcaaagtcgagatattaaaaacaaaacaaaaacttgaaaaatagactcgaaaataatactaacattttttttttgggagatgatgataacaagaatagtaatagtaaccggtggcggtggtattggttctgctgatttccccgtgagttgtgccttctctctggtgtgacgccattttactctacttttctccattttccctctgtcctttttctccttttctatttttttcttcctgaccagttcaattcttcttcttctttttttaaataaagaagagttcaaacttttaaaatgggcaacactaatttgtttgctaatttacgatagggacccaatgtatggtcgtccggtttagtctttttgttttttattagactaaactaaatttgaaatcacatgtggtttgttatttatctactttcgtgtttgagttgattggaactagttttggttttagttttgtttagtttcttggctcattcttctggttatcttggtatgctataataaaaaaaatactggagtgagaaccttcaccattatgggtttgaactgccataactaaatttggagaatatgattattcagatcgggtttgtttagaaatcgacatttctacttatatttggaaaagttatatagtagaaaatcaaacaaaatgtcgaatgttatatttctcgtttcatgattttctatatatctcatttgtttaattataagacagattgtttagttcgttcttttcgtttactgttttctcaaatttgttttgtagattttttttccatattcggcgaccaatcatataattatcttttaactaatatgtggttaattaaaaaataaaaaaatgtcgatttggttcggacttaagattagaatttcggtttggtggtaacgaaaattttaaaagtcagaaatcaaccaaactccggttggacggttcagccgcttcggttcggacttaagccatgccgctattagaaaaatggatgtttttttttctagtattcacacgtgtccataaaccctaattttccagttttatgaaattgaagaacgaaattgaagtgaaaagtgaaatcgtgcaattttcatcttcctcttctccttaaaccctgatttcggattctcacaatcgaacttggctgcagagaaggatg

SEQ ID NO: 20494 - DNA, 3003 bp, Unknown; identical to SEQ ID NO: 20493
  misc_feature (1)..( 3003): 2750-1469P.txt file - cDNA_ID_1826498; gDNA_ID_1620745; Annot_ID_166626

SEQ ID NO: 20495 - DNA, 3000 bp, Unknown; identical to SEQ ID NO: 4913
  misc_feature (1)..( 3000): 2750-1469P.txt file - cDNA_ID_1826502; gDNA_ID_1620745; Annot_ID_49698

SEQ ID NO: 20496 - DNA, 3000 bp, Unknown; identical to SEQ ID NO: 4910
  misc_feature (1)..( 3000): 2750-1469P.txt file - cDNA_ID_1826514; gDNA_ID_1620745; Annot_ID_49693

SEQ ID NO: 20497 - DNA, 3000 bp, Unknown; identical to SEQ ID NO: 4908
  misc_feature (1)..( 3000): 2750-1469P.txt file - cDNA_ID_1826530; gDNA_ID_1620745; Annot_ID_49689

SEQ ID NO: 20498 - DNA, 3000 bp, Unknown; identical to SEQ ID NO: 4908
  misc_feature (1)..( 3000): 2750-1469P.txt file - cDNA_ID_1826530; gDNA_ID_1620745; Annot_ID_166611

SEQ ID NO: 20499 - DNA, 3003 bp, Unknown
  misc_feature (1)..( 3003): 2750-1469P.txt file - cDNA_ID_1826550; gDNA_ID_1620746; Annot_ID_49734
cttgagttttcccaaaaaagaaaagattttggtatgattttcccacgtgaaacaatattgtagattaaaatagtagtgtataatggtggcttagtgagtttggttaatatcatttttcacatacccgtagtgagtttttccttgtcgtggttaagtcaggcggcttagccgcagtgctaaggttaccatcagtgaggcgatattcatgcatgatccaatctgtttttatccctttaggaggctttccaccgtaaaaaacaagcgctttcttgacaccaaccttgtgactattgcacgtaaatatcggtttatcggttcccgttgctttccaataaccggaagttgctgcccggtttggcctaaccccatttggatacttccgatcccgaggactaaagaagtaccactcgtgctctccaaaactcgccttgcctaaaccattcaaaatattattatccacaagatagttactatatataccaaatttaaatagtggctagattacagtggtcatagtaaaattaaatcgtacattttaatcatatcattaaagcataaattaggaaatataaatacttggaagctcccaaggatcaaacttgtaaagatcaatctctgcgatgattgagactggaagtggaacagaatctgctttcttcttgaggtaatgaactactagttcctcatcagtcgggtgaaaccgaaacccgggagggagatgcggatggcccggccctatgctcgaatcccccatgttttccatcaacttctaatttgatataatgacgatattttcacgaaatcagtctcatgatcgtcaagagaatatgtaggaaaagtatagattattttggagagtgaatgtgtttcatataagatgcgagaagaaataggtgttaggtttgtgtgagcatatgagtaccgaactgggtccctcgacgaggaaattacacgtggctaatcgtagggcccaaaattagcggccaatgggcattaaattttggagaaaaggcagggttttttcgaactgccttatgtcatgcctttcttatgctacacatcacgcacatacctcattttggtttttgtgtaagattttataaaaactagaaatgtgggaattctctataaatatattttaaaaaattatcgtgttaccaaaatgtgtttttcgttcgcaattgaactctagtaaactatgaagataattaatacaaagaaaatccaaatagtcgactgtagtagttatatatatatatatatatatatatatacatgtataaactttgggtactagcataattttccaagttagtaatattatcaataatcaagagtttcaaattactgatgatgtttttaggaatcgatcgactcgttgcatggaactacacgaggtgtacgaagattcttcgtcgtcgaaggacattgttcaagagatatggtgaggtgactttatcaggagtcaggagatatgaggtcatggggtctgctaggatgttttgttacatttcggtggacatcactaggacgtggtataaaaagactggctcaccttgatatagattgaatctagtggacctcatcctatagtagtaggcccggccataggcatgcatgcgatgctaagactcaaaaggtaaggcccatgatcctttcatctaaattcctttgaagcctaactttaagagtttgggtgatagaattgaggatttgcttctgagatatggactaggctaggattttaggcctctaatggctaaatttttgagaaatttcttcttcttccccctcttcattcttgtgagttgtgacaattctttttgacactatgttagcaaactctccaaattcttcttcttccaactgttccatgagaggattcgaggagactcatatattagtattacacacggttgtggttcagattactgtccactcccagcccagcccagccccgacatctcgaacattaattctatatatatttcgtctcttttttttctgtacgaacaaaatagtttagtatttcacttataaaattaacgagagtaaaaactacgatataatacaaatggccattaaagattaaataaatataaacatcaaaacatatcaaagcggactggttagttatgttacgttgtaccacctttttataactttttttaaaccgttttatttatatataagctgttgactaaactgaaaacatcaaaacatatatcttcctaagaaattggtgtgtctatttaaatttaatatctgagttaatatgaaatttaattttattgatgaatttgtattttgatttaatatctttattctagatacagttggtcatttctctttgcttttactatgttactttttgagatggtgaccgtttcaaagatgtttacacttttacttacttctttcaacggggtttagtataaaaaagaacaaaggaaaagtagcgaatactttttgacgcaaatataactaacaaatattttttgattcaaaagtatatgtacgtctttgaaggtttttttttaatcttttcttcaaaccacacgagaaaagacaaaaatgcttgcaagtcaaagataagaataaattcactcgtttcttgaagtattttcaaatagacactagtattttcttgaagtccaaatgttagaaaaagaagtttgaattcttccttgagtattagcgcgagaagaatcacaatttttatgaatatttacaaaaacaaagtggcaaaatatccaagatccgacatggagttctcggaccttattcacaaagacacaaaccatagctaactataagcgtaaaacgatcacttataaatatagagacacatatctatttcttactaatctaaaatcatttcttcttccacaatactaaaagcaattatcaaaaatatatcaaaaccagtcttcatctctaaatcactctttcgcttaattcaatcatttcatttcttcctcgtctattcaaaactcttcgatg

SEQ ID NO: 20500 - DNA, 3000 bp, Unknown
  misc_feature (1)..( 3000): 2750-1469P.txt file - cDNA_ID_1826554; gDNA_ID_1620746; Annot_ID_49733
accaaataataatttatgagatataagattgttatttctatattgcgtgtatgatttctaacaaattcgtaaaagaacctgtaatcaaaaaaacagtcgaatgttttataaaataaaatgctatgtttttattttaagcaatcctaatattttaatatgtaaaaatgaactatatattgcattcatatggttaaaaatgataaatatatatatatatatatatatgtatatatatatatatataatgtagaaaaacaagagcatacccattagatgtatcaaacgtgagtcctacggtatattttgcttcctcgagagccaattgaaacctccggatctcggcagctggacgtgtcttgtcgtcttttacgcagagttccgatggcttgacatcgcaaaatatagggatgactcttttcttgttcttcacgagcaatgcgagttcatggagacagaagtaagagtcacagtaacgaggagagaaaaccgcaataccaaccccgcatgctttgattgccatgtcgatctcgacaaaaagcctgtctccaggctttaaactcttactatccaagaaagcagtcaaacgttgtctagtgaaacaatcatatagtaggcctgaaatagtcttcttggtatcgatcccacgatgattgatgaaaatatcacatgggtttgggtaaggtagggttggatttgcaatgtatcttgttgtgtatgcgatttttgagcaaggtgttaacaaacgttgcatcgaagagttttgaatagacgaggaagaaatgaaatgattgaattaagcgaaagagtgatttagagatgaagactggttttgatatatttttgataattgcttttagtattgtggaagaagaaatgattttagattagtaagaaatagatatgtgtctctatatttataagtgatcgttttacgcttatagttagctatggtttgtgtctttgtgaataaggtccgagaactccatgtcggatcttggatattttgccactttgtttttgtaaatattcataaaaattgtgattcttctcgcgctaatactcaaggaagaattcaaacttctttttctaacatttggacttcaagaaaatactagtgtctatttgaaaatacttcaagaaacgagtgaatttattcttatctttgacttgcaagcatttttgtcttttctcgtgtggtttgaagaaaagattaaaaaaaaaccttcaaagacgtacatatacttttgaatcaaaaaatatttgttagttatatttgcgtcaaaaagtattcgctacttttcctttgttcttttttatactaaaccccgttgaaagaagtaagtaaaagtgtaaacatctttgaaacggtcaccatctcaaaaagtaacatagtaaaagcaaagagaaatgaccaactgtatctagaataaagatattaaatcaaaatacaaattcatcaataaaattaaatttcatattaactcagatattaaatttaaatagacacaccaatttcttaggaagatatatgttttgatgttttcagtttagtcaacagcttatatataaataaaacggtttaaaaaaagttataaaaaggtggtacaacgtaacataactaaccagtccgctttgatatgttttgatgtttatatttatttaatctttaatggccatttgtattatatcgtagtttttactctcgttaattttataagtgaaatactaaactattttgttcgtacagaaaaaaaagagacgaaatatatatagaattaatgttcgagatgtcggggctgggctgggctgggagtggacagtaatctgaaccacaaccgtgtgtaatactaatatatgagtctcctcgaatcctctcatggaacagttggaagaagaagaatttggagagtttgctaacatagtgtcaaaaagaattgtcacaactcacaagaatgaagagggggaagaagaagaaatttctcaaaaatttagccattagaggcctaaaatcctagcctagtccatatctcagaagcaaatcctcaattctatcacccaaactcttaaagttaggcttcaaaggaatttagatgaaaggatcatgggccttaccttttgagtcttagcatcgcatgcatgcctatggccgggcctactactataggatgaggtccactagattcaatctatatcaaggtgagccagtctttttataccacgtcctagtgatgtccaccgaaatgtaacaaaacatcctagcagaccccatgacctcatatctcctgactcctgataaagtcacctcaccatatctcttgaacaatgtccttcgacgacgaagaatcttcgtacacctcgtgtagttccatgcaacgagtcgatcgattcctaaaaacatcatcagtaatttgaaactcttgattattgataatattactaacttggaaaattatgctagtacccaaagtttatacatgtatatatatatatatatatatatatataactactacagtcgactatttggattttctttgtattaattatcttcatagtttactagagttcaattgcgaacgaaaaacacattttggtaacacgataattttttaaaatatatttatagagaattcccacatttctagtttttataaaatcttacacaaaaaccaaaatgaggtatgtgcgtgatgtgtagcataagaaaggcatgacataaggcagttcgaaaaaaccctgccttttctccaaaatttaatgcccattggccgctaattttgggccctacgattagccacgtgtaatttcctcgtcgagggacccagttcggtactcatatgctcacacaaacctaacacctatttcttctcgcatcttatatgaaacacattcactctccaaaataatctatacttttcctacatattctcttgacgatcatgagactgatttcgtgaaaatatcgtcattatatcaaattagaagttgatggaaaacatg

SEQ ID NO: 20501 - DNA, 3000 bp, Unknown; identical to SEQ ID NO: 4941
  misc_feature (1)..( 3000): 2750-1469P.txt file - cDNA_ID_1826557; gDNA_ID_1620746; Annot_ID_49732

SEQ ID NO: 20502 - DNA, 3003 bp, Unknown
  misc_feature (1)..( 3003): 2750-1469P.txt file - cDNA_ID_1826565; gDNA_ID_1620746; Annot_ID_49730
gaagatgaaaaaagagctccggattcgtgtctagtatctgcaagcatgggttcaaagaagaatcagattttgcttctttattacatcagaaaagtgaatgactactctccacacaagatatgaagaagcattgtacctcaggattcaaatcattaactttttcaatcgcatcctcgacatttccgttttgaacagcctttttaacagccattcgatcagtaatggtcgcaagatctatctctgctgtttctcgataaggaagttcaaaaggagtagataagctaaacatcaaacacaccaattccataaacaaaaactcaaaaccagaatcagaaaaaggatacgtttggttccagactccctttggaatttctcagcagcttcaacatatccttcagtcacaagaaaattcatcaccaaagtattcatatcttctttcctaagcttcacagcatttagtttcttctcccattcttcacgtgtgatcattttcttcgaagtagcctgcgacaagccacgattaaaactaggtcacacaacgtgcataaagattaaagttttccaaaaacccatcatcaagttgtatcaaataacacaaagaacagactcataagaggagtcaaaattaccatatcttcgtcgtcttcttcaagctgattgataaaaatacgaaacagtgacattagaacgccagtgaggctctcatatcttgaaatctaatctaatccactcaatacgaaattaatacctgttcgagcaacactccgatcagagctatttccaaaagaaattgactttgtgatcagatagtgatacaaagtaatttagggctttagtcaaaattcaagctttaatctcaaaacagcacaggagtggtagttctaagaaagagagagtgtgcgactattttcctcaaaaattgaatataacgatgtacctggagaagtggagaatctggggaagattatctgggaacgattcttgcaaataatccggagatttggcgatcgatttgcttctagattgcttgcgaaagtctcttccctaaatttacaatctgataaaacaaaaaaaagttggaggttttcgatagagaagaagagatcgggtttaaattattaggatgttgacgaaccgtcgatgaataatccggtttaaattattaagggaaccggtttgtttttggatttggttctttatataccggatagtattatgtaactcatttccaaatgattttaatacccaaagatttttaaactattttacctttgaagaacaaaatttcgatttaaaatcataatttttttttatttttttttttaaatcttggaggttgtgggtcaaagtccgtaatcccccaggcctgaaaccacagcataaaatattagtttcgtcccaagcgtcactcgaaccggcgacctctaagctttgcataaggtctttaccaattgagctaacgacacttggttaaaatcataattaaataagactgatgttaaaaatctctatattatttggaatttgatacacaatttaaaaccaataactgatactctattatactctattaaaatcaactattaggtaacaaatatgtgacataaacattttgcagtccgatgcaaaatatatctttcaatctcaacaatatgttttttcttggtcaacaatctaacaatatgtttaattgcatcttcaaactaaagtcccaaaacatgttttgttctttgcacatggttgtttgtgtggaaccacaataagacaaaggatcgattgcagaatttgaggtcttctagctagttgaccgactaagaatcaatggaccacttattctttaatattatttttcccaactggtttggaaggacttagtgaagaagttacactaaaacttctcgagtcaatcctcatatggtttcttttggcaattcctatctctgcaaaatcaaaggctcttcatatcaattaatatggcaagcaactactttgagacatggcaagaacggaattgttgatcacataataagcaagctctttctcatcaaactacctacaaagttttgcgctctacaagatatttgatcaatcataaaaatggtgatctcgtataatactagtcttcttttagggctaacaaatgattcagaagattacaaatgtgctttgtagaaattagcaatatagtgctttgtagaattttatgaccacaagattggtaagatcatttagtcaaatatatgttttatctcttcttattgattgagatgattatttttctaatgagtcgatccacatgtctaattccaattgatctttgtgatttagtttcatatttgttttctttaacatatgaaatttttttgttagtgtagaaaatctaattttcacacaattaaaaataatttttacaataaattatgattagcaaacacttcaaaaaaatctccattacttaaacacttcagtttcctactactaattaaagttgtttccttttgtttaaattgtgattttgctttaacaataaagatgacggcgcataaaatataattatatataatcatgcattattaaataatgaaaaaatggaaaaaaatgaaagaaaaagaaaaacaaatgttcgaccgttccttatttaaagccggaagtcccatagccttgtggtgtttactttttccaattcggagaaagccaaaagagagaacaaggcaataaaaagaagccaccgtcgctacaaaaagtcgcgatttttattttctctatcccaactgctctctacctttcctcgaaaattccttcaaaacccaattctcaagccttcttcttcgtcgtacctgaaaattctacaatctctggatctacgcgtctacttctgaatttcgatttgggtttcccgggagctgaaattccgtgacttttgggttttctgatttagggtttgttcctcttctcgttctttctcgggttagttttttttttttttttttgtgatttttgatg

SEQ ID NO: 20503 - DNA, 3000 bp, Unknown; identical to SEQ ID NO: 4939
  misc_feature (1)..( 3000): 2750-1469P.txt file - cDNA_ID_1826569; gDNA_ID_1620746; Annot_ID_49727

SEQ ID NO: 20504 - DNA, 3000 bp, Unknown; identical to SEQ ID NO: 4943
  misc_feature (1)..( 3000): 2750-1469P.txt file - cDNA_ID_1826569; gDNA_ID_1620746; Annot_ID_166673

SEQ ID NO: 20505 - DNA, 3000 bp, Unknown; identical to SEQ ID NO: 4938
  misc_feature (1)..( 3000): 2750-1469P.txt file - cDNA_ID_1826573; gDNA_ID_1620746; Annot_ID_49726

SEQ ID NO: 20506 - DNA, 3000 bp, Unknown; identical to SEQ ID NO: 4937
  misc_feature (1)..( 3000): 2750-1469P.txt file - cDNA_ID_1826581; gDNA_ID_1620746; Annot_ID_49724

SEQ ID NO: 20507 - DNA, 3000 bp, Unknown; identical to SEQ ID NO: 4934
  misc_feature (1)..( 3000): 2750-1469P.txt file - cDNA_ID_1826593; gDNA_ID_1620746; Annot_ID_49721

SEQ ID NO: 20508 - DNA, 3000 bp, Unknown; identical to SEQ ID NO: 4957
  misc_feature (1)..( 3000): 2750-1469P.txt file - cDNA_ID_1826605; gDNA_ID_1620748; Annot_ID_49747

SEQ ID NO: 20509 - DNA, 3000 bp, Unknown; identical to SEQ ID NO: 4960
  misc_feature (1)..( 3000): 2750-1469P.txt file - cDNA_ID_1826607; gDNA_ID_1620748; Annot_ID_49745

SEQ ID NO: 20510 - DNA, 3000 bp, Unknown; identical to SEQ ID NO: 4960
  misc_feature (1)..( 3000): 2750-1469P.txt file - cDNA_ID_1826607; gDNA_ID_1620748; Annot_ID_166713

SEQ ID NO: 20511 - DNA, 3000 bp, Unknown; identical to SEQ ID NO: 4955
  misc_feature (1)..( 3000): 2750-1469P.txt file - cDNA_ID_1826621; gDNA_ID_1620748; Annot_ID_49741

SEQ ID NO: 20512 - DNA, 3000 bp, Unknown; identical to SEQ ID NO: 4954
  misc_feature (1)..( 3000): 2750-1469P.txt file - cDNA_ID_1826625; gDNA_ID_1620748; Annot_ID_49740

SEQ ID NO: 20513 - DNA, 3000 bp, Unknown; identical to SEQ ID NO: 4954
  misc_feature (1)..( 3000): 2750-1469P.txt file - cDNA_ID_1826625; gDNA_ID_1620748; Annot_ID_166706

SEQ ID NO: 20514 - DNA, 3000 bp, Unknown; identical to SEQ ID NO: 4952
  misc_feature (1)..( 3000): 2750-1469P.txt file - cDNA_ID_1826633; gDNA_ID_1620748; Annot_ID_49737

SEQ ID NO: 20515 - DNA, 3003 bp, Unknown
  misc_feature (1)..( 3003): 2750-1469P.txt file - cDNA_ID_1826633; gDNA_ID_1620777; Annot_ID_167780
tgtagaaaattaggatgcaaagactttagatatttcaatcttattggtaaaaataaattctaataattatttttattattattaaatatagtttataaatattatttatgataagtatgaatttatttgaaaaatagtgactacaattgatttattaataattatttttttgaaaattaaataattcataaataaatgaataaataaaaaactcattttacaaattcactatttaaaatcttcaaatatgatttcaaaagaacagaaaagtaaaactacatttaatcaatcaaaattatttgataataaaatataaatatttttttaaatagttttgaaattatatggaaaaagaaaaaagtattttattttcttttattattctctcttaaagtgaaagtctcgtttatgagactttagaaagaaaaaaaaataaacgaaaagaaaaagagtttacaaacttttaaaattaataaaatcttgaaagggagattggttaaaaaataacttgaagaatttaaaatattttcaaaactaaaaatattaacaaagtcttctttgtcaccgttaatgtcctcttgttcttctatttcaattcgagtttggttatagaaggaattgagtcgggtctctttatcgtttcttggaaaaattcctttatggtggtgtttatattgatctttttcggcggtggcgacaagtgacgactcctctggattcatgtgaatgctctgtaaaagatcgaacacaacttcttttgtaagttcttttaatccctctaatactttctctatagtttctttcgttggcttcaatttttcggccactgaaactatcttcgtgccggcttttctcatcgttgaaaaaaaagctctaaaataacagaaagaaaatggttaaactggagaagaagacggacccaattcaattggaagagatatgtgtatacgttcatttatgagtctaaaagaaaatatccatacatttataactctacatccctaaggaaataatatcccatatctctactcatacacattagtcataaaatcttacttggtacttgtcaaattccctaattgatcataaactcctactaaatatctcataaatgatgtttatacacataatatataccataaccatcgatatttacgtcgtatcaatctcacgtcttaatcaatgcccatatcaaaacttcatgcataccttatatagctagcatctctcccatgttcgaacaacttcacatctcgaattaaatcaaatctttagacgatcaaaactattatacaattttatccaattatattagtattaattaaataaattatattgttataaattttagtggcctgttaaattagttattatccatactgaatgtttgttaaaatatataacatatgctaagtttaattcaccaataacacatataacaaaaagttgttaaaaaaattgggagatttgcaaaactaccatttttttactacctttttgcaacaatacttttttatgttgtccatttttaaaaataccctttcccttgaacaaaatgaccaaattaccctcatctaatagaaacatgtaattggaaactgaacttttcccaccaattttttggcgccaaaatttttttttcccgccaaaaaaaaagtttccgccaaacttttttcccgcaaaaaaaaaaattctgccaaaagaaaaattttccgtcaaatttttttttcgtaacaaatttttcctcagccaaaaaattgattttaaaaatccttataaatattttctggcggcaaatagatttacaaggaattttaaaagggttttaaaagatttacaagagatttaaaaatgttttaaaagatttacaagagattttaaaagagttttaaaagatttacaagggattttaaaagggttttaaaaaatttacaagtaattttaaaaggttttaaaatctcttgtaaatctttcaaaacacttttaaaccctttaaaaatctttacaaatcatttgtaaatcttttaaagccctttaaagttccttgtaaatattgtaaaccccttttaaaatccattgtaaatattttaaaatccttttaaaacaattttaaaccctttaaaaatctttataagacatttgtaaatcttttcaatccctttaaaatatcttgtaaatcttttaaaacccttttaaaatcccttgtaaatcttttaaaaaccttttaaaatcccttgtaaatcacccttttaaaatcccttgtacatcacccttttaaaattccttgtaaatcttataaaacccctttaaaatcccttgtaaatcttttaaaactcttttaaaatcccttgtaaatctatttcccgcaaaaaaaaaaattggcgggaaaaatatttttgaaaacaaaatttggcgggaaattttttttcgaaattttttggcgggaaatttattttggaatattttaggcaaaaaatattaatatttcattttgtaaacctaaaacaatttccaaataagagtaaaatggtcgttaaaaatttaaagagggtagaaataaaaatggataaaataaaagagtatagttgaaaaggggcatcataaaaaaggcattagaaataatttttcatgttttaaatgacaataatttaaaagttaactaaaagagtctataatgggtaataacaaacgtataacactagtgaaaataggacttgtcaatccatgaattaaatattttcatggatacggtcgtagggaaataaatctttccgtcagtcctaaaaagcctaaattattggatagacaaaaatctgaaaatcttaaatcacacgtaaatcaaacgtatttacccccacatggaacttaatccaatctattaaattcaggtggcgaccgttcattggttcttgtctctagaatcccaaaggactcgtttccgagtataaaaatacgttcctcaattcaaagtacaaaccaaaaacagaaccgaaacagaaaatg

SEQ ID NO: 20516 - DNA, 3000 bp, Unknown; identical to SEQ ID NO: 4952
  misc_feature (1)..( 3000): 2750-1469P.txt file - cDNA_ID_1826633; gDNA_ID_1620748; Annot_ID_166701

SEQ ID NO: 20517 - DNA, 3000 bp, Unknown; identical to SEQ ID NO: 4951
  misc_feature (1)..( 3000): 2750-1469P.txt file - cDNA_ID_1826637; gDNA_ID_1620748; Annot_ID_49736

SEQ ID NO: 20518 - DNA, 3003 bp, Unknown
  misc_feature (1)..( 3003): 2750-1469P.txt file - cDNA_ID_1826657; gDNA_ID_1620749; Annot_ID_49776
agttaaccgcaaagtggtgaaggttaagtttaacgcgcgaaacagcgggggagaaagagcttggacggtcgatggaaccgaatgctagaaattctgaccaccatggacggtagctagaaacagaagctattagattgtgcaccgacaaggagataacatcaccagcggagagacttatctcctccgccgggatcagaacactctcccccggtgctaacatcgccgatcaccggacaccacttttgagttctctagtcaactagtttaaccgaaattaaaagttttgaaggtataggtatatagcaaaacaaaaagtggttcccacgttgattaacgttttgggatgggccagttttattttagggcccataaaagtcgggtcggatcctcttcaaaatgtggattcggttcagcgattctcttctcggtagttctcaaaagcagagagcagcggcagagacgtctgagtagaacctgggatccaggttcagttattttaccattataccccttgaactcgtcttcttcgtcaaggtaatcttcgatttcagatggaatctgtagaaatctagattccaatttgcttaattgccaatagtttgatgggtttttgcggttttgcgaatccgaggctctcggaggtgagattttcgtctttgaatttagagttctcgggtctgcttagttcctttaagttccagagatgatgaagaaaaatctattttggattaagctcaaatatgaactctgtaattcattatagcactagtgttgcggttcgtaaagcttctcgctttctcttcacatcgaggaaattttgcaatggtagcatcggtggtgatgtaaccgataacgggaccgaagagcccttgaagataacttgggaatcttcggagatggattgtgagtttgaccaggaggaaaatggtgagaaaatctctgttagaaaaaggtttatggagagtactaaactcagtgcgtctcgggttctcgatacgttacagcaagattgtcccggtttcaatacgaaatcagctttagatgaattgaatgtttcaatctcagggctattagtgagagaggttcttgttgggatcttaagaactctgagctttgataataaaacaaggtgtgctaagctcgcttacaagttctttgtgtggtgtggtggacaagagaatttcaggcacactgcgaattgttatcatttacttatgaagatatttgctgaatgtggtgagtataaagccatgtgcaggctaattgatgagatgatcaaagacggttatccaacaacagcatgcacgtttaatctattgatatgtacttgcggggaagcaggccttgctagagatgttgttgagcagttcatcaagtcgaaaactttcaattaccgaccttataaacactcttacaatgccattttgcattctttgctaggggtgaaacagtacaagctgattgattgggtttacgagcagatgttagaagacgggtttacgccagatgttctgacttacaacattgtaatgtttgcaaactttaggttagggaaaacagatcggctttatagattgctagatgaaatggttaaagacgggttttctcctgatttgtatacatacaacatcctcctccatcatctagcaacaggaaacaagcctctcgctgctcttaaccttctgaatcatatgagggaagtaggagttgagcccggtgtcatccatttcactactctgatagacgggctgagccgagctgggaagttagaagcttgcaaatactttatggacgaaacggtgaaagttggatgcacgccagatgttgtttgctacactgttatgatcacaggatatatatcaggtggggagctcgagaaagccgaagaaatgttcaaagaaatgacagaaaaggggcaactcccgaatgttttcacatacaattcgatgatccgcgggttttgtatggcggggaaattcaaagaggcgtgcgcgttgctcaaggaaatggagtcaagagggtgtaaccctaattttgtagtgtatagtacactggtgaacaatctaaaaaacgcggggaaggttttagaggctcatgaagtagtgaaggacatggtagagaaagggcattatgttcatcttatttcaaagttgaaaaaatatagaagatcttagttttttttagtttgtttcataaggcttttttgtgatatcgattaaacggatttttttttttgcctacctcatgttccttaacatgttttagtaggctgttgtgtattagccattttaaccgaaccaaatgtattgaaccgaagtgaaaagaaccaatcagaaccaaacgaatggatactaaattttaaatccgaattcactgaatagatacttaaaaatctataaaaatacttgaaaataaccgaacaatatccaaaaaaacaaaatttaccgaatagatactaaaatttaaatccgaatgaactggaaccaaaacttcaagatacccgaatgaacactatagaactgaaaccgatcggataaccgaacatcgaagactaattttcagaaattgaaataaccaaccaaaaaaaggaaaacgcatcgtcgacagcagggttcgaacctgcgcgggcgaagcccaacagatttcaagtctgtctccttaaccactcggacatatcgacttgttgtgcagaatcgaacgtaccttttatataattgttacaaaaataaaccagcccaataaaggcccataaatggtggcttcgcttgaatcttctagttgacactaaaggttctctttacgactccggcgcgtgtttcgttatcgactttagtaaaaaaaaaactcggaatctgaatccgatcaaatctgaacaacaccggcgacgaatctctgcggcgtagatttagatttcatcccggggagacttaaattgatgcagtagtgaaatatcacggcgaagggatggtttgttggtaaaagagccaattgaaatcagttatg

SEQ ID NO: 20519 - DNA, 3003 bp, Unknown
  misc_feature (1)..( 3003): 2750-1469P.txt file - cDNA_ID_1826677; gDNA_ID_1620749; Annot_ID_49769
attgattcaaggtagctttctttctctttacactgcacctgaaaagtttcagaaatcatgtctagccaatacttatgagctctggtgctctgtgctttagtcaattgccagaattccttggaggttcatgctcttgctttggtgatggaggagggtgtcttcgctctaataaaggaccctggaatgatcctgaaataatgaaggtaaaatctatatctttttagattttgctgttagttttcgaggatgctgttccttaaggaacttttaagtaggagttcagattctatttcggctttgtacatgaagctcattttagatctattccttgattagctcatctaccatggagaatcatcactttttaggcaaagcaccagaaagctgactgacccgcattattcttcttcctacataagtatacatccatcaaaggtaaatgattctatctagccaatttctctgtttgtcgtagaacttttttcatggttaatatgacaatgcaactttggattttcaggctatacaagctgagacttcagcagcagagtcgatatcttgttctgatgttccttcttctccaactggaagattatgctcagcctcttctcatgtgaattcagcttatgaggaagtgagttcttgtgttagtgcatttttgtcacagaacaccttagttgatactgaccagaacagtatgatctatgtaggctagggcatcagatgttaatggctattatagttgcgacgacaagtttgccatacctgacaaagctactaaccgaaaaggccaagaaaggcaatcccaataccaaatgcgtgaacttaatgcaacaactatcggtttaaaatgtgaaacatcttcaccaggttatacttcttattaatgcttttctcataaaacaatttcattttatatgtctccttttttaattcaaatgttgctcagtgctaatattacagatttcttctatagttttctcaccttttgaatttcatcttctctctggtatctcctaggtgctcccatcatccgttggcttcatgatttaagggtaatgattgacaagataaaatgtgagaacctagcgaaaagactactttcgttaatgctgaaactagctgcagtttttcgttatactccgcttgagcttctgagaagccagactacagtcagcccttcaagtctaacagaagatgacagtcggtgcagcctcatctcaccacctcctagagagcccacaatgaaagaccggattcttccatgtttggaacgtattcagaaactggagaaaagttatgaggatattcggaacaaacccgttgcaatacctgtagagaaggagagaatgttgatggattctttagatagaatcaagtcagttgagtttgatctcgacaaaacaaagagggtacgatacctttcctgttagttttaaaaccttcaaacttaaagattcagtatggactcaaaagcgttttttcattggttgcagcttttacacgccacggtgatgaaacagatggagataactgaaatgctgcaaaatatacgagactcccaacttcacgtaagaacctaatctgcctcagtatagcaaggaacattgtgatgagataactaacactcgagattgttctttgtgcagagaagaagaagattgttctgttaataaaccataagagaacatctgagttttgcataaatacaaatctgcacatacagagaaagagagagagagaattgaaaacaaaagacatgttagtttctttagctctttcccttctcttctaacttatttcacaacttttttttgcctttctaaataggtccctatgcttccactttttaagttataaaaagaagaagaagaagatagtgacagagaaagactctgatgatcaatcctgtctgtgataatttagattgagagagatcagaattttaaaaaccaaatccttttgttgtaatcagtgtagataagaaactacactaagctaaacaaatgagattttgtaaatctttcccaaggtattttgataatgagaaaaacactcttgagtctctgaagaatccattttgtttaacatgaaagcaaaaactatattattaagtaaaacatttatatcagaatctgatatttcaagtggatttgcagttgttaatgtttatgattagagtttgatatatcatcaaggttgcataataatgaatgatggccaatgagataaagacaaaacagccctcgtaatcagaaccctgtattggaattatataagggtaaaaccgtcaaaataagtaacaaaataaggaaattttaaatcagaaaaaatagagaccgtccttttccactgtgaacgaagataaatttcgctattcctctctctctctctctctctctctctctctctctctctcttcttcttcttctccgttcgtgctctggactcgctcgaaatcgatccgatgataatttatgcagctcgaaacttaatttagaatcatacctttttctggatttggctgacgaatccgttttcaattgcacgagttgcttcgccaggtgaatctatcgatcctaggttttctccgcctctgattttttcttgttcctgagtttttggaatcgaattttacgattggtagggtttgtgttcttgaggaggcttgtgaagtatttattatttggtttcgtttctcccatcttcgattatgtcggtagttttggtttctggaaatggactttgatatttgtgtacatagattgcaggtttgatccttgtttctgagcgatttgcttgttggagattgttataatctcatggagtcgtaatctattaggtgttttcatgcttgattgttcactaaatcacatttttatgttttaagtatgttggtgttattggattctactatattgtagcttctgtggtccctggctttcgtagtttttagtaataaaggtgctttttgatatatgtaggtttatcaacttaagaatg

SEQ ID NO: 20520 - DNA, 3003 bp, Unknown
  misc_feature (1)..( 3003): 2750-1469P.txt file - cDNA_ID_1826681; gDNA_ID_1620749; Annot_ID_49768
aaacataagtcgaaggaatagtttcttggaaactaaactgaaaacgaaacaacatttcaaatagattgcagaaaatctaaaccccaaatagaagagattgtaatatactcgtgcaaaaacattttagtatttttttaataaaattttggagaagtgacttccccgcaaaagtatgagaaatcttattataccaataattatgtaataagtactgtggtaatttgctggtgagactttcagagcattaaatgttttttaacttggatttttatttgtcggcacgcaattgaagaaaccaagtgaaaaatttaatggcgaatgatggtttgatgatgcgtttgtacagaagaaaaaaacgatagtgtcttgtgtcgttttagagcggtaaaagtaaaacagtaatcattaaaaataaaataaaaaatcatttgataatgatgtaaattttatttcttgccgactgaatttatattcgaaactgtacaatttcttgaacgtactgttatgttttgatgggacctttctcatttattgctggacccgtttttatttgcaaacaaaaacaaatacgaatagtgaaaaataaaacaaaaagatttattgaaaatatatggtaactaattgataagtgttgataacttaatatacgagtgaaaacttttgataacgaaaaataaaataaaaaaaagttcgaaaaaaagaagaacatataggagctgagtaatgtacgtatatttatgagaagaacacataacataatgataataaatttataagaatgttagtattttcttttaatggttaagaaatggacaatcctagtatgaatctaaaatgatgggatgcatgcattaaattaatcaggctgaggaatattgacacgtgtccatatccatatgtggttgtccgaaaaagtcaacttactccagttaattaccaccacccttttcatttcttctagaaaattaaaaaacgttacgaaaaacttaactaattgtcatatcgtatacgttacaaagattattgactaattatttattcaacgtatttttgccatttaattttggttcattgacttattatttttattagtttattgactaccagaccattaaatagatttagaattagataaaacgtcaaacaaaatagctgaaaaaggatagtaatttaggatactctccaactaaagtttttaagcacttgacgttaataacgaagttattaactagttaatcgatttgaaataaaacaatccaagataatttttcaaattttcgaaataaagcgactaacatcttgataaacataattgttttgaagaagtctaaacttaaaccgaaaaagtagagggactttcttaaaaaacaaaaactaattatcttctagtaaatcaaccaaaaaatcttgtagtacctgtaaaaaacctaaacttgaacaaagcagtatcttaagggtatgatttaaatcaagtttgggaatgaacaaacccactatctacatgctttcaaaacaaaatactacagaatacagattgtgcattttaataacagaataatataaatgacttgtaacaaaaaaaaaagaataatgtaaatgacactggggaaaacaaatgtggtattaaaacatattaaacagtttatgaaaacaaattctaaggaaaaacgaaagttatatacatgttggggtgaatttattagacattgaaatcaataattaaatactcatgggggaagaaaaggacacgcatgcaaaatagagacagaccaagggtaacaaaaagctactgaccaacgctgccaatgcacactttcttttaccttctttctccatttgttcactctgataaggaccattggacccaacactacacacaatattaccaaacctaaagaattttttttctttcaaaatgaaccaaaagaaaagaaaagaagagtatattaatttattaagtagtagcgaaaactcaaaagagtaaagaagcagaagatagaagaagaacaacaacacacgcgagaaatttcagatctttcctctctccgcatctccctttttgcatcctcgtgtaatcatcgtctaagaagaagaagaagaatccttttgcttgttgctttactttctctgcaaactttcgtatctttgcgtgtttgagaatctctctatctttctcggatttggagagttatcgaagagatcgtgtcacattaaggtaaaaacagagttttaattagagttctgtttcggttctgttttttttttggtttgtcggtgggtttactgttaccccttccgagaatcgagggttgagatctcatccgtattgttcttcttcaatcggcattactgcgaaatctaacgtttttattgttttttccgaatcactgattcagcggaataacagagtatgatggttttttgatttcgacgttttctgattactactgtttctttttaacggtttctgtctcatttaaagtcttgagatttgcatttatggcgatagctaaagtaatgtcttttttttattaggattgaagacaagtctttaatgcagagaaatcgtgtgaaaatggattcttaagccccacttttagttgcagatctggagctttttactgggtttctgctaatttatcgacaagaacaaaaaaaggtttacacaagtttttgtttttatgtttctgttttgtggttaatggcttaggcaaatatcttgtgggtttggtactgctttagttcttatgttcacgaggaatcctttgctttgaaagtctatggccgtgtaaaagagatatgtatttaatgtaatcacaggaagatttacttttgattcaaaacccaagaaagttatgatgattcttggtttaatttgttttgacaagttttgtcttttgtttctccaggtttgttttgtctcacaagtgatggtcgtatgactcacatgcatgtcctctgagctcgtttagcatcaataagctttccctttgaattgatatg

SEQ ID NO: 20521 - DNA, 3003 bp, Unknown
  misc_feature (1)..( 3003): 2750-1469P.txt file - cDNA_ID_1826695; gDNA_ID_1620749; Annot_ID_49764
cagaggagcaaagggcttgaagagaaatgtccatgaagcttatggattactaaaggaatccattttagagattagagctacaggattaagtgatccgttgattaagcctgaagtttctttcgaggtgctattctgtcacataataaaaagtgtgctgacaaaagaaatcattacttattgctttgttgcctgagctaaaaattgctaaccctattcaggttttcagttcgttaacccgaaccattgcaactgctaaaaatattaatgggaagaacccacgagagagctttctggacagattaccaaagtccactaaggatgaagttctacacgtaagtccgacattttccagtgtcctaagtgacaagaagctctatatgtactagttagtgaagattaggtagtaatgcatatggataagaggacttttcttctttcatctacagcattggacatcaatacaagaattactgaaacatttttggtcatcttatccgataacaaccacatatcttcataccaaggtaatgttattgcaattttcaaatctcccagtcccagaaattgctatatatattgattcctaggctttcacgggaaatttaatcttattatacaccaagagcaagttattataccaaatatttttcgtcgattcttgtgatgttatattattatcatgcaggttggtaaactgaaggatgcaatgtccaatacatattcaaaacttgaggtaagctttgaaattcttcatctttctgacagaataagcaactgatagtaaatctgctatgttaaaacagtagttcctaatcataccaatgcgtttacgaaaatgaaatttttgggtaaataaaattgatgcagtattgtagtcgaatcttatttgcatatatatggtcaactgtacggtttccttgatattaaactccatgtaactcaggcaatgaaagagtcggtgcaatctgatctccggcatcaggtttctctactggttcgtccaatgcaacaggttagcttcttccaatatctacggaagagttttatacttttattacatcatgtctcggttaagtctatattttccactcatattgcatctatatccagtttctacagccttgcattgtaatccggtttgaaaattgatcttaatcggttttctctgctaggctcttgacgctgcgttccatcactacgaagtggatctgcagagaagaacagctaagagcggcgaaagaccaaacggctacgtatagaggacaaaaaaactaaaactaaaaagctttgcaagatctttgaattgtttcatcagccttggttggtgtttttgaaaatcttcatttgtccctttttgtccgaccattgagatacaaaaatgcgtttatattgtagtaatattttcttttcttttttttgttaattaggcgttatattgttaactgcgagagacaacaaagagattttctcgatctgaacatttttaagtttgcaatgtattagtaaattctctacaggctttgaggacgttactacagctccaagaaagctctcagtgccataattgtttggttatttggttactggtgaatatttataataatgggacaataatagagaaaatgcttcgatggcgtagtagatttcaatgtttgaatcgcatcaaacaacaatccaaattagaaatatataaaattcaacataaaactttttttgacatagcattcatggataacttttgatttgaatgattaatttactcattgtgaggaaaaaaataaaaacagataaagttactcattgcttgtcatattgacatgacatacaaaattcaagctccataagtaaagctataaagaaaaagaaaagggggactctccacttttaggtttcatataaactcgttaactagagattgggttttgattaagcacgatataatatatatggccgaaaaagccttttggttagtttacttggctcacgttttcgtcttcatattttcctgtggacttgtcttctccttctagataacttgcatattcttctcttgacatattcgattttgttttctcctctaaacattggtgagtttaggttttctttgtgttgaagttacttatttccagacacagccacagaggtatcgatatttacttggttcataagttgatcgatatttacttggttcataagttgttgcattggtaatagatgtgtgacctttatttgagaacaaaccgtccaatggtcgtgcatatggtgggccttgtaccagagagatctgcgccgctctattaatgatcactgacataccactagtagatcttttcgcatgcaaatatattttatattattttctttgttaaaagatttttcctagtattatcatatgagtaattaatgtttgtcctttagctttcactataaaaacgcatattattatcgatagtaaacatcccaaatgttcggttcatagcattttcgattttcatatttgaaaggtagagaatcttttatatttaacaaattacaactttacaagcattgtagtgaggttatatttatacatggtgcatcaaatagatataggaggattagtttgcgatttcaatgattaaacccaaaaaagaacgacaagaataaagtaaacttaaacatcatattcgaaatgaatcatatccgtctatgaataattatgtcaactattcagcatttacaatcacgccaaacaattgacacgttattctctaatcataatattggttacaagaaatagaaattcaccgaattacctttccaaattttgttcaaataaatgtacgtatcttattatactaattttattttgcattttcgtgtccgctagatatgaacacgtcatcgataacgttctataaatatcattcctcttgtccaactaattaactcactctcgagagtagcgtgagtcttgaggtttcattattatttttttgttttccctacaaggaagtaacaatg

SEQ ID NO: 20522 - DNA, 827 bp, Unknown
  misc_feature (1)..( 827): 2750-1469P.txt file - cDNA_ID_1826721; gDNA_ID_1620749; Annot_ID_49754
gaattcgcgtactcctaacattgatgaagtcatgaagatgtccagaatgtaaatgttggaattgtacctttgattgaaactgcaaaagagagaagaagaatccatgagaagaagaagatgaagaacagagaaagaagcattagcaaaaggaagaagaagacgttgtcgcataagagacgtcgtgaagagaagagtcaaaggaagagaagaaagtcaacaaaccaaatgggtttgtgttttgtgagttgggcccataggtgatgagataagacccatacgaaataaaataagtgttttgtggttgtttagttaaggtccaacaagaagaggttgtaataactaaaagtaaactaaggcctagttagagtctaaaagtgtgaatcaaggaactagtgttccattgtgtagggtggctacttgtcttgtcttgtgtaagagtcatgattaggcctaagtgaaaatgtgtaagtgtgttgcaagtagaaaagtagtagtatatttatgagagtgttgtgttgtgtaagatgatccagtgtagtcattaaaattcttaaaacgtgttcttgtttctcaaagcaaaagagcgagaaagaaagtgaacagagatacaagagagtgagagaatgatggaagaggtcagaattacaacagtaaaacatcgtcctgttgagtaatagtaagccttaaatgccattatgaataattaaacgttaattattcatcacaaaacgacgtcgtgttgagtgtaggtgacgaaacagttgttttcttctcccttccattgttggtctttgaagagaagcagaaagttttgagaagaaaagatg

SEQ ID NO: 20523 - DNA, 3003 bp, Unknown
  misc_feature (1)..( 3003): 2750-1469P.txt file - cDNA_ID_1826789; gDNA_ID_1620751; Annot_ID_49824
ttaaaaaagaactgagtcctcctcgagacactttgtagcttgcggataacgagacaatttcaaatttccagcctgtgccagcggaaagtcaacaatcgatctaactgtaaactaagatcaaatatatgtattattgagggtttaggttggcatgtgcaactttcacatattttctggagaaatcaaatataataataatcattatcattgattgaatgatcatttttgacttttgatggcgctcctcctatcttccaattagtagtaacttttaagggttaagttgtatactagtcactttttaaaatttaattgaaaaaatagtcactttactatttataatttgcaaaatagtcacttttcactgtttgattcgtacacttagtttgtacaccacttttagtgatcagatgtatataaaaaatacacagcgtacactttacatttgtacaataaaagtgatgtacaatccaagtgtacgaatcaaacagtgaaaagtgactactttgcaaattatgaatagtaaagtgactactttcctaattaagtttgaaaaagtgactattttgccaaaacaccccttgaacgagatttatttaataaatactgtattaattaacgaaagaaattttaaaactttaatgacaaattgggtcaagtaagaggaacctgagattctttcgaaacagtattctctctattcgtcgaaaattgggactaagaacatcattattggtagtatcttaggttagtcttagcttagttcttaggatttttttataattgattttgaaaattttgaaatgaaagctaagaacatttcattttatctcttatgtaaaagactcttttaacaaatatatgattaaaaagccaaaattttctaataattaacctaagcaactaccaataaatgtgttctaacgttttgatttaatctggtatttagggtattttgtcattttggtttatctcttatggatttttgtttccatgtttgttgtgtggcattgcttaccaatacatagaatagaaacaataaatgaaactatgatgcttttcttacttaaagagtctgaggtcatcaaaattcaatatgtagagtgagtgagatgcaatttctatataaccgaaatccaactgcattattgtttgcatctggaagctcctctctttctgatgtattttatctacaaactaaaaattcatttgtctatcttgatgatggttcttttcttctttatcctcattttaacaaatattcgagaatcactttcgctatgaacgtgtgctaacatggatatatttctttttaatattcaatattgtgattcaaaccaaccatcgaattatatcagccttctttttaccacagtttggctcaaccaagtttcttccttttatttcaaatgagattgtttgagagattttgaatatgactgtatgtaacgtattgtatgcgcttaaactaaacttagtgctctccatatctgtttttactcgcattttgtcaactattgagttttatattgcccccttagctagtggatcttgtcgtggtgtatgcttattttgagataattaaaatcgaaagcatgatatcatcttgaagtttacagactgtccgagtgcaaagtctacgaaagatttaaagattagaaacttgaagaaatcaatgtgaaaattaatggtcatttacacatatatatatgtgttggggaaacaacggacaactgtacagcaataaagttccaccctacatatttatgtgagtttgtgaaaaaaaataaaaaatattttgctagcaaaaaagtaaaaaataaatgagacaccaaattatacgtaaaaatcatcttaatgtgaagagtaaaaactatgggaccgtagtacactcaaaatttcagacacgaccagcaaatgtccaaacgttctacacaaaaaaacctaacagatctatttttctcctcctctagatcttaaacctctcttttcttttgtttcttatacacaaacaattaggttaagagtgtttatatactccctcataacccttacccaaattccaatctcatggattaataatataaatggttgaactccaagtttggttctccaaatcaaaacccaatttggttcccaccactaggaggaaaaccaacagactcccctccgataaagtactggaggaaacaacaatcctgactatgataacatcgtatttttgcatgttttagatatagattttttatgttttaaaaaagtttttgtttgattttcaaatttttttagtactaatgtagtttatacgagattaatattgtagtctttaatggactgtatcaaccaaacctgactttgttggggcaatttgtggtaattgtatatatgaaaaaatggtaatgggcttgaatatcccacgaagccttttaccaagaagtttcacgcatcccacatcggaagggtaagagagtttgatagtggaaacttttatataaatagacttcactctccctcagattcaaatttcgcagctatgtggtgagcacaaagcgaactattctttcgccttttactaaagaataccgtgtgctctccacgccaagtggcttacgcctatttttggagggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatg

SEQ ID NO: 20524 - DNA, 3000 bp, Unknown
  misc_feature (1)..( 3000): 2750-1469P.txt file - cDNA_ID_1826789; gDNA_ID_2926183; Annot_ID_140669
aaaaagaactgagtcctcctcgagacactttgtagcttgcggataacgagacaatttcaaatttccagcctgtgccagcggaaagtcaacaatcgatctaactgtaaactaagatcaaatatatgtattattgagggtttaggttggcatgtgcaactttcacatattttctggagaaatcaaatataataataatcattatcattgattgaatgatcatttttgacttttgatggcgctcctcctatcttccaattagtagtaacttttaagggttaagttgtatactagtcactttttaaaatttaattgaaaaaatagtcactttactatttataatttgcaaaatagtcacttttcactgtttgattcgtacacttagtttgtacaccacttttagtgatcagatgtatataaaaaatacacagcgtacactttacatttgtacaataaaagtgatgtacaatccaagtgtacgaatcaaacagtgaaaagtgactactttgcaaattatgaatagtaaagtgactactttcctaattaagtttgaaaaagtgactattttgccaaaacaccccttgaacgagatttatttaataaatactgtattaattaacgaaagaaattttaaaactttaatgacaaattgggtcaagtaagaggaacctgagattctttcgaaacagtattctctctattcgtcgaaaattgggactaagaacatcattattggtagtatcttaggttagtcttagcttagttcttaggatttttttataattgattttgaaaattttgaaatgaaagctaagaacatttcattttatctcttatgtaaaagactcttttaacaaatatatgattaaaaagccaaaattttctaataattaacctaagcaactaccaataaatgtgttctaacgttttgatttaatctggtatttagggtattttgtcattttggtttatctcttatggatttttgtttccatgtttgttgtgtggcattgcttaccaatacatagaatagaaacaataaatgaaactatgatgcttttcttacttaaagagtctgaggtcatcaaaattcaatatgtagagtgagtgagatgcaatttctatataaccgaaatccaactgcattattgtttgcatctggaagctcctctctttctgatgtattttatctacaaactaaaaattcatttgtctatcttgatgatggttcttttcttctttatcctcattttaacaaatattcgagaatcactttcgctatgaacgtgtgctaacatggatatatttctttttaatattcaatattgtgattcaaaccaaccatcgaattatatcagccttctttttaccacagtttggctcaaccaagtttcttccttttatttcaaatgagattgtttgagagattttgaatatgactgtatgtaacgtattgtatgcgcttaaactaaacttagtgctctccatatctgtttttactcgcattttgtcaactattgagttttatattgcccccttagctagtggatcttgtcgtggtgtatgcttattttgagataattaaaatcgaaagcatgatatcatcttgaagtttacagactgtccgagtgcaaagtctacgaaagatttaaagattagaaacttgaagaaatcaatgtgaaaattaatggtcatttacacatatatatatgtgttggggaaacaacggacaactgtacagcaataaagttccaccctacatatttatgtgagtttgtgaaaaaaaataaaaaatattttgctagcaaaaaagtaaaaaataaatgagacaccaaattatacgtaaaaatcatcttaatgtgaagagtaaaaactatgggaccgtagtacactcaaaatttcagacacgaccagcaaatgtccaaacgttctacacaaaaaaacctaacagatctatttttctcctcctctagatcttaaacctctcttttcttttgtttcttatacacaaacaattaggttaagagtgtttatatactccctcataacccttacccaaattccaatctcatggattaataatataaatggttgaactccaagtttggttctccaaatcaaaacccaatttggttcccaccactaggaggaaaaccaacagactcccctccgataaagtactggaggaaacaacaatcctgactatgataacatcgtatttttgcatgttttagatatagattttttatgttttaaaaaagtttttgtttgattttcaaatttttttagtactaatgtagtttatacgagattaatattgtagtctttaatggactgtatcaaccaaacctgactttgttggggcaatttgtggtaattgtatatatgaaaaaatggtaatgggcttgaatatcccacgaagccttttaccaagaagtttcacgcatcccacatcggaagggtaagagagtttgatagtggaaacttttatataaatagacttcactctccctcagattcaaatttcgcagctatgtggtgagcacaaagcgaactattctttcgccttttactaaagaataccgtgtgctctccacgccaagtggcttacgcctatttttggagggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatg

SEQ ID NO: 20525 - DNA, 3003 bp, Unknown
  misc_feature (1)..( 3003): 2750-1469P.txt file - cDNA_ID_1826797; gDNA_ID_1620751; Annot_ID_49822
taatttagccggccaagatatggtaaaactgcttgatgtgattaagactggtgcaccaaactcaagcagtagctcaaataaacaggttgaagaaagggtcgaagtttcccttccatctcccactccatcaactaatcctggaatggtgcgttacttgaaacctattcaccccaaattcctcggacatatccaaaaccctattaatagatcatgttgccaaattgaatctcacgacatatagaaaaaaggaaagaactacaacaggctctagctaacaccaaactggattatgaattccagctgttagatctaacctgatgagtacaatgcccccattagaagatgttaatgtctgtttcttattctcttactgagttaagtgtattgttccaattttacagagtggatggggacaagaagggattcggaatccattttcaaggcaaaaccaagttggtactgcagttgctagatcgggtacacagcttcgtgttggttcaatgcaatggcatcaaacaaatgaacaatcaatcccacgacatgctccatcagcatacagtaactcgatcacattggctcacacagaaagagaacagcaacaatatatgcaaccaaaacttcatcacaatttacattttcaacaacaacaacaacaaccaatctcaacaacctcgtatgcagttagggaaccagtaggacaaatgggaacaggtacatcgagttcatggaggagtcagcagagtcagaacagttactactcacatcaagaaaacgagattgcatcggcttcacaagttacttcataccaagggaatagccagtacatgagtagcaatccaggatatgaatcatggagtcctgataatagcccaagtaggaaccagcttaacatgaggggacaacaacaacaagcatcaaggaaacatgattcttctactcatccatattggaaccaaaacaaaagatggcgttaaaccatatataagactatggttctttggtcctcaatatttgcttgtcatggttgaattagcattatactctgttcagacacagattttcatttttaactcacaacagattcatcagagataataaactaaaagaaagaatgaatggataaagttattactgtctcaattggcttcaaggcttttcaaaaacaagtcttgtcttcatcattattcgactaattccaaatctgattcaatttagtaacagtaacactggctaaactggactgcttcggtaattggagattttggtatacaatatccatttctgtgaagattgatagaatgtggatactgttcttattcgtacacaatttttgtttacaaagggaacactatatactgttcctattggtactctcagtttaaaccgatatcttaaccggttgggatggataaccgggtttacttttgataactaaaagaacccagcatatagtttaaggccacaatctcaacttgcaaatacagagttaacagccgtttaattatcgttcttatgatttgttctttgttaaatgataggtcaaaaattatttatgtcttttctaatttcataactgtgaatgtttattgaatccacattactcgtcaccgaactaagtaagcagtctctaaattaagacggtgatagacagtgctcttcataaatcgttcataagtcgttcaaacttgtattagccaaatcattcaaaaaacataattaagagatccaaaaacagaagattaaaattaagaataacagattaatgagagaaagagccaattagtcagataattgtagtctgagttttggtcgacagaataaattaatatatccgaaaaatcgttatcatcattccatcggctctttctcatcgtcatcaatcttaaacagtaaaaaccaaaccctaattttcccgagaaaactgaattgtgaatacaaataagcagtgaaggctcagaaggatccattggtaaattttctaatcagagaattactcataaaataggtagtttttaatcatcactgccttcactctaaaccctaatctagccgaaatcgaattgaaaacaaaaatggattcaaatcttcagagaaaatcaaaaattgaaaaccatcgaaccaaatcaagcaacgaaaaaagaagagaaaaaccgaaacatgaaagaactactttgtggaataatcgatcattagaatgagttgattgagaaaagtaatcacaggcggcaatatataagacaatggaggaagctagggtttacgttttcgaaagaatcgggtcggtcccgttaacccgatgagtttgggctttgtgaattacatcaaactcggcccattgagtatctagtttcgggtttgacccgttatacatgatgccacgtagaccgagacgaacaaaaaaagccagagaagaagaagtttcagagaaattttccgggaaaaggcgcaagaaaatatcagacaaaaaccgattattattctgggtccattttttcaaaggtttattaaaaacgcaaccgttttgtcaaaagcgataatgagaaaacttcttcgacgactctgggtttctcgggaaacaagtactcagagagagagagatatttcgagaaaagaagaaacactcctccgatccatacgaaataagataaaggggaaaccaaaccctaaatcgagcttctccttatcggaaatgtcgcacttccaccacttttgactcctccgttcatcggcggcgatctgaatcaccgtcaatctgatttcgtttctgtgaaggtatacgcatttgatttctactactgagagctgatttgagttcttttttaaaaatcattagctaagttagtttcagagctcttcttcgaatatctggaagagagacgagtttaggtcgatcgattttgaaaatggtatagagcttcgtttatttgtgagaacgaccaagctttttctattgtgatgttatggtataatgatatgcatagaattctacgtgaaccaggaatg

SEQ ID NO: 20526 - DNA, 3000 bp, Unknown
  misc_feature (1)..( 3000): 2750-1469P.txt file - cDNA_ID_1826797; gDNA_ID_2926183; Annot_ID_140671
tttagccggccaagatatggtaaaactgcttgatgtgattaagactggtgcaccaaactcaagcagtagctcaaataaacaggttgaagaaagggtcgaagtttcccttccatctcccactccatcaactaatcctggaatggtgcgttacttgaaacctattcaccccaaattcctcggacatatccaaaaccctattaatagatcatgttgccaaattgaatctcacgacatatagaaaaaaggaaagaactacaacaggctctagctaacaccaaactggattatgaattccagctgttagatctaacctgatgagtacaatgcccccattagaagatgttaatgtctgtttcttattctcttactgagttaagtgtattgttccaattttacagagtggatggggacaagaagggattcggaatccattttcaaggcaaaaccaagttggtactgcagttgctagatcgggtacacagcttcgtgttggttcaatgcaatggcatcaaacaaatgaacaatcaatcccacgacatgctccatcagcatacagtaactcgatcacattggctcacacagaaagagaacagcaacaatatatgcaaccaaaacttcatcacaatttacattttcaacaacaacaacaacaaccaatctcaacaacctcgtatgcagttagggaaccagtaggacaaatgggaacaggtacatcgagttcatggaggagtcagcagagtcagaacagttactactcacatcaagaaaacgagattgcatcggcttcacaagttacttcataccaagggaatagccagtacatgagtagcaatccaggatatgaatcatggagtcctgataatagcccaagtaggaaccagcttaacatgaggggacaacaacaacaagcatcaaggaaacatgattcttctactcatccatattggaaccaaaacaaaagatggcgttaaaccatatataagactatggttctttggtcctcaatatttgcttgtcatggttgaattagcattatactctgttcagacacagattttcatttttaactcacaacagattcatcagagataataaactaaaagaaagaatgaatggataaagttattactgtctcaattggcttcaaggcttttcaaaaacaagtcttgtcttcatcattattcgactaattccaaatctgattcaatttagtaacagtaacactggctaaactggactgcttcggtaattggagattttggtatacaatatccatttctgtgaagattgatagaatgtggatactgttcttattcgtacacaatttttgtttacaaagggaacactatatactgttcctattggtactctcagtttaaaccgatatcttaaccggttgggatggataaccgggtttacttttgataactaaaagaacccagcatatagtttaaggccacaatctcaacttgcaaatacagagttaacagccgtttaattatcgttcttatgatttgttctttgttaaatgataggtcaaaaattatttatgtcttttctaatttcataactgtgaatgtttattgaatccacattactcgtcaccgaactaagtaagcagtctctaaattaagacggtgatagacagtgctcttcataaatcgttcataagtcgttcaaacttgtattagccaaatcattcaaaaaacataattaagagatccaaaaacagaagattaaaattaagaataacagattaatgagagaaagagccaattagtcagataattgtagtctgagttttggtcgacagaataaattaatatatccgaaaaatcgttatcatcattccatcggctctttctcatcgtcatcaatcttaaacagtaaaaaccaaaccctaattttcccgagaaaactgaattgtgaatacaaataagcagtgaaggctcagaaggatccattggtaaattttctaatcagagaattactcataaaataggtagtttttaatcatcactgccttcactctaaaccctaatctagccgaaatcgaattgaaaacaaaaatggattcaaatcttcagagaaaatcaaaaattgaaaaccatcgaaccaaatcaagcaacgaaaaaagaagagaaaaaccgaaacatgaaagaactactttgtggaataatcgatcattagaatgagttgattgagaaaagtaatcacaggcggcaatatataagacaatggaggaagctagggtttacgttttcgaaagaatcgggtcggtcccgttaacccgatgagtttgggctttgtgaattacatcaaactcggcccattgagtatctagtttcgggtttgacccgttatacatgatgccacgtagaccgagacgaacaaaaaaagccagagaagaagaagtttcagagaaattttccgggaaaaggcgcaagaaaatatcagacaaaaaccgattattattctgggtccattttttcaaaggtttattaaaaacgcaaccgttttgtcaaaagcgataatgagaaaacttcttcgacgactctgggtttctcgggaaacaagtactcagagagagagagatatttcgagaaaagaagaaacactcctccgatccatacgaaataagataaaggggaaaccaaaccctaaatcgagcttctccttatcggaaatgtcgcacttccaccacttttgactcctccgttcatcggcggcgatctgaatcaccgtcaatctgatttcgtttctgtgaaggtatacgcatttgatttctactactgagagctgatttgagttcttttttaaaaatcattagctaagttagtttcagagctcttcttcgaatatctggaagagagacgagtttaggtcgatcgattttgaaaatggtatagagcttcgtttatttgtgagaacgaccaagctttttctattgtgatgttatggtataatgatatgcatagaattctacgtgaaccaggaatg

SEQ ID NO: 20527 - DNA, 3003 bp, Unknown
  misc_feature (1)..( 3003): 2750-1469P.txt file - cDNA_ID_1826801; gDNA_ID_1620751; Annot_ID_49821
agagttatccgaatataacaagtaagataatatgaacctgattagtagccgtgtcttcggcctgttggacaagagcgttaccctctgctgtgacatgctgtgaacgaataacaagttacagttaatgtcatacagtaattaagagactgcaagtagaccatgaagaaaagactatccatttgctaatcataaacaaaagaatgaagataggtaataaacctgcttaaagatgtttgcaacaggttccaagcctcgcaaaattttatggtaaagcctgtacatcctggagagatcatccacctgaaagtagacaaatataaccattaaagaaataattaagtcactaactactcaacaataaaaacaaaaatacttgctctaccttgtcatctcttagcaatgcacggcaccctgagtgttctttttctagaagctgacttgcaaacacaaccagcaattcatgttgtactttctgcatacaaaagattactatacaagtcaaacagatatcaatctttaaaatcaagtatgcctggactacgcatttaaaaagagtctggaaagtatctcaatacaaataacaaaattcaaaatcaaggcttatgcaagatctatggtttcttcatcaaacctacaagtacaggcataattacatagtgcataataaccaacctcaaccagctttggctcactgcttgagtgtaggtagtgagccactctctccctctccttctttagacattcttcagactgtaacatgaaagcacagaagttaataaataatttcaactattgtgaaataaaaacaaattttagaaaatgatatcacgagtcatgccttcaacatgtaatcagggcaagaatcttcctgaatccagcttgatgccttgcgagaataatacgaagaagtatcttgaagcatgaagctttcaaaatcttcttcatacctctccatctgccccattccaatctctacatagatatctaatacgtttttcagcagggccctatcaatctgctcgccctcccgttctttatcaacctgacagaagaacaggtcatgttagaccttgaatcaggcaaaagccagagttggatgtaactgcacaacaatattgacgccatacttacaagagctattacagcttgtttgaccttagaatgtagctcattataaacctgaagcgaacagaatcaaggaaaagttaaaaatatttcaatacaactgaaagctataaagccacaggaatgaatgccataccaggtcacggaagcatgtcaggccaacttcattcagtggtggaagtgatctccgagcaatgaagtaacggtcaaggtagtagaagaagcgggatagccatctgaccattactttatggtttgaccatcttttaaatagctcccgcagcataaactcatcatgcttctccctcaacgcaggcaaaacctaaccacagacaacaagagagcaaacattcaaaaccgtttgaatcaacttaaaaccaagaggggacaggacttcttgacatatgaaaccatgcacaaaagtggcatcttaaaattcagaggtagtaaaaacgagaagtttataagaaagaaactaaatatcaatcagactcactgttgagttaatatattcctcaaatgcttcccgatacttgtcataaagctgctgtgagtaatcatgaggaggtttctgggtgcacatgttgtagatagtcctgagaatcaaataaattccccatcataagtatcaggacaaacagccaaaccgctatataaggtaataaacaagtataaaacctacgtataaagcatcatatattgctcagagtcaaatgctggctcattcaatccttccagaatccgtttcagcttagtaattccagtctgcatatagtcccatccttgctccaagtcaatagtcttgcgctccatgttgacaaacaacttttcaagctctcctcaacctaagttaaccaaagaacaaggagaaaaccaaaatttagaacagcagtattaagcaacacaatgaaatgactgaagcgagagagtcaacaatatttatcattcttcagaggttataataacacgttaacacccacattatcgaatgcgaaacgagtattatcacccaaatcaaacccaaactatcagattgtgcgcaaacgaggacataagcatcagaatatactcgagaaacaatcaatccatgagataaacacgaaattacacagtagaaacgcaatccagagactccgacgtaaccctaacaatctcgatcccacaaaaattcaaataaaaacctagaaagacgaacaatcaacagaatgataaaaaaatcaactgtcgtatggaacaaaacaagcgagaatccgacagaaatagtgatacctcgagatcttaaaccctaataatcagaaaatcgcgtcgccgtaccccaaacagaccctgacgattaccgattcccgattacacaggatcggcgagagctgctgcgatcgaaaaagaagcgagagagagagagaatcaaaaccctaagaatcgttcaggaaaaaagcgtaaaatagagagaaagagagacgagacctatgagaagggcggtgaaaagatatctcaggaaacaaactcgttctcttctattctattattttcaggtcttatagatttaattatttttattttatgtcaactaatatattagtataatattaaacaaatttaatttcttaccttttcagagatctacatcaagacgctgcgttttataatttttctttgtaaagtaacttatttacttttatgcccctttattttgccttccttactcaaaccctaacccgaatcggctttttgacaatccgaaattaggtaaccatgttcattgaatttatcgtttcaacacattcgaatcactgagtcctacgtttcagtttaattccctgatgcacattttgaattcggtttgcgtattggtcttcgagttttccgtcggcggccatg

SEQ ID NO: 20528 - DNA, 3000 bp, Unknown
  misc_feature (1)..( 3000): 2750-1469P.txt file - cDNA_ID_1826801; gDNA_ID_2926183; Annot_ID_140672
gttatccgaatataacaagtaagataatatgaacctgattagtagccgtgtcttcggcctgttggacaagagcgttaccctctgctgtgacatgctgtgaacgaataacaagttacagttaatgtcatacagtaattaagagactgcaagtagaccatgaagaaaagactatccatttgctaatcataaacaaaagaatgaagataggtaataaacctgcttaaagatgtttgcaacaggttccaagcctcgcaaaattttatggtaaagcctgtacatcctggagagatcatccacctgaaagtagacaaatataaccattaaagaaataattaagtcactaactactcaacaataaaaacaaaaatacttgctctaccttgtcatctcttagcaatgcacggcaccctgagtgttctttttctagaagctgacttgcaaacacaaccagcaattcatgttgtactttctgcatacaaaagattactatacaagtcaaacagatatcaatctttaaaatcaagtatgcctggactacgcatttaaaaagagtctggaaagtatctcaatacaaataacaaaattcaaaatcaaggcttatgcaagatctatggtttcttcatcaaacctacaagtacaggcataattacatagtgcataataaccaacctcaaccagctttggctcactgcttgagtgtaggtagtgagccactctctccctctccttctttagacattcttcagactgtaacatgaaagcacagaagttaataaataatttcaactattgtgaaataaaaacaaattttagaaaatgatatcacgagtcatgccttcaacatgtaatcagggcaagaatcttcctgaatccagcttgatgccttgcgagaataatacgaagaagtatcttgaagcatgaagctttcaaaatcttcttcatacctctccatctgccccattccaatctctacatagatatctaatacgtttttcagcagggccctatcaatctgctcgccctcccgttctttatcaacctgacagaagaacaggtcatgttagaccttgaatcaggcaaaagccagagttggatgtaactgcacaacaatattgacgccatacttacaagagctattacagcttgtttgaccttagaatgtagctcattataaacctgaagcgaacagaatcaaggaaaagttaaaaatatttcaatacaactgaaagctataaagccacaggaatgaatgccataccaggtcacggaagcatgtcaggccaacttcattcagtggtggaagtgatctccgagcaatgaagtaacggtcaaggtagtagaagaagcgggatagccatctgaccattactttatggtttgaccatcttttaaatagctcccgcagcataaactcatcatgcttctccctcaacgcaggcaaaacctaaccacagacaacaagagagcaaacattcaaaaccgtttgaatcaacttaaaaccaagaggggacaggacttcttgacatatgaaaccatgcacaaaagtggcatcttaaaattcagaggtagtaaaaacgagaagtttataagaaagaaactaaatatcaatcagactcactgttgagttaatatattcctcaaatgcttcccgatacttgtcataaagctgctgtgagtaatcatgaggaggtttctgggtgcacatgttgtagatagtcctgagaatcaaataaattccccatcataagtatcaggacaaacagccaaaccgctatataaggtaataaacaagtataaaacctacgtataaagcatcatatattgctcagagtcaaatgctggctcattcaatccttccagaatccgtttcagcttagtaattccagtctgcatatagtcccatccttgctccaagtcaatagtcttgcgctccatgttgacaaacaacttttcaagctctcctcaacctaagttaaccaaagaacaaggagaaaaccaaaatttagaacagcagtattaagcaacacaatgaaatgactgaagcgagagagtcaacaatatttatcattcttcagaggttataataacacgttaacacccacattatcgaatgcgaaacgagtattatcacccaaatcaaacccaaactatcagattgtgcgcaaacgaggacataagcatcagaatatactcgagaaacaatcaatccatgagataaacacgaaattacacagtagaaacgcaatccagagactccgacgtaaccctaacaatctcgatcccacaaaaattcaaataaaaacctagaaagacgaacaatcaacagaatgataaaaaaatcaactgtcgtatggaacaaaacaagcgagaatccgacagaaatagtgatacctcgagatcttaaaccctaataatcagaaaatcgcgtcgccgtaccccaaacagaccctgacgattaccgattcccgattacacaggatcggcgagagctgctgcgatcgaaaaagaagcgagagagagagagaatcaaaaccctaagaatcgttcaggaaaaaagcgtaaaatagagagaaagagagacgagacctatgagaagggcggtgaaaagatatctcaggaaacaaactcgttctcttctattctattattttcaggtcttatagatttaattatttttattttatgtcaactaatatattagtataatattaaacaaatttaatttcttaccttttcagagatctacatcaagacgctgcgttttataatttttctttgtaaagtaacttatttacttttatgcccctttattttgccttccttactcaaaccctaacccgaatcggctttttgacaatccgaaattaggtaaccatgttcattgaatttatcgtttcaacacattcgaatcactgagtcctacgtttcagtttaattccctgatgcacattttgaattcggtttgcgtattggtcttcgagttttccgtcggcggccatg

SEQ ID NO: 20529 - DNA, 3000 bp, Unknown; identical to SEQ ID NO: 4981
  misc_feature (1)..( 3000): 2750-1469P.txt file - cDNA_ID_1826805; gDNA_ID_1620751; Annot_ID_49820

SEQ ID NO: 20530 - DNA, 3003 bp, Unknown
  misc_feature (1)..( 3003): 2750-1469P.txt file - cDNA_ID_1826805; gDNA_ID_2926183; Annot_ID_140673
agtctatgagtaaaatgtcactaaacaacaaaatgagaggtaaaataagtattattcgacacataaaccaaaacttgcctctgtttcagaagcaattgactctgcgaatcaatttgcgaactgttacgattttgtttcttcatagcttggattttcgcaaataacttggtccaccttgataacaaaccttttgccctgtttgatatgtctgatcttcaaatcagatgatgaaatcgaataaatcacaacaagaactttggcattgatgaaagctacgcagcatttaggtttttcagaaattacacctgatatcctatagaaacgaagtccattaacgctttgtaatatggcagacatattttcaggagatgctttgtggagaggtaaatgacaaagaacctgcgtgttaaatgtcaattatccataataaaacaatctgcatatttttacagccatccagctgcaagtaaattaatctcgtaccttcaggataagaagtaagacacttgtttgctcttcactagcagcttgacttaaccatgttgtaagtatcaaaacccctccttttgataaaaacctgtggcacatatagaaaatgactgtcaagacgggaatataataacaataaaataaaataagacagtgggtgaaagagaacccccaactagtaccagatcagcacagaagcatcttgtatctgcatgatccactccattagtttcacctggcctgaaaatgtttcctctttacgcagcagagaaaatatattctcaacaaagtatttgtctgaatcgctgatgtcaggtggaatatcttcaggtggaataagtgccactgtttcaccttcaccccagcttatagaacatgcctccggatgtatagagttcaagggaacgggttcaacatgatttgtggcattgttattttccggaacaccatcatcttgtaaagcatgcgtattggacataactactttctcccttgaaagcctcacctgtttcctcactcttgtcttttgagtaacaaaaaattctcgaacctgccattgaagaaaataataaagagacaaaccaaagtctcatgagtacctcaacatgacagatctaaactgacatggaattctaaaagcatggcaaaaaagagtacatatcatgtagaagaacaatacctgggcgactgtgatgccaaataaagcacttatctcccgagattccctcttactaatagcatctttaattgcgaaaactgcttgtagatacttaacagccttaggattcaacaagtctcttggccgctttcctgaaatatttacaaattcatcagatactaggcatcgagcacgtaaaagttgggtatgcctttaatgaacctagagagcaacaatgaattgaaacattctctgtgatatacgtaattatgccaaaagatctcacgaatcctaagatgactcaccaattttaatggacaaagcaccagcagcctgaaacaacaaaaaaattaaacagattaatgtctttaacagagatgattacttgatcagagaaatgacatataaacagttgaagcatcaccattacagttcacagaagaaacggagaggtcgagctatatgaatttataccaaaaacacctctaatttttgctagactcaatacccttcaaagaatttattccaaaatccgaatgacctgtccctctcagctttgcccatatcaccataccccaataaaacacgaactttagataccaaaaaacatagaaacaataacccaccatttcttgcgcaaggggattaacgccggtaagtttgcattgcgcaacgacgacatcttggagctgatcgatctggctatgaaaaagcaccttctgcgaatccaatagctccattaaagactccaccgagctcccgatttctatctcctccttgaacgcgtccatggccgccgacggaaaactcgaagaccaatacgcaaaccgaattcaaaatgtgcatcagggaattaaactgaaacgtaggactcagtgattcgaatgtgttgaaacgataaattcaatgaacatggttacctaatttcggattgtcaaaaagccgattcgggttagggtttgagtaaggaaggcaaaataaaggggcataaaagtaaataagttactttacaaagaaaaattataaaacgcagcgtcttgatgtagatctctgaaaaggtaagaaattaaatttgtttaatattatactaatatattagttgacataaaataaaaataattaaatctataagacctgaaaataatagaatagaagagaacgagtttgtttcctgagatatcttttcaccgcccttctcataggtctcgtctctctttctctctattttacgcttttttcctgaacgattcttagggttttgattctctctctctctcgcttctttttcgatcgcagcagctctcgccgatcctgtgtaatcgggaatcggtaatcgtcagggtctgtttggggtacggcgacgcgattttctgattattagggtttaagatctcgaggtatcactatttctgtcggattctcgcttgttttgttccatacgacagttgatttttttatcattctgttgattgttcgtctttctaggtttttatttgaatttttgtgggatcgagattgttagggttacgtcggagtctctggattgcgtttctactgtgtaatttcgtgtttatctcatggattgattgtttctcgagtatattctgatgcttatgtcctcgtttgcgcacaatctgatagtttgggtttgatttgggtgataatactcgtttcgcattcgataatgtgggtgttaacgtgttattataacctctgaagaatgataaatattgttgactctctcgcttcagtcatttcattgtgttgcttaatactgctgttctaaattttggttttctccttgttctttggttaacttaggttgaggagagcttgaaaagttgtttgtcaacatg

SEQ ID NO: 20531 - DNA, 3000 bp, Unknown
  misc_feature (1)..( 3000): 2750-1469P.txt file - cDNA_ID_1826809; gDNA_ID_1620751; Annot_ID_49819
ttatggaaacatattttaggctttgaaagaggcatttgagattttttgtaacaaaacggttgctggaagttcaagtgcagaactacttgcaacattttgcgacaatattctcaaaaaggggggaagtgaaaagctgagtgatgaagctatcgaagatacgcttgagaaggtacttttgtcaaactgttttttctttttcaagtctccaaagagtggtcctgaattttataatgttgttacaggttgtcaaattgcttgcatacataagtgacaaggatcttttcgctgagttctacaggtttatctccaacttcaatctttctttatctgtggatcgactctttttgcttctactctttgtttttcttgtaatgttttgtttttactagctttttgtggagatgccttgcaacaatatacaatttgattgacataagttggattactgagttgcaagccattttgtttatggttttgattgcaggaagaagctggcccgtaggctcttatttgatcgcagtgctaatgatgatcatgagagaagtatcctgacaaagctcaagcaacaatgtggtggacagtttacttctaagatggagggcatggttagtttgagtgtccctgtgtttcttattttaaagcggtgcgtgctctgatgacttatgttttctatataattttaatccgctggtgacaggtgacggatttgacactggcaagagaaaaccaaaacagtttcgaggattatctaggcagtaaccctgctgcaaacccagggattgacttgaccgtcactgttcttaccactggtttctggccaagttacaaatcatttgacataaatctacccagtgaaatggtaaaaactctattgattttcttacatacctgaaaaggagattgtttgcttctgatagatctaattcgttgattctttgtttcagatcaagtgtgttgaagtcttcaaagggttttatgaaacgaaaacgaaacacaggaagcttacgtggatctattcactgggaacttgtcacataaacgggaagtttgatcaaaaggccatcgagttaatagtgtctacttaccaggtactgtatgtttctcagaaaatactgatatatattttctatctgtaaacggactctgatgccacgttctctgtctctataggctgctgtgcttctactctttaacacaactgacaagttaagttacactgagatcttggctcaactgaacctaagccatgaagatctagttaggttgcttcattccttgtcatgtgctaagtacaagatactccttaaggagccaaacaccaagactgtctcccagaatgatgcctttgagttcaactccaaattcaccgatagaatgcgcagaatcaaggtttgtgacgttaatagtaatactcaaaagtctgcaagtttatgtcatgttttacatattgttaataactaacatcaacttgggtgatttgcgtcacagatccctcttcccccagttgatgaaaggaagaaagtcgttgaagatgtcgataaagacagaagatatgcaattgatgctgccattgtcaggatcatgaagagcaggaaagtattgggacatcaacaacttgtttctgagtgtgttgagcaacttagccgaatgttcaaggtaaattatacatataattatatttatacagagacatttgaagatgcacgtggtgatgaaactcattggatttgtgatgtttgttgcagcctgatatcaaagcgatcaagaagcgtatggaggatttaataaccagagattatttggagagggacaaggagaatcctaacatgtttaggtacttggcttagggcaaaaaaacaacaactatggaagtggttggctcatgaaaggaatctgcttgtatatttagaagtccatatggagactgtcctaaaacaaatttatcgcttcattttcgctatttttctcttttaaaaaatattcggtctgtgctttttttttgggatgcaaatttgccttgtggatttttgtttcttaaatattgaatggagatggagaaatggccttaatgaatgaatctctgctttctaatatatttatccttgatcatattatttaagttttatgtatctctgtgttatattgacggatgggaaagtcgtaacaaataatatgagatttcttataatcgaacgctaatgagacaaagatgaaccgacggaaggtgccttcctcaatcgccgaacattaaaaatcattgtaatcatctacgtcattagctatagtccaccagaaccgtaatagtttctgcttaggaccaatgtcttatattttaagccgtttttctgttgtatgatgatctgaaatattattgggatacaaagacgggtatgttaaggttaataacaattttgaacgggttaatggtggagctggtggattatattacttgattccaatgtgcttttttctttcttttttgggttaatatgaattatgaacggatcatcaaagacgatatttggagcctacacagagaatgatatatacgacatggagaaattctgttcatatatgttttgaggtgcggagtcattttactccatcgagcaaatgtttctcactttttatttgcttgagattctgttaaacaaacaaagaatcatgccattgcactatgatgaaaaagctgcgaggagatgtgcaaattataagaatcagcaaattccaacgggcttcaagtattacatgtatgggcctttaattaataaaatgggcctttaaagctactcgtatgtatcagtcctaaaccaaaagtaatagaccaataatgaattaaagtcaggcttattttagcaggcccatagaggctatagtcaatcctgcgccaggtgatagtgagataccgagtctagctccttggtttctctgcttctccttctctctcagatcaaaaaaaaccttcgtgtgcgtctctcgtcctctaaattgtcgaaaatg

SEQ ID NO: 20532 - DNA, 3003 bp, Unknown
  misc_feature (1)..( 3003): 2750-1469P.txt file - cDNA_ID_1826809; gDNA_ID_2926183; Annot_ID_140674
agtttatggaaacatattttaggctttgaaagaggcatttgagattttttgtaacaaaacggttgctggaagttcaagtgcagaactacttgcaacattttgcgacaatattctcaaaaaggggggaagtgaaaagctgagtgatgaagctatcgaagatacgcttgagaaggtacttttgtcaaactgttttttctttttcaagtctccaaagagtggtcctgaattttataatgttgttacaggttgtcaaattgcttgcatacataagtgacaaggatcttttcgctgagttctacaggtttatctccaacttcaatctttctttatctgtggatcgactctttttgcttctactctttgtttttcttgtaatgttttgtttttactagctttttgtggagatgccttgcaacaatatacaatttgattgacataagttggattactgagttgcaagccattttgtttatggttttgattgcaggaagaagctggcccgtaggctcttatttgatcgcagtgctaatgatgatcatgagagaagtatcctgacaaagctcaagcaacaatgtggtggacagtttacttctaagatggagggcatggttagtttgagtgtccctgtgtttcttattttaaagcggtgcgtgctctgatgacttatgttttctatataattttaatccgctggtgacaggtgacggatttgacactggcaagagaaaaccaaaacagtttcgaggattatctaggcagtaaccctgctgcaaacccagggattgacttgaccgtcactgttcttaccactggtttctggccaagttacaaatcatttgacataaatctacccagtgaaatggtaaaaactctattgattttcttacatacctgaaaaggagattgtttgcttctgatagatctaattcgttgattctttgtttcagatcaagtgtgttgaagtcttcaaagggttttatgaaacgaaaacgaaacacaggaagcttacgtggatctattcactgggaacttgtcacataaacgggaagtttgatcaaaaggccatcgagttaatagtgtctacttaccaggtactgtatgtttctcagaaaatactgatatatattttctatctgtaaacggactctgatgccacgttctctgtctctataggctgctgtgcttctactctttaacacaactgacaagttaagttacactgagatcttggctcaactgaacctaagccatgaagatctagttaggttgcttcattccttgtcatgtgctaagtacaagatactccttaaggagccaaacaccaagactgtctcccagaatgatgcctttgagttcaactccaaattcaccgatagaatgcgcagaatcaaggtttgtgacgttaatagtaatactcaaaagtctgcaagtttatgtcatgttttacatattgttaataactaacatcaacttgggtgatttgcgtcacagatccctcttcccccagttgatgaaaggaagaaagtcgttgaagatgtcgataaagacagaagatatgcaattgatgctgccattgtcaggatcatgaagagcaggaaagtattgggacatcaacaacttgtttctgagtgtgttgagcaacttagccgaatgttcaaggtaaattatacatataattatatttatacagagacatttgaagatgcacgtggtgatgaaactcattggatttgtgatgtttgttgcagcctgatatcaaagcgatcaagaagcgtatggaggatttaataaccagagattatttggagagggacaaggagaatcctaacatgtttaggtacttggcttagggcaaaaaaacaacaactatggaagtggttggctcatgaaaggaatctgcttgtatatttagaagtccatatggagactgtcctaaaacaaatttatcgcttcattttcgctatttttctcttttaaaaaatattcggtctgtgctttttttttgggatgcaaatttgccttgtggatttttgtttcttaaatattgaatggagatggagaaatggccttaatgaatgaatctctgctttctaatatatttatccttgatcatattatttaagttttatgtatctctgtgttatattgacggatgggaaagtcgtaacaaataatatgagatttcttataatcgaacgctaatgagacaaagatgaaccgacggaaggtgccttcctcaatcgccgaacattaaaaatcattgtaatcatctacgtcattagctatagtccaccagaaccgtaatagtttctgcttaggaccaatgtcttatattttaagccgtttttctgttgtatgatgatctgaaatattattgggatacaaagacgggtatgttaaggttaataacaattttgaacgggttaatggtggagctggtggattatattacttgattccaatgtgcttttttctttcttttttgggttaatatgaattatgaacggatcatcaaagacgatatttggagcctacacagagaatgatatatacgacatggagaaattctgttcatatatgttttgaggtgcggagtcattttactccatcgagcaaatgtttctcactttttatttgcttgagattctgttaaacaaacaaagaatcatgccattgcactatgatgaaaaagctgcgaggagatgtgcaaattataagaatcagcaaattccaacgggcttcaagtattacatgtatgggcctttaattaataaaatgggcctttaaagctactcgtatgtatcagtcctaaaccaaaagtaatagaccaataatgaattaaagtcaggcttattttagcaggcccatagaggctatagtcaatcctgcgccaggtgatagtgagataccgagtctagctccttggtttctctgcttctccttctctctcagatcaaaaaaaaccttcgtgtgcgtctctcgtcctctaaattgtcgaaaatg

SEQ ID NO: 20533 - DNA, 3000 bp, Unknown; identical to SEQ ID NO: 4980
  misc_feature (1)..( 3000): 2750-1469P.txt file - cDNA_ID_1826813; gDNA_ID_1620751; Annot_ID_49817

SEQ ID NO: 20534 - DNA, 3000 bp, Unknown; identical to SEQ ID NO: 4980
  misc_feature (1)..( 3000): 2750-1469P.txt file - cDNA_ID_1826813; gDNA_ID_1620751; Annot_ID_166795

SEQ ID NO: 20535 - DNA, 3003 bp, Unknown
  misc_feature (1)..( 3003): 2750-1469P.txt file - cDNA_ID_1826813; gDNA_ID_2926183; Annot_ID_140676
gcctctaatagcttctggttctttccgttctcatatatctagcagatccactacctatctaccatgacgccaagtagtgacggtactgtccgtcgtacttattgctctctatttttagaacatgacgaatgaattgtagttatctattattgtatccctcctaattctaattaatgtattcaactattagaatgtattgaaaaaatcgcttatttttctgtttgtaagttaaattttcctatatcacttattgagatgtttacataattcaaaaacgtcacataattatcttgcgagatataatcaaattcgagatatgcgctaagcaaacaagctccaaataaagtatttcaaattcaaaagagacaatttagtttcctagaaaatgttttctctcttctatcacaattcaggttgattcccaagcttgtcgatatggaagattctgtttgctagcttatcaatctcagcgactcctctctctaatttgagtctacaccaacaaaaactaaagggttcacatcattatgcctaaatggagctcatttataaaggaacaacttgtgcttaaggaggtaattctcagaccaaacacgaacatccaacataagaagtaataaaagctaagaaaaacagttatttacaaaaatcaataaataaaacaagttttgttttggatgaaaaaaaaaaaaaaaaaaaaacaagttttgttttgataatatattaacacaaaaaaaatcagttaatcaacttaatagtttaatatattaattattatccctttaagaatttttttttctaatgcccttttcatgatgccctttttcaactttacccttttgttttatccaattttatttctaccctctttaaatttttaatgaccattttacccttatttggaaattgttttaggttaacaaaatgaaaaattaatattttttcgccaaaaatattccaaaataaatttcccgccaaaatttgttttcaaacatatttttcccgccaattttttttttttggcgggaaatagatttacaagggattttaaaagagttttaaaagatttacaagggattttataggggttttataagatttacaagggattttaaaagggtaatttacaatagattttaaagggatttcaaaaatttacaaaagtcttttaaagatttttaaaggctttaaaattgttttaaaaaattttaaaatatttacaagggattttaaaagggttttacaatatttacaatggattttaaagggctttaaaagatttacaaaggatttgtaaagatttttaaagagtttaaaagtattttgaaagatttacaagggattttaaaaccttttaaaattacttgtaaattttttaaaacccttttaaaatccattgtaaatcttttcaaactcttttaaaatcttttgtaaatcttttaaaacctttttaaaatctcttgtaaatcttttaaaacccttttaaaattctttgtaaatctatttgccgccaaaaaatatttacaaggatttttaaaatcatttttttggctgaggaaaaatttgttacgaaaaaaatttttgccgggaatgtttttttttgtcgggaaaaaagtttggcagaaacttttctttttggcgggaaaaaaaaaatttggcgccaaaaaattggcgggaaaagttcagttttcaattacatgtttctattagatgagggtaatttggtcattttgttcaagagaaggggtatttttaaaaatggacaacataaaagggtattgttgcaaaagagtagtaaaaaaagtgtaattttataaatctcccttattttaatatacaaacaaatattatttttacttgtgtataattttgtcttttgataattttcattttttgataatgttaacaattttctagttttgttttaaatatattgtttaatttagatttgacatgtaatatatataaacagatattattttttacttgtataaatctaatattttaattgacacatgttccggtcattttaaaaaccaaactttatataataagataaaaatgataaatcttattctatttataaatacattttattaatttataaagaatacaacacatatacattcgttctaaccgtatcaattttaaagacacaaatacaaactaaaaccaaattaagttcaaccgaaccaaacgagataaaccgatctattctaaaaaaaaaaaaaaatacttcctttgtagccttttgattgttcgagcatcatcaagtttacattgttcgagcattatccaatccagtataaaatattattcacaccggagaacggtacaattcttcaataaaagatgagtcgacagcgaccgctctaatcagtggaactctgaagtttctgtatttttatctttcttacatgatctcattttttttattttttattttttcacaatcttacatgatctcctagtatcacttaattatatacaacgaaacatgtgaactggaacatagttgatagaaaggaaaaagagggaaaatgtgatttgattatagatttaactcattaacaatgtgtgattgtgtgtggatgctttaagtaaacacggaatagaaacgaataatatggaaactggaaagttgaaaacgcgtttcctaatttgtctcacagatttttaatactaaaaaaaagtggaatatataaactctataataaggtcgtaatcaaattacatgaagataatagagatcatttaccataattaatctaatcaaaagcaattagtattattgacaatgacaacaaatcatcaacacaaagaggaaaataaataaataaaaaaactcagaagaatctgtctcactgatttcttcatcttcttctcttcctggacccgacattccagtgttggtacataaaagactcttcctttgtctgttttttgttcccagattcatctttacttattgactaaattctctctggtgtgagaagtaaaatg

SEQ ID NO: 20536 - DNA, 3003 bp, Unknown; identical to SEQ ID NO: 20535
  misc_feature (1)..( 3003): 2750-1469P.txt file - cDNA_ID_1826813; gDNA_ID_2926183; Annot_ID_200437

SEQ ID NO: 20537 - DNA, 3000 bp, Unknown; identical to SEQ ID NO: 4979
  misc_feature (1)..( 3000): 2750-1469P.txt file - cDNA_ID_1826817; gDNA_ID_1620751; Annot_ID_49816

SEQ ID NO: 20538 - DNA, 3003 bp, Unknown
  misc_feature (1)..( 3003): 2750-1469P.txt file - cDNA_ID_1826817; gDNA_ID_2926183; Annot_ID_140677
aattgtttctttaaagcttaagtgagatgtgactgtgtctgattataagcagcgctttgagtatttaaagttcaaatctttcactttttttttttctttgtgttgctttagtgcaaatttgtggatgtatgatgaatcattttggtgaattgcagagctgatgttgttagggtttatatcgctgttactgacggtattccaagggctcatttccaaattctgtgtgaaagaaaatgtgcttatgcatatgcttccatgttctctcgattcaagacgagaagctggggcaagtgaacataaaaacgttacagcaaaagaacattttcagacttttttacctattgttggaaccactaggcgtctacttgctgaacatgctgctgtgcaagttggttactgtagcgaaaaggtaaattcaaataccttcagggcctcactatagtcatattaggtgttgctcttgctattacttgattgaatcagtacttacttctctccctcttgttttcagggtaaagtaccattgctttcgcttgaggcattgcaccatctacatattttcatcttcgtcctcgccatatcccatgtgacattctgtgtccttaccgtgatttttggaagcacaagggtgagcacaaaccaatatagaaattttctacattcaatgtatatataaattaagttctcaggtgtgaaacctctggtttatctatgttaatgcagattcaccaatggaagaaatgggaggattcgatcgcagatgagaagtttgaccccgaaacaggtactaaatcgattatatgctagcggaacattatgcatattgtttgattatttattgtgctttgttgcagctctcaggaaaagaagggtcactcatgtacacaaccatgcttttattaaagagcattttcttggtattggcaaagattcagtcatcctcggatggacggtatggtatctttaaattacattactagttttatattggttatttgtcctttggaactacccgatgttgagagtatgttgtttgcatgacagcaatcctttctcaagcaattctatgattctgtgacgaaatcagattacgtgactttacgtcttggtttcattatggtaaaatcttgattacttacaaaaattgagatttggtaatcaagaacatttgctttgatcttttagtctaacaatctatatggtttaaatacagacacattgtaagggaaaccccaagcttaatttccacaagtatatgatgcgcgctctagaggatgatttcaaacaagttgttggtattagttggtatctttggatctttgtcgtcatctttttgctgctaaatgttaacggtatgcttttcacaaaactcaaatctttttcttatgtctagtttcaatagaaatgaaaagaaattgttattacgtttcctttgatatcgaagctacaattatgtatcttgcaggatggcacacatatttctggatagcatttattccctttgctgtgagtcatttgtttttgtcctcattttacttcgttggaatgtgcttaaatcttctttcagttgagctgaatttgttttttttaatgtaaaatttgaagttgcttcttgctgtgggaacaaagttggagcatgtgattgcacagttagctcatgaagttgcagagaaacatgtagccattgaaggagacttagtggtgaaaccctcagatgagcatttctggttcagcaaacctcaaattgttctctacttgatccattttatcctcttccagaatgcttttgagattgcgtttttcttttggatttgggtaagtctggttctttaagaaaagaaaaaacaaaattttaagattcacctaaaatggttaagactgatgactttattttaggttacatacggcttcgactcgtgcattatgggacaggtgagatacattgttccaagattggttatcgggtaagcataaagattcgacattttttcttttgttctttctcatattgtttcgttgagtataactcattgtagactggtatctttcttcttctctttagggtcttcattcaagtgctttgcagttacagtacactgcctctttacgccatcgtctcacaggtaacaagctaatttttactaaaaagcttgagaatcttttggtttggttttttggattctttctgaaaagttgacccttttcttatattacaacagatgggaagtagcttcaagaaagctatattcgaggagaatgtgcaggttggtcttgttggttgggcacagaaagtgaaacaaaagagagacctaaaagctgcagctagtaatggagacgaaggaagctctcaggctggtcctggtcctgattctggttctggttctgctcctgctgctggtcctggtgcaggttttgcaggaattcagctcagcagagtaacaagaaacaacgcaggggacacaaacaatgagattacacctgatcataacaactgagcagagatattatcttttccatttagaggatcatcatcagattttagcttcaaggtccggttttgtggtttatacataagttatagtgacttgatttttttgttttgttacaaagttaccatctttggattagaattgggaaattgaatctgtttgtatattgtattatttggaacattgtggatgcccatggatatgtttctgttcaattattttggttttgggtaatgaaatttgaaaccaacgaaaaaccaaaaatattcttcagttggaatttggtttcttacaatgtgttggaaaaagtacatttaaatttcaagactttggatttgttgtacagtaagcaatcaaatatgatttaggttaaaccggttaattttactttggtttggatgattaaaccggctccaaattaatattccttttatctctctgctttttacttttgtacgagagttaaagccacactagtcactcgcgctagtctcttcttcgaacgcttgcaatg

SEQ ID NO: 20539 - DNA, 3000 bp, Unknown; identical to SEQ ID NO: 4978
  misc_feature (1)..( 3000): 2750-1469P.txt file - cDNA_ID_1826825; gDNA_ID_1620751; Annot_ID_49812

SEQ ID NO: 20540 - DNA, 3003 bp, Unknown
  misc_feature (1)..( 3003): 2750-1469P.txt file - cDNA_ID_1826825; gDNA_ID_2926183; Annot_ID_140681
agctttttgtggtaaatttagatttttaaaaaactccatatattttttttttataatttaggcttgtctattgtaaatttgtaatatagcttagtgatttatttgtttagcttctggtgacattttataaatttttaatgaccagtataatatagtatttttttataaattaaaatataatctaatgttttatgtcaacttcgttgttcattgaataaatcaaactttgaagaataattaaataacaatgtttgcaaaaactgttacgttttttcatgtaaacattagtggacgttatacaatagatatttaaattataaaaactattcaaagaatattgtaaagaaataaaacagaaatgtgtaagaaaaaatgtttattttattgtacgtaataaaaaaagagaatatacttgtgtgggtggacctaaatgcaaataggcaaagtaccgacaaaaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgattgttgattccgatgattatcgtcgtgttcttaagaacaagcttgagactgagtgcgctactgttgtttctcttcgggtgtgttgttaatcttctatttttcttatctatatgtgtaatttgtgcgttttgatctaaatctgaagctctgatgttctcttcttaggttgggtctgtgaagcctgaagattcgactagttctccagaaactcaacttcaaccagttcaatccagtcctcttactcaaggtaagagtctcttcttagtttcaccaggatagatgagcgatgataaacctgcagattcgtttctctgttctgtgtttgttaatttagatgcctaggttaaggaattagaaatagaaaatggtacttttgttggatcaagcgcctagttttatccgtcaagtttcaatctttttgtgactgactttctcattgaaattaaactgctttctggaagaacaataagcttgggattgagatgagttctggtggttagttcaatatatgggaaatcattatttcagcgctcgtctttctctttcagatatctcttctgagtcttagacatagtaagttttaatcgtggtaggttctttgatgaccccaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggtaatcattactttttctccaatttcttgtcgtttgaagattacatttatagagccttgttcttccttttaatatttgtaggatgctgtcaaatcgtgagtcagctaggcgatctagaaggagaaagcaggagcaaacaagtgacctcgaaacacaggttttgtgttgtatcctctcaacacctcatttttgtgttgaaggatattaatgagacctaatttgtattttgataggttaatgatctaaaaggtgagcattcatcacttcttaaacaactgagcaacatgaatcacaagtatgacgaggctgctgttggcaatagaatactaaaggctgacattgagacattaagagctaaggtaagaagacttaagtattatcctcctctcctttttctgaactaccctttttttgtatacagttttagtaactcccatgttatgttaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggtaagctaaaacatggctctttcttttaagaccattgaacaatttaaaaccatttgaagtactatgatccctgtttatacatatcagattcctgtctcccctttttttgctcattttacaggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataacagagtgtatatctgtttttatccaattttaaaaaagatagctcacatggctttactaatttcccctatcattaaattccgacaacctcggcgatttccatggtagatcgatcaagcattcacattttctcgtcagaaaacacaaaaaaaaaaaacagaggagaaaaagagacgacgacaaacaagtgaaagaaaaaagtcgtcgttcttccaatttttttctcctctctcttcctctgtttaacggcgtacgtaagtcaaaatg

SEQ ID NO: 20541 - DNA, 3003 bp, Unknown
  misc_feature (1)..( 3003): 2750-1469P.txt file - cDNA_ID_1826835; gDNA_ID_1620751; Annot_ID_49809
tctgcacaacataccccaaattaagttacgaaacctggttatgcaatcaaaaagctaccacatttaaaatcaagtttcaagtttctcattttatgcaatgcttatagtgatatcaagtgtcaaattctagcctaaagattactataaagagcaccacattcaaaaagttaaaagctctcattctctgtactgcctttagcagtgacaaatcaagcctttctaatttctaagtgtaaaacaatgctgccaaaactaacacatttcataggctaaatcccttatctgtaatgtctaatgtgaaatctcacttcttagtctcgtaaaaatgctaccatatccgatacgcttaaatcttgtgctctctaatgtctaatataaaatgaagttgttaactgtttagcctaaagaatgataccaaaactaccacatttcataagctaaagactacaactctcactctctccaatggaaattggaataagtagctttacttgtattaaggcgaagaaaataagcacggtgagagcgccaaacaagaagggtccaaggaaattaaagtcatatcctttcctagcagcccaaaaagtatataatgtgagcgaaagcaccactaccgatgtcaagatcactgactcgagaatcactttccctgtgtccaacacagaataagctttaaacatatacacaatcagaatcatagaaaaaactgagagatgaaatttgctaagagctagttccccaatagcaaaaacagaactttgttgcctaatggatccttaacaggtaaccaaaagtggttgatcaagtcataccattggtgaaggcacatgttaatccaacaacaaaagccagagccaaagtgaaaatccccaagagcaagtaattcaccggatgtttctgatggtaatagtacaacggacacaacactatacatcggagagaaacacaaatccaagtttcagcttttgagattattaccaaacttcgaaaaagattgaaacttttgatttgtaaaacaagtgtgcgtgatgattgtacctatgagaggtgtgatgatgatgactatgtaaagagctaatccaagtccggtggtggcgaagaacagagcgattggacggacggtgaccaccgtggcagcgacagcgacggtggctagaagctgaaaggcgattatagagtagaccttgcgtataaatccccaccggagctcgggattttcatgcatcgctgggtatagtaaaggccttcttgagctaacgcctgtttccacgtcatctttccggtacggtaagttccactgatacattatttacgatagcagagtctttataaagtgaaggaacgcgcgggaaaattcgaatcctttcgattactactgtatcacgatctacagagagagaaccacaagcgagagagaaaagttgatgcggtgctttgcttgagcttcttcggattttcctgggagaagcggtgatgccaagaggaagaagaaagttcatgaaagctctcggctaaaccgtagatgacgcgtggcaaccggagatgtcgcataagcggtgacaaggatttgatgtgtccaaagggaaagtgttcttttttttggctcaacacaatacttgcttaaccaaacttcacagtacatttcaaatagtaacgaaattttttatatatatatatatatatatatatttttattactatttaaaccgtacaatattttatctataattaatttgcatttttccaattagaacttaactaaaaaaaattagttgatcaatagtatcattcttgcatttaatatagagggttttcaatcaatatatgtaagatatttttaatcaattatttaaactgaaataattaaaagtaaaaattgatttgaaatttggataaaaagtaaacaaaaataaatttttagagaaattaatttgggatatattttcatcgttgataaataatattgaaactgaaattacttaaaatgatgcagttttaaattttaacgctagtttttataaactttttttttggttttggtggtgttaaatgattgagttgatagtttaacttgttaaatgaaaatataattataatgtagattcttgactaatcatagtttatatttttaatcgtaattgagacacaaaaggctgttatgcttgatcatttttgtatacattattgtagaatgtaaaaacttataattaatagaaaaaataataatttagttcaaaaaatagaatttttcacaatctcttgaagagtggcctaagaatccgatagtggtggttactgtttgtgttgagatatagcatatgagcaaaaacaattgaaaagaagaaaaactttcccttttaccaatgaaacaaaagagctctcagataattagaaaagtgtcaatttgtataacatttcccactctctctctcacttcgattcacttttgctcaaacttgacaacttgtccgaatctgtccatagcacacctctctctctgttttagggttttctcttcactggtgctttcttccttgtctcgctggttcaaagattcttactttttgatgtctaagacatcttagatttgttagactctctttaatttttctgggtttagccactagattatgttatactgctagaaggttagggtttggtcgagaaagctctaattttggtgatttatcctcttaatttcgcaaagggttatcttttcaatggcaattgcgagtgagttttgttattctcacttatgtatttagtaattgttccgtcagctgtacataagtggttggtttcatagagaaatgcttttagctttaggtgttgtaagatctcataataccaaagttcagatttttttgtataggattccattaagtagcccatctccacttagtttctggtctgggtagtgtgtaaccgacaagaaaatagtgttttgactatcctctggctatcctggagatctgggatttgtttcatctgttatgtcagatg

SEQ ID NO: 20542 - DNA, 3003 bp, Unknown; identical to SEQ ID NO: 20541
  misc_feature (1)..( 3003): 2750-1469P.txt file - cDNA_ID_1826835; gDNA_ID_1620751; Annot_ID_166787

SEQ ID NO: 20543 - DNA, 3000 bp, Unknown
  misc_feature (1)..( 3000): 2750-1469P.txt file - cDNA_ID_1826835; gDNA_ID_2926194; Annot_ID_141172
gcacaacataccccaaattaagttacgaaacctggttatgcaatcaaaaagctaccacatttaaaatcaagtttcaagtttctcattttatgcaatgcttatagtgatatcaagtgtcaaattctagcctaaagattactataaagagcaccacattcaaaaagttaaaagctctcattctctgtactgcctttagcagtgacaaatcaagcctttctaatttctaagtgtaaaacaatgctgccaaaactaacacatttcataggctaaatcccttatctgtaatgtctaatgtgaaatctcacttcttagtctcgtaaaaatgctaccatatccgatacgcttaaatcttgtgctctctaatgtctaatataaaatgaagttgttaactgtttagcctaaagaatgataccaaaactaccacatttcataagctaaagactacaactctcactctctccaatggaaattggaataagtagctttacttgtattaaggcgaagaaaataagcacggtgagagcgccaaacaagaagggtccaaggaaattaaagtcatatcctttcctagcagcccaaaaagtatataatgtgagcgaaagcaccactaccgatgtcaagatcactgactcgagaatcactttccctgtgtccaacacagaataagctttaaacatatacacaatcagaatcatagaaaaaactgagagatgaaatttgctaagagctagttccccaatagcaaaaacagaactttgttgcctaatggatccttaacaggtaaccaaaagtggttgatcaagtcataccattggtgaaggcacatgttaatccaacaacaaaagccagagccaaagtgaaaatccccaagagcaagtaattcaccggatgtttctgatggtaatagtacaacggacacaacactatacatcggagagaaacacaaatccaagtttcagcttttgagattattaccaaacttcgaaaaagattgaaacttttgatttgtaaaacaagtgtgcgtgatgattgtacctatgagaggtgtgatgatgatgactatgtaaagagctaatccaagtccggtggtggcgaagaacagagcgattggacggacggtgaccaccgtggcagcgacagcgacggtggctagaagctgaaaggcgattatagagtagaccttgcgtataaatccccaccggagctcgggattttcatgcatcgctgggtatagtaaaggccttcttgagctaacgcctgtttccacgtcatctttccggtacggtaagttccactgatacattatttacgatagcagagtctttataaagtgaaggaacgcgcgggaaaattcgaatcctttcgattactactgtatcacgatctacagagagagaaccacaagcgagagagaaaagttgatgcggtgctttgcttgagcttcttcggattttcctgggagaagcggtgatgccaagaggaagaagaaagttcatgaaagctctcggctaaaccgtagatgacgcgtggcaaccggagatgtcgcataagcggtgacaaggatttgatgtgtccaaagggaaagtgttcttttttttggctcaacacaatacttgcttaaccaaacttcacagtacatttcaaatagtaacgaaattttttatatatatatatatatatatatatttttattactatttaaaccgtacaatattttatctataattaatttgcatttttccaattagaacttaactaaaaaaaattagttgatcaatagtatcattcttgcatttaatatagagggttttcaatcaatatatgtaagatatttttaatcaattatttaaactgaaataattaaaagtaaaaattgatttgaaatttggataaaaagtaaacaaaaataaatttttagagaaattaatttgggatatattttcatcgttgataaataatattgaaactgaaattacttaaaatgatgcagttttaaattttaacgctagtttttataaactttttttttggttttggtggtgttaaatgattgagttgatagtttaacttgttaaatgaaaatataattataatgtagattcttgactaatcatagtttatatttttaatcgtaattgagacacaaaaggctgttatgcttgatcatttttgtatacattattgtagaatgtaaaaacttataattaatagaaaaaataataatttagttcaaaaaatagaatttttcacaatctcttgaagagtggcctaagaatccgatagtggtggttactgtttgtgttgagatatagcatatgagcaaaaacaattgaaaagaagaaaaactttcccttttaccaatgaaacaaaagagctctcagataattagaaaagtgtcaatttgtataacatttcccactctctctctcacttcgattcacttttgctcaaacttgacaacttgtccgaatctgtccatagcacacctctctctctgttttagggttttctcttcactggtgctttcttccttgtctcgctggttcaaagattcttactttttgatgtctaagacatcttagatttgttagactctctttaatttttctgggtttagccactagattatgttatactgctagaaggttagggtttggtcgagaaagctctaattttggtgatttatcctcttaatttcgcaaagggttatcttttcaatggcaattgcgagtgagttttgttattctcacttatgtatttagtaattgttccgtcagctgtacataagtggttggtttcatagagaaatgcttttagctttaggtgttgtaagatctcataataccaaagttcagatttttttgtataggattccattaagtagcccatctccacttagtttctggtctgggtagtgtgtaaccgacaagaaaatagtgttttgactatcctctggctatcctggagatctgggatttgtttcatctgttatgtcagatg

SEQ ID NO: 20544 - DNA, 3000 bp, Unknown; identical to SEQ ID NO: 20543
  misc_feature (1)..( 3000): 2750-1469P.txt file - cDNA_ID_1826835; gDNA_ID_2926194; Annot_ID_201273

SEQ ID NO: 20545 - DNA, 3000 bp, Unknown; identical to SEQ ID NO: 4992
  misc_feature (1)..( 3000): 2750-1469P.txt file - cDNA_ID_1826854; gDNA_ID_1620751; Annot_ID_49827

SEQ ID NO: 20546 - DNA, 3003 bp, Unknown; identical to SEQ ID NO: 17516
  misc_feature (1)..( 3003): 2750-1469P.txt file - cDNA_ID_1826854; gDNA_ID_2926183; Annot_ID_140666

SEQ ID NO: 20547 - DNA, 3003 bp, Unknown
  misc_feature (1)..( 3003): 2750-1469P.txt file - cDNA_ID_1826878; gDNA_ID_1620753; Annot_ID_49864
tgctgggtaaaatgcagttacatggagatatgtgcaaggaactatctgcagtttattgcaaggtattgtccatcttcccttcgttggaagaagcaagacctcggagtaaatcagggattcaaaccttgtgttcgttacatattgcacttgagaaggcaaagaacattcttcaacactgttctgagtgtagcaaactttatttggttagttgctctttctttctttggatacattattctcttttgtgtgtttggtctctctcttgaattcctccacttttatatgttgagcaggccattactggggatgctgtactgttaaaatttgagaaagcaaaatctgcacttatcgatagtcttagacgtgtggaggacattgttcctagttcaattgggtctcaggtaatgtatatatcagtgcacacaaaatctttccttttgcaagttaataagtgtccagggcttatgtgctagatattggctttttttgtttattgattttagaattctagttgataaaatggtttatgctaatgttatttgacttcttcagattttggacattgttggtgaactagagcacaccaagttcctacttgatccatcagagaaggaagttggtgataggataattgcactattacaacaagggaagaaatttgacaacggcagtgacagtaccgaacttgaaatttttcaccaggcagctactagactcagtataacttcttctagatcagctctggcggagcggcgtgctttaaagaaagtcattgacagggcacgtgtggaagaagacaagcggaaggagtcaattgtggcttatctgttgcatctcatgagaaaatactccaagctatttagaagtgagatgatggatgagaatgactctccttgttcaacaccgtgttcccctactggtcaaggtcctaacgaagatcgtgttaatgcgtttgggcgacaactatccaagtttggttctattaactataagcctatgaacagtaggaaatcaggacagatgcctattccaccagaagaacttaggtgtcccatatctttgcagcttatgtatgatcctgtcatcattgcttctggacagacttatgaacgggtctgtattgagaaatggtttagtgatggacataactcttgtcccaagactcagcagcaactcccacatctttccctgactcccaattactgtgttaaaggtttgattgcgagctggtgtgaacagaatggaatcacagtccctactggaccaccagaatctcttgacctcaattactggagattagccatgtctgactctgaatcccccaattcaaagtcagttgatagtgtaggattgtgcacaccgaaggatatcagagtcgttcctttggaggagagtagtactattgaatctgaacgacaacaaaaagaaaaaaacaatgctcctgatgaggtggattctgaaatcaatgttctagaggggtatcaggatatattggcaatcgtggacaaagaggaggacttagctaaaaagtgcaaagtagtagaaaatgtcaggatattgctaaaggataatgaagaggccaggatcctcatgggagccaatgggttcgtggaagcgtttttgcagtttctagaatcagctgttcatgataacaatgcagccgcacaggaaaccggagctatggctctatttaacttagcagtcaacaataacaggttagttattatcacatccttcctgtctttgttaccaatcaaattccttagcaatgtcactttctaacatcccattcatggtgctcttcatttgcaaaccttgtcataatctcttctgtttcgttcttttggatgcactgcaggaacaaagagctgatgctgacttcaggggtcatcccactgctagagaaaatgatttcttgttcccaatcccaagggccagcaactgcgttatatctaaacctctcttgcctcgagaaagccaagcccgtgattggctcaagtcaagcagtttcctttttcgtgaatcttcttcttcaggatacgaaaacccaatgcaagctggacgcccttcacgccctctacaacctctccacctactctcccaatattcccactctcctttcatcaaacataatcaaaagcctccaagtccttgcatcaacaggtaaccacttgtggatagagaagtcattagccgtattactaaatctagcctctagccgggaaggaaaagaagagatgataacaacacaaggaatgatcagtacacttgcaacggtgttagacaccggtgacacagtcgaacaagagcaagcagtttcttgcctagtgatcctatgtacgggaagcgagtcgtgtatccagatggtgctacaagaaggagtgattccgtctctggtgtcgatctcagtgaacggaagtccccgaggaagagacaagtctcagaagcttctgatgctgttcagggaacaaaggcatagagatcagccatcaccaaacaaagaagaagctcccaggaaaaccgtatcggcaccaatggctatacctgcgccagtttcagctccagagtcagaagtaaaacctttgactaaatcaatctccagaagaaagacaatgacaagaccattcagtttcctctggaagaaaagccactcgatccatcattgacactcctatgtaaagttgcgttttcttctgtcgtccttaacttcttacaagtcatccgcatagagaaaaaaaatatttgtacaggtcacattgtgatcacaccattttttgctaacgaatcctctctcgcgagaggtatccatgtagatagtctactgatgtatcaggttatatatatgaaacctcacttttcagtacaaaaacagagtcgacaattcttgaaaactctgtttgacatctgtttattttgacggtcgattcacaggtggaccaattctagtggataaaactagtgccacgtagtatgaataaatactatataataatacttaaaatg

SEQ ID NO: 20548 - DNA, 3000 bp, Unknown; identical to SEQ ID NO: 5005
  misc_feature (1)..( 3000): 2750-1469P.txt file - cDNA_ID_1826890; gDNA_ID_1620753; Annot_ID_49860

SEQ ID NO: 20549 - DNA, 3000 bp, Unknown
  misc_feature (1)..( 3000): 2750-1469P.txt file - cDNA_ID_1826902; gDNA_ID_1620753; Annot_ID_49857
agaaaaggtacaccatcccatcttgcattgtcgatgaagagtgcagcagctgcaaatgtcggggtcagactaccttttggcacagttttatcatcagtatagcttggataagtgactcctcctatgctgtggctcttgtactgtcctatcaccacatcttcaagttttattggtctcattgaacgtagtacctttacctgaattaatgcgaggacctcaaaatactgccttgaaatcaacaaaattataagaaagggaacaataggagaccttttcatttctgatatcctctgcatccaaactcacaggtgtttccatggcgaaaagagctaatatctgaagcagatgattctgcattatatctcttattattccgtaattgtcgaagtacctggatttgaagagtagaaaagtgtcaaaacataggcttcaacacacatgagaaataaaatattagacagaggacaacaaggattaccctccgcgtccttcagtgccgaaatcctcagaaaaaatgaattgcacgttccttatatactgccttgaccatagcggttcaaatataagatttgagaatcgaagaaccgacaagttctcaaccagctccttccctaagtaatggtctatcctgtaaaaatcaacttttcgtatcagcaaggtatcttaaaccatcatcactaaaatttacaataacataaacacgatctctccacctaaatatttggtcttcctccaggtactgcttaagagactttgttaatgcagccgaggttttggagtcccggccaaaaggtttctcgacaatgaccctagtccatccattgacagatgaagcagatgagcttgcacatttcaccgcgtcaacaaagatatttggagggattgaaagatagaaaagacggttcgaaagtcttccaccctgcaaatagttatgtgatggataagggcaaataagaaagaaaaaatgtaagaagaccaaagttttctagtttttactaatttttcagaaacaacaatagttttcctaattctgtattcaggccataatctacagcatatcaccttacacctaccaaggtaactcatgacctcaattagccttcagaaaaatgaggcaatgatgcaatgtggttgcaaggaattcatgaggaatgcagaaaaaaacaataagctgaggaaaacatcaatacctcatgctccttgagcttctcgtccaatgcaacaaaatgttcctgagaatcatactgacccgaatggtaaaaacatctcttgagaaactcttccatcttttcaccgcagtttgccctgaaccatcacagttaaatgttaaacaacccatctctgacaaagtaccaagggaaagaaaccataaggactaatgtcttggtggttttaaaagctacaataattattcacctcttatcaattctacatgtcaatgttttgctgaccataactctaagttcagcatctgtcatcttactccttgcatagccaaaaatggtaaaatgctgcgaccaaaaacagcttaccacatcaatcaatataacaatcaatcatcagaaagagagaaagatagaagaagttatttatacctcaggaagacagccttcatagtaaagtgcgaaaagagctgggaatattttcttcttggcaagatcaccagaagctcccaccaccgtgatactaactgttgaaagttgttcaccgccatcagactctgctacaaccttgtcagcttcaagtgaaggaatcgttaacacccctacatctttcgcctcctcggacgagcttgactcggtggctactgatcctaaacacacaattgtaagcgcattagagaacattcattacatgcaatgttttgtctaaagtcggatactttctataagaaaatctatctaaaaccaagctgaactacaggattcaatcctatatatacaagctttcaagttaccggcaaagcaaggcataaagaagaaaacccaattgagaatccaattaaagttaccatcttgcacgacaacagaactctgaacggacctcctctgcgatctaacaacacagagctcagctagattaagcccctgaggagaagcgtagtggaaggagagtgagcggcgtgggtcaacaacattgatcagcgaagaatgatgatgattcgacaagaaaggagacgaagacgaagtgcgggagcggtaggtagggcaggagagagacgacatttttcgaatttgagacgagtgtgagttatgaattggatttggatgcaaacaaatctcacaattgcactaatgagcgaatttgtaaggacaattgtcaaattttgagccttttcacgtctcccaaaggttatgtctttgccaaatctgtgtggttttgttggtatggtttagtgaaaggttatttgcaaatattattattattcaattcacaagtggccctttgatttctcttgaaacaaggatttgcaactactatattgttgcattttcatgagctcttaaaattgataagcaatactagtagtggccctaagcaaaaaaaaaaaaatatatattggaagaattagattcgaaatttggctataatgtccaagaccaaacatagataaccctatcggcttaggcatgcatttctaataacacacattccgatcaatgactatgtatgtgtttaaaacattgctttcatcatatcacatctaacattcattgatacattgcacaaaagccttgatcttaaacttaataagtttataataattatttatacttgtctcatgtaagtttataatctatttgctaaatatttttccattacaataaaactatatcattgaaagaagcattttaaaaatcatgcattttcgctggagctattgtgatttagctcatttgtgaattgattgaatttgttaaaaaaaaaaaaaaaatcatgcatgtatatgatgagcgagagacataataatgattaatgagggtgaaatacataaacatg

SEQ ID NO: 20550 - DNA, 3000 bp, Unknown; identical to SEQ ID NO: 5003
  misc_feature (1)..( 3000): 2750-1469P.txt file - cDNA_ID_1826925; gDNA_ID_1620753; Annot_ID_49849

SEQ ID NO: 20551 - DNA, 3000 bp, Unknown; identical to SEQ ID NO: 5002
  misc_feature (1)..( 3000): 2750-1469P.txt file - cDNA_ID_1826929; gDNA_ID_1620753; Annot_ID_49848

SEQ ID NO: 20552 - DNA, 3000 bp, Unknown; identical to SEQ ID NO: 5000
  misc_feature (1)..( 3000): 2750-1469P.txt file - cDNA_ID_1826937; gDNA_ID_1620753; Annot_ID_49845

SEQ ID NO: 20553 - DNA, 3000 bp, Unknown; identical to SEQ ID NO: 5000
  misc_feature (1)..( 3000): 2750-1469P.txt file - cDNA_ID_1826937; gDNA_ID_1620753; Annot_ID_166834

SEQ ID NO: 20554 - DNA, 3003 bp, Unknown
  misc_feature (1)..( 3003): 2750-1469P.txt file - cDNA_ID_1826941; gDNA_ID_1620753; Annot_ID_49844
tcgtcgtacgtactatagaaactgattgaaaatgatatcgaggaaacataatttgtcgatcggtgttggaaccttccatgcatgactccaattagagttctggaacttttggtttctcattagtcatgactctgattggacaagttctagtttttaacgactcatgactcttcacatgctccgaaagttcatcaaaacatttatcaaagttttacatgtttttgtgaacaataattatcttataaaaacatcaaaacatttatcaaagttctataagataattattgttcacaaaaacatgtaaaacatcatatcattttgtgggtttatattcaggtttaaagagtgtatatactatatatatatatatatatatatgtcataaaaactatgaaaaaagatccggcgacaaagacgaggaacgcttgtctttaggaaaataacaaaagtgatttgttttgatgatatattttcgtaaattcaaaacagaaagaatacgttatgtaagggagctaaatgagctcttaagatgcttaagaaaatggaattgtgatcgattgcgtacaaaacgtaaattcctatctaccatttctagtggtcggtttagccatagaatggccaatgtgattaagacaattgttgaaaactggtcacatgtatgttacaatttccggtactatgttcaaacagagaaaccagaatggattggttacctacgtatacatacttttaattttaaaagtttagagagcgttagatctaaacagttaatataacttaaacgtaatttggaatgtaacatcaggagtcacaaatgaaatgagtaaatagatagtataattaaataagaagcaagatttatttagtagacttaatagccagatcgattacaataggacataataactcataaatccatataggaatgaagaggtaaacattattaacctcctaaatatcctaaagcagtagccatagcaatggcagcctgagccatcattgaaaaacatgatacgatcaccaagaaacatccccatttcaacattttcacgatatttataaactcagcttaaatatgaaattattacaaaatatctttctggtttttaggtggggctgaaatgcttctagcatgatagatcaatttatagttgaaccatgcataaatgattaaatgatactatcagactcttcaaaattctttctcttctcgtaagttggaaattaataaaggacagtcaaagataaagaataaatgatttggaaattggaacattttgtcatgaaagtgcgtcgaaccaatttaggcttaagctcaaattgtatatgagcttattatagaggcccattcattttgtcaaaaagaaatttttttaaatatattttttacttcctcctctgcaaacatgtaaacgtgggacgagtagtcttacttgccgtgtaaacttaaatattggccatgtttggtccgtatcaatacaagaagtcaagaagaagacgtgttaagaaagaaattgaggaaacaaagcggtcgatgtggaaccttccgtgactccaattagggttctgaaacttttggtctctcatgcatgactccagttatcattagttcaataccaattctagttcttgacgactcaagtcaagatcattcagacggccttttaaaatctctttaacgttcgagacaaagataaaatccttttattttttcatagagaaaattgtaaaagaggataacaaaatagagagaatttgcttttaggaatttccgattgaatatgtagttggtaaagcctagttttatataattatatgtggacggaaaaagattcattatctcgcttatataaaaacataccaattaattatagtctatagtcacaattcatcatatattctagactttaaaagttgattttagaatttctgagaatcgagaggcaacaaaaaaagtctacaaatttgactaagaagaagcaggcacatccgccttgacgaagaaaacggtttggttgggaatgatggagttgaccggtagacaagtttcgtcgaagaaaacaaaaaaaaatagaaacacaaaatcgggtttaattttgcaatttcgcttcagtagaagacttgttgaattcaataacaatttagtttcgttcgacgagtgtaataacgcgttgagcattaataactatcgaggggccattaagcattaaattaccatttaattacgaattttaggggttgtttccttcatcgtagcttatcaaattacacacactcatacgttcacaccttcccatttttccaagaaaaaacttggttcatatttcttctaattcatacgttttgtgatagtattttcaacttttgttttaaagtttttcaacatgtattaccaattcaatttggtaatccaccatcatatatttatatattgctcgaaagatccggtagcagttgagtctgtctgacaaattaaaacactattcacgatttttttctacagttttactttaatcttaaaaaccaatattattacaaataaccaagtcaaagataaggtcaaccccaccagacaaaacttagttcacggcacaacaagactaagcactgaagtctttgagaggaagattttgaaaatctcgtgcaaagactaaaacatccttctttactatatatatctttcgctccactacgaaggttattttcgtaattcgacacaattccttacagagaataagcgaacagatcaacaactactctgctcttacaggcgacgacgtcaacaacaacccaaaataccaaaaaccctcaaaagtctcaaacaaaactcaaaacccaacaattaaagaaacaacatttcaatatacagatttacttccttttacagattttcctaaaaaaccgaaattgaaacaaacaaaaccaaaagacgttaccttttttccattgattcctcaattctctaaacaaatgagttaatcttccatggctgccatgttgatg

SEQ ID NO: 20555 - DNA, 3003 bp, Unknown
  misc_feature (1)..( 3003): 2750-1469P.txt file - cDNA_ID_1826945; gDNA_ID_1620753; Annot_ID_49843
tgacatccagtgaaattcaagaatgagttccaggggttcccggtggcgtttcggagaagctgcggcggaatggctgaggagtttgtatagaaaccagcggagactggagaaggagcgaagaacaacaagaaaaccatgaaaacacaaatcctcaccatccaaaagagaaatattaaaaagattaagtgaagaggtattattgagatttacaagagaattagagagatgacatagataaaactaaacaagtttgacgttggagaaagcagaggtcatttctgcgttgcgtttggagaattttctatgttgaaaatgctgcattattcaaaggaaacttcctccgtcctcgtttcaaagggtctcacgaagaaaaagactaatgaagcttctgccaatagatagtgtcgttttatggataattaaagttgattggtggcttggtgcaatagattaggcccgatttagtcttggatgactagaaattgtgattgaccggtggtaaaggaccggttaaatgcaaagttggaaaaagaaccatgcaacaaaaatggttgaaggcggcagaatcaactaaattggttgaaagtgtttttgttttttttgggtcgttgaatgtttgaattggtcttttttctttttgtgataatttttccggaggttgttgttattggttgaaaaaatcaacgtaaaatctccaccttacacgagtaacgccatgacttgtttgttaggctatctaattttttcctgtaatgggtataacatgcaagtctccatcggtaaaattaattgatatatcatacatgcatataaagttttgggccaaaagtttgaagccctttctaaacagaattaggatacatataaacagaaaaatgtagattttcatgttagatccatttaggctaaaaattgttttcagaattagttcaaccacgtttgcaccaacattattaaaacttagaagcctgtaaacgcatagctttattaaccaaaatctaaactaagggacgtttgatagtgtttagtgtacatttatttcgtagttatgatatttttgactgactaattcattttagttacagattttaattacattttttttttggtgtgctttgggttaataatacttaattatattctaccaccaagtgataggttttctttgcatacggttagtgtatgactaatggagtcataagagcaccttcactagaggactctttagagcatcctcaatggacaatttaattgggtgtctttctctattataaaatattaagaaaatttcgtttgcccccaaaaaaaaaaaatattaagaaaatcaaaatataattattaaaatatgatagtgtctttaaatgagagacattcagttaaaatgtctatgaaaagacattatgggaaggagaatttttatttaaagacattttcatattttaataattatattttagttcttttaatagtttattgtggaggaagacatccaatataaatgtgcaatgtggatggtgtaagatgatcttaagaagataaagtctttttatatcacatgaaaagtctattttgttaataaaaaaaagtatatggaaaaacagaaaatacatatatttatgaaaagacagtgttgccctacagagccaatagaacccatttgactgagtaaaatgctgtaaacgaatgccccacatactattaaatagtgagattctaactcaaaaacaattgacaatgaatagaaaactttatatattatatatctatatatatatttttgtagttattttaacaaataaatcttagagttggacttatttacaacccaatgccattagcattaaatatttttttcaaaataattaattttactttaaattcttaatttaaattgtcaatcacattatcaatcaaatttaatccaaacaaacttcacatcaatcccttaaaattagcataaacgtatttgttaacaatattttaaaacaaagttttttgtttaaataaatattattcttactaaacgttttttgtttaaataaataaattctgtatttgaacttatttacaatgtcatgctactggcattaattatttagaaatgaaaatatttaattaacgatttaaatcttctaaatctttgcttttagagttattatgtcattacctaaaagggaaaaaatatatttttttaaatattattatttatatatttaaactttataaaacattattaatatttaaacttataaaaagtttaatatataaaaaaatttaacatcattatataatatatagtttaaaaaaatctcaaaaacatttccgtcatattttgtgattcaaaattttaaaaatgaacatatattgaccaaattggcgaaaaatgtgtgggttcaacatcccgcatcgactaaaatatttagacaataattcataaataagatcaatattaataaaataaatggtttttttgcaggacgggttttgcgggacgggtttggcaggacgttacttaataacagttgtaaactataaaataaaaatattttatagatagatacaatttacaaatttttatatatactaactttaaaaaatcatttgtctccgcggtgtaccgcgggttaaaatctagtaccacttaatttcatacttaattttcaatgtgatatattgttatccttaatacataccaacatgtcgtcttccctctcatttcctctcctcaattttgtttatatagatgcgtaatctaaaatagtgtcgaagtgaactttaattattaagatctcttcattcatttgcctttttcttctcatgtttttgctttttatagatgaacaagcccttgcaacccaagcagaacaccgcaaactcaatgagtcacttacttacatatactttcgttattttatttatgttattgttttgttgattttcatggtttaatacatcatgtcatatgtatattatgctggtgttgtagaagagacgataaccatg

SEQ ID NO: 20556 - DNA, 3000 bp, Unknown; identical to SEQ ID NO: 4996
  misc_feature (1)..( 3000): 2750-1469P.txt file - cDNA_ID_1826956; gDNA_ID_1620753; Annot_ID_49838

SEQ ID NO: 20557 - DNA, 3000 bp, Unknown; identical to SEQ ID NO: 5025
  misc_feature (1)..( 3000): 2750-1469P.txt file - cDNA_ID_1826968; gDNA_ID_1620755; Annot_ID_49875

SEQ ID NO: 20558 - DNA, 3000 bp, Unknown
  misc_feature (1)..( 3000): 2750-1469P.txt file - cDNA_ID_1826976; gDNA_ID_1620755; Annot_ID_49873
gtttttgggaattgctaactttgcaaccacgtatatgtgtacaattgaaaagtcacatagaatgacgactgcatagacctatattattaaaaaaataaaaattgtccattttgatcaagaatgatggatcataatttgatgtatatatacgtatgatgattataaaatcacatattttgggagactcacgtacgccttgaggagaccaagaccaaccctaaccccaaagcttaatcgctttagcaacgacaaggacaagacaccacttacttctatggaatctttaccacaatgtgtgtaataatctaacagctgagtagaatttgctcacactgatactacatacaaaatctaattgtatcagtcattcacatgtgaaataatgtatgatttaaacgaaaattatgtgtataataattaacgtaactgaagataaaaaatataaaataaatatttgcttattttatgtgtgttaattggagataagaaaaaattggtattttatttgaaatcgtggtagaaaatttctcaaaagtcgtactaatgccttgagttttgatcagttttgagtttttttagtttttttttttctttttctaattgtgtgccatttgtagtgtttaggtgtcttttatgtgtacatagttgtctatcgattcattcaagttccaaactgcttttagagaaaaaaaaaaggggggcattaattggggatgttatcgacataagtatgtgtatatgggatgtgatgagagatttttcattgctggatggagctcaaatttggcatatactagaaaactgagagagttttatttggaggtggtttgagatcattcgaatggttgaatacttttttagaaaacagattacttttgcgaaatttgtttgaaaacaaatttggcatatactagaaaacagattttgaaccttttctctagtttaatctaatcatgaattactttacagtttcttttgtgtttagagattgacaccatattcttcttgatgctcacgtttctctttagggtacatacgtaaaactctacttcccctttggtttccaagattgctttcatctccatagcttattgctcattcatcgcctaacaaaacattacacgaagcatgttgtttaatgtaaaccaacatcatgagacaaagaaatatgtcagtaaaacaatagatttcagtcactctatatctaaagatttaacgacatgcttttgatttcccttgaatgcaagaaccagttctttcttcacaggagtaatcacaagtttctgaaataacagagaacccatattaagaacaagctatagagacagagatgaacatgttgacttgattacctctacttctttaggttctggaaatttctctcagccacagagcaacttttcctacctacgggttttgatcatcaattctctagctgtcaaacgaaatgaagaaaatacaagataaaagtaagtttcttaccgagtgggcacgtaagtcgaatgcagacctatctgctataccaacacattcaatccacccatatgaactctcaaattcagcatccaaacaatctgcagcatagcgggccatttcatttgcaaaatgctggcggaaacgcaactgttccttgtctgtgccaagacggacaaggaaaagatacactctcgcaatgaagtagcctacagtttctttgttcacagttccctattcaaatacagttgcaggcatcaataagcaattaagaaacaaaaggtctgagggagtgcatactagaagtaagtagacgcagatgattacagatactgaccttggcaacaacttcgccaaggcaaagttttttcgcagattggccagacatttgttcctctcttggaaacataaggaattcaaaatttgctacatcagagaatttcggatgtgacttattcccaggatcaacaaaatgctcaatttctgccagcgtgaattcacaaactctaagaagcccttgacgatgagatatctgcaagtaatatgcgtcacttattaaaagccagacataaaagaaagaaaaaagagtccctgattgagataaacacatccaatctatcaagcaaaggaatagaaaattaaacgataatcacctcatttctaaaggttgaccaatttgagcagcagcaaagggaaatttcctcccattgtagtaatacaagtccttcacaaaaatgccttgttagagtgttcttcgtgtctggagcaataatccttaagcaagtggtccgtccgcactgtaacaagttccagttttctcattcttaaccattagatcagtgaactggtctacatgtccagatgccttgagaacaacctctggtgtcacacatggacaatccacttcatacatattctccttaagaatgaaatgctatctgagaacaaacctaaaacaatctctactcttctctatgaatcatgtcaaatttgtctcaatttctactcaaaagagaaaggtgaatgatgttccgtacttacttgacgccagaagctaagaacattggatttaacagcacaatccttaatcaaatagtccggcgacgtcacggttgattttgaaagaagggatatagaacaaacgccgctcgagagtattaaccacattttgtcgaaatcagcagctccatggctgcatcaatcgtgaagccttgagagcttgaagacattcccctgagcttcgacggaggaagatttcgcctatactgatttccgccgtttgaatttgatcggagcattttgttttttcacaaactttcatatctttaacgacgtcgttagtactgaagaaaaaccctaaagagtaaagaccctaacggcgtcgtattaaaaccctaaaacggcttcgtattaaaaccctctgtcttataaataatctcttaaaaccctttcttcttctcttacattttcagctgctcataaaccctaaaaatcctctctttttctcaaccttgattcttagccatg

SEQ ID NO: 20559 - DNA, 613 bp, Unknown
  misc_feature (1)..( 613): 2750-1469P.txt file - cDNA_ID_1827000; gDNA_ID_1620756; Annot_ID_49910
ttcctttaagattatatcttcttgccttaaaactgtatcggctaacgccaccaacgttgcgtcgtctgttcgttccgctggtgcctccgttgctgcttcaatttccgctgctgaagatgataaggatcaggtcccttgattttgttttgcagttactgtttgatacttgcttttgttctgtgtaccgtgttggattttactattttgttagatcatttaaaatctaagacgtaattgggattctttcctgtttagaaatatttagtggattaatggttggtgtgtttacttcattcttagtctagcttttgctgctgtgtccactaagtttgagatacataggtctagtaacaaatatgcaagtgattcttctgatgtgaaattatgtgttcgaatttgttggttgtggttggttaatttctgaattaggtgtctatttcctttttcctgttgaccctctttgaaatgggaggttttgctatattttcaattctaggttaacaacttctttttctttttttcgagagactactttgtccacaaacatctgaacttcgctttcatgaccaggtgacctgggctggatttggcattcttgaactgggtcaacatg

SEQ ID NO: 20560 - DNA, 613 bp, Unknown; identical to SEQ ID NO: 20559
  misc_feature (1)..( 613): 2750-1469P.txt file - cDNA_ID_1827000; gDNA_ID_1620756; Annot_ID_166996

SEQ ID NO: 20561 - DNA, 3003 bp, Unknown
  misc_feature (1)..( 3003): 2750-1469P.txt file - cDNA_ID_1827008; gDNA_ID_1620756; Annot_ID_49908
actgaaaacccaccaatccacagcgtcttccgccacagctacagcgtctaaccaagtggttgaaccaagaaagacttcaccgatctccaccgacgtccataaccaggaagaaacggaagagaagcctctcatccaccgagaaagggccaccgctgccacgcttaccggaaaaaccacaccactccaatgccggagaagatagcttgccttactcctgctttgtcttgcaaattcataacctaagatgaagaacagaggcagaaaaaactagatctgtaaaaactggaaaaaacttcaaagagagagaaaatgaacagtagcggaacgattgtccaaagtcctccaaacgagatatctttaaatgttgttttgctaattagtggcgtttcgagagctaggcgagcaacaatggcgatgagatttaatatggtaagtgtgtagttaattaacaaaagttcaaaccggatgctattcttacttgtaaagacaaacgaccaattaagaatccaaattttaatataggaattgaaataaactaatggaccttgtttttggcgattcatttctttatttgttatcttaatatgggtcacgattccttttgttatttaattgtattaagatgtgcattaagatgtggaataatagcacttatgcaaatctgtgcattgcaaaaaaaagaaagaagaagcaagatggagtcaagtgatcgttcaagtcaagcaaaagctttcgacgagacaaaaaccggcgtgaaagggcttgtggcttcgggaatcaaagagattccagccatgttccatacacctccggatactctaacaagcctgaaacaaacagcaccaccttcgcagcagctgacgatccccacggtggatctgaaaggaggaagcatggatttgatatcgcggcggagcgtggtggagaagattggagacgctgcggagagatggggattcttccaggtggtgaatcatgggatctcggtggaggtgatggagaggatgaaagaagggattcgcaggtttcacgagcaggacccggaagtgaagaaacggttctactctagggatcacactagagatgtgctttactacagcaacatcgatctccacacttgtaataaggctgcaaattggagagatacgctcgcctgttacatggcccccgatcctcccaagttacaggacttgcccgcggtttgcgggtaacgtttccctttccataccaaacacctagctagctaggattcatttctctttagtttttttttggtttatgatgatagagattatattcttttactttaattatgagaaagaatttccacgtacgaattggcgtatttctcatctacttgcttcgggtctactagatcggatatcttgtgtgttttaactcggttattacaaaatttaaacttgaaaaagcataaaaagtcaataattaataactacataagttagtggattctacacttgattttatcatgagttattgatttctaaatagtaattataaccttttaatgatttcattggtttttaataaattatttatttatttcacattggattttaacagatctttcaatgtatatattaaattaaagataaataaatcaaaaagttaaataccaaagttattttgaatagatttgttatatgtgccttgtgaatagctagacgtacgctaatctcttgcaaatattttgatgtgacagggagattatgatggagtactcaaagcaactaatgactttaggtgaatttctctttgagcttctatctgaggctttgggattaaaccctaatcacctcaaggacatgggctgtgccaagtctcatatcatgtttggccaatactatccaccttgccctcagcctgaccttactttaggcataagcaagcacaccgatttctcgtttatcaccattcttcttcaggacaatatcggagggcttcaagttatccatgaccaatgctgggttgatgtttctcctgtccctggcgcccttgtcattaacatcggagatcttctccaggttaaaaagaaaatattgttgcgcttctagcttcatttcatctatggagtgggtttaaccctctgttttattgtgtgcagcttataagcaatgacaaattcattagcgcggagcatagggtgatagcaaatggatcttctgaaccgcggatttcaatgccatgtttcgtcagcacgttcatgaagccgaatccacgaatatatggacccatcaaagaacttttgtcagaacaaaaccctgccaagtatagagacttaaccatcaccgagttttcaaacaccttcaggtcccaaacgatcagtcaccctgcgttacaccatttcaggatctgaagcaattatattggtggctctgctcggtcttcatctcaaagtaactttcgtgaaaccagcttcttttttctttctcaaaaggcataaggatatttgtaacattcaaataaggtacacaatgaaaactactactacttacttacttcatcttccagccgtgatgtaataaaatttgcgaggaactttcttgttttaagtcctcgtgttaccattttcatctacgaactttggggattagattccccctcttttgaaccttgttttatgttgtatcacgaaaaaagcttattggcctcatttatcatcatcatccaccgatgatatatcgtttaattatatgttcatcagatattcttgtaaacttaaatgattaaccaaaagcatatgattttaggttttttaaaaccttggtggactagtccacgttcggttgactgatttggatatacatatacatatatatatatatatatgaaaataaccaaattaatattagatgtggttgtgatatacgtacatcattttctttatgaggtggcaatttctcttgttatctgaatgatacaaatttagttaaggacgtagaaaagcaaaaaaacaaacaaaaaaaagaccaagaagcaatg

SEQ ID NO: 20562 - DNA, 3003 bp, Unknown; identical to SEQ ID NO: 20561
  misc_feature (1)..( 3003): 2750-1469P.txt file - cDNA_ID_1827008; gDNA_ID_1620756; Annot_ID_166994

SEQ ID NO: 20563 - DNA, 3000 bp, Unknown
  misc_feature (1)..( 3000): 2750-1469P.txt file - cDNA_ID_1827038; gDNA_ID_1620756; Annot_ID_49899
gttgtccaaacaaaagacaacaactttacaatctcactgagactttagcttttttaccctttggagcatctgtctcgaaatagcgataattgaaatgcagggttggggcaaaagggttcttgggatgcaaaacctagaatcacacagaaatccgtaatgataaaacatgagaacctccaagaatcgtaaaattgaagggagagattcattaccgagctgactccagcagcgaagaacggaacaggaccaggtttctgatcagaagctgagccctttgcagctctataagcttcaggaggcataacaccataaaccacagagacattaacaccagctttctcaaagacattcccgtcctgcaacacacgactgattccaccgccaccaccaggtcgagaccaaacatcttctttaaacttaggaccgccttctatagcttcaattgcatcacaaacactgtcttgagcagccctaatcatagtctcgaaacgagccctgacggaagaagaagaagaagatggagtgacgtcatcagaatccctaaggaaagtaaagggtcgttcagtttcgggaacttctttctcaattgagactgaacatcgcaaggcgagattaggtttatttctgattggacgggagaatctgagagtagagggattgggagaataatgaagacgatgagaggagaaaggagcgaaagtaggagaagagaggagagtcgacgagtgagaagccatgtttgatccgaatttggatttgatgctgaagaagaagatgatgatggagagatattaaatgataagaagtcttcgtcgtccactgattttgaccgctctccctttttatttaacagctcaaggtaaaagaaaacacagttccagtcttctcagactaaaccacttctgaattatttagccgaaaccaaaccagacacgaaattaaaattgcggtttaatttggtcgaaccgaagatattgatacacaataggctcttatccttcttaacgggcttaattgcccaaattaggcccaaaacgattagccggtttacggcactatgctattttgatgtggataaatcatggtcatgtaatatatctttatctatcgttagaatctgtgataaacaaaacaaaagtgtattatagattcgaatcctatctaattattatttcaaataaccaaatagatgtaattacaaccgtcttattctttccaaaaaatagttaatcgctgacaaaagaaaatccggttgggcccatcacgttgtctatatattcatgatcatatagagagttcagccgcttgacctgcgaggaattcaagaaaaccctgcttcacagagcagtattacacaagagacgaaagagcacttttaaccttagcaattatataggtaccttagctagttcttcttcgaatctatacgatcgatatgaagattcttccggttggatcacggttttgtccgacggatctagggttggtgaggctttatcttcgaaacaaggtggagagaaatcagagcagtttcataacaactatggacatccaccaagactacccttggcttcttcctcacgtaaacaatcctttgttcaataacaacgagtggtactactttgttccgcttactgaacgaggtggcaagatattaagcgtacaccggaaggtagccgcaagaggaggaagcgaaggcggcacttggagaagcaacgatgggaaaaaagagatcaaggacggacacatgcaaaagggtgatgggttacgagcagtctttcacgtaccacaggagagtgcatggaaagcttgtcaagaccgattgacagaagatggagtattctcttcactagagtgatgacctccaaaaggttgtcttgtgtcggatccgatacaagaaagaggcgaacgtcaacgagtttggactcgttaaccatcaggctcatcagactcaggtggcggagaacaccaacaacatcttacggaaccaagtagtgtaagaagaggatgctttaaccggttttgctgatcagcttgagatgatgctagagggacaagaagaccgtgagcagaaagaagaggctgatttaaccggttttgctgatagccttgagacgatgctagagggacaagaagatcatgagcagccagaagatgctgatttaaccggttttgctgatagccttgagacgatgctagagggacatgaagatcgtgagcagccagaagaggctgaattaaccggttttgctaatgatgaccttgagacgatgatgctagatggagaataatctcgcgaagttactcaacaacaacaacaacaacaacaacaacaacaacgtcaagaagattgtgacgttactcaagagcaagaaaaagatgatgtgatggtactgataaacaatcctaatgatgccctcgcattggggaattatgagattattgatctaactagggttgataaatgatacgacacaaaccagagaggatagaattatattttagtgggttgagttgatatgtgacaaagattactatagacatatggttagtgtatttgtgtaactccggtaaaggagatatcataaaaatagtggattttccggggtaaaattctagtttaacgaactttattttagtttgtacttttgtttttccataactctacaattaatatagagttgcagcagtaatgttaactatttagctatgaatttcaattgtgtacttaaaagtaatgtttttggttttcaaagattataaaattcgaaaatactaattgtgatttgtgagttccattgataaataagcaaacataaaggaccaacaaatgttttgaaaaccaaaaaaaatggtggttgtggaggttggggcacatgagagcgtttttttgaccaaagtacgtaacagaatcaacttcttcacttgcccggtggtttcattttccttttataaaaagacaaatatgaactcatttcctcaaaacttaatcacaccatg

SEQ ID NO: 20564 - DNA, 3003 bp, Unknown
  misc_feature (1)..( 3003): 2750-1469P.txt file - cDNA_ID_1827046; gDNA_ID_1620756; Annot_ID_49897
gtagcagtgaagaagaggagagtgatgaggacgagagcgacaaagaggaaaataagaaggaagaaaagtttgaacacatggttgtggggaaagaggatgatctagcaggggacttgaagagggtgagatagagaatttagatgaggagaatggggatgacgatattgaggatgaggatgatgatgatgatgatgatgatgatgacgatgatgatgtgaatgagatggttgcttggagcaatgatgaggatgatgaccttggtttgcaaacaaaagaacctatcaggtcaaagaatgagctcaaggtacatatccttcagcttttcacatttcatagctattactattagtggttgatattttttccattagtggttgactgcgacaagaaaactatgtactgtcctcaaggtttttagcattactctttgaaggatggaagccttctttttgttgtgtaaattttgaaagatttttcccctttttaaaacttttgcaggagcttcctccagttcctcctgtggatgtcactctggaaccacaccatgccacacttcctgttggagttgttctttcggtatattaaaaattacctctacttgtatgctattgcttctctgtttgatgtcttgacaatccactgctaaaagcatacccgtctcatttgtgattttacaggtaatgagcgcacaagtaatagttgagggaatggaaaagcatagtcctttgactgaaggttctatcctttggataactgaaaaaagaacgccattgggactggtggatgagatctttggacccgtgaagtgcccttattatattgtgaggttcaattcagagagtgaagtgccagaaggggtttgtcaagggacacctgtctcatttgtcgccgatttcgctcaacatattctcaatatcaaggaactgcagaagaaaggttacgatgcatctggggataacgacgaggagataccagacgagctagagttctcagatgatgaaaaagaagccgaatacagaagaatgcagaagttggaaaagagaggaatgatgagtgaccagaaaaccggtaacaccaggaacaagaagaagaaaaaccgagatcccggaaggcctacaagcagttactcaggggaatggacgaagaaccagggatctagttctctatcgtcaaaccgttctgatcctcaaatgggtggtccgcgtcctcaaatggacggttttcctccaaacaatgcagcatggagaccccagagtaatcagcagaacccatatcagcttcctcctatacctaatcagatgggaatgcagatacctttcatggcaatgcaaaatcaaaatcaaatgatgttccaaccgcagttcaatggtggccagatgccaatgccaggtggaccgggaggcttaaacttctttccaggacaggcttcagcgccatggcctgcaatggtaggtcagaattgtttcaaccaacagtttgggatgggtcgtggtattcagcagcagccattaccaaatgagctgagttttaatatgttttctcaaggtcttcaaatgcacccaccacagtcccaaatgcaccggccacagtctcaaatgaatccacagttccaaatgccaccacagttccagccccaccagcaatctccaatgaacccgcagtaccaaatgatgcaccgaccacagtctccagcgaacccgcagttccaaatgcaagcacaatctgatgtgcgaccactacagtcacaaatcccgcagtcaccaagtgatttgcagtccccaatggaaccacaatctcaagggtttagcagcgggcagtcttctgaacggggaaggggcttccatggtcgtggtagaggtagagggcggggtcgcttcggacgtgggcgaggtagaggccggcaacagtctggatgaaactttttttggaagcatactaaactgctaatgtgtgtcatagccaggctatatttagttttgtatgccagtttttgtatgattatgatctttttttttttacacattctctataacagtaaaacgaactttgatttctctgttgttccttctccttgtaccaccaaagtcaaactggctatagagtagaatagactatactcactagcagtgaattaggcagcaacataagaacagtgttttttttttctcgccgttaatttcgttacttatctaacgtattattatgagttgataatgccacgtgtacgtcatcgcttgtaaagggtttgagagtcgtacatgatcattaaattctctactgattgattttgattttgccaacaattattaaagcttacaccacgaaatgtttgatgtttaaattaattgccatgtctctctgtctctctctgtatctctctctctcttcttccccgcgtcgatttcacattttctcttttaagacagctttgaatctacagacaacttcatttttaccaaaatttctgtttcttcaaaggattgaactttcatatttctctcttgcccagttctgagttattgcaatcagaagttgtaaacacttttcctgtctctttctgctacccgaatttatcttctttagcgtctgtctctttcagcggacgtgtcttgtctctttaaggtaatttcaagacttaaacttgaagtatctctggccttcttctgctgtctgtttcatttttgaaatcgatttggagattagatctgactcagcttcgactaaaagccattgctttcgcctttggattgttgattccctagtggatgttctttatctctttaaaaaggtcctctcttttaaatcaatttttgctgaacttgcccaattcggaaactttgttgcaagtctcctcttggtctctggtaatcgttttcgcatcaatccttatattgatttgaatctgtaatcagattcgatctttgatgctaatttggtattctatagaagacaacatatctgaattgggtttcttcgttggataggataagtggttagggaatg

SEQ ID NO: 20565 - DNA, 3003 bp, Unknown; identical to SEQ ID NO: 20564
  misc_feature (1)..( 3003): 2750-1469P.txt file - cDNA_ID_1827046; gDNA_ID_1620756; Annot_ID_166980

SEQ ID NO: 20566 - DNA, 3003 bp, Unknown
  misc_feature (1)..( 3003): 2750-1469P.txt file - cDNA_ID_1827065; gDNA_ID_1620756; Annot_ID_49892
cagccacattcggatctgtcttctgcatcgaaagcgtactccttactttactgatcactgccgacgtatctttgatatactcttcatcttcagcggcggagaccggcgccggagctagaaactgaatcgattgtgttagaagcgtggatgttgccgccagggagaggaaatcgcggcggaggaggtggttgcgacgtggaggaggaagaggcggagatacggaggaggcgatgatggtcggtttatgcggcggaagattgggtttgagaagagtagctgtcgctgatgctgaagccattgtcggaactctggagaaaaggtgtaagaagagaatgaaagagttttgttgtgcgttagtaaatcggggaaaatgtgtttctgtgtgttggatttttgacacgtgtcccttatcttcttatcttagattctatggtttttgaggatgacacatgaagatccactgccaggtcaggatttgcttgtttttatatctgtttggtttaattgtaaagcccgattaagataaggcccatatgtcaaagcccacgcgatgatgagtcattgtgcgtggcctttttagtttagtaatttttgataatgctgcaattggaagatatagcatttggttaaattgacccacaaacacgtgacattcttctcttgctgtcagacacatgggatgatgattatgatgatccctttggatttcacaaaattaagatttttttttttaatttcttcatgtgtcatcctcaaaaaccatacaatctttgatcttgataataagctttctaattaaatcgtctttgattggcccagtgtgaaaaaaggaaagaaaaaacaaacgaaagctaaggcctacgcgggaactccgtgaacgatttgtcaacagaaccaaatgggaaaagaagctttattaaactccaatctaattttacacatttattatattcgtgatctaccaaccaacctatcctttcgtctttttttttttttattgtgaaaactacaaatgcaaaaacaaaactgcatattaataagaaatgttttggatatcatgattctctaaaaacatgaattactccatataactgataataaatttaatcatcgccttcacatctctatttgactatcaaccatataattcgctctcattttctttagtgaaatgttttggtgggtgaatatgcatgaaattcatatggatagactttaatggaacataaaataaataaataacgaagtggggattagtagtagtatgtggagaaaagttggacaactcatctgtttttgcaaactttgcaagtgtcccatttatttctcgtctcttatgtcgtcttgcttttattaggacaccacaaaaaaataagttgactaaataaaaagcaattaagaagttgactaagtaaaaagaagctgaatagtgtttttttccatcatacaattaaccacaatgcaattaagaacaaacaatctttaattatatccacaaaaattgatcttttgattttcatttccctatattctttgtaacaagaaaataaaaaaaaaaagaaggaaatttaggaaagtttttaaaatgattaaatagcaaaagcaagtaagctttgattttgatctttcatgaaagaaagcgaagaccaaaaaagattctgtagggaagctctctctcttttgttttcttcttcttcttctcatcctctctgattcttcgctttcttcaattaatgagatctcacccatctccctctctctctctaccactactacaactactcaatcactaactctctcctttctctttccatagtcagtcattgtctctggatcaattgttcttgatcccctaaaggttccttcttttcctctgattttctctgattccttgcacttttgctttgtttctctctttgtctttgtactctgtaatctcatatttggattggctcgttcgagtttcgtaggatctttcttctgatgattttggtttgttcttttctctcttttgtcactctgcacttgttttgggttacagaggaaactttatcagatccatttttcttatctaaatcgggtttctgaaaagtgaatcgcttttccacttaacaataatcccaccttttttcttttcactattagggtttcgttattcttaaggcctgcttgcagcattactatataaaagccttataagatgaatctaatttgctttcagctctcactgttcagatataagctttggggtttagcattatatgttttgttttcactggaaaatgtaaacaatgattcttgaaaaatctggtcacgttttcttaacgtcaagagttgtatggaaacttgtttcagtagttaatcttgcaatttgcctcataacatgtgtttggatacatgatgtgcttattataagacatttgaggaaactctctgttcttgatttgtatgttattttgttttcctgtcttctgattcttaagtgttttgattaatttattagcaaagattaatgaaaagtgaatatattacaaaacatggagctataagagtcttaaggttggtccaatgccaaacaattaggacaggctgtttagtaatatctacatatattctattgctaaagatcacatgctgggttttcttctttatgacttgtttgcgtctgcttttcttttttgtaactttgcaataaattaatcactaattcatttttctgcaatgttttcagctcacggtccatgcatcatcattgaccaagatttgaagaaaaggttttgcccacaaagagtattttatatagaataaagaaacttgtgtgaaagctctttgatttgaccaaataagttgctaaaagcctttacattgggggatctggttttggtacaacaatagaagtcttctttttctcaaatctctctgcgatcagatccgttgtgtatacttgcattgaccaatgggaggttgtatctctaagactcgtggagcaatgaagagcctatg

SEQ ID NO: 20567 - DNA, 3000 bp, Unknown
  misc_feature (1)..( 3000): 2750-1469P.txt file - cDNA_ID_1827069; gDNA_ID_1620756; Annot_ID_49890
ttttcccatttggttctgttgacaaatcgttcacggagttcccgcgtaggccttagctttcgtttgttttttctttccttttttcacactgggccaatcaaagacgatttaattagaaagcttattatcaagatcaaagattgtatggtttttgaggatgacacatgaagaaattaaaaaaaaaaatcttaattttgtgaaatccaaagggatcatcataatcatcatcccatgtgtctgacagcaagagaagaatgtcacgtgtttgtgggtcaatttaaccaaatgctatatcttccaattgcagcattatcaaaaattactaaactaaaaaggccacgcacaatgactcatcatcgcgtgggctttgacatatgggccttatcttaatcgggctttacaattaaaccaaacagatataaaaacaagcaaatcctgacctggcagtggatcttcatgtgtcatcctcaaaaaccatagaatctaagataagaagataagggacacgtgtcaaaaatccaacacacagaaacacattttccccgatttactaacgcacaacaaaactctttcattctcttcttacaccttttctccagagttccgacaatggcttcagcatcagcgacagctactcttctcaaacccaatcttccgccgcataaaccgaccatcatcgcctcctccgtatctccgcctcttcctcctccacgtcgcaaccacctcctccgccgcgatttcctctccctggcggcaacatccacgcttctaacacaatcgattcagtttctagctccggcgccggtctccgccgctgaagatgaagagtatatcaaagatacgtcggcagtgatcagtaaagtaaggagtacgctttcgatgcagaagacagatccgaatgtggctgatgcggtggcggagctgagagaagcgtcgaattcttgggttgccaagtaccggaaagagaaagctcttctcggaaaagcttctttccgggatatatactcggcgttgaatgctgtttcaggtcattatgtgagttttggtccgacggctccgattccggcgaagaggaaggcgaggattcttgaagagatggaaactgctgagaaagctctcacaagaggaagatgaaaaaactgcagtcaggccttcttctccattttcttgttgatgaaaattttattttcctaaaaatgccaatcgaattatatgagaagagaaacttgaattggctcgcctgcttttttttttcattcctgtaaaatacttaatgttctgcatgataattgcttaattatcattatcagagatacttatataacttatatcgaattccattttctcaatgattggagctgcttcataagttcgattaactctcttctgttgtactatatacttccctagaaaatttgtctacactttctttagtttttgatagaggagaaatgaattacaccattataaaatctccaaaactcctaagtcacatttctgcataattgcattgaatgcttatcaacctaaaatgatttcaagtctatgtaaagactttcctatgggccatcaacaaagcccacaaagtgtgtagtttggtcattttatttgtaggtgacaacaaactccacaagcattccccattccaacatattacgtgcaggtccacacacgtgaacactaacacatggctcgtatttactctatttatatattataataatatattcattcaacgcaattaacaacaacacgtgtgcactagtaatctaccattatactgctgacctttccaatacgttaaaatcaaattgatgggtgtagtaaataatgaccgtgtttgctgctgactagtgtgtttaattacgcctaatttatgtattttggtcaatagttcattagtataatcttgcaccctctttatttaacactaatcttgcaagtcaacattcgctcgcctcaccaaatgcaatatatatcgtactccatacgggttacaagattaggtttcatcggtgagtactaataatatacgttaatgaatctatattacggggacggatacgaattggataacaaattaaaagtggtcaataagttacttaaaccagtaaaccctagcttgtgataccaaatctctaatttctgaatatgattgatgcaaataatatgtaaaaaggattctaaccaataaaatgactaaactaaccaaatttctaagatcaattcacctcaagaaaacaaaaaattcataaattttggataacaacaaaaccaaaaccacgtgaagaaaacaatgagctgtggtgaggtggtggacgaggaaaatcggtcaaacttaattaaagatcttatctatttttctcatttcctttttctgtgtttttattttctttttataaataaactgtttttgctataaaaaaacaaagacaccaattgtaaaaaaaaaaaaaacatctgctgatcgtctctgagtaaaagcaatcgtttcgaatccaaaattgcccgagaaaaagttttgacttccccgggaaaatctctatcctttcttcattcattcaacaaagttctgaatattttctctgttcttctccctcattttatggctttaccttttattcatttaccttgtctcgattgatctgacttcaagattagaaatctcgacgcgtggcttccattttttctcagagaatcacatttaaaaaaaaaaaacagaaaaacaatattcgatctttgcttactactcattgtgcgtcttctcgatttgtaatctccatacaattttttctagagagaatccatctctctctcttttttttctttggttttgcttgtcccttaaattcagcctccttcatacataacgtcaaagctcagatatctgaataactcgcttgcgtgcctctctctctctaaaagcccatctctttctcctcctcctcctccattgaagaagaaacctaccttcgtaatatttcctcaattacgatcatg

SEQ ID NO: 20568 - DNA, 3003 bp, Unknown
  misc_feature (1)..( 3003): 2750-1469P.txt file - cDNA_ID_1827071; gDNA_ID_1620756; Annot_ID_49889
gacctgtgctagtcttttgccagcttcctcttcagatacgtaacctttggtgatatacttttgaaaaggcggaaaaagaagccgaaacagcggtatgtgttctctgaacaaccctgttgtagcgatgcaaccagggtaaagagaagcaaacgtgactcctgtttcctcgtggtaacgtctgtgaagctcctgcattgtcagcatattgcatactttgctgtctttgtaagcctttgctccatcaaactctcctccatctatcattgaactgttttgcccattcaatcctgacgctaagcctcttaggtctccaaggtttgcctttggcggtacattcccagccaaagtatttgtgtttcctgcaagaacatagaaaagaacattcattgtttgatactaggaactatcttggtggaaatggacaagttgtctgtgttatttacctgttatagatcctacgatgatcatacgttttgatggataatcagattttttcaggtcatcaagaagcaatcttgagagaagaaagtgaccgagatggttggttccaacgcttatctcaaagccttcagctgtaaaagaaggctctttagcagttggttggtaaaccgcggcattgcagacaagaacatcgagtggttgttctgttctccggaaattttcaacgaattgcttcacgctttcaagcgaagcaagatcaagatgcatcactgtgtaatcttccttggacattccaacagatctcgctgccttctcggccttgagaaagttcctgcaagccatgatcacatgccatttccctgtgtctgctaaagctttggccgtagctaaacctaaaccagacgaagctccagtgatcactgcagtgccttttctctcagtcttcttttgctccggcgatgcttcgtttgccggcggcgtggctgtaactgtctgtgcacgaataccggtggaaaatcgcggtttctgtcttctctgttcctgcaacgaaacagagtataaacctcaggacgttttcgatatctttttttgagaatttcacatcgtatagggtgattgactttaccttgatggtcaacagggtggatatcttttcagctctaagatggtttgaaaatgaagaaccagtaaaagtcgtctcctttagagaagcattgaatttgccctgcaaaatcaccattgcattgaggtaaattcttcattttatcgaaaacaaatcataacaagatggaaatcattactaatggtgaaaacatacctctttttggattgaaatggtagaaggaagaagagaataggcagcttggagagccattgttgtacggaactgaaggtgctagagtgtcacagtgtcttcgattttccccgaattgaggagcgacagaagataaggtagttttgggttagtgacacgtgtcttccaggctacagctttttccctcaaccaatcagatcactagtttcagattcttcatctctcgtttattgggccttgagatgggctttaatattgttttgttaactctcaactgatctgatcaccgttgataggtgaactgtaatgaatctggaccgtccaaatgtgtcaagaacaatttggtggaagagagaagaaggcggcaacttaacggtcaatggagaggtgggagaaagaaaacaaaaacgaaaaaagagagagaaaaaaaaacacttttggatcacacagctctcttcatcttctacaatttctaaaagttgcaaaattccaatgaaaatttccatttttgcctctattttattttattttcttcttctacttcatctcttttcttttcctcctccgtcgtcacggtttctagaccatctcctcctcctcctccattgtcttgttcatatgcctataacaggtaactttttcccccctcatctttttaatcaatcataacgatttttgcttgtgaaatttgatttgatcatcattgtttgctaattatattttcaagggtaatttcattgtaaagttttaaactttacataaaagttatgaaaagaaaacatcctttaattgcgctattatgttagctacaacttttagagaaacctttttgagcccaattataccaaaatttgactaagtgaaaatggaaatgatgatggaacttttgaatatttagaaatcgaattagaactttagctcatttatatttagtcattttgattctatcatcttcttgtcattctctaaattaactcaaaggagtaaataaaaatacaaatacaaaatttatacagaacaacccacaattctgtctagtttagttaaacgtgttaaaatagtcacgcaatgctttttctatttttaaaaattaataagctctgacctgtacgcaaccaaataaaacactaaaacttatctgtgatcaacttagctctgtataaaaatcttcctcctctttctttctgtccaattctctacagagaagtcttagcttttgcaaaatcattaactaatctctgttttgatgactagataacttggatgtaggattattatacctaaattctttctttccatgcatttatgtcggttttgacatctttgttctcttagtttaaaagatatcaatattagttatcttctattctttgaacatttgtgtccatctcatgaagttcaggaagcgtaggcaatactttcctgcttgttcgtctcatcgccaagtaatgatctcttcgtcatcttcttcttctccaaactcatatcaaatttgaatcttatcatcaaattgagagtaatcaacgacaccactgcaatcttgcatatacattgttcttgtgtattccacccgtttctttaatcttcaatgtaccgtaattgagtgtcgttttggttgtaacttgtaagtgaattaagctcactcaaactttctgatcttcagagttgatctttttttttttttatgttctgcagctaatgttatacgcaaacatatgtctgaaaacgtttgcaggtagaggaggatg

SEQ ID NO: 20569 - DNA, 3000 bp, Unknown
  misc_feature (1)..( 3000): 2750-1469P.txt file - cDNA_ID_1827095; gDNA_ID_1620756; Annot_ID_49878
ccaaaacagcacaaaccgcagcaacagcattgccttctttcaaaagaaccttaaacacaaatccaaacacttctcttgtaatcttacgagcttcaacaaccaatacccttctcgatttcccaaaaaacgcaagcaacacaaccaccgatatccagatcaccataaccgccggaaccgcaaccgcagccgccgcaaccatcgacatggctccaaacacagctcctaacaccacagacgcgtaaaccgccggtaatcttgacggagacggcgatgacgtgtactggagcttgtaccagctaagcacagatgtgagaaagttccatgaggaagccaggagaatcgcgtagacagctacaaagagacaaacccatgtccgtctcttgctcatgattcgcataaagataaggtacgatcttggaggagagccattcgatgttcttggcgatcctgttggatccatcatcggcgatctgattgagattttttattgagggattttttctttctttgtgttggaaattgaaatctccgtgatttgagatttgtgctgaagaactagaagaagaagaagaagaagaagaagaagagagagagcacaaaaaaaaaagtgaaagtcttcagatttggggaaaatagattagttcacgtgagtcccactctcatgttaaagcgcgtgttaatcactcgttggtttagaggcttgtagtggagtacacgcgcttaagtttcgttttatttattgatttcccccaaaagagaccagacatggaaattaggaacaaatgaatatacatggaaactgcgtgaactcactctgatcaaaaatattattatttccattaatatcacttaattactcttttcttcgtttatttctttctcctctcggaattatgaaattaaatactaatgacgaaacgcgatttctgtttataccattttttacttcaacaaatctgtttgagacgtaatgcattatcttcttttttttttttagtttagtcgtatagcaagttagggacaaacaaacaaatgcgatttgtctttccttttcttttttttaatgcgatttggcttgatagtgcgcctctacgcttattatagccgacaaactaaaataaaagaatcgtctatttattctaacctttaatgacattttaccttttttgttttgttttgttttgtctatcttttatgaagaagactctaaaggaacgaaacttcttgacgttcaccgctagcaaattcttgaatgcatgcgattgtctttttcttatggaagtcttagctttttctcttgaatatggattttaatattcttccgtctagtcatcaaatgagattaagcatttatctacaatatatggaacactaatcatataagttgagaatctacaatcaaacatttttaaaattggatatggatgtggtattgtatggtaaaccatcttccaagtaattggacatttggaatactaagatttacttggcatatgaaacaatttaacgtcccttgacatttgtaacaatttcacgtacgaacgattgcaacgactttgttatgtgtcaaacgcttttctaatatggaagttgacacgactttgagaattaatttgtaagaacattaaacaaataatcttccagttttgtagtcttctattgatgtacacttcaaagaatcttctagttcataatcccatgaccggaaacggagtccaattttgccatacaacacggtcgcgatggcaaattggcaacaccgcatggtccgcatgccgatgaaggtgtcggcatcctattgacgatctctatatttaatacactttgatttttttttaaaataagtaaatgaattagttctaaagacatcgggctgtcgtgtgagccaagtaaattaaagtatttcataaattattctattttagttatttacaaacacacgcgtgtgcacatgtatttggcaaattatttgagtcaaacaacatcttcctatcacaattctgaacttctttatactcgtgattaatttcttatatttttgtcttcactgttttagtccacatgttaaattataagaacttcatacacgaaaactaaacaattaaaaaaaaaaaaaaaaactaaacaattagaataatttcaaacgaaataaaaagtcaatacaattagtcttgtaagagcgatgatcaaatagattgaaagactataataatgctctaagtttattttaaaattttcaaccaattttatctaccatttaaaaggttgacaaaaaaaaaatgttgactaaaacaagtcttgatacaattatttgaataggctgaatgatgataccaatcaaacttacatttaataaaatctgaacattttaaaaaataaaaataaatgaaagagaattccatgaatgatgatgagatagagccatagagagactgagagagagagatgtggagaaaaatctaactttggtcgacgaaaggcggctaagttggttattgacatttagctattttttttatgaatccgttcatacatcgatcgatgatagtgactcactctacgtaatcgtttaattagtcaaatctgctacaactaacaaataaaaatctcccctttccttacatattctctccgcaaccctctttgattctattcaacgctttgcctaaagtcaatcttcatcaatttctctccattccttcactcaattccggccaaagttttgatttttccggttcgaatcactctttctggggatttcacagtgtactgtgtgtggtcttccgaagaagaagaagaattcaaaaatacgatcttgttggttttcgtgaattgggtatttcccgctgagccgttgaagttgtgtgtttgttctgagtggattgaaattagggtttagattttagggaagtgaatggattgggttgtgaataataaaggttaagtttttctgtagattggttatgtgtgtagattcatgttctagagagcatacgaatg

SEQ ID NO: 20570 - DNA, 3000 bp, Unknown; identical to SEQ ID NO: 20569
  misc_feature (1)..( 3000): 2750-1469P.txt file - cDNA_ID_1827095; gDNA_ID_1620756; Annot_ID_166956

SEQ ID NO: 20571 - DNA, 954 bp, Unknown; identical to SEQ ID NO: 5049
  misc_feature (1)..( 954): 2750-1469P.txt file - cDNA_ID_1827143; gDNA_ID_1620758; Annot_ID_49954

SEQ ID NO: 20572 - DNA, 3000 bp, Unknown; identical to SEQ ID NO: 5048
  misc_feature (1)..( 3000): 2750-1469P.txt file - cDNA_ID_1827151; gDNA_ID_1620758; Annot_ID_49952

SEQ ID NO: 20573 - DNA, 3003 bp, Unknown
  misc_feature (1)..( 3003): 2750-1469P.txt file - cDNA_ID_1827175; gDNA_ID_1620758; Annot_ID_49944
atgtggtgctatatagatcatactagatattccttcttttgacgttatgttaagacccttcaatgcagcattaagagcatgttttagaaaattttgggtgtggtttgaggttatggagctgtagattaaatatcacttactcttttaggatattacacgatcaatgttgatccttatatgaactgtgtgagtgtatggataagtggaaaaacaagagacaagttacacttgctttcagtagacttaggtagagcaagaaagaacttagtctccattttctttcttaaaggagttgctgtgtttctgatatttttcttgggtgttgcacaggtgaaaattggattaagggttctcacacgtcccatgggtgaccgtttgcctcagatttaccgaacccttggcgagaactacagcgaaagggttcttccttccatcatccatgaaaccctaaaagcagtggtagctcagtacaatgcaagccagctcattacccagagagaagtacgtatctcaacattctttttctacaacttttctgctcttttgtttctaatggtggactctgtttactctctcctctaggctgtgagcagagagatacgcaagattctgacagagcgggcttctaactttgacattgctcttgatgatgtctccatcacgactctgacattcggcaaagagttcaccgcagctatcgaggcaaaacaagttgctgctcaggaagctgaacgggctaagttcattgtggagaaagccgaacaagacaggagaagtgcggttatccgtgcgcaggtatagcattggtgatcttgattgcaaatctaatgacatgagattagtggttttggcctgaagcattagctctttttgaatctttgtgcagggagaagctaaaagtgctcagcttatcggacaagcaattgcgaacaatcaggcattcatcactctgagaaagattgaagctgcgagagagattgcacagaccattgcacaatctgctaacaaggtttacctgagctccaacgatctgttgcttaaccttcaagaaatgaacttggagcctaagaagtaaaagagaaggaacgagtaagtttcttcatttcatattcatttcatttaaaagatctctccgccttggaagtaaaggatgggttggtgtttgaccaaatgaccctttctcgtgactgattctgaaaatagtctttaagaggacatattgagagagacgcagattggctttggtcagtattattcatcattttcaatgaaactttttgttgatattttcctgtgtttccccggacaattgatgaagttgaatttaaaactcaataatattcatatgatctgatctatgccaatagttctttttagtatatgttacatacgacatgcttatataaatatccgaatataagatccgtaccaatcctttcataaaacttaaatataaatatttcttgttagcttgctattcaaattttcttttttccactagttgccaaccttatctacctataaggatttgtattggagagcagagaaaataaaatattgcatacgtataataagattttgtatgagcagagcaacatggaccctttgtatttaatgacgtcttgccggcgccaccatgatagagacgtctttttctttctttcaccggtgaggagttttatgggggtgacgaaactccggcgaattttccggtgacgtcaaattttaaaattttgaccaagtaaactcttatttcaatatttgtatataaccgacggctgctttttatgatgtcatgtataattaaaattagctggaaacgagtgatgaccgttaaccaagataataaaatgttttgagcaataaataattccaaaaaaataaaagcgttgtggattaacaaaagacggaacgacttgctgtttcgtaaagttaaagggagacgtcatgtcgttttgtcaccatgagggtccatttttttttgtcagtttttcgtacttctcagctgtttcttttgacgaaaggagttgttagattttccacagaactgttgacaagtcatcaccttggctttgcggagttcgtgacgtatgtgcaacgtattttcgaccatatcataagtttaactaatcctagacaagatgttcaaaatgtataattcgatggaaaaaatatgcgtttctatagtttatgcgttttatcaaaattctaaatgacagcttaaatccatgataatagacagatgcttaatggaaaagaaataaaatctataggacgtgtactgggtagtgggtacatatatatgtttcaaggtgcaactagaatataaaacacaaattgatatcttaatgttagagaaaacaagtcatcgtcatgacgtaatagagatgatctaaaatctaatggtccatacaaatgatttgcctttatccataaaacgtaaccttacgaagacaattttaattgtgacataagtttctaaacaaataaagatatctcttgacatcagccttgtcgtaagccccttactatgtattcgtcatcatttagtttaatataatctatatataagtcactgattttatgaatgctacaattttctaaattacaatatgtcaaaaatgacattcggttaagataatcatagttatattctttaaaaaattgagttgtcgcatttgagttccgacaatgagttcgaaatttatctttcacacataagttaaatatatttttaagttttggatgatttacactcaacattaataaataatcataagtttagttatagatctttattttggatacggtgacatggcttcggatatcaagagaatacagtttacacatgcttcattgacccccaaagccaaatgctctccaaaatcctctatataaattctttaataatcacatctcttaccaaacgaacccaactacacaagtctctctctcttttcccatttctccctctctctctttgtctctctatcatcaattatg

SEQ ID NO: 20574 - DNA, 3000 bp, Unknown; identical to SEQ ID NO: 5046
  misc_feature (1)..( 3000): 2750-1469P.txt file - cDNA_ID_1827178; gDNA_ID_1620758; Annot_ID_49941

SEQ ID NO: 20575 - DNA, 3000 bp, Unknown; identical to SEQ ID NO: 5046
  misc_feature (1)..( 3000): 2750-1469P.txt file - cDNA_ID_1827178; gDNA_ID_1620758; Annot_ID_167070

SEQ ID NO: 20576 - DNA, 3000 bp, Unknown; identical to SEQ ID NO: 5044
  misc_feature (1)..( 3000): 2750-1469P.txt file - cDNA_ID_1827186; gDNA_ID_1620758; Annot_ID_49938

SEQ ID NO: 20577 - DNA, 3000 bp, Unknown; identical to SEQ ID NO: 5044
  misc_feature (1)..( 3000): 2750-1469P.txt file - cDNA_ID_1827186; gDNA_ID_1620758; Annot_ID_167066

SEQ ID NO: 20578 - DNA, 3000 bp, Unknown; identical to SEQ ID NO: 5043
  misc_feature (1)..( 3000): 2750-1469P.txt file - cDNA_ID_1827190; gDNA_ID_1620758; Annot_ID_49936

SEQ ID NO: 20579 - DNA, 3000 bp, Unknown; identical to SEQ ID NO: 5043
  misc_feature (1)..( 3000): 2750-1469P.txt file - cDNA_ID_1827190; gDNA_ID_1620758; Annot_ID_167062

SEQ ID NO: 20580 - DNA, 3000 bp, Unknown; identical to SEQ ID NO: 5041
  misc_feature (1)..( 3000): 2750-1469P.txt file - cDNA_ID_1827214; gDNA_ID_1620758; Annot_ID_49929

SEQ ID NO: 20581 - DNA, 3000 bp, Unknown
  misc_feature (1)..( 3000): 2750-1469P.txt file - cDNA_ID_1827238; gDNA_ID_1620759; Annot_ID_49971
ttcttcattttaatcaagatctgttaaagaatagaataaataggaagatactttcacgtccgaattaacggacctgaatgaagcaatcgtcggaagactccatcccagcattgcagtcttataattcgctgattcggacgccgggaagtttcgtcgagttatgtcgcaggagctttacgatgtcgtttcatacgactgaacattattttttttggtgtaagattcattcgactaaacatagttttcaatgtttcattcactttttttgttttttaatttttttttttgtcaaccaaaaatataaatttatttgactcgaatgctacactaatgaagtttagttttgtaaaactgtgggaaaattgatttttttttacagaaactagaaataaggtgtatttttttcttagacagagacataaagtgtatttttaaatccaacttattgaaaattggaatgcgtaaattaacctccaactaccaaaattaaatgactaacgttgataaactctttataatattttagaattatctttactagagacaatcttaaaagggaattgggaattagtttatgattatttttttatattaaagaaaaacactaataacagaattatgtattaatgctcagtcagattatttaatttttcttttctcaagccagattatttaatcaaaatatttcctactaaaacagattttataatatttgggagacaatttatcgaattaaacaggccgagacaggtaaggcccatgtgccctgagaccatttggttcctttctctttttatttttctataaactaaaagagctacaaaaatgtgagcaaaatattcgatattcgtttcatttttcaaagaatatcactaaactaaaagataatatttaatatttgacatgtgtacaaattgccaagtgaatgaatttctcaacaaatgttagagaagatgtttgtttccctttcatttcgagctggaatctttattgtgggtcatgttaataatgttttttcgaagactactgtttcgattttgagaaaaatggcatagaactgataaagaatgacgtactttcttattgattagcatgcattctctaattttcatttaacaaaaaaaaatgcattctccaattttctaaactatgcaaattgcttagaaaccggtttagttgtttttgggttctcttatttctcacgatttcaattttataatatatataacttttttatgggtgtatgtcctatatctttaggagtttattaggtaaatgacaattgaaaataatctacattggtaaagtgataatggaacttatttaattagaaatcaaatcctacatgttggcgggagagtggtctctgattaagctttagcctaacgattggtagatctctttaaaactacgaaatcttggtgaagattgtatgctataagtgtgtgtactgtgtactatttcgaacaaagtgagaatgtctaattgtagccaagccgccaagtagctgccttaaatgtttgaagacacattcatcatttaaaagggactttacaatgaaattgaatatgtatacctccttttttttttttttttcaacgtatacatacctcaaataaatggcattttcaaaggaaatcactcagtcgatgagatatgtttttgtggcgctacgtgaaaacataggtaaatgaactttgtgcatcattgttggaacgaaggatatggctatacaaaaaaatatttggtttccgcgatggatatgatatacaattcaaagttttgaagttgaatattacacatttttcttcaacatatatgttttcttttcagtaacttctgaaacctaaattgtgatatggaattatataaaacgagttgcaactttttaaagatatcaaagataatgtcaacgttattttttgtaacttttaaatgtatacatcacaaattcataatctcttttttttttttttgataaaccgtaggaattccaaacatttgttccgttgataatactaaggcgtataatcatctcttccaagtggggttgagctagtgatctacttcttgagcactcacgcagacacgcagtcactctcttgaccactaggccaaaaacccatcagataaattcatacataatcttatacactttatatgttttattattacaacatagaatataatcatacacacctaacagaaaaccttaaaagcttaaaacctttaaagagtaaacaaatggttgaagtagtagacccaaaatcattaatcataggtatgttacttcctatgtcaaaagaagaaatatgaaatcttcttcttttagttataggaataagccaaatatactaacagcaactagaatatcaaaagtgtgaccaaaaaaaaaaaaaatcaccaaaaacaatataattaaaatatctatttaatcctcgtgcttgctctctcttccagagaaaggggaaaaaaaaaaaaaacagattcctgatattttctgcttcgcttcgctttgctttggcctttgggtttgctttgccttttatctccacaataataatattcgttaacctctcctcgttctcgtcgctgtttcttcccgatctttgctatagttctggattcaaaatctttcttccccaataggtatacgcgaaaaaaaaaatccaacattttcttcttacttaaatcctcaaattttgtcacttgttcatgcttttaagtaatcaatttcttaatttcagtgttaagtttgtcacgaatcttatttcttttctgttgggttaatgaatagtcgattaaaaatcccagctttttcaatctgttattgctaagtgattaggaatctcagatgttgacgttcactgatagggttttagtcaaaattcctaatttcttcaagctttatagtaagaatcttaagttgtttgttttgggtacagatgtttgtctcttaatttttgatttttctgcaaaatcaaatttttaagagctatg

SEQ ID NO: 20582 - DNA, 3000 bp, Unknown; identical to SEQ ID NO: 5068
  misc_feature (1)..( 3000): 2750-1469P.txt file - cDNA_ID_1827242; gDNA_ID_1620759; Annot_ID_49970

SEQ ID NO: 20583 - DNA, 3000 bp, Unknown
  misc_feature (1)..( 3000): 2750-1469P.txt file - cDNA_ID_1827246; gDNA_ID_1620759; Annot_ID_49969
gagaatactgtcagcgacgatggaggttgctggaacgttcgtcggagatattagttcttctaagcgtcacttaatggcgtttctacgtaacaagggttttgatgcaggtacatatatatagtctataatcatctctttctatataatatactgaaatttacattttttatattgaaatgggaattaacggagatgattttactagtttgtgactaatatatgggattatatttaacctacggaataattttcgtatcttatgtaaacttgtaattttgtttaactatttcgtgattttacaagtgtaattagtggctaaaatgaatcaaagttttgattttatttgtgtttttcttttaaaagttaactagaagatttattttcatcatactgtagttccattccaccattttataatttaaatcacgattccacaatttatttttatcatctagagcgtacgtaaggttccttaacttgagtattttcttcattcgttttatgattcagtagtgtcttaaaaaattagttttttgagttaataaaatagtgttttggatattggaaatttagaaccataaaatattcagacgaaatggctgcgaagattttttttcttggggggtcgaatagctaagtagattaaaaaaaatcctccttttcaccgcaagtagccaaatttgtttttcctactgatatctatgatttgtgcaattgcttaccaatcatattaaacagaagttacctaaataaagtacttagaaataattaagttgtactaaaagttatataaatatgtactttatattgcagccaaaaaaagttgtactttctgtagtattatgatgtactcgtggtacttggaataagtttctactatatgtaagaaaaatgacaataatcatcgccatgtatgtgtataggtctttgcaagtcgagttgggaaagattcggcaaaaacaccggcggaaaatacgagtacgtcgacgttcgttgtggcggagattataataatcggtatttcgtcgagacaaaccttgccggagagtttgagatagctagaccaacgaaaaggtacctctcaatactaagccaagtgccacgcgtcttcgtgggaacttcagaggaactgaaactgctcgtgagaatcatgtgccatgagatgagacggtcgatgaagcacgtagggatccacgtgccaccgtggaggagaaacggttacatgcaagctaagtggttcggtttctataaacgaacttcgacgaccaataactacgaaatggttaatacttatgatacgactgcgtttaagggttgcaaggaagagttttgggaagctaaaggtcttaaggttatggttggtcagctttcgattgctttcaacattagtgcggttgaagtgtaataataatcagaaaacaaaagagggatccttttccagtttgagctaatatgtaagctaattcttgggttttgtttgtaaatactaaaatagtgaaatttttgttgatttagttacgcagattaatacgtaaaatgtattttaaataacatgcatttcggagcggttttaactctactgaccaagtcagatttgttttggtttattttcatttttcaacacaaatctagtcaaagacgagtgtcataaattgaatggtattttagcgttattccttccccgaaaaagaaatttgtgtccgagtgtttttgacggcaaagtgtgtgtttcattaattgtactaactagtcaaaaaagtataaagaaactcacaaaatatttatttttcatttataagctaaatggtttattactaattttgttatccttctaccataattagttgccactgttaaaatcggatgaattatttttgttctatgtgattgttgatgatacagtgcactaaaaaaagttcttcatcttagtgttgtgattatatcaaacagatttccattactgtctcctcaggtttcataagtttataagcataatgtttgctttcgatgtgaaatgaccaatagactcttgactctttaggcccattatataacccgatcatgggccagtaacatgtggaaggcttttcatgtggaaggcttgtcttcattaacacatgtaaagacaaggatcaaactctttttttacaaatctgtttagtttagttatgaggttgcaacaggtagcataataaataaaaattttaccaaatgtttcatttgtattaacaatcttttagtaatatgtaaaatgggaaaaataggaaaaattggaaatagactttacaaatggataacactggatttcttgtaattgataaaataatttttttgagatatcatatgtttcctcttttcacatttacaacaactacaggtcctaaaatttgtccaaattatcgtttatgtactcaattattcatctgcaagttctcacaaaaatgttggtgtaaaccattaggttaaattctccggtctcctctgtaagattttgaattttccgcaatagaattaaacctcaaaacgaaaattaaaaaaaaattatccgaaaaatgcagataacgcatgtagaaaaaaaattacaatttacgaaaataataataatagcaaaatatttataatttttagtacttttgtttcgtttaccaaacgtagaggcatgctcctaggctctttaaacatccatacaccattttaactgtcttcaaatataattagctagtattataaatcctggaaaaaaaaacccagccattatcgtagaactctaaaacaaattacaaaggaaactttaattatgtgaaaagcaaaaattatatcaaatagtattgcatatgaagtattttgaaaacactactaatcagatcttatcaacaaaaagaacataagataaacatttataagaaacttaccatttagacaaaaaaaaaaaaaaaaaacttaccatttccatttttttttcttcgagtaatatttttaattttctatatatactacatg

SEQ ID NO: 20584 - DNA, 3003 bp, Unknown
  misc_feature (1)..( 3003): 2750-1469P.txt file - cDNA_ID_1827254; gDNA_ID_1620759; Annot_ID_49967
aaaactagaaaccctagctcaaaggggaatcatcaacttgttgtctctccactattttaccaagtcgtgagataaattttgggccgaagatggaagataatgggcctagagattttcagcccaatggctgaaaacattttatgcatgaatggatttgtaactagtatcggaaaccatccaaacatgtgatgttgtagactagatcatctataaaattgtatggtctaaactatacaagctatgtaaatggtgtctgtttctaatactatgtaaactagttaacaagatttcgttaaaataaactataataaccaatgaatcaaatcggtaattggaactaattgagtgtccaacgctcacaaagccaacccctaaatctcataaacctacaaaaggacaaaatgtattagaagattgtgaatcgcaattttgacaaaaaaaaaagagtgagaaaagaagaagtatagttatctttctaagtctagttaaatgatctacttgttggaacttcaattctaaaccaatgacttctggtgaagttcattaccaaaatgatcggatcttgaagtcattagattctctgcaatgaacattataaactaatgtaactacatgtaaaaattgaagtcatattacataagaaattgaggtcttagtttgaaagcttataatagcaatgaacaaatataaacatttatttcacattggaaaatgaaatattttcctctatatatattatacacttactacaagtttcactagctttgtgaagaggacattatggtataagtgatgaatagacatgcaaaacaaacatcgggttttggtgaatgtgcccacaaaagatttatgaaacatttgttttttgaatttaatgctaaattatattcaaaataaaaaaaaacgttttttacacaaaactggaaactgattgaaactttttatgaaaaaaaaacttctcttctctaagctctcgatgcaaaccaaactctcatttcatccttatacttcaaaacaccacaaccactcatcgtacttaaacgatttctgacgtttttgtctatcatttttataagtctctccggcagggatgggctcttcccgtgtcttctttggttcctttcattccaaattgagtgtatgaaacattcgtcacatatttttggtccaagatcaaactgttttctcttcggatttttattcaacatttgtcacatatttttggtccaagatcaaacagttttctctaacggaacaagattctacagcttctcagcttccacgtggtcccgatcatggattgccacgtgtacgattccacttggtaaacatgatttttttttggaaagacaagttgtatctgtaagattaaataattcagtacgaaaaggcatcgaatcctcactcacggattgttcacaaatgttgtctccaagtagtgtaaaatatttcgctttttacacattgccaaagatcatctccatccattaacgttacgtttatctccgaatatactttatgaaacagtttgttaattaattaagttctagatatcaggtagaaagagagtttatgacactttctgtcatttttagtcatattttaagggaaggtttttgcagagactagaaaactgcaaatcatatagtgtttctaactttgatatattgaagatttttttttgttgatatattgaaattttgatgtaatattaacatgtcttatttatgtttctttatctcattcggatgtatatattttttatgccacaaggttttctgtgacctaatatcttatatgatcaaatcaatagtttctatatccaaatataacatgatctaatggtacaccaataaaaatgctccaacgatgatcgtgaaaaccaataagaatgtgatctgaatttggtttattattacggtgtaattttgttattttactagccagtgttgtatatggatgaatcaaagtgtaattttttgtgtaactaattattcgtcgatcgcgacaattcccttttaagataggatagtttattgatatataaaataatcctaatactaaaatagaaaaagacggtcagataacaaatattttcgcagtcgcgtctaatggtttttacgaagttgaatacagtgtgatctttggattatttttgaagtcaatcttcatctataatttttttttaaataatattaggataataataggttgaagagaaataattatatccataattttctgtaaataaatacagctttactttatatttattatcatcatcgaaccaatgatatgaagcaattttagtcggtaacttggcgagtcgttaattcagttcgaattataaaaagacttctaaacacgaaccgaacacgatttgatttgttctcaagagaaaatatataaatagatttataactctttacttctcaaaaggctaacttttgaaccaagcaatcacgagaaacctttgaaaatctcttactttggatccgttcccttattcacttggtttcttctttaacttccaaaactcaacttgtaaccaaaactttctggtgcttttctttcttctcgtgtcctttatttccccggaaaatttaagctcctcttcgttagtttccccggaaagtttcatcattgttatacactaggaaaaaagaagaagatgaaacccatttgtttccttctctgtttctgcttccttcctgtgaaagtctcttccttttgacacaagtctcttctgtttcaaattttctctgttggcttatttcttcttttccctgattctgttttgttttccctagaaaattaatgaaacgacggttagattctcgggagatcctatcgaacccatgtttttgaatcagttcatgcacttcctgaaatctattcatactttcagaaggaaaaacctagtttaacatatctttaaccctaatttctctgctttcaaaccctaccttgtgaaccaagcaaaactctcctttgatcaatatg

SEQ ID NO: 20585 - DNA, 3003 bp, Unknown
  misc_feature (1)..( 3003): 2750-1469P.txt file - cDNA_ID_1827264; gDNA_ID_1620759; Annot_ID_49961
cgaggtcgaatatcccgagtaccgtgggcttatccaccggtggttcgtctggtccaaccgatagcgtcaacacatctacgccgtccataattgcctatgacaaaattaaataagtaaacaaataaaattggttaaagatcactaagagaaatataggccctaattagtattgtttacttggtcgatggctgcaattacgtcaacaagagttccgattgatggataaatcgccttgtagacggctattctgccacacaaaccaataaaataactcgtcattttttttccaaaactataaagtatcatttagtctttgaactttcaatatatgagctaatgaatatgcgtgaggtgacaaaccgtgaacgtggggccataccgctagcacggccgtagaagaatccgtcgacgatcaccggaactccagcgttcccggctgcgatggatgccacgtggctgaaccaacccgaccaaatagtaaacacttatgcaacacatacaatgcacaacaaacttacaaagcaaatgtatagaccattttacaaacacaaacaatataaagacatataatctacccccataatatggccgtaaagagactttagcaaaacttattgtcattaccgccaataatttaaaaccattatatagagtcaagtctacaacctcatttccatattctcaaaaaataatatgaacatatcattacagtttaccaaaaaaagatagatttatagttttttttctaagatatatagttgactacaaaataaagacatgtatttataatacaatggctaagtgatttatcaaattcaaaaatggtatttcacaaaatctcttcaaaaaagagagagacatttataccttccgtggccggacgcatcgaacggagagagtatatccaaggaggagttaagagcgcctgaagctcgagctccggcggaaaagaaccttgcggagataatttttccgttacaagatccgggtggaaaaaagggaccgatctcacagtcaccggagaaatgcaaacgtgagagatttgatgagtaagggtttgtgagatcaagtgcggcgaagctaggatgagtagggttaattccggtgtccacgaaaccgatcacgatgtcttctccagcacgtctgtctccttcgtttgagatcttttgccagacttgttgaggaagttccaagaaatcgggagtgtatgttgtcattagtttcactcctttgtcttcttctactgccttcactccttttgttttcccgagtttcttggcctgcaagtatcagacaaccaaaattaaccagtgattgaactaaacctaattaaaaatggaaattatcaagagattcaaaactcggcgatcctggttggtttagtttcaattgtttttgatattttcttaatatatcggattcatagtagttgatatcaagtaaaaaaattgggaattcatttagttatgcacttgcgatataaagtgggttcaatttcttaaaaatatgactttttatccaaaaaaaaatgaagtccttaaacttgactaacgaaatgaaccaaaacagaaaagtgaaccgagttatattcattttgggtaagcggagaacctgagaagcagtggtacggactgcaatagcattgatgacatgtttgaagctataaagctttgtataacttcccttttcaagtgtgcttccaagtatttcgtcatgaatctcttctatcttctttgcttctaacgccatagctttgctaattaattgtcgaacatcaaaaaagtattcctcaataaataaatgaattatataatgattaatttagatattggccaagtcaaagacatattgttaatgaacatggaagatgagaaaataagaacttatagatgaatttaaaccaagtatatgaaaaaataataatgtgataaattctttaaatttcgaagaaaaatgtattgatgtggacctgttgatattagtagaagctcgaaaggccaatggttcaccttcaaccaaaatagagtaaatctttggtatatgatcatcgttttcgccttttccttctttttcttctgctctggacaatattgcacaaacaaccaatacaaatatacatactattaaacatatgtaggaatatgatcttagttttcttggattggtttccattagatctttattaggattctccatttgcgttaatgaagataatttatatcatgtagagggcaatgagagtcatgttcttggacaatgcacattaccaacgtgaccattttattctatcagaggtttatatatatgcgttacaatttgtaatatttggtattatggtgtgagccttgcttataaggaagttattttcttagttcaaaccataaagaaaaagtaaaaaggaagcttatttagaaaaagttatatcttaaacaatctgtcattcctttttttcccatttaatgttatttttcaacttatataaaataggtacacaatttatcgtatgccacatggcatgttttgattcgttttctaggtttttgctgacccagattgataagattgtgaactacatttttcaagagtaatttcagttataatgagaaatatggaaaattaattaaaatatagcaatgtaaagataacaagattgtttgaatattccttaagacaagtttaaaccattttacccttcatttaaactgttacagaaaagaaaattagattttttcattagacattttatttctgaaacatgtgaatatttgcattctcaatctcatattctcatatagccacaatattcgaaatataattcatgtaacaatattatcgtccaaatcccttatggaattgtacacaaaccacttcatttctcgactcatttattattgggccaagatgggccggactattgtcttaagaaaatataatctcaaaacccaaatctgctaacatatatcgaacaaaaaacctcaggaactcttgaaaacttgttaaatg

SEQ ID NO: 20586 - DNA, 3003 bp, Unknown
  misc_feature (1)..( 3003): 2750-1469P.txt file - cDNA_ID_1827274; gDNA_ID_1620759; Annot_ID_49958
aacctgtcaaatgcatacaatatcctaaaaattggaaactatctcttcagaccaaatagcaaagagagattctatattaatgaaaacaataatctttacagtgaattgatcagcacgtcgcttctctgattggagaaaagataaccgcattgcagcaattttctcatattccttcattagtacatagcaagtccaaaatgtgaatgcataagccatcacaagatgtgcccaaaacctttttaccaaattaagaaaaattctaatcattataaagtttttaacaaaaatcagaagtagcaactacataattttctttcactaacaaacctgtctgatccacgttcgacattcgaaatcgaaagcttatcgatattactcgatgttacattacgaagttttgctagctgcaatccatcacttgtccaatttacaggtactaaaattgaccatgaaagtaatgcaatcggaccaaagatcttaagcctataaaatagtaaacaaaaaaaaaaaccattagaaaaaaaaaacaaagctataattagtaactgtatgcaagaacaaaacattttttgattacccaatcaagtaaatcctcaagtaaacagcagaatccaaaccagcatgatcaataagttcaggctctggcatcttaagagcatcaggcatccagtttaaaaaccgaacgtatgatcgaaagtccaaattcataatcttgctaacgaaagcacccgaattcacagggctgcttctaacaccttttaagtaccatttagggaaataaaccctatcattgaatggttgaatcctcaagattgcaaatagcaatagaaatatcaatgcacttagaatattaatcgctgctgctagtccaatatctgctaatgtcgccatctcctcaaactaatttataataaaccctcacaaattctttcttcacctgcaaatatataagagccctaaaaattgtcataagagtttagacacaaagatcaagttttagatttgtataatagtcaaagacgcttatactaatctcacctttagaaactcattactcaaaaaaatttggccctttcgttgactcttttttttcacaatgttcttgcgatcagattgaagaagaaaataatatgagatgaatcaagaaatcatattggtgaagtggagatttgtgtggtttgtataaaagcttcttcgaatataatctttaaattttcttcaaggaaaagtattgcacaagtttctttagttttctcttctccttcctctgaaaacagaaacagagagagggaagaaaaaacagagtatggaaaaaacagagagattggttctgttaacagcacaaaaatggggaagagaagaaaagaaacttcgtgccgtttttgttgatacaaaacgctgaaaatacacggagaaatagaagaagaagaagatgatgaaaaagttggatctttttaaaatctttgaatctagttgttgttggtcggccgtctaactcaagagactattattattccttgaaaaagtttcatttcaaaaaaatgtcccaattgggtttattcctaaattaaacttaaaccagctctaactttttattattattacacatctatcttatttgttttagatatacccatgcttattttggagataaagttagattaaaataactaaaataataactttgttgctaaaataagataatgacttcatagttgactaaagtaaaaaatcatgaaattagcttaattaaattgttactaatactactcaagtaagaaaataatgaaaataggcaaataccgtgccatcacgttgaagtctataattttttttgtttttttttaataatcatattcttcagtataaatcacctttttgtctattttattcccaatacgaattacttttcttacgtccaaatcaatgtgaataatctagctacatttttcttcattttctttttttaataaccacctttcatcagtgtcacagaaatttatctaaggacgtgcgttaagactatctgggattacatcaaaactgcaattgttttttaatactctcattatattagtccttgtagacgtgtagtactagtaccatgtcgaaaaagtaaacatttgtatcaattgctatatacatatattaaaatggttgtaaatacaattttaaattcttaacttaattatcttgaaaaagtaagttaataagtgtctgcatgtgctatatttcctttaacaaaaaaaaaaggcctgacaaaaggaaattaataagttctctaactcttgtctaattaatataacaccaaaaacagatgtctaggccccaattaaaatcatattactctgatatgcagaaagcgtatttgaaaccctccacacaaaaagcccaatataccaaacacatgcttgcaactatttttgtttttgacagctagtttagctacttgtttatgttatgaaacacaatgaaaaattattcaaatttcatagatatagcttcaacaagctgtagatagtagtaataaactagttttcaattttattatttacgtagttggtaggagctaatccaactttacacatcgctaaatgaaaaattattattcatcttaaatactcaacaaaattattaattctgtcttaccaaaatgttattaattctaagaaatgataacaactactaagaacagtctacttgatcaatttcttataactttgaaaccacaacggacatacgtagggttatatttcgtattagataaaataataggtaaagattaaaatgattttaaaggacagggaccttaaattaataccagcgtcaatctcaaggtttaaaaaaaactttaataattacgttcagacaaagaagaaaaatcctcactgaaattcgagcaaaaaacactcacttcgctctttcttcgctagcttcgttaaattcagcaaatctatctctcacgatcgaacagaactgagagagagtgtgagcttagccatg

SEQ ID NO: 20587 - DNA, 3000 bp, Unknown; identical to SEQ ID NO: 5060
  misc_feature (1)..( 3000): 2750-1469P.txt file - cDNA_ID_1827282; gDNA_ID_1620759; Annot_ID_49956

SEQ ID NO: 20588 - DNA, 3000 bp, Unknown; identical to SEQ ID NO: 5059
  misc_feature (1)..( 3000): 2750-1469P.txt file - cDNA_ID_1827286; gDNA_ID_1620759; Annot_ID_49955

SEQ ID NO: 20589 - DNA, 3000 bp, Unknown; identical to SEQ ID NO: 5059
  misc_feature (1)..( 3000): 2750-1469P.txt file - cDNA_ID_1827286; gDNA_ID_1620759; Annot_ID_167098

SEQ ID NO: 20590 - DNA, 3003 bp, Unknown
  misc_feature (1)..( 3003): 2750-1469P.txt file - cDNA_ID_1827326; gDNA_ID_1620761; Annot_ID_50016
aatgttagcatcaacattgactggagaactggaatcgctgctaaggattgggcctctattgctaagaaagagaagatcgaggttagctttcaagagattttacagttcagagagtggtattgcttataattttgcttcaaaatatttctaaaatttgttactctatgacaattgcttaagggtgtggagctggagatcaggaaactcgaaggcgcagtcgaagccatccatgaaaatatactctacctaagaaacaggtaaagtcatcttcagctgcatgaactgctcttgccttctttgctgactctcattatcaaaatggtaattgcagagaagcagacatgaggacaatgagtgagaaaacgaactcgcgggtggcttggtacagtataatgtcactaggtgtttgcattgctgtctctggtttccaggtactctacttgaagcagtactttgagaagaagaagcttatatagagattccctgatattcaggtcctttaatgagagtttcttcttaaagaataatattcaattcatctcctttctttcctctttacacgcctcctttttactgacgctgtaaaatttttgttcatggattgtttatgtagcttctctctgataagaagtcattatttctgattctgaaataataatattaacttcttgtcatctccaaagtccaaacgaaagagattctagaaccattgatattgggttgtaactgatactttatgttagtttggggctataacacgtaagtttgacagtacaagggttaagattacaagaaaaaactaatcaaatgggtattacatacaaatcagcccaaatttctgacccaacaggcccgttaagagcaaaccctaatttcaaagagaatatatataaaccctaatcacatttcgcaaccaccaaagcggaggaaaaatgccggctggacatggagttcgagcgagaacgagggatctgttcgcgaggcctttcaggaagaagggttacattcctctatcgacttacctgaggaccttcaaggtcggcgattacgtcgatgtgaaggtgaatggtgcgatccacaagggtatgcctcacaagttctaccatggtcgtactggtcgtatctggaacgtcaccaagcgcgccgtcggtgttgaagtcaacaaacaggtctgatgatctctcacttcccttaaacttttgtgtccttgaattaggatttgagcttgttgtgctatttggattgttgatctgttgatttgatgttgaaatatgtgattgagtattaggtttgtagaatgtaaaccttctactgtgctccaatttagctcagattgttagttttggctcaaagatcttatcttctattatgcagtagtgtggttcttgatcctgtttcagatttgaagtttgattgcttaggtctcgtttagtctttagccttagcatgcattgcgttgtatcaatttggccctttttgcatcacagttctagctaagcatctagttttacttctccattgaactgctagtatgtttggtttcatgactatcgcattgctctagttttgctttaaatgaccaccaacattcgtatattaatcttgtttctataagtgtcttagagatgttattgtgtaatgctgattagcctatgaccagaacacaaacatttttgctagtactacttatattgggtattatgactgacatatgatggtggggttgtttcagattgggaacaggatcataaggaagaggattcatgttcgtgtggagcatgtgcagcagtcaagatgtgccgaggagttcaagctgaggaagaagaaaaacgatgagctcaaggctgcagccaaagccaatggtgagaccatcagcaccaagagacagcctaaaggacccaaaccaggattcatggtcgaaggaatgaccttggagactgtcactccaatcccctacgatgtcgtcaacgatctcaaaggaggctattagttctatcttcttgtgctttagaactctttttcatttgttttgtagcagacttaaaactaagaattatgatttactatataacaggagtttgcaatccagattttgtaaggatggtttatttttattattggtatttttgatcttccaactattgttcacttttgtcaacggtgtcttacgaattttaaatatgtctgaaattgatttaattatgagcctcattttaagatacgtttgacttggagcccatggaactccagcacgatgccacgtagcgtctgagcaacagaacctaattttgaacactgaactcaaaagagaagaagaaaagagtcaagtcttgggtgtccattaatgggagatctctgttatgttcaacacttgctcgagagacagatagaaaccaggctgcttcgtcattgtttctcctctgaagcattttcgttatttctgtttgctgtattaaaatttcctaaaatagaaagactatgaaacctcatttccctaaaatctctcatattcttgataggctcttcgtaatttcaggaatcactcacaattccaaatctctctctctctctctctctctctctccattaatctcagcatatctctttctctctaacccacaagtcttcctttgattctttgatttcaattcgttttcttcatacaaaaacattgagacacatatttaatccatatttcgagatcagtcttgctgacctcaaattttccagtttcgttacatctacagaaaaagctcctctcttttttttttgtctcccatttgattttaagattagcgtctaatccaacaagttccaacaaggtctaaagatcaaaagctcaaatctttgttctttgttggtggtgtgggtgggaagatttcattttcagtggagaagaagaaaaaaggaaagattaggaagctaatcaaaacatacagtttcctgattccggtcaggaaactgtggagcattgacggaatcacgaagccgtggagaattatg

SEQ ID NO: 20591 - DNA, 3000 bp, Unknown; identical to SEQ ID NO: 5083
  misc_feature (1)..( 3000): 2750-1469P.txt file - cDNA_ID_1827334; gDNA_ID_1620761; Annot_ID_50013

SEQ ID NO: 20592 - DNA, 3000 bp, Unknown; identical to SEQ ID NO: 5096
  misc_feature (1)..( 3000): 2750-1469P.txt file - cDNA_ID_1827338; gDNA_ID_1620761; Annot_ID_50011

SEQ ID NO: 20593 - DNA, 3003 bp, Unknown
  misc_feature (1)..( 3003): 2750-1469P.txt file - cDNA_ID_1827342; gDNA_ID_1620761; Annot_ID_50009
tataaattttaaaataatatgtatgaaattgaatataaatattcaaattatgacacagtactcagtaattttttttcttaaatctacttttgacccgttatagtatttttttcatgtactgaacaatttatattcgtttttaaaaattcaaattgtggcatatgcgaaaaaactctaattatttttttataacgatgatattattttttcgcaaaaatagaatcatataaagatgagaggtgaattataataattaataaaaaattaatatgataatattgatatcaaatctaatttgttgattttaattggttacttttttggaaattaataatgtatttcgtttttgagttaaatttaattaattaaattagtatttgactttttaatttttaaagaaatgaattaatttactctttaaaattttatttctaatggcatacgtatgtaattacttacaaaaaataaggttacattttaaaaattaatatgataatttagatatcaaatctaatttgttgattttaattggttacttttctggaaattaataatgtatttcgtttttgagttaaatttaattaattaaattagtatttgactctttaatttttaaagaaatgaattaatttactctttaaaattttatttctaatggcatacctatataattacttacaaaaaagaagattatatttcaaatgtacttcccaaataatatagtaggatcacttccattccgagttttcttctttctttgatatatatatctacttatttatttactcggtttgattttataataaatttgtttataattattttctgaacaagagatggccataaaatacagtgatgaaatcaataatggtccatgcaaatgtactcaaattatccacttggaaagtttatagtatacaatgggttgttacgtattttagaatctaatttgcatggcgatttaattgacatttcatcatcaaccgagctataacgagagataaaccagaagatgcaacgttcgtgaacaaactcgactgatattctagatggttttatttattttttacttatagaaaggaacaaattagatttaaagataatatgctctaatctaagagtttggaaccactataccacatactatatcccatgattaaaaaaaatctcaattattatagcgcaaatgattggttttcatcagttaatagaacttgctgagtgagtccccaaatttgaggatgattagtaatttagtatcgtaaagactaaaaaagacttaagaaaaatagtaatgattagagaagtcaaacctttaataattaagatagataaagagagacaaggttgctcaaccccacttggagtgtgatgcttttttggcagtgttcctttatgataacacatctcttcacacacaactttagtgtatcacaggcccatgtcactttaagataagataacatattctagtatatgattattttcatatttgtaagtgtattaaattattcatagacacaccatgaattaattgtaataatgcgaaggacctgtatcatgtaacagagacagacgaagtgtgcagaggtcggtgagaagcaatttggtcaccatgctccaactctcttctctaggtcccttttgctttaattttctcgtttaataacaatatcttatgaaagcagttaccatatcaattgaaggattgtataataccgtaatttatttatatatagtacatctaattaaacattaattatttctactaatagcctaaaaccactactaatacaacaactagtacttgtttacgataattattaaacttgtctcgatacctacaacatgcccaaaaaagtaatcaatactttgtttaatcacaaagatctcagtgagatggttctatagatagtatttctgatttgttagtatattagagaattgaccatctattaaaataagagaatgaacactatttgataaaacaatacatacgcaattatcattgtctttaatttttatcaaagtaatcatacgatcgactatttgtatgcaaaaattcatcattttatttgcaaaaaaaaacaaacaaacatggtagaattgtatttggtgtgtgttttaacaaattgttgcaatgtttagtgcaacatatataatccactatatataatcattgacataattaatatttgattatatgaagcaatttctctttaattatgtgtttataaatatagggagaaaagaaaaatagagagaaaggtaaagagtagagctaatgattcgggcgacgctaaaaggttgaatgttcgagagaaacggagtctcagagactgtgaaaacaaaaaatcaaaatcctcagttacagacgatttggtcccctctcttctctctctgcgtccgtcttgtgcgtcgatttgtctccatctccttctctctccgcctactttctcaggactactccaattcgccgactttttctcctctgttctctgcatttggattgatgccactttaatactttgaggttctcactctctctttctctcttcgctgacttcgattgcttcagtaccctttttctcaggtcagctacgatgatagctttattcagacaagaagatcaaagttttgatctttttgttttggttttcttaagagatggttaattaggtcttgagtgcgctgttttgaatcgttcttcagtgtgattaaacaattggttttgatttgactaatcatgttgccattaaactaagtgaaaatctctgctttttttatattgcatattgatgattgagacattgatttcttttctatttctttatttcccagtttctaatttgggaactgaaaagttttctaatttaagcattacaaagtgtacaatttttgtttctggcaagtttttcttggcctaattcgtctattttatgaattcacctttttaggatcaagacttcgtaaaagattgtttctgtaaaacgcaacaccatg

SEQ ID NO: 20594 - DNA, 3003 bp, Unknown; identical to SEQ ID NO: 20593
  misc_feature (1)..( 3003): 2750-1469P.txt file - cDNA_ID_1827342; gDNA_ID_1620761; Annot_ID_167157

SEQ ID NO: 20595 - DNA, 3003 bp, Unknown
  misc_feature (1)..( 3003): 2750-1469P.txt file - cDNA_ID_1827352; gDNA_ID_1620761; Annot_ID_50006
caatatattgaaatatttatacatttaaaataaaatctataaaactgaaagaaaataattaatattctgaacttcattttttgcattttgtgtataaattaaaaaaaaaaaaaattactgctacgtgatttgttgaaaaaattaacacgtggggtgttttatttttgattacatgaacttgtgaaccttgtttctgcttacaaaaactgaagagcccatttcaaacaaggcccatattctgattgagcggccctattttaccaaaccacctactaatgaacactctcaagtcacctcattcgagttggaagttccctttaaaacaattattttcagacacagagagactcagacaggagatatgaactgcggaggaaaggtggtctgcgttaccggagcttccggctacatagcgtcttggattgtcaagcttttgctcctccgtggctacaccgtcaatgccactgttcgagatccaagtttgttcccaactctctctctcttctttattttaaaaaacaaacgactgcaattattagggacgattatgagtagcacaaatagaatcaaaatcggaatctggctgaaaaatctgacggaatcaaaccaattatgtctttacttaaattacatacataacatccaaatcgttcttttttttttttttgagacaaccaaattgaaatttgggactttgattagctgttgtgttttgaatgatgacttattaattagacaatatttttccgacctttataattaaattaccaaatacggaaagttcagagaactcattcaggttcgtaccaagttttgacttttgagggtacaagtaaaatcattcttttgaactttgaactttgaagtgcatgttgacgttatactcttcttcagaggacaagaagaaaacagaacatcttcttgcactagacggtgcaaaagaaagactcaaattgttcaaagcagatcttttggaagaatcttcttttgatcaagctatcgatggttgtgatgctgtcttccacactgcttctccagttctattcactgtcacagatcctcaggtttgtcagggaattattttaactattaatttgcaaagtcatatgagttaaaatcaaaatttgtgtttcttttcctattagactgagctgattgatccagccttaaagggtactattaacgtccttaatacatgcaaacaagtttcttctgtcaagagggtcattctgacatcttccacggctgcggttctctctcgtcagcctcctattgggccaaacgacctggtggacgagactttcttctccgatccaagtctatgcagggagacaaaggtcctttgattttgttgtggacttatcagtttcaagagttcggattctttcttacacttttcttattttcttcttcagaattggtattcactctccaagattttggccgagaatgcagcgtggcaatttgccaaagacaatggaatcgacatggttgtgttgaatcctggatttatttgcggaccactcttgcaaccaactcttaacatgtcggtagagctaattgtggatttcataaatggtaagaaccctttcaataaaagatactacaggttctcggacgtaagagatgtcgccttggttcatatcaaagcgttggagactccttcagccaatggcagatacatcatcgatggtccaaatatgagtgtaaacgacattatagacattcttcggaagctgttcccagatttgtctattgctgatacgtgagatctctttccctagctctacctttgcttatcatcttatgaagtttataaatttaatgaaagattttgaaaaacttacttgttgatgattttgttaggaatgaagaaagtgagatgaatgagatgatatgccaagtgtgtgtggagaaagtgaaaaatttgggagtagagttcactcctatgaaatcaagccttagagacactattgttagcctcaaggagaaatgtcttttatgattctgttcgtatatttgtaactattatgtgtatttttattttgttagtattactaattcaagtggtttaagttgttgagactctttaaaatctaagcattttataaacaataatatataattattgtttaggctaaatttgtcactaattaaggtttggatacatagtgtctaaactaagctaataatatcacttaacgtttacttgtaacgctaggtgatgatgtcgtcaagtcaattggtacaaggaataaacgagtggtcatatgacattatgaccatatgaattcaaactccagtaatccaatggtaattggattcaatgatcaagacttgaaccacgtaatccacccttatccttagaagctcataaatatcactaaagggacaggcaacacttaaccagtagttgtccaataatttagttttccaaaatgaaaaattattgttgtcatctattttaggtgttttagttcaatgtggattcctcgtcctaacaaatacttgacgaatatatctagactataaaattggttatgagttctacttttttttgtttgtgaaattatcaaaatttgttatatttatttatttattctcattaatttgagtactaatttttaaattatttatactaaaaacaattactaagatacaaaaatggataagagcatggtgtatagatatttaatgggatagaatatttcccataattgtatgtgtgtgagaggttttgttttcgtaaggaaagaaacaaaaaccatttgaccaaagaaaagcaaaagaaggcaaggaatcaaacaacaaatgttgcaaggcagaaataatggacgttatgttaatgtagtgtcgtcacacgtgacttaaaagagacgagtctgcgtgtcaaactaaaaatgtatgcaactataaaaatgggatttgattatctttttagtaccgaagcctaccaaccacatgcacactaattctactcgccaaataaagtgaaaagagatg

SEQ ID NO: 20596 - DNA, 3003 bp, Unknown; identical to SEQ ID NO: 20595
  misc_feature (1)..( 3003): 2750-1469P.txt file - cDNA_ID_1827352; gDNA_ID_1620761; Annot_ID_167152

SEQ ID NO: 20597 - DNA, 3003 bp, Unknown
  misc_feature (1)..( 3003): 2750-1469P.txt file - cDNA_ID_1827363; gDNA_ID_1620761; Annot_ID_49999
tccaggaacatgccggaattgcacatgaatctccactctttcaacattaaggcacaccaatcaattgttatgacagttggatatgtctatgagtaggaataattattcttacctgtgtttaatgaggccagtgccaactcttacaaggaaaggtacaccatcccaacgtgcattatcaatatacaaggctgctgcacaatatgtagggtctacaccgttcaagatcacaccgttcttgtctcgggaactggatttatactggccaaggatgacatcacgcgggtctatcttgcgaattgatcttaaaaccttcacctgcagaagcaggtttgtcaccaagtcacttgacagaacaagagtacacaacttacatatataccataagacgattttgttctttacagtacaggttgaccttttcatttcggatatcttcaccatcgagacttatcggaggttccatggcaagtaatgcgattgtctgaagtatatggctgtgcactatgtcccgtattattccatatccatcagaaaaccttaaaaaaagcagtaggaaattagaaaataacattactgatttgtctaagaatgctgaaacaacacaatttactctcacatgcaaagaaatggtgaaaatagaactattgtgccttacttttctgtttgcgcaattgattctgatataataacctggaaacatcatttatacacaaagtgaacaaaccagaatgtggaagaggaaagttcaggcactatacacaactacaaacaatcagaaggaaacactacctgtatattgcgtatgtatgttctgttccatagtggttcaaaaactagatttgaaaaccttaacactgtcagattttcaatgaggtttcttcctaacatgtgatctatcctgtaacgggcacagaagtgtgaagaaatatgaacttgagagctgtgcatgcagaaagcaactagatttaaaagaaggacctgtagatttgcttctcttcaaacttagagagaagtgactttgttaactgatgagacgaatgtgagttaaaaccaaaaggtttctcaactattattcgagtccagcctcgtggtgcctgagcgttatctccaatggtgcatgccacatccaccagagcttcttgaggtactgagaggtaaaagattctatttgcttctgattctccctgaagaagaaaagctgttaatgtcttattctatcttgcttgtctgttcaaaatgttgtaaactcagaaagaggactacttctgggacaaaatgtaatcattgaaagaaagaaaaaaaggtacttaggaacctcaatctgtttcattctctcggcaagtcgggacatcccatccctgttattataacctccattgatatagtatgttctactctgaaatgcatccatcttgcccccacaattctccctgaacatttagcatcattctttagctagcacggccgtatatcagagataccaaatttaaggtagtaccaagaattatacatactgatgatcaacacggcaagtcagcgttgatgcaatgatggatctgaggtcttcatctgtcagattctttcttgaaaccccaaatatagcaacatcctgtgacaatgaagaccaatcaagaagacaaccgaaaaaaactatccaactgttttgctgcttactttgtaattgttcatgagcacaaaagtcatacctcaggaaggtagccgctataatacaacgcaaacaatgccgggaaaatcttccctcttgctagctcaccagtggctcctacaacagcaatgcaaagtgaggcccttcttcgaacatctgaaagatcatccgagagttgttttgacacaggtggtaagtctccaacattgtgaaacccatcattcaaatccgttcccagaatattctcttctggtcgtaaatcttcagctctagtttcttcagcaaaacctgcatcacattctacctcaggaagtgctaaagaatgatcaagtgaagacatgagatgtaaattgactcatatcttagaactagacctcgttcatcatcgctgaggaaagtgtgctttgagtgtgttgtaagctcgtttacaggctgatgttttctgttgttgccttgtctacgattcaagctcttaagtatccacagtttcaaaccacagaatctccggcagagattcgagcctcctccgttgagaacaaggcttccacttctggagaaactatagtctcttgacgaaacctattcacacaaaatagagaaatttcaacaactagaaatcaagttgatttcgaaggtcaataatatactaaagcttagattcagagggcatgtaacacgaatttgagatctttggtgagattgcagaaaacattagcataatccaagaaaaataataatctttgtttctcaaagtaatgaccttttgataaaacgaaagcatgcatgaaaggtagagcgaatacatgtgcttaccggaaaattagaaaaagaggcggcgagatggcaagagcagacggaggaagacggagccgtcgctgattgagaaaagggaagcaagcaactggagagagacatgaggatagttcctcagggattatagctaaacatgttcaaagctttaaagctgctttaagtggatcaaagtggaagacgagtgcaagtttaagttttctgattgacgcctccattaatggttccaactttcagataatcgtcgggttcttctaaaccgaaccgtaccggttggttctcgaggaaagagaattgaatttgtggtttaggcgggggtgggtaggttgactttcgatatctcaacgtcaacgtctcttctggtcccgccgagtcggcgtcatcgttgagttggtgagatcatcttcttctcaacttcatcgatcttatcgtctcgaaaattgtcaccttttcttctcagctacttcaggcggagaaacactttccgtggtttagtgttgaggacgatcactgtttgtaattcgatg

SEQ ID NO: 20598 - DNA, 3003 bp, Unknown; identical to SEQ ID NO: 20597
  misc_feature (1)..( 3003): 2750-1469P.txt file - cDNA_ID_1827363; gDNA_ID_1620761; Annot_ID_167141

SEQ ID NO: 20599 - DNA, 3000 bp, Unknown; identical to SEQ ID NO: 5077
  misc_feature (1)..( 3000): 2750-1469P.txt file - cDNA_ID_1827367; gDNA_ID_1620761; Annot_ID_49998

SEQ ID NO: 20600 - DNA, 3003 bp, Unknown
  misc_feature (1)..( 3003): 2750-1469P.txt file - cDNA_ID_1827379; gDNA_ID_1620761; Annot_ID_49995
ttcaactaattaatcagcgtcactttaccacttttttgtcttttttttctttaccacatttttcttcacattctgaattaatattattcatcaagaaacttatagcttaccatataccattatatgcgtattctatcgtaatctccggaaaataagacgatgtcgtgctaaactttttttcttaattattagtttagtgtttttaatttttagtcttctaaatggaggttcatttgttgccaaaattgtaaaataataagaagtaaattaatgaatttaaatctattcaacgtatagtactgatgaattaagttattaacatatatcaaaaaaaatcttgaccacaaaaaaaaaagactttaagcatgcagtacttctatgtcaataaattaaaaagcttgatttttgaaacttttggaaagtaataaatttaggtgacgcaagaaagttcaaagacgtaaaaacgttctacatgagactcacaaagccatttagtaaatggtttttcgtcgttaatattttaatatacgcactcaccattttgacgtttatgttgatgaatatgatttcatcattttctactttcgcagttaagacaaacttgaaaacacaaaaaaacaatgctaaaagaaaaatttagctaatcaaagtttagcatttcttgctgatctttgtaaaacatagactcaccacctaaaacctaattacttttaaccccaaaaaagtaataaaaacacccatatgctttattcaagaattaaaacaaattcaacatttcatcgatgcaattgttttaatcgtgtaattcatacatgtctaaaatcgttagttgatcaaataagatgtatatgggcagatattagtatggttttttttttaccgttcgagaaaaaatgcgaccggaaaagtggcgatagtggcaaatatctgacgataagcgaccaggatgagtggcttcataccggcctccatagccatcttcgacgtaatgttcatgcctgcgtagccgatttgcaccaacaccatcgccaagaacggcaacatatctgatttagccatctctcactctcttttattttattcttccaatttatgtgtttatgtgtatctccaaaatatgcctctctcactattactaatcaataataataggtcaagaaaccaagaaaaaaaaataagggagagaggtggattctctatatcatttattagtttccccaaatctatattttattttggttcgaccttatatttatagccaaagatgtatatatacacacatttatatatacatgcacatacatatatttatttatatacatacatatatatagagagagatgttttaaacagaaaggtgagaaacggttcgagaatgaagtttgcttgtaacacttggactctctttagggcataagaacacgaaacaataggtgatatgaatcatttgatatttttggcaatttatttaaattttctccttgctgattactaatacaatccaaattggcgttttgtcaaaaaaaaatctaacttattttcctcgttttaatccatttttttggtttccgttttttcatgggtttggtggagcttgtgaatgtctttctcaagcttcaagcaatcaatttgcctttgctaaaactcgtttctgtgatattaaaccaagggcttggtttatcgcttgattaacaatatcgaattagtattatcttacgtattttgaattgattttcattatatcactcttgctttttgtcaaacttttgtgtgtgtaatatatatcataaatggtaaattaactatttatatcccaaaagggttggaagttgggcatggattatcgaatatatattgaatggcatgcatcttatgcaatataaatataactaggtaagtatccgcaaaatgtatgcatctaattatttctaaaatttaatatataattaaattcatgattatattattacatgtttcagttcgactgcatactgtatatatactatatatttttaatgtatgaactaggtaatcatttacacaatgggttggacatacgtaatttaagaatatctttgaaaataactggaatttatatcattaaaaagtaggatataactagagtggctagtataattttcagaaaactaattaatttttaattaaaaactatactgaaacataatgatttatatataaaactttagtaaactaaagtaaaatgcataatgaaaacttgtataatataagaaaatctcatatacaaaacaacatatattgttgggccaattattggtcttaaaaggcctcatttattcttaaaaggcctttccttaggtgtacagtgacttccttgagcaagaatgtcatttcatatggatagagataaaacattggtctgtagtcagcacataggtataccaaacacgttaaacttttttgttggctgaaatttgagaaagtaagtgatgcttaacattttgctggatatcagtggttaatttttatacgaaatgcttttggagttgaagatgaataaattatgagtaatgctccatttgcataagtcaaacaagctagcgttggcgtccagatgattaatttccgcgtcctctttggcttccaagttccaacgtaaattttcgccgcatattttttcgatcttatcttttcgttgttacgtacaaaaggaaaattccattgtacattcgttttggatatatactttaggatgcatatgcatatttatgtatgaacaattagcatctacattggagctggagccaacagtaagcttgagttatgtgtctgtcactgtcaaccaccaacatacaaagtcttaggctttgtttttaaattcactaaagaatcacactcacacactatagcttaaaataagagaaataaggcccacacacttaaggcttaccattattacaatttattacaaagctttcgatcttcactctatcttgatcaaatctctactagcaagttacaatg

SEQ ID NO: 20601 - DNA, 3003 bp, Unknown; identical to SEQ ID NO: 20600
  misc_feature (1)..( 3003): 2750-1469P.txt file - cDNA_ID_1827379; gDNA_ID_1620761; Annot_ID_167137

SEQ ID NO: 20602 - DNA, 3000 bp, Unknown; identical to SEQ ID NO: 5075
  misc_feature (1)..( 3000): 2750-1469P.txt file - cDNA_ID_1827383; gDNA_ID_1620761; Annot_ID_49994

SEQ ID NO: 20603 - DNA, 450 bp, Unknown
  misc_feature (1)..( 450): 2750-1469P.txt file - cDNA_ID_1827398; gDNA_ID_1620762; Annot_ID_50051
ttctattggaaaatgagtgtttttgtttgatttttttgcaatgtactgatctgtgctatccatttcctttgttttccaggctggtctctcgcaagaatctccatctgtagatggtttgcaagaatatgcaagcacagtgattgagaaaagtattgagagcttatatgcatgcggaggttgattactacattatgtgttcctattatttgaaggttcatgcagttatcatatagctaggatacctcctattcatatcagaattttgagttaatatagctaggacacctcttattaatattagaattttaaattgaaatagatatgatacctgtttgttctatgtgcttttaagattcacattacttcagaattttgttttgcttttaataccaaaatgctacgagttgacccaatgaaatacacttaatcattttcttatttgatcatatg

SEQ ID NO: 20604 - DNA, 3003 bp, Unknown
  misc_feature (1)..( 3003): 2750-1469P.txt file - cDNA_ID_1827402; gDNA_ID_1620762; Annot_ID_50050
ctcccattgggaacatgacgaaatctaaccaaacagtcaacaatcagaaaagtttctctgttacactctttcgagtccggattctcgtcttccgtcaccataaacaaaccaccgcactaactcgtcgacgacgcgttctcaaatctgacgatacgaactcgcccgaagactcaaacgtgactatattttaccttaatgcgctcgttttttctcagcgatccgaccgacacaattttttgggcaacgcgctttcgactagccggaaaaccaaatcgtcctagtcccccagtgtgatctagttacgccaccacaggcctgatagtattaaaacaaaagggcgaaataaaacgacgacgtttacgaggagcgactcctcgggatccggtagccaatagtaaactcagatcacatagatcttcccgagccctagcgatttcgatttctaaagcagattctaaagacaaaaatcaggaaactcgaggaagaggaacctagtttcgaaacaaaaacaaaaaccagagaagaagatgatcaacgagaatgatgaaatcggaaggaaaccttaccgtctctccgacgaagaactaacggaacggagcttgagattgagcgacgaagaagcagcgatcgagagaaagagagaagtgcaaaaactaatcttagtgaaggccaagtatggaaatgtattaatgtgttcaaacacattaaaattgaatttttttttaagaaaaagtatggtactgagattcagagatggtgaatatctgttgtacctaacagcaatttagtaaactataatttctgacgactatttttcgatacttttgtaacaattatcgtaaaaaacaaaaaattaagtgagattacattcgacgttagatgccagaaataatatatatatgtgattgtgaatatgtacctttttttcttttttcaatgagtgtaatatgaatgctttgagaggattacacgcgtgattctgattcggatcaccaacttcttttgcttcccttttaatttctttcctatcttttgcttttcccattcatctctctcgctttccacaaaggcgagatttgaatacgtaatcctaattatactctcatagagatttggtaatttggcccaaaatatctttctactttgtaatatgtcgatgcatagaaaacataatcttattctaacattcacaaatctcctatatttccatattgaatctctcagtctggatcggtttgtaatctctgtccagctacctcttacgtttcaggtgtttctatgatttatccattggcttcattggctgcctataacttatatatcatgttgcaatctttgtgtgtgttgtgttggggagagcttatagccggccgctcctccattagcttccaaatggttgaatcagtctgtatcagatttaaactcagtgatagcacccacgttatgcatgatttttaagatttgataagcagactgtttttaacttcaattcaagagcatcatccactttcggcttaatatcctatattaatttctttaacaagctaaaatgaacataatgaaaataactacactcactgattggcaattactaatatctcaaaacattaagaagtattttttttttttttgggtgaaaagtcactgtctttttcttaaagccaaaatttatacggaacgacaaaacaaaaaatatgactaaaaacttcttaagcgcaatcactgaccatgcagcctattttagtttttaagtcttttatatacattggctgttatagtcgtaaaacaatcaggtatttgttatggagataacaatttgggaacgcataaatagtgcctctgatggttggaagtggaacaaaatcacaatatttttttctagtgtataaacaacatacaaatatcatgtcacctgcaaagagaataatatgccaaaattttgatataatacgcataacagagtttatatatcaacgttctagacttataggtgatcatccattatctttaacctcttgtagctagctaggttaattaggagatgcatgcatctagataggcatatatagtctaacattacaaatccatcaaaggttcccttcttcttctccaaagaaattagctacatacaaatttgacagactctcataaatatatatatatatgtttatagattatattattaaaaatacaaatgatattttctgtattttgttaaaattagttcttaagattttatgaaatttataattgagccaacgtcttagaaataattatacgacatacgtaatttaaattcaatgacgatgacttaaacttaatgttttacagtatttatccaatcaaattttaccacatcagcagagaagagtcaaacttaggaaaagtctatcttggattatcctgacgtggcttttttcaagtaagaaataaattaatgctaatcacgtacgtacctacccagcttttggacctcgtgggctatatagaaaacaagtaaccaaagagagacgaagcaaaaacattcagagagaaaattcagcatttttgatagctcaagcacttgattctttccaaaggggtttcctgaggtatgtttgctttcctttttggttttaatttgtttcaaatcttagatcgattcttcactttggattcttaaatcgattcttgtcctcgtctgtgctgatttcgaacttttccgattccaactccgccgaatctacgtatagatctttgaggaaatgtttttttcgatttatgatcggcggatctaccgattcctttgcttgttttctttggatgtatcacactcttctgaagatgccttgacctttttatgtgaactagtaagagttattatggcttagatcgttgaatatctggtatatgtgttcttataatgggattaggatctatgttttggtgcgtattaaagcttagttgagattgatgtttttgggttttcaaattctgtttcttgtctgttgagctaatttaatg

SEQ ID NO: 20605 - DNA, 3000 bp, Unknown
  misc_feature (1)..( 3000): 2750-1469P.txt file - cDNA_ID_1827406; gDNA_ID_1620762; Annot_ID_50049
gatacatccaaagaaaacaagcaaaggaatcggtagatccgccgatcataaatcgaaaaaaacatttcctcaaagatctatacgtagattcggcggagttggaatcggaaaagttcgaaatcagcacagacgaggacaagaatcgatttaagaatccaaagtgaagaatcgatctaagatttgaaacaaattaaaaccaaaaaggaaagcaaacatacctcaggaaacccctttggaaagaatcaagtgcttgagctatcaaaaatgctgaattttctctctgaatgtttttgcttcgtctctctttggttacttgttttctatatagcccacgaggtccaaaagctgggtaggtacgtacgtgattagcattaatttatttcttacttgaaaaaagccacgtcaggataatccaagatagacttttcctaagtttgactcttctctgctgatgtggtaaaatttgattggataaatactgtaaaacattaagtttaagtcatcgtcattgaatttaaattacgtatgtcgtataattatttctaagacgttggctcaattataaatttcataaaatcttaagaactaattttaacaaaatacagaaaatatcatttgtatttttaataatataatctataaacatatatatatatatttatgagagtctgtcaaatttgtatgtagctaatttctttggagaagaagaagggaacctttgatggatttgtaatgttagactatatatgcctatctagatgcatgcatctcctaattaacctagctagctacaagaggttaaagataatggatgatcacctataagtctagaacgttgatatataaactctgttatgcgtattatatcaaaattttggcatattattctctttgcaggtgacatgatatttgtatgttgtttatacactagaaaaaaatattgtgattttgttccacttccaaccatcagaggcactatttatgcgttcccaaattgttatctccataacaaatacctgattgttttacgactataacagccaatgtatataaaagacttaaaaactaaaataggctgcatggtcagtgattgcgcttaagaagtttttagtcatattttttgttttgtcgttccgtataaattttggctttaagaaaaagacagtgacttttcacccaaaaaaaaaaaaaatacttcttaatgttttgagatattagtaattgccaatcagtgagtgtagttattttcattatgttcattttagcttgttaaagaaattaatataggatattaagccgaaagtggatgatgctcttgaattgaagttaaaaacagtctgcttatcaaatcttaaaaatcatgcataacgtgggtgctatcactgagtttaaatctgatacagactgattcaaccatttggaagctaatggaggagcggccggctataagctctccccaacacaacacacacaaagattgcaacatgatatataagttataggcagccaatgaagccaatggataaatcatagaaacacctgaaacgtaagaggtagctggacagagattacaaaccgatccagactgagagattcaatatggaaatataggagatttgtgaatgttagaataagattatgttttctatgcatcgacatattacaaagtagaaagatattttgggccaaattaccaaatctctatgagagtataattaggattacgtattcaaatctcgcctttgtggaaagcgagagagatgaatgggaaaagcaaaagataggaaagaaattaaaagggaagcaaaagaagttggtgatccgaatcagaatcacgcgtgtaatcctctcaaagcattcatattacactcattgaaaaaagaaaaaaaggtacatattcacaatcacatatatatattatttctggcatctaacgtcgaatgtaatctcacttaattttttgttttttacgataattgttacaaaagtatcgaaaaatagtcgtcagaaattatagtttactaaattgctgttaggtacaacagatattcaccatctctgaatctcagtaccatactttttcttaaaaaaaaattcaattttaatgtgtttgaacacattaatacatttccatacttggccttcactaagattagtttttgcacttctctctttctctcgatcgctgcttcttcgtcgctcaatctcaagctccgttccgttagttcttcgtcggagagacggtaaggtttccttccgatttcatcattctcgttgatcatcttcttctctggtttttgtttttgtttcgaaactaggttcctcttcctcgagtttcctgatttttgtctttagaatctgctttagaaatcgaaatcgctagggctcgggaagatctatgtgatctgagtttactattggctaccggatcccgaggagtcgctcctcgtaaacgtcgtcgttttatttcgcccttttgttttaatactatcaggcctgtggtggcgtaactagatcacactgggggactaggacgatttggttttccggctagtcgaaagcgcgttgcccaaaaaattgtgtcggtcggatcgctgagaaaaaacgagcgcattaaggtaaaatatagtcacgtttgagtcttcgggcgagttcgtatcgtcagatttgagaacgcgtcgtcgacgagttagtgcggtggtttgtttatggtgacggaagacgagaatccggactcgaaagagtgtaacagagaaacttttctgattgttgactgtttggttagatttcgtcatgttcccaatgggagagcgggtttatgattgtcccaaatagagtatagatctgagtttgtttttcgctctagtgtcgacagtttcatacttgaatggttctgggctgatctttctcttattatttttttgttgaaataggggtggagagaatcctgctgcaagtggtagctgtttgatacttgagtcattttgtcacagcaacatg

SEQ ID NO: 20606 - DNA, 3000 bp, Unknown
  misc_feature (1)..( 3000): 2750-1469P.txt file - cDNA_ID_1827410; gDNA_ID_1620762; Annot_ID_50048
ttgtttgagcattcaaaattttaaactggttgatgatgaatgggttcttgaaattcaaattcagtcaatgctttgggttattgagttgtatatgttatttatgcagtcattatgcaagcttttaaagaaccacctccagatatggtttgcaaagacaaattcttaatccagagtactgctgtatctgcggaaacaactgatgaagacatcacagctagcatggtaagcattccaacacttgttgaccttctttatcattaatttcagttatttggtctgtcaagtatatatgtacactcatttattcttggcagttttcgaaagccgaaggcaaacacatagaggagaacaaactcagggtcacgctcgtaccgccctctgactcacctgaactatctccaatcaatacaccgaagcagggagcagtatttgaagattccatcctcaaggatcgtttatatagccagtcagagaccctagctccgccacaatatgtaagaagagtatttaccccttttcgcaacaacttttatgatttgttagtaagatgaagagtaatttgccaagcagtgagtgtagttatgttccagcaagttcattttagcttagcttataatcacagttattgggtgcaatagggattttcttgtagttatttgtttattctcaaaatttatttttctaggagggtgagattgtaaaagagcctaggatggttggacatgatgagttaaaggcagccgacaatgcaaaggagttaaagacaccaaaaatggccacagtggattttgtggaagatcgatatactgctaatgacttgaaggcaactaaagatagctacgattcatcgaggatggcaaaagaaactggattcgatccaattaggtctcataaggatgcggatgatggaagggcgattaaggcaacaactaatttggacgctcccatgaagaaggccatggatctacctagggatcaagggtttactaatggaatagctgttgacagtgaaccaaagatatctaaggagagagatgttgtccagctgcagaaaacagatggccagaatgtcagaggattggatgaacttaagttggttaaagacattgaggagatgaagctgaaagtggatgctcttgaatccaagttaaaacaggtctgcttatcaaattttaaaatccataacttccgtgctatatgtaactgtgctaaagagtttaaatctggtgcaggctgattcaaccatttcgaagctaatggaggagcgatctataagctcccaacatagacaaagcttgcaacatgagctggtgagaatgctagtgagaaaacatagctgtttctttctcctacaatcaaaacagtttcataataacgaagcttgtattttgatgatgatgcaggcggaactgagaacgaagaagatagtgaaagaagtgcacaatgggttccctctgctgtatgtatgcgttgtggcattcattgcctatgttatcgggcactttctgcgcacttgactgctcgctcggtgtctatatcatatcaagtgtgcagtaagggatatatagacaaagaaggtaaaaggattagatttcgtctgtttgggtttgctttgtgggagaggatgaatgatttctccgacacatttaagatggaatatgatagactgtatagcattggtgttagttaacacaaggacacaaggacatatggtatgatgatatgctttgtttctctgcttctcttactaatttgaagctgttggattgatttgtctcttcttacgttcccttcttttttttttcgttttcttttgtcgtatagaccaggcaggggctagggcctagtgatgggtattggcccaatactattgggttatttgcctggtttattatttcgattttaggttaattcaattttaagaatacgtagatttgtttggtttagtttggtttggttgcactaagttcggttttacataaatagaatctaacactactaattgttatacgtaaaatacaacaacaataacagatttttcgtttcaattttcgtttaagagggtagacattttggtttggtttggttcattttttttttccctttcaaattcacatccttcacgtagatgacaaaataaagaaaaacatgaatgaaagttgtaacttgtaagcatcaacatggaaatcatatcacaaagaacacaaatctaactaatgggtcttttcacatattggtataattataagttgtaagaatattagttaaacagaggcaacgagagatgcgtgatatatgaaaagttgaaaacaaaagacatggatctaaagagtcaagcaaaatgtaatatctttttttcttctaaacttgaggatgtccaagttgcagtgaatgattccctttaatcatggagaaattcaatgaaataattgtgtttcttcccacactttatctttatttattttcttaccacaattacaactattatcacaaaaatgtaagtaacatagcttgtgactcttcttccatttatgagttgattatcactatatttataagtaattaccaacgaatgttccaaattaagcaaaatattgtaatcgatacactatgtattcatctacaatatgttaacgagctccttttatggaaatatttcgattgaaaaaacatttgatggatcgttcactaaataaataatccagtaacgttttcttaagggagatatacatattcgtgtggagatcaacatatcttcgttaattgactacgcaaaatagttaatggaaaaggcagagtgactcgtgagcttggcagatccaaaagaggttgtcaagaaaaagcagatttaaaagttcttccctcttctttaagtcacccattaatttcacatatatgtacatacatgttgcatttaactcatatacatacatattctcacatctataaagagagcataagactcagagagatctagaggaagagagagagagaaagatg

SEQ ID NO: 20607 - DNA, 3000 bp, Unknown; identical to SEQ ID NO: 20606
  misc_feature (1)..( 3000): 2750-1469P.txt file - cDNA_ID_1827410; gDNA_ID_1620762; Annot_ID_167206

SEQ ID NO: 20608 - DNA, 3000 bp, Unknown
  misc_feature (1)..( 3000): 2750-1469P.txt file - cDNA_ID_1827413; gDNA_ID_1620762; Annot_ID_50047
gtagactgagatggacaaattatctgagacctggaattaaacgtggaaactttactcctcatgaagaaggaatgatcattcacttgcaagccttattgggtaacaagtaatctcagacaaaaggatctacatctctttatacttgaatgttttgtgtatatattttgatgatgtgaaccctaaactggcttatttgtttacatatggttgtggtaagatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagacataatatcatgtgttgttttttggtttctctaagatataagtagctaaaatgctcactgcataagttgtaactaatctaaagttgtctacccatttacatgaataaaatccaatttaagacttgtaatactattcaaatttcttttacaaatacatgatatctatacttcatctttagaatctaccaagtcgaatctacaaattcaggaaaatatcaattcaaagctaatatgcattaaaccctcatgcttaagaatggtgtaggtctaagagagtttttgctcgcaaatcacatcaattcgagaaacgttaatgggatgcgttaatatatttgggaactcgtgttgccttttagtccataaaaacaagatgaatgagagaagtattaaaagctttattcatacacaaaaatgtgtgatctttatattttaagaaatgagaaacaataatgaatggagaaatgtaggacctccataactaattaaggattgataagtgtaaatgaaagagatgaagccaaacgtaacgatcacttgaaaatggcgttaatataataaatatacacattatccttgttccgtttatcattcttcatgcaaagttattaaatacatccatggcccttaattatgacgtttgagctcttggtaatgtaagcagtggacaaccaaataaagctattgtttacggttcctaatctaaataataattaacaatcaaatgcaagtcaaatatgagcaacaagagaagatggaagcacacaacacagccaaaacttttggtgggttctactatttttttccgtccaaaaaggcaaaaacagatacaaaaattgaatacaaatcaaaaacagttaattaaaaactcaaatctgattatattcattcaactactctaataaaaaaaatataatttttgtattttattttatttttctttttgaaataaaaaaaatagttcccacactcaaattgcaactttcggcagccgtttttgtaatcagtagccgactttcctgtctctctccacatctcaccatcttagttttcaatcttttgcctaacattttataattattcggaaaggaaaataaaactaagtgatttaattgtgaagactaataattataaaatgttatttaaggactagtagtaccaatattaagacttttttttaagtctgttatgttaatctttttgttttccctggtttggtcaataaaatagatctctctcattcaatgtctctcacaaagaattttattaattttaaaattaagtgattttagttgtgaagactacgtgcagtccttgctgggtctgccttttgagttttttaaaaatatataaatgggatcaatgttctctgtgaagctctccctcaaaaatcacaactttgctagattttggattttcactttctactctgtaattgagacttactctggcgatcatcatgatcaaaaggttagatttttctataacagcgcttatatttagttggatcatataaaatattgtgggtcttgatcgtatgattgatccatttagtatttcttctacacacaattctaattctgattttgttgagctgtcaattgttctttttagatctcttttcctttttgtggcaaacttttgatttagagtggtttaaaatctttgttggaatttatttttgcttcaattgctgacttgagataaatatttgatcttcctgtactctggagataaacactattaagaaggctaaataaaaacgtaagctttatcttgttttggtcaacttttctgttcttgcttctgtttgtcccaaatctgcaaatatcatttgtaaatcggattggattctggatattagttgtcttttctgcacgaatcaagtttgtttcattatctcaaatctctttatcaactttagtctcattatattttctgagtagaatcttgatgttattgattcaatatttttctcatatttttgtactctttactaattgtttgatgtgtatctacattgatgcagatttgaagcctgattgattcttgatcttatgtttctgcaaagagttggctactagacaaacgtctgcagtaaaattacagatg

SEQ ID NO: 20609 - DNA, 3000 bp, Unknown; identical to SEQ ID NO: 20608
  misc_feature (1)..( 3000): 2750-1469P.txt file - cDNA_ID_1827413; gDNA_ID_1620762; Annot_ID_167204

SEQ ID NO: 20610 - DNA, 3003 bp, Unknown
  misc_feature (1)..( 3003): 2750-1469P.txt file - cDNA_ID_1827421; gDNA_ID_1620762; Annot_ID_50043
ctcctcagtgatgagggtagccatatactactgtacatgactgggcatggaggtgatgaatttttgaagtttcaagatgcagaagaactccagagtcacgatttagcagatgctgtaaaacaaatgaaagagaagcgtaggtttgtttcacatttatggtgtttctcgagtcatattgactccatttcctccattagttcagtgctttttatctgtcttttgaaatctggcttgtcctgcatatagcttttccacagggcatttcttggtggaacgaaaattattcattcaatgtctcatcttaattcaattttgactatctaatgacattatttcgcttgcctagattcaaggagctgatgataatggttgatacttgccaagctgccactctctttaatcaggtacatcttcgcacactttttcagggttgttttgtctttatatttaagtaagccataattttagttttgctctgccttttggagctagtatgttaatttgacgttgttagttttgtgaaataatttttttggtagcttcaatctcctggtgttttggctattggtagcagtctaaaaggagagaactcatattcccatcacctggattcagatgtaagttcccttcaccatttcatgaatggaaagtaccattacgatattaaggggaaaattattcaatgaagttgtcattgtttggggattgtttcttctttttatcattgtattgatctccaaatctaatgttgtttttgcttcagattggtgtatctgttgtagatcggtttacatattacactcttgcattctttgagaggctcaatatatatgacaatgcatcacttaacaggtacaataactatgcaactctcgtcaccaacattctgcaaaccttttatatgatattcgttttcactttgattatatatgacggcattgtgattgtcaaattgactaaggagacgattaaatagttggctgtttgaactaatacgcctttttagcctgaactatctgagctagaaacatttgttcacctccccttgctgctgtgcagtttatttaggtcctacgatccgagactgctaatgtctactgcctactaccggactgatctttaccaaccacatctggtggaggtatggactaaattgatgcaatgtgacgtttaattgattgtcagcttaaattactattctgttgcaaccaatcaagactaagtaacctaggttctagttgcttgttatgtgcactgaacagtctaggattatccataagttcactgtaacatgatcagggaaatgatattgatttaaataaaaaacttgcaccttccgcatatttttccttgatgattaattactcattctccaagtttactcgttctgggaactaggtaccggtcacaaatttcttcggttcagttatggagaccattcatactgattcagcttacaaagctttctcaagtaaaatctccgaaagaaagatcaattctgagatgccattcaatcaactttccgaacacgatcttaaagaagagcttgagaatacaaacataccaaacgatgagttgatagctgaggttactgtctatactctcttccctggtttatcatactttggattgagtacattacttagatatatgaatttaagcagggttagggttttgagcatgatagatgatgtatttgctttctggcttgtgttcgtactcttactggattcgactaacagaattgagattccatgttatgttgttgttgcagaagcaaaaatgcccatattcacaaatgcgggcagacctccacgagaaagtggagaagcttgaaaatgtcgatacagtggttaacctcagcatagcagtgatggtactcgctgtaatggtctcatcatctttactacgatgaagaactgatataatcatctgcacttcacttaatctatgtagtctgattcactgttgcagcttcacacccattttgtaattttttgcacaatgctataaaaaaaaatcaccaaaatcaagaaaatatcaactctcatgctcgaacctcagaaattgtagccagttatgctgcagtccacagattaattggctacttttcaagcctagatctaaggttcatgttcattcggcaatagttaaatctgcataaaacaagggaaacacaagatttaaggttcagaaattatgctcaccgtagctctcagatcgggtttggtgagctgcttggtatggcctagtaataatgtaatatcataaatgttaacaaataaaacaatattctttacttaatctgattaggatactgcaactttatccttgggtacttgaaaaagcaatagtttgttactatgctaattattgttaattttgtttcttactcaaaataactatcttctactattaatgtttttaattttaaaaattgttcaactttatattattaaagtataataaataaaaccacaagaaaatttacaaaatgtaataaaaaaccaagtaaatggaaggatgcattggtgtagccacataagtaggggcggaaggcaacaaagaaggagccatctttatcgcaactcctgaaactgagtctgaccctctacttacttcttttattgctgctctctctcattcttaattccaatctaataagtacgggctctgctagtacagatagagagagagagagagtgtagaccaagacacacaacacaacacaacagagaaagagaattacattagttttttttctttcacattcctcttgcttattgctcttcaaaatctacctgtacactcttctcttttattgtcttgtttgtataaatcatctcctacaaaaataattaatataagttgtcccctttctctttgcttctctgtttttcgcaattttctctttttgattctcttccttccttggaatccaccacactccatttgcttcttctgagatctgatctctctcctaggtgatgcgctgcggagatg

SEQ ID NO: 20611 - DNA, 3003 bp, Unknown; identical to SEQ ID NO: 20610
  misc_feature (1)..( 3003): 2750-1469P.txt file - cDNA_ID_1827421; gDNA_ID_1620762; Annot_ID_167200

SEQ ID NO: 20612 - DNA, 3003 bp, Unknown
  misc_feature (1)..( 3003): 2750-1469P.txt file - cDNA_ID_1827437; gDNA_ID_1620762; Annot_ID_50038
atagctgtgcaataaactttaggtagcatatagcttttggagatcatatgtcctaatgcttatcttgttttggttagggtcctatggagaggtctatcatgctgactggcatggcacggttagtttttcagaaccttacatttgatttcattagagctattgtagcaacttgtatctgttattctcttccagaacttgccgctttagttgcgttcacattttttagggcttcaattgtgtcaaggagcatgtatctggcggttatctggaacttcaaacattattaacctgtcaaatttgttaatgagtgcaaagagataaaatgcagcgcttaaatgcatgttttgtcattaaatattcaaagcagtgtttgtgttcttaaagtgaaacagttttaaaaagcacttttatatacgcttgtttcagtcactagccacaaaaatgcattagtgccctccatggtattgtctcacattctctcatcaatattagctgttgtctttttagtttatttagtgatagattatttttggtgatttaaactagccttctgtgtctgcccgtgctgtttatcttcacagaagtggaaggtttcaagtttatatttctgcatttttgttatgattggatttaggaagttgctgtcaagaaatttttggaccaggacttctcaggtgctgctttagccgagttcagaagcgaagtaagccataagttcacttgcgtttatttactagtatacttagctacccatttatttttttggttgaacccaatggcttacgttgcagcttatttgcttgcctttgaattcccactctattaatatttccctatctgaaggtacggattatgcgaagattgcgtcatccaaatgttgtattcttccttggggctgttactcgtcctccaaatctttccatcgtcacagagtttctgcctaggtttgtcccatcttcttcttgtgaaagttaattgcatatgagatttttgagtcctaaaagattctaatgtttttttgctgttttattatagaggaagcttgtatcgaatccttcatcggcccaaatctcacattgacgagcggcgccggattaaaatggcccttgacgtggtagaaaaatagattcatatatcaacttccatgtcccccaggcttatttcttcagaatagtcactaaattccagactattgttactttcaggcaatggggatgaactgcttacacaccagtacaccgacaattgttcatcgtgatctcaaaacaccaaaccttttggttgataacaactggaatgttaaggtaggaagacttttttcttaagttgtccaacgaatatacttgtttactctaatggtaaataaatagattttgtttttatcttactaaccttgtaggtcggtgattttgggttgtctcgcttaaagcacaatacttttttatcctccaaatcaactgctggaacggtgagaacgcagaacccttaaatctctttactttttgatagaaatgcaactttcctactggcatgcttgttataatctggggtacggcttcttctctaatcacatgcattgttaattttaccagcctgaatggatggctccagaagttctacgcaatgagccctcaaatgaaaagtgagtagcttattagaagctcagttctgttcttggttctactagaaaatgttaaggcagatactactctttactttccctttccctttttttccaaggagattaaaaaaaatgttggctgtttttcgtcaggtgtgatgtgtacagtttcggggtaatactttgggaactagcaacattgagattaccatggagaggaatgaacccaatgcaagtagttggagcagttgggttccagaatcggcggcttgagatccccaaggaacttgatcctgtggtgggaaggatcatcctggaatgttggcaaacgtaagtgtcatgaaacaaactcaaaacacttttagaatctgcgctggttgaaaatatgtttggttttatgtttgggcagggatccgaatctgcggccgtcatttgctcagctgacggaagtgctgaagcctttgaaccggcttgtacttcctacaccacaatagatgtcatctgtgtgaatatgtgaaagaaaatttggttaatgtatactatttgacctctggtgctgcgcagagttattatacataagccagcctagaattgaggaatgtaaatgaaatcaatgtacactatactacgttttgatgtattatttgttataggaaaagccgctatgctgtgcttattttatcagaaataatgctaataagttaaacgtctgtcaccaatcatagttataatcaaatccaagctccatagagttacttgaatctccaaattaatcctttaacttaattattttgggacgaaattacatatactgcgaaaataataatagagtgtgttggagggagagagggtacgtgcgtgggtgtcgagaggagagtgagtgattaaggtccacgaattggcgcgaattccatgggaagaagaaacctaccgaagtccgaggatgattgtttcctctctcgcgcgaacaacaatgtcactctctctctttctctctgtttttctattctacaaattgctgtttcacctcttttctctctttctccttttccgatctcgatttttcccaatctcatgctttttctggtgactgcatcgttttacttttgttctgggtgacccttatgcctgaggatgtcttcaaattgtggattgattttgaatttttccgaaaaaaatctgtaaccgattgagtttcatccggtttgtctgaatctccggtggtcggtctgtttgtctcgaaaatctacagacttttgtatgtttcttgcgtacaaagtcacctcatcccactatatactgtggaaaaatgtcccaaggattggattcccttcacttgtatctcttgtaaagaaggaaagacagactaacattggataatg

SEQ ID NO: 20613 - DNA, 3003 bp, Unknown
  misc_feature (1)..( 3003): 2750-1469P.txt file - cDNA_ID_1827441; gDNA_ID_1620762; Annot_ID_50037
aagctaaagccaccaagataaaccatgtagtccactcaggtaacttagtgaaccaagctgcaacaactatccccataacaaccatataacactgtctaagcacaattggtatcccaccagcaaacacagacaaagtccccaagatcgtgaaattgaaaagcaatatgaagcaggtgatggaatcaacaggaattgagaaatgctggattatcgataggaaaattgcacctcccatcgtacctgagataaagaatcaacaatgaattcgagtaaaccctaagaagaagaagaagaagaagaagaagaagaagaagaagtgaatgaggaaacaaaaattggtacctaagacaaagaaggcagagaaacgcatgtaatgcttaaggaaattggtgaagttatagtagaagaggagaacaaggatgaaagtgacggcggcaatgaggacgacgaagacgatggcgttggcgagactaccttcgagcttgacggtggtggagtcggagggattctcgatgtaaatgaggttagcggcgctacggatctgagggtcagaagtgacagagagagagtaggtgagaaggacgacgaggaacatgcagatggagacgggagccatcacgccgataatctcaactccgagggaatcgaggatactagactccatcgttatcgatttcggtggattttttggcttacgccatttttgggagttctagaggaagaagacgagaggagagaggtacttctgagtcttcttctgaccagcagctcgtctatgccaatattttattttgtttgtgtcgacctacgatatatcatttaaagcccaaaagggcaaataacggtacaacaataacagcccattaggcccaataactacaaacaaagctacttttttaaaagtatatctatttaatatattaaaaataaaattcggtttcgggatcaaatgtttcgattttcaggtcggaccggagtggattaaactggatttaaaaccaggattttgcctttggcgtaacctttcgaagaggaatgtctgcaaacgagatacccgacgagctatggagaaagatcctagagattggcgtaaagtcttcgactttctcgtacaaagatctttgctgcatctctatctcctctcgccgtctcttccgattgtcctgcgatgattccctctgggatcttctgctcgtccatgatttccctaaccacatcgtctctgcttcttcttcttctgaatctcccaccaagtttatctacatgactaggtaaccttgtttgattgaaatttgtgctttctgagatttcttctgttgttagtgtgagtatttaagctcctatggatgtggttgataggtttgagagggagaaggagaggaaattagctgcccatagaagagctttactcaggaaggagagtgaaatttctgaatggggccggaggattcgtgaattggaggcacgattgtccgacgaggctgagagactacagtcttcttctctgcaattttcagatttgctgaaagtgaggtagtccccaacctggtgaacattttgtcagatttcagaaagtttcgttttttaaagtcgttatagctctctgtctatggctacgaatagcaattataaaggagattgcttgttcagttgtgacagtttagaaagatgattctttgttgatcaagtgaaatgagattggtcctactgttcttgcctcatgcatccttctcatgtaattttttaatggctttctcaggcaagcatcagtagctttgaacgtttggcagccggaggtagtacgtggtagacaaaagcaaatggttgagcaaaacgctgttcctgttgagggtcgattgcgtgcacttgagatggagatgaagttatgcaagcagcaaatcatgggtttgaatagggcacttgtgagtcttagttagggaattccaatcatgttccacacttccactggttgactttttaggtctcttaaattgttatctctgtaattgcagagggaggtaaaacaccgatatgacatagcaataaaagagctagaatccatgaagtatcatcctttacgagattacaagtcgatacgtaatggagaccaaggaagtaatggcaagacgaaaaagttgaaaactagcatcaactatagtggagaccaagtaagtaatggcaagaggaggaagttgaaaacaagcattgattgtaagtttatgaacatttctcacttttcttcatgtagtagtgttaccgaaaaattctattcttactctccaaaaattatacatgagtatattcctgaaaatctgcttgttctttgaagtgtgagacaatgcaatgtagaagagttttatgccgatatggacttgtccgaaactatgacgtgggatgtttaatgtttgaagttatagatttacattgttgatctttgttatcttagttgtgttatcgattgtgggtttttaatatacttatgaacacttgttatcttgattccgcaaaagcagttccagcaaaacccagaaacacggagaagctgttccagtcagaatcagaatgatggttggctgttccagtcagaatcagaatgatggttggctgctccattccacagagagattgaatacttgagagttgttgttgttgtattgtttgtaatatttccaattagatttgcagaagaaagctgaaattttgtcacataatgtggtcgatatagaattctgtaagtttggaatatcatgaataaagatgtatttgtttaaaaggtataaaactccttggttctttggcatgtctgggtcaaatcaagactctgttctgctttactgttcccattggacctttttttgtactcggattttccagttttggtttatagttttttactagtcttttcatgaatgtgatgatgatatggaagaatgctcctaataaggaatggtttcatgatcatcattgaactctagagaaaacgattatagatactaactcatg

SEQ ID NO: 20614 - DNA, 3003 bp, Unknown
  misc_feature (1)..( 3003): 2750-1469P.txt file - cDNA_ID_1827445; gDNA_ID_1620762; Annot_ID_50034
ttactttagacaaaaaaacaaaaacaaaaaggaaacattcttacttgtgcaattgcagcaaatgaaaaatgaaatttgtgaaccaagttaaataaagcatctttagatgcactaagggcatctccaacccacccacatctatagaggtgttaagatattattgtacaagtaatgaagacttctttaagaaattaggctattaacaattagactctatcatcaaccactaaaccatcacattagtttacttttttaccttttccttcggtttagtctaaagtcaaacgtcatttttttcttggtgcgagtatggttagcctcgtagatgatataaccatcataacttactatatcgttaaaatcgaatatagtttttgttcatatattatatgcaatgtaattgctaatgatagaattttttatgattagattgaataattattatgatgtgggtcagcccaaaagcccacagaaaaggagtattaatggaaaacatgtgaatagtttcttcttccccttttctcaaactaaaggataaaaaagctttctttttctctctctctatcatctctgtcaaattcaaaattcgagtattcgaaaaatccagctccaaaatcgttgattagcagcgactaaaacccaaagtttcctccaattttaacgaattacttcgtgggtcaatctcataatctgggaacactctttcggttttgattttgttggcagcatctattctaagcgaaatgatgggaagtaaaagagaagaagagaggaacgagaagattattcgtgggcttatgaagcttccaccgaatcgtcgttgtatcaactgcaatagccttgtaattttatctaactctctctcccttttaccaatttttgtcttccttcaaaggcttaatttgttctctaaattgttcctgtgagtgtatcaactgagttttgaactgatgggtttcagcttctgtgattatgatttctataatcttgtgaaagatatgttttttttggggggcttgtgtttgtctagaaaatgttttgatttatgtccttcgatgggttctatcagtgaagttaatctgcaaagccaagtaatttgtttatttccagatatagaaatggaaagagaagctcgcaaagctacaatttttcgttcatttgtgtgaatttggatttaattccattctggctatattatagtaagacttgcaaatgatgcagggccctcaatatgtttgcacaactttctggaccttcgtatgcatggcttgtagcgggatacagtgagtaccttccccttcctatatactttctttgcaactattcctgacctctcttgtgttccttccttgtcagtatcgtacgctggtttgtgttaccttttctctttccatgatttactttatcatcttacatcttacatttacagttaagttatatgtaatttgtaaagtaggaataagtaacctttttgttaacggtttcctatgttcatcccacgattaagttttctgctatattgtaagctatcgagtctaaattagtttaaatatttgtagacaggactcattgtgatcccccagaagcatggctaatgcattgtcttacaaaatatacatttatatctagtgtttgattgtttttgtgggctttagtttttgtttcatgcacctgatttcgtcgacagattgtgtgagctgatttttttggcatcattgtatttggtggctgacttataccttttattttattactcttgtactgatataacagaattctcaatctattcagtggatccctttttatttatgtctcttgtcttgatttggtaaattttggtgcaactgttatacgagacttgttatcattgaaaaggaaatataggcttatgtgaaatgagcagctgtaatctttcttcgcgttatttttaggtatattcggaagtatttctttctccagctgtgcatcgtttcatatgcggttatagggttcttttgatgcatatttaagtatagggaggtgcagtgtgcattttatttattacgatttcctgtttcctagctaagttacactgccttgatgtagtgaatatgttcctaccttttctttttctcttagtttcagtttttcatggtttattttattttgatgacctgcagccgcgaattcactcatcgtgtgaaatctgtgtcaatgtcaaagtttacttctaaagaagttgaagtacttcaaaatggtggtaatcaggtagtattgatgctaaagtttcaattttctaaattttccttagatagatgtttccgtctgtagcttatgagagttttctatttcagcgcgcccgagaaatatatttgaaaaactgggaccaccaacgacagaggcttccagaaaacaggtttaaataattagttttccttggtgttcatgtttgagcagccagaaacattgcttttttgaaaaaagaaaaaatatgatctgtttaaaatccatgatatgttgttgttgttctttggcagtaatgctgagagagttcgcgaatttatcaaaaatgtgtatgtgcaaaagaaatatgcaggcgcaaatgatgcggacaagccttcgaaagatagtcaggcaagattatcttgtttcttttatgccatctttctaaatttgactcatattttgctgcaatatttaggataaaatcttatatccaaagcagcaatgtatttgagtgaaattttccgtctaagtgtgttctattggtagtacttttctttttctttaggatttattttatacttgaactttctaatctaacaatacaatattatgggttttaagatgatcaatgttgctctgaagctcaaggtagtcatataggtcttctagtgtctgatacttattatttcttttgacttgctctaaattcaaccatgtgcatgcatgcatggaacacttatttatttttcattttccctgtaatgcaatggacaggaccatgtaagttctgaagatatg

SEQ ID NO: 20615 - DNA, 3000 bp, Unknown
  misc_feature (1)..( 3000): 2750-1469P.txt file - cDNA_ID_1827457; gDNA_ID_1620762; Annot_ID_50031
tagcctaatttcttaaagaagtcttcattacttgtacaataatatcttaacacctctatagatgtgggtgggttggagatgcccttagtgcatctaaagatgctttatttaacttggttcacaaatttcatttttcatttgctgcaattgcacaagtaagaatgtttcctttttgtttttgtttttttgtctaaagtaagaatgtttccttatttcatggaatataattatagaattacaagttgatcatatctcaacaacgttatctaggttttcaatcaatcgtttcatttgaatcaatactaattcgtttaagaccaaatccgcgcgatgaaaaattcctcaaccgttttcggaataaatttataatcttaaaatagcttaatcaagaattttttcacgtaggttgtaaaatatttgagaaagaaatagttatagacttaaagatgacatcatctagaagataaatcgaagaaggcaacagaaaactaaaagataaaagcatccgtttctcaatctccgtttcttgtctcttcttgctctcttgatctcttccattgtttattaatttacacctttgacgttcaaagagtgggtgatcttttttttgttctaggtatagtggagttgttgttcttcttacgtactacaattctgataaggtactccaatatatattgaagacaggagaatgatctatatagatgcttattgatcgagcagaatgtctaagcttatgcagaatccggtgttacatgaattgaagaagcaagcttctttcttcatcaaggaaaagatcaagactgctcgtcttgctgtaaccgatgttactgcagaagaactgtgagtaaactttactaaagttataaacctatttcctgctaaacctaaatctctcatattttagaaacctttacaagtattatcaagtgtttttgcaatcaaaacttgtttttgtggtatttttagcatatctctctctctcttgtactaattgagttgaaatataaactgtctaatgtgaagattgacagaagaagttacgggcagcgatcactcatccatagactcacgctccatggcggccataacaagagtttcttttgaggttgatcaattccaaagaatcgtgaagattctacgtcaaaggttattttgcctcactgttatataagcaaaacaacttagaaataaatatcacagattcacagaaccatcaatgatttcatcaacacaatactacaccaaaaataaaaatcaccatatttttttttgacggcaataaaattaccatttaagcatcaaaaatcccgaaaattttatagtaattcatcataatagtcaagaatcagattactgtttagtgtctatataatttattgattggtaatttttttttgtagaatggtagtgtttgatagaaaggaatggcgcggcatgtgcaacacgttgtcaatgttgaaccacttgttgctcaatggcccactaagtgtattcagtgagtttcaacatgagagagctattattgaagatgctataaagatggagtggattgatgagagagggttcgattgtggtctaaaggttcgaaacatagccgagaaagtactaagattgcttgaagacgacatgtttcttaaagatgagcgagaaagaaaccgtaagcaaagcattggtcggatcacaggatttggaaactcgagttttgtcatacattctgaaacgaacaacggacgagacggctcgttaatgttgagtaaccatcaaacttgtgaaaatgattgtatcgcggatgatcatccattcgtcgaaaatgagcacaagactgctcaactcttgctttcttcttcgacttagagttagatttcccttggttgtattattatgtttgctctatagaattacttatgaccaaagaacaaagttttggaaattctgagacgatgaactcacacaaatacgttaatcgcgacgcttacatgcatcggtgattgattatctctgtatggagaaaagaactgcatcacgtattagaaaagaaatagatgatagatttttgtttttaggtttgtttctcgaagaagaaaaaaataatagagattttgatttcttaacaagaagaagagtatttataagccaagggtacacatgctacagtatatgctaacatttatgcttaacctaaaataatatatcactatttttttatttatttttcttacaaaaaaatatatttattagaaacatatgaaaaatatctacataaaatagaaatacagtatacaatagcgaaaaaaacacatgttatgcgagattagatatacgagtaaatgtataaaaactctatttattgaattagatattcacatagaaatatgttacttaagtatgtatttgttttgtattttcagtaaaggtcacgtgggatttattttttgcatatttagtccttgggatttagatctcgtaaacggcgtcgtactaagagtatcctccggcggcatcagttttggagtttcttggatcatcacactcacctgcttcgttactcttcccttggattggattggattggattcgctctttcatggttgaagaatgagatctcaccaagctggccgcaaacttccgcttcttcaacttctcggctgcgtcgctgttttctccgttttcgttttcaccatccaatcttccttcttcgcaggtcatctatcgccgtacctttccctttccattatatatacacttcaattgttcgaatagcaatatgattcttcatctctcgcgcagataataatcgtaaactagatcttcagccggaagatatccagatcttgtcagattttcagtccagcgttcaacagtgcgtggtttgtctcctttcccagtttctttgattctggacttgttacttttctatatggattcttcggatttggatcgatgccacagttttggtttattatggcgcactagttttgattttggataaatcagatg

SEQ ID NO: 20616 - DNA, 3000 bp, Unknown
  misc_feature (1)..( 3000): 2750-1469P.txt file - cDNA_ID_1827463; gDNA_ID_1620762; Annot_ID_50028
aatatatatttggtgcagacaaagaataacatacggagatgctagaaaattgagaggattattcttataatttgactttgcaacaaaagtgctgtagttttgaaattttggaatgtggggaatttttagaaaacagaagaaacgtacctaactagcccaccaccgtacatcgtgtttttccctcaacgtacttgttttcaacatcaaatagtcatgagtgaaaaaagttgatctattacgaaaagtgtgcattaactttaaatcggtggaatgttgttatcaaaagacactacactgaaataggatccgcatgtaaacgaacatttgaattaaaaaggtactatttaaatataagagagtggataacaatcagataataaaaacaaaaaaagatatggtttctccaagtatctgaacgacatttttcattgcttgagaaaattatttcgtttaattatatgtgcaaaggttagattaggtctttatcaacaaagtgttagattagggataacataaactatttttattgattaaaaaaaaaaaaaagcagaaaaaggagtacaactctgctttctcacatccttttactcaccccacatggaaaaaaaaacccgtaaaaggcggaaaaagatttgttatcctctctacattaccgtctctacccctaaaaagacttttcaaaagccaaacaaaattcacataagcaacaaatgcagaaaaaaaaaaaaaactcatcgccaaactcagaagcagccacaacaaacaagcttcttttattattcagctcctttttttttggttaaaagtcttttccagagtcttctcttctactaggttggtaggctggcggaatctaaaatgcccataacccaaatttacatgcccgacactcctccatacttgttagataaaaaaccaccgagagagatgataagctatcacttgacacttatttatttctccgagagaatcttctagatgaatctctcctctgtttctcctgctctttggatccatgggtgccctgcaacaaaacaaaattacaaaataccaaatttagttcactttatcattaaaccaacctactaaaaaatggattagtgtggataagataacattatctgttaaaaatagatgaaatttattgacattaaaaattcaacagagaaacagatctgatggttttagaatcttacttaatgcttgttcggctgagaatcttctagaagcatctttgcatatcaatttccttaggaaatctttagccatagatgaaaccccccggaatatcttcgtcggaaaacggagatttcctctgagtaccgcttcgaatatctcttcagctgtctcgccgtaaaacggtggagttccagcgagcatcgtgtacaaaacgacgccggcgctccatagatcgaccttctctccgtaagaatatcccattaaaacctccggcgccacgtaatacggcgttccgacgactccttcggtggtctctccctcacctaaccaaatccctgaaccgaaatcgcagatcttaaccgtatcgtttcgtagatctaccagaatgttctccggtttaatatccctgtgaacgacgccgtatcggtgacaatgcgaaagcgcctggagaatctgtttagcgaacgacgccgtctgaggctcaaagaaggttccagaagagacgagacggtcgtagatcgaaacagagggatggacgagctccatgaagatggagagagtcgaatcagtgtcgatgagatcatggatttgaacgatgttagggtgataggacaagagagccatgagcttaggctcgttgtcgagacaggcacggtcaaggtcgtcggagagagaggctttgtcgatggttttgcaagcgaagaaatcaccggtggccggagcgtagacgcgagagacggtgccgaaacggccacggccgatctcctcgcagatctggtatttgttggtgttgttgtttccgagtgtttggctgcaagtcataatatcactttcttaatattttttgttttgtgttggttcttgtgtgagttaagaagacctcttgagtcggctctacctttttttatagccaaaactcttgagaatattccttttgatgcctacatgttttttttttctactagtattttccttttccttaacgttatatcttttttgtttttattttgttttaaataggattttagatattatttcccaatccaaatctatttttttgttttgttagaagtttacttggagaaggtttgtactttgtaatgtcttttcttatcttattatatacaattttactttctaacagttctttattatctatttggtttgttctttgaaatgataattacttggtggtagtctaaaattcacatttaagtttattatcaaatgtactacacaattacaatcctctctaaattacagaaaaacattctcaacagatccagatttgttaagataaaatattggatctacaatttaatatgtttccagaaaaagttcataaattgataatgcacaatctagtgaaaaagaggtaggaaatccaaccccaatttatgcaaaaacatttccaaattgaatgtgagtactaaacgatttcttggacgagattgaaatctgaaaaagagataagaaaagtgtggcatgtttggattggaattgggagataatccctgcaagtaagtaaaccagagatcccacgaaaacaaactaataaagacactggattgggccgataaatcagttgggctgaagaaagcaggccgtctttattattacctaattcgttcacgatggaggtcgaaccgagaatatccccctccggaggcgagcgccttatccattgggccacgcgaactattggtcaggcctcagtttttagccttaacaaactattgagtattgaatgattagcttccaaacatcaatcaccaaccttctagtttccttttaaccctactagagctctgctctgccatg

SEQ ID NO: 20617 - DNA, 3003 bp, Unknown
  misc_feature (1)..( 3003): 2750-1469P.txt file - cDNA_ID_1827471; gDNA_ID_1620762; Annot_ID_50026
gtgttgtaagttacagtgttcagttccaatccatgagataagatatgctgaataaccgaagccacctcttccaaattccctcgcctgcagttatagttaaccagagaattatatgtgacaatgtcaggatagcaaccttccactgccatgtcttctaaaacttctatagctcgagcgcttccacagtacctgcacacgagttcgaccaaaaccgtgtatgtaatcataaatggagggcaaccattctgcagttgatccttccaaaacctgatggcttgctcagcattcccataatcaaacatacaccgaatcactgtgttatacgtgatcacatcaggagggctcccactcaaactcatatcttctaagaggaccaaagcagttcttatatgccctttcttgcaaagatttccgatgatcatgttataggtaatagtatctggaaccccaccagacattaccattactctcaagatacacattgctttatccagttgatcaattctggctagaccacggactaagtttgagcaagaaggaaaatgaggaacctgattatgtcgtgccatcacctcgacaagtttgcacgcatctgttaacttcccattgctgcacaggttatgaaggatctcattgttggtctcttcgtcgttctctgtaattggtccatcagatgataaaccaaattgcttcataggtttcactctggctctcaagttagtaccgacaccatagtgatggaactctgagcttctctcagcatgatcatttacattgtcaatgcacacactacttaacaagccgtgacatctaaaaaaaacatcctttttcagcccaatttcttgcttccaatctaaagaagaaaactttctgcaagataaaggattcgcctgcttttgagacagactaggaatatgcaagaactgaacctcaagtagcaaattcgacgaagccatttctcagaatccagaagctattttaacaaaacagagatctttccttttacaaaagcttatcaaactcaatgaagaagaagttagaccaataattatttgctggtatgatgttcagtctctgctgctttatctcataacctattcttgagtgaatggagaaaccaaacctgtgaaaaggaaaggtacaagttatagagacagagaagcagactgaaacagtttccaacaaaagaaaagaagcagaaaaccttcaagttgcggttaagtttgagaaaccctaacaaatctggagaaatgatgagtgtgagaaactcactgttcgttgttcgaagccgacgcgggttttgagatgataagtagggtttatcctaaatttacaatgtgcaccctatatgtctcgacatgtttcatttattcccacaaacttatgaaacatctaacattaacctcctctgtttttattccctttgtttttgtgaatcggtttaattattttgggccaattcagctatcggattgggctttttcaagttttgggttgagttacaaccaaattaaaaatcaaacagagatcaatttctccgcatagaaaaataacatgttacattaccattcgaaaacaagatgaatagtcatttatacacgcctctcttacacattataatgtctaaataattgcattatcatattcaaaatttagatatgttggtcaaaaacagaattaagtattataaattgtgtataccaaattagttgacgctatcattgcatatcatactcacatactacaatatttattacatgaactaagtgattgtattccagtggctattttcatttaactataacaaaaaaatcgaatgcgataaaactacttcgaaaataatcgatggctcttggaatttttataaaatctagttcttgaaataaataaaaatttctatgcaatatttttcggtaaatttttgttctctattacaataaaattttattttaaagaaatgaaattgttatttagcgtatatttgtaaccaaattagcaggcgtaaatacaaatcctttaaataactctgttgttgtgtggatatgcggtaatgtccacccgtgaataaatgtttacgtgttatatgacccaacaaagtgaaccaattatattactcctctctaacgcacttgtttattgcatttttatttatttgatggtcgaaacaaaatagtaagagtagttgttgcataggaaattgcatctgcttgcttttgaagcgttaataacttataaccaagcaagacatatatcatacagagcaaaaaattaggcaaacccagaaaaagccaccacatgttcctcttctcatgatcttaaaattgaaaaaaagaaggtgataagtttaatctaatcttgaccagtgaaatagctttttgttgcttgttgtttttgttcattcttcacagatttaattgtcacatacccaacgtatatggatggacctgtagatttaattccagttttacccttttcttcttcctttcatctgattttgtttgctgctttttttttgttttctggggaatatggaaaaggttaggtttcatatttggacctttttttttggtgttgaatttttcttcttaatttttatgcaaacatggaaaaggacatgcgatgataatcctgaatctactagtgcttagatctgatgaatactggattattaaaaaaaaatattactaaaaatttcaatgatctagggtttcttcagatctttaaatttgttgctgattttactcgatttctcttagtctgggtgcagttgatggagctccagctattttgaccatccaatttcaccagaaaccctaaatcacaagactatgtaagcattttccttatggctcttcttcctgatttttgattcagctaatttggtgatgaaccgtttatatatatctgtaatcgtactttaccctgaaaatatgtacctaccatatgtgtcatgtgtatttttattattttataaatggttgtgatattattgagacatgaatg

SEQ ID NO: 20618 - DNA, 3003 bp, Unknown
  misc_feature (1)..( 3003): 2750-1469P.txt file - cDNA_ID_1827479; gDNA_ID_1620762; Annot_ID_50024
tacacactgaagattgacgaaaagagtgatatatacagtctaggcgttgtgcttctggaattggtgactgggaaaatgccgatagatccttcgtttgaggattcgattgacgtggttgagtggattcggaggaaggtgaagaagaacgagagcttggaagaagtgatcgacgcgagcatcgccggagattgtaaacacgtgatcgaagagatgctcctggcactgcgaatcgctcttctctgcaccgcgaagctaccgaaggatagaccatcgattagagacgtcatcacaatgctcgcggaggcgaagccacgccggaaaagtgtttgccaagtcgccggggatttgccgattttcagaaactcgccagtggtagggctgatttagatgacggaggcgataagggtagttttgtcatttcatcagctggggctaattttaacattgggctaacaagttaactttgggctgaatcaaaaacccatgttttcaaatctgatgggtgcactaaagcccattgaaccaaatgacatgattcaaaattgtaataggccccttgttgatggctgatccagcaaattgtagttaccagaggctaaaaaaataataaataaagattttaattagttttgttttaatggaatattaatctttcaattcacagagaaatattatcttttatgatacaataattataaataaaaaaatttgatttttttctataaatgaatttttatgaacgaaatataagttaaatatattgtatatgttcttgattaatttcttctattctgaatttgtttccatttccggttaaaatttttgattcgcaattgcttacatcaactatagtctatatatgacaaagtcaaatatccaaaaacgagattttgtaattatgagaatcagtctttggcaataatctctgatatactcaaaatagagtgaatacaattattggtttttcatgctaaatatgagtttgctatatataccaaatggttatataaatttttttggggacaaaagataattaaatatacagcaaatggtcaagttaccttcttcttcttttttttttctttttgttatcataaaattttataaaaaatggtaaaactacatatgccaacagagaaaaaataaccctaggctggttaaacatattaaaattttcagtgacaacaatcctaaaaaaaatataactttagaaaataactaataaaatacaaatcaaaattgcaaaattaaacataaattttaattatattctaattctttttcacgattagaaattgtcttgatattgataaaaatcaacttcaccgaaagtttatggtctttacgtgcctacttgctatttggtagatttttgaaattgaaatatatgcttagttaatctggttcgataaacctctcatttgaggttttgtatatgttgttattcgctaacatcgataacgtttattcactaacattggtaacgtcgaaatatactcaactaaagtccgattgagaaagaaaaaaaattaaatatagtcttgaacacgagtagaagaaactggaaatgtcaaacaaccatttcactcgccactgcagaggtggaaagttgtaaatcgattatctaggttttacatataagtaaaatatatccaaaaattgtaaaattgtacctttttctttttctcacgatatgagttaaatataccggaaagttgtaaagttgtaactgttttatgatttttctgaacccacgaaatatgattttaatggattggagagttgtaaaattctaactgtattaccgattttttcagctcgaaatatgagttacatatattgtaaatactaaattttacataattgtttctaaaatcttaatacaatcatatcaactatcttttttttttttttttgacaatcaatcatattaactatctaataaaagtataaaactacaacctctaaacttctttttttaaatttctttttttttaacttcttaaataatacaatcatatcaactatctaataaaactacaacctaaacttcttttctaaaacatcttttttttttaacccaaaatcaatacacaaaaggtgctttctctttgctatgaaatctctattcttctcaaaaaaatatttacatagttttcatcacctacattgtctctaatagtccaagttaggaatataatctgtattttccgaaaccgttgcaactctctctctataagaagttttgaaacatctgaaaccaccaaacactctcgacaggcctcactgcgacgaaccgtttcgatcgcgacccttcagttgtcgtctcccccaaacgaaaccctagcaaattcttccgagtctgctttcgcactaggtaggattctctcgctttggtaagcctattcttcgccgtcgcctaaatttcgagcgcttgatgaaaatgcttagaattaagtagccttgtaattcttaattaatcacgatttgtgctactcctcttttttatgtagaccatgatatatgccgcaaggatgctcgtgatctcggagaactgatgtatgcgtatgctgtaagtcttctcctttcgtgtagcttcaattgattagggtttttcaggtttcagagcaactgggttgggatttgctggtccgctttgtcttctactgttttacacaactaattatggttttgccttccagaacctgcaaaattttggatgcaattctcgtctctttaggtaaacgctattgcttcttctcttattttctaagtcaattgattctgggtaactttaatatcatgcttaaataaagttcgtggttattaattgtcgggatttagagctgagtttagttgtcttgtcgtaagatcttattgtgtgagatattaaataccagattgtttcacagatgcgtctttttagttgtggtaagtctcaggaggtgtgcttaacgtttccattattgacactttttcagtagcaactagcaagtgaagatg

SEQ ID NO: 20619 - DNA, 3003 bp, Unknown
  misc_feature (1)..( 3003): 2750-1469P.txt file - cDNA_ID_1827487; gDNA_ID_2096295; Annot_ID_195536
gaagtccacttgataacttccttgtatttgtaggcgaagtatttagaagctttagcctctgagacacttctcacaagcgatgaagcagtagttgtagcagcagcagctgaagcagtcgcccttgcaagagctgctgtcaaagttgccaaagatgcaacattatttaagaacagtaacaacacgaacctattaacttcgtcaacggccgacaaacgctccaagtgggaccagtttactgagaaggaacgtgctggcatattggggcatctagcggtttcggacaatggaattgtgagtgataaaatcactgcatctgcctctaacaaagagtctattggtgatttagaatcagaaaaacaagaagaagttgagcttctggaggagcaaccttcagtgagtttagctgtgagatctacacgtcaaactgaaaggaaagctcggagggcaaaagggttagagaaaactgcatcaggtattccgtctgtgaagactggttcgagccctaaaaagaaacgtcttgttgcgcaggaagttgatcataatgatcctttgcgttatctaagaatgacaacaagcagttccaagcttctcactgtcagagaagaacatgagctgtcggcaggaatacaggtttgtcaccaatattccaaattctaaactaaccacctccctttttctacatcgcgtctgagacatcacaaacactcacccttcgtaggactctagattctaggcgaaaatgatgtctacaaaatctttagatgtttgagaatgacgaaattagtggttagtggtagaatccaagatcgcttctttgtgctttctagccaatatatcatctgaagttctgtgaaagctaattatcctgacatgcttgtcttaaattgaattgtcaccttttttgttcttattatgtagccattcaccaactgtttagtgttgatagaaaatgggaaacgtatgttcagctttggaagaatcaacattacttgtgaacgttatttcttcttctctgtaatttttcttatctttctttattgtggttttgatcacacactttggtttctttgtttaggaccttctgaagttagaaagacttcaaacagagcttacagagcgtagtggacgtcagccaacctttgcgcagtgggcttctgctgctggagtcgatcagaaatcattaaggcaacgtatacatcatggcacactatgcaaagacaaaatgatcaaaagcaacattcgactcgttatttcgattgcaaagaattatcaaggagctgggatgaacctccaagatcttgtccaggtttgagcttttctctccttatttttttttgtaataacacatctgtaagcagtagtgatgaaagtgatagatattgaacaccttgctcaaatattttcgaaatggtcacaggaagggtgcagagggcttgtgaggggagcagagaagtttgatgctacaaagggttttaaattttcgacttacgcgcattggtggatcaagcaagctgtgcggaagtctctctctgatcagtccagaatgataagattgcctgtaagttatcccaaatgtttttcttttttacttgtttaaacaaaaggtttgggattatgcctcaaattttaagggatgattggcagtttcacatggtggaagcaacatatagggtgaaagaggcacgaaagcaactgtacagtgaaaccggtaagcacccaaagaacgaagaaattgcagaggcaacagggctgtcgatgaagagactcatggcggttctactctctcctaaacctccgaggtcgctagaccagaaaatcggaatgaatcaaaacctcaaaccttcggttggtaccacctgacacaacacacaccatacaacatagacttgttgtttgtctaaaaatagtaaataatatgagatgggtttgtaatgtaaaaatatgcaggaagtgatagcagatccagaagcagtaacgtcagaagatatactgataaaggaattcatgaggcaggacttggacaaagtgttggactcgttgggtacaagggagaaacaagtgatacgttggagatttgggatggaggatgggagaatgaagacgttgcaagagataggagagatgatgggagtgagcagggagagagtaagacagatagagtcatctgcattcaggaaactaaagaacaagaagagaaacaaccatttgcagcaatacttggttgcacaatcataattctttttctcttcaatatggaatgttttgtgcatagaacccacccacctgagcataacaagcagtaaattattactttttagcatttacgattcttgtgacaactactaaatcgaaaaaattattttaaaactaaaaagaaattgttgtctgaaaaacataagtgatatacaacaataaataaatatctcttataagaatttgggaaaaaaaaaatccaaagattagagatatttgggtggagaaaacaaccgcctaggacaaaaaaaaattgtgggtagaggaggaggaggaggctttgttcacacaccacacgacggaacattctcttccgagtcttatccaaagcaaaatcatattttgcttaaatatcttcttctccggctctgtctctgtctctcttcttcccgcggagctttcagtttttgtttggtaacatcgtttctctttctcactaactctgatatcatattatcaatttttccttttcaacacccaaaatcacaatctttcagctttattctgtttttccttgcttgagaattgtgttcgattcatgtctacgaactgaaatcacaaattttgccaacgttttatgattcctggttccgtatttttttttttgtaatcaatagttagctcatttcgaataatcaaactcaattttattgttcatgatttgttatctgggataaaagagagtaatgtgctaattatgtatactcaggtattgcttggtgtggggaagattagatagtgtgaagaatg

SEQ ID NO: 20620 - DNA, 3003 bp, Unknown; identical to SEQ ID NO: 20619
  misc_feature (1)..( 3003): 2750-1469P.txt file - cDNA_ID_1827487; gDNA_ID_1620762; Annot_ID_50019

SEQ ID NO: 20621 - DNA, 3003 bp, Unknown; identical to SEQ ID NO: 20619
  misc_feature (1)..( 3003): 2750-1469P.txt file - cDNA_ID_1827487; gDNA_ID_1620762; Annot_ID_167174

SEQ ID NO: 20622 - DNA, 1386 bp, Unknown
  misc_feature (1)..( 1386): 2750-1469P.txt file - cDNA_ID_1827489; gDNA_ID_1620762; Annot_ID_50018
gaattcacacttgactcttctttatatgtgtcctagatttggttcagctatatgatcatttctatttttggatttggctgaattcaacaaagcttggtggaatttttcagtttaatatgtctgtctctttgttcttggattgatatctattcagtatgtcctatatttacttacacaccttcaggccatgggtagagctgcaacttcctttgcaaagttagctgacacagctcgcaaagaactccctagtacattggcagcggtaaggctctctggcatggaaataagcgatcttactcttgaattgagcgatttaaggttatctctaaagctcttttcttttcttttcttttctggcttttgatcatctcaactctaaaaaaagtgaatgctacatgtttcaaagcaattagttcacaattagttcttccgagtcaccttgttatctgtccggaataagaaactttttctaaatcattattatgcgatgcaaatggtttcagccaagatataacagatgggataaacaaatcagctaaagcggttcaagcagctgaagctggaatcaaacagattggaacacttgcacagcagcaaactctctgtaagcttcttctaagcttttggataatctgtaataaaagctgctgttcatggtggcaacagttcacactggtaaaaaaaaagcggaaaatatgatctgatgatgaacttgatcttgtgattcagcaatgattgaagagagagcaaatttaccagaaatatcactacaacctgttgtggctggtgcagccgaaaagacttctcacgcaatcggcagtgcaaccaagagactaatgaacattataaccggaggaaacaaggatgaagattagacatttagaagttttcacttggagtgtgtttttggtccgtctttgtttgaagggattagtacaaggtaaagtccatttagggaaacagagaatctatgaacaagaagactttttagtaaaatttggtatatttatgaaacctgaagtgtaactgtgtaagacacaaaagaagaaataataacagccacagccattttaagatgtacaacagcagataaaatagtttacataacaagccgacaaaaaaaaaaaactattctattcttacatatgggttgactttgcaaagatggtaatagtgtgattgggattgggccaaagttaataggcccaaaagaagtggaaaattagaagtaatgaatcctttgattgagatagaagctttatcctcttcttcgtcttcatcatccgcgcatcaccagttttttctctctctctacaaatcttcttaacggcctttcatcaatggtcagcagacttagctttcgaatataggctaagaacgagcatg

SEQ ID NO: 20623 - DNA, 3003 bp, Unknown
  misc_feature (1)..( 3003): 2750-1469P.txt file - cDNA_ID_1827500; gDNA_ID_1620763; Annot_ID_50068
ttcgaaagggccacgagtgtttgtgccatatccttcacctaaaccgataaacaaacatataataaactcacaaggaagtcaaaatctgacaagggaagacttttacttaccctgcatttctaaaccctcatagataacataaggaagcttcgaatcttcagtagaatcagcgaacaatgtagctaaatctatgccatcttgttccatgtcaacaccaattagacttccggagttgtgtaacagcctttgcatcacgagcacattaggatctttttgtgcaccaaagttccttgtagaatcaagagaacctgcaacacccaagaagtaaaggtattaatatagttttttttattcctgcgcaatgtcttatacataatttgtgatgaaagaacgtaccttcgaacatgtcatcataaagattgaacgtgtctgtgtatataaggatattatcattgtcgtagttacttgggttttccctgtacgattcatatcccttcaagacttcttcatctgtttcttggctcggactattcttctccgcttccttggatcgcacgtaagaagaatttgatgattcttgagtcgatggagatatagggtcgtcggagagagtcatctctgtttcgttggatcacgatagttaaaacgacttagtactctttttcgatttcttcttcgtcggagagacttatcgttaaaacgatttgagattgagagagactgttagacggattagtgagaccgcgagtgacgagactcgtttctgtctttcttttctttttttttttttttaacatcttcattttattgatattatgaagaattgtaatcaaatcgtaatgctgtgtaaattacaggtggtatagtagagtaaaatttaaaatgttcttctcgaaacaagtgagctttggctagcagatctgcaggtttgtttgtcatccgagtgacccatgtgaatttacactctcgaaatcgatttctccatgcctgaacttctctaacccaattatacagatcaaatcgtgcctttccatcattgagaattttcagcagctccatgttatctccttcgaagcagactcttgtatatccatgactccagcagttctgcattgcaaatataagggcttgaaattcgttctcgattgcactgttgttggttcgtcctctagcttgtcctgcactaacaaaaaggcctgcttcatctcttgttacccaacccgctttacctgtctttcttttcttatataataataccggccttattttgttgttttgaataagaaaatgtatatgttttaaagaaaaaatcaaattacgaacacttcaaaacataatctagatcattaatttattacacgtgaaaagaaaacaaaaataataatttcatttaaatatttatcaaattaaaatatatttattatataataaaaatataaaaatatttattatataaatatatatttaatataaattatattattatataaaatatacttattatacaattaaaacataaacaaatttattatatatttctgatgaattcttctacactcatgatatatactctctccaccttttcttttgcagtgaaagctcacaaaaatatacaaaactacattctcatcaaaaaatcaccaacttaaaaaataccaaaaattgtatttaattctatagttaaaatcaatttgagttttattgagtttttatataattttagtcttttaggtgaatttggggaattgttatttgttgttaaatcctacttcaaatcatgaaatttgaatctttgtattttgaagtatgtaaattatctaaatccaagtcttctttagtccaatcccaagcattctgcatcatcagctgtcttttctcctagggtgcgtgtgaagtcattcctgagattgaaggtctcctggatctgcctctcatcatagccgcaagagttcgacaagtacgtttctgcccctagattgtcaaacataaccaattagataacactagatagagatgaaacagaaggcaatgccaatgctctgtgtcgtatggcttctgcaacaaggtatatagagtagctggacagtggacgtagaaatactatgggccagaattattatgggctcaaattagaagtatttctattgggccagcattatttattctctaccctaaaccctactatttcaacacttgaccaaaatggcctttaagacacgctgggcctacgccaataattatccacgtcggtctaaaactcaatgacttgacgaaaatgcctttgaggattctatgaaattaccgaaattacccttttgtttcttagccgcgtaagtttcgtctgatattatttttcttcttctccgagaaacaaaccctttaatttactgttgtttctcacaattctcaaaaatctctcatccgaattgcgccttttccgcttccttttgctctgtcaaatctctcaaccggaaaaatctcgggaaggttcgtctgatccaattctgaagattttgaaaaacccaccgagaacttcgaggtgaatttgatcatcttcttcaaaaacctgtttttttgtttgtttgttcttgtgtgtctctattgttaattttgacgaggagatttatatatcctatgatcaggtcgtgtttcacttctctaattaagttgctttcttttgattccaccgtattgtatctctggatcgaaattagggttttagtgtgtgttgtgaactttaaacgcataaagtttctgcctttcgcgtatttgaaagtttgatgcagccatattctgtagtgtctccaagcaattttctagggttttacataaatatgatgtaacttcttatttgttgattttactaattagatgatacttttcagtgaagttattgtcttttgggattacttgaatcaacccaatagctcttgcaccattttaacccagtaataatcgtttgtttttgctttcttgcagatttaattgaatttttcactgatg

SEQ ID NO: 20624 - DNA, 3003 bp, Unknown; identical to SEQ ID NO: 20623
  misc_feature (1)..( 3003): 2750-1469P.txt file - cDNA_ID_1827500; gDNA_ID_2926194; Annot_ID_141192

SEQ ID NO: 20625 - DNA, 3000 bp, Unknown; identical to SEQ ID NO: 5112
  misc_feature (1)..( 3000): 2750-1469P.txt file - cDNA_ID_1827508; gDNA_ID_1620763; Annot_ID_50066

SEQ ID NO: 20626 - DNA, 3000 bp, Unknown; identical to SEQ ID NO: 5112
  misc_feature (1)..( 3000): 2750-1469P.txt file - cDNA_ID_1827508; gDNA_ID_1620763; Annot_ID_167247

SEQ ID NO: 20627 - DNA, 3000 bp, Unknown; identical to SEQ ID NO: 5112
  misc_feature (1)..( 3000): 2750-1469P.txt file - cDNA_ID_1827508; gDNA_ID_2926194; Annot_ID_141190

SEQ ID NO: 20628 - DNA, 3000 bp, Unknown; identical to SEQ ID NO: 5112
  misc_feature (1)..( 3000): 2750-1469P.txt file - cDNA_ID_1827508; gDNA_ID_2926194; Annot_ID_201297

SEQ ID NO: 20629 - DNA, 3000 bp, Unknown; identical to SEQ ID NO: 5108
  misc_feature (1)..( 3000): 2750-1469P.txt file - cDNA_ID_1827511; gDNA_ID_1620763; Annot_ID_50065

SEQ ID NO: 20630 - DNA, 3000 bp, Unknown; identical to SEQ ID NO: 5108
  misc_feature (1)..( 3000): 2750-1469P.txt file - cDNA_ID_1827511; gDNA_ID_2926194; Annot_ID_141189

SEQ ID NO: 20631 - DNA, 3003 bp, Unknown
  misc_feature (1)..( 3003): 2750-1469P.txt file - cDNA_ID_1827518; gDNA_ID_1620763; Annot_ID_50062
ttccggctactaaaagtataataatcactaatatttaaatttctaatgatacctttccttgttgtccttaaactagtattaaaacttataattcgttgacataatgaaagctttttgttcgtttaatatagttttctcataaagtcataataacaaactttttgttcgtttaatcctgtctaagtaacttatgaatcacaataacaaaatacactaaacaaaaagttaatttagtttataaacgaatgaagtgatataatattaatatttttatcattaaacgtaaatcatagattaaaaaaaagatttggccaaaaaaaaaagattaaagaaaatattaaaattaaaaataaataatgatgattctaccatatttggtagtagtaatttgtaaaaaactttcttttaatgtaattgagttttcagaattcttattttttaccaatccacgtatccaactaatattacattaaataaataaatgttcaagaaactaattggaaatcataaaataaatctccaatctaaagtagaaccgcattataaatacaaactcatcccttctacttcccatcatcttcatcacacacccatactcttcctcgaactctcttcttctttctctcttactttgtgtttgctctgttttgctctcttaacacaacacaaaaaatgtccatcgttgttggccaagcttaccaacatcttcccaagcaagtaagccaaaatcctgacgtgggtggatggagtttcttgcaatatttctctgagccaaaaggcattgtccagaacagagaagacgacacaaagaaaacagcttatgtctacccgatcgagaagcgttccgtagctaaactgagccttgagatgtgcacagagagcctcgggaccgagaatgggagtgatagtggagacgagatgtcgttacttgcgcttgaagcaaccaatatttcaaagagtcctcgtcttactacgaaacctcaaaaagaaactagcttcatgacccgtgagaacagttttcctccgccgctaaactccgtcaacggattcaacaatagccgtatggtgaaatcgtataaagaagacggtcgtcttgttgttcaagcaattagggtttgttctccacctcgttgctttgtatctgaacgtcgtgaaggaaggcttcgtctctgtttatcacagaattcattgaatagccaagacgcagaagaagagtttgaagaagaagatgaagatgatcaatacgatgcagaggaagaagaagaagaagaagaagaagaagaagaagaagaagaagaagaagaagaagaagaagaagaagaagaagaagaggacgaggagggcattgtggggaataatgagaactttgagggtaaaagtggaaataaaaaggttagcaacaggccaaaaaggagatgcaatgaaaatggatgtgagcctaaaactatgcttaattggaagcagcagcaattttgggtgaccacttaatgggaattactcaactcagcaaataattattttttacggcttctaattctacatatataaatgctaaaatgtgagttaattgttacttaaactgtttaacaacatagagaactaatcttcattatctgcttttactttttagtatgttataggtaacctttgattattaacgagagttttagttatgttttcatagactaacgagagtgaaactatagttttaaaaagggtaataaagtaccagtaatagtgagactgacgaaaactatatgatatctttcaaaaaacttcattgaaattttggtaacatcatctacactagtttgcaacacatctttgtgcttctaagcgcagtcaatgtcaatgttattgtcatcactagtcttagtagcaccaagggataccacacttttatcatcaaccatcagtccatcaaatggtcattaattcatatttaagtcttttataagaactaaaggtttctacaattttcaacaaaattaagtaatgtaaatgtcgtttatgagtatgcgaataactttaacattattattgtagaccaaactctttgactgtcacgtgtgcatatttatagacacttgctcgtacggacgtaattgaataagaacatataatttgtaggtccattgtacacgatctctctactttcttgatattcttccctctgtctcgaccaaattcgtactatataaatctcggagtgatatcaaaatagattgcaagtatatgattgagccaatgagaaatagacaacattacgatgtaatgtccaatcttacgtacaaatgtgaagagcaatctttgttctctgcaaacgaataagagaacattacgattctttatatataacatgccacttgactccgcttataattgaccgaaatctaaagcaaatctcatcatgtacccatcttatttggtatattgatgattcgattttattttattttcaatatagaaaatgtattttccatatacttaatgttataaaaaaaaaatcatgtttatattttaattcaagttgaatcactttttgacgagattatgcgaaatcaagttttgatggaaaaaaatatggaattgtgtttttgacgggaaactacggaatcactttttgacgagattatgtgaaatcaagttttgactggaaaatttggaatcacgtttttggcgggaaaattatggaattacgtatttagcgaaaaatgtgaaatcacgttttgacgaggaaaattagttcttatttgttgtgaacagtgaactagtgaagttaaccaaagtgttgcagttttgataaggctaatgactactaattttagaatgatttttattgactgagagaaaattttgaaagttcttttatgtactgcttttattttggttttagattgggccgagacaaggcccaacaaagaaatagctcaaacacactcacttagcaaattactcaaacagcagagagagagagagagctcagtaaactaaacaaaaatg

SEQ ID NO: 20632 - DNA, 3003 bp, Unknown; identical to SEQ ID NO: 20631
  misc_feature (1)..( 3003): 2750-1469P.txt file - cDNA_ID_1827518; gDNA_ID_1620763; Annot_ID_167242

SEQ ID NO: 20633 - DNA, 3003 bp, Unknown; identical to SEQ ID NO: 20631
  misc_feature (1)..( 3003): 2750-1469P.txt file - cDNA_ID_1827518; gDNA_ID_2926194; Annot_ID_141186

SEQ ID NO: 20634 - DNA, 3003 bp, Unknown; identical to SEQ ID NO: 20631
  misc_feature (1)..( 3003): 2750-1469P.txt file - cDNA_ID_1827518; gDNA_ID_2926194; Annot_ID_201293

SEQ ID NO: 20635 - DNA, 3000 bp, Unknown; identical to SEQ ID NO: 5105
  misc_feature (1)..( 3000): 2750-1469P.txt file - cDNA_ID_1827534; gDNA_ID_1620763; Annot_ID_50056

SEQ ID NO: 20636 - DNA, 3000 bp, Unknown; identical to SEQ ID NO: 5105
  misc_feature (1)..( 3000): 2750-1469P.txt file - cDNA_ID_1827534; gDNA_ID_2926194; Annot_ID_141180

SEQ ID NO: 20637 - DNA, 3000 bp, Unknown; identical to SEQ ID NO: 5104
  misc_feature (1)..( 3000): 2750-1469P.txt file - cDNA_ID_1827542; gDNA_ID_1620763; Annot_ID_50054

SEQ ID NO: 20638 - DNA, 3000 bp, Unknown; identical to SEQ ID NO: 5104
  misc_feature (1)..( 3000): 2750-1469P.txt file - cDNA_ID_1827542; gDNA_ID_2926194; Annot_ID_141178

SEQ ID NO: 20639 - DNA, 3003 bp, Unknown
  misc_feature (1)..( 3003): 2750-1469P.txt file - cDNA_ID_1827546; gDNA_ID_1620764; Annot_ID_50089
acttgtcttcttttattttattattttccaaaaataatacttcgctttttagaattactcatactcaatgaaataaaaaacaccacttgaaatcacaaaattgatagttgaaccaaaaaaaaaaaccaaaattgatagttgccttaaaccctcattaactaataaatttttatgcatataacttatagaacacacgtctttaaagttgggatttgggaatatgtgaaaattcaatgtttgaatgatcaaataaaatttcatcatgtaccgtggttgttataagttataactcagatatattatacagctttgtcaaataatactgatgtggaaccccattaatgaaacaagaaactttttttcactttgactttctttcttatttaggcatgaccatgttcgatctgacttcttcttacaaaagcaaggttaaacaaaattttattttatgtttaaacgaacaatatctcagtcatatatattagttgttggtggtaaatcaacttacataaaactttttaatctttttgtactcagaaaaatcgaagatggggtagaaacaagtaaaacaatacgtagttagggtttattgtacgaataactctctctttttttattgtcaacaaaataatcctagattagtacaaaaaacaatatacataataggaggaaacataaggaataaaagggaatcttatataggtcattttagaaaattaataaaacaaaatatgattatatataactcctagtcaagttacagctgttaataaagacttgcagaaagtagagtttcgtagttcataagcatgggataaataccctctaacctaacaacgaacaaatcatttggtcaaaccttttaattatttggtcaaaccccacaatcttgggttgttaactagctgtaacacccaccagatatgaggcctctcgtgtatgtagacatacatgtgttttatgctactataaactcaaaaactgatattatggtcagtattatacgatttttgttctgatctcaaaataaataagtcgggagtagaatactattttctgattaaaaatcctttatctgaaacttcgttgcagatcatttctgttttttccacagtgatataaaaaaagtacacttatgaattatgtatacaaccttgtaataagggatgttcttacaaatgtagttaggttaggaaatatgacttgtttattcaacttggaaatgcttctcatcattgcagacaagcagaagatttaagatccaaccaaattatgataagtgaaacttgcacacaactcctctttctacattactccaataactatgtctatatgggaccagactatattactgtttcactaattaaacgcatataaccactacacattcattagaggcggaaacgtaaaagtaaattatgtagtagtaaattttgtaaacaaaaagaagtaatatcactagtccttaaagttacaagcatcagatcttaaatgtgtacagttgtatagtttaccaactaaccaatgtataaacagaatagtacaatctaatttccgtttcatgtgctgtaaaagaacaatgacacacgtaaaaagtgagcaaaggaatgattaagaaaccttaatggagtaggttaaattaaagacacaggttccttattatactccattttcacttaaattatgttaactttgattagagtgaaaccaattaaagtgagaagatcctgcgaccacgctcgcggactacttatgtggaccctcttttttaactaaaacttacaatggcccacaagaagtggaagtggtccatactcttttatttgcaatgatgtcaagattcctagtatcttaattatgatcgcaaatcatatctttctctctaatctcatcgtttatttctcaaagccataacaatttgctttatctaaaaaagttaagaaaaccgtatagtctagaaaccaaattaatgtcgctggtccaatgatgcatgaagaagtatgataactttggttctcattgatgtcgatgatagactaaatgcatatatatttacgtgaaaagaagtccgaattccacattagaaagtaataaatcttgattgtccataaaaaaaaaagattgattagaaattatatttcttcattaccaagtttatttggttaccagatatatcaacgatcaacaacttttcattagaaaatggggtactactaaaccacagtattaaaaaaaacattcattacataaaaatgatttctcgtgaccaaaaattgttttgtattttaacgaagctgtgtccttttagagaacatatatgatttggaagctccaagtcacacatacacacacgtagtttagagaaaaattgtttgttgacattattaacgataacaaaaatatttgaggatcatgagtggtgacaacgacgttgatttcagattggttagtattcattttcggttacatgcgaaaaaagtggtgaccacggatactacaagcttcacatagaaatatttacgcattgataatgatataatatgtaataacgtgaaatctcttagtggtattagtagaaaaatcatggtccataagccatatctatgacttgtagttacctccttttttctccaacttttttttctttctctagttatttttgagatctgacattataattttaatttcaattttgatgatagtttgaagattttttttttttttttgaatctcacattttaatttaatttgagttttgatgatatatactaaatgggcctcacgtgagggaagaagcctacccgctaattcatgtaaagtgtatctcagcacttgactttcagtctcagcgatcggagacggagaagctcatggaagctgctggcgttacaagttctcatcttctctagtcttttacatttcacctccctttcgtcggcgacccaaatccacgttttgggaattcctccctaaaaatcagaaacccttggcttttccaacatg

SEQ ID NO: 20640 - DNA, 3000 bp, Unknown; identical to SEQ ID NO: 5129
  misc_feature (1)..( 3000): 2750-1469P.txt file - cDNA_ID_1827567; gDNA_ID_1620764; Annot_ID_50083

SEQ ID NO: 20641 - DNA, 3003 bp, Unknown
  misc_feature (1)..( 3003): 2750-1469P.txt file - cDNA_ID_1827571; gDNA_ID_1620764; Annot_ID_50082
ttttttttttattaggttcctcctccgggcaaaggctcgttgtatctcagaccgttgttgttcggaagtggagcaagcttgggtgtggctgcagcatcagagtacacgtttcttgtgtttggctctcctgttcaaaactacttcaaggtcttaatcgccttgaagaggtattcttgttttctttgtagcaaagagtcttggtcttaaatttgattgcttgtataggaaggcacagcggcgttgaacctgtatgtggaggaggtgattccacgcgcttatcttggaggaactggtggtgtaaaggcaatatccaattacggtccagtaagtttaaacactcatcctatatagtttcaagtactaagcaaggtgtttcgttccaaagtaagtgttaattgttttggtgattaactgtgaaaggtgcttgaagtgatgagaagagcaaaatcaagagggttttcggatgttttgtatcttgatgcagatactgggaagaacatagaagaagtctctgctgctaatatattccttgtgaaggttaacaaacactctatttaagacaaaagtggaagggattttttttgttctaatgatgctgttgtatactaattgaagtttattgagtctttcagggcaatacaatagtgacaccagctacgagcggaacgattctcggagggatcacacgtaagagcataatcgaaatcgcccttgatcttggttacaaagttagtagttattccacgtcttttttcttctaacaccgtttccaatcttgagtcaaaaaacagagcaatactctgtttcaaaataggaatacttttgatgcatggaagttttgataagtgtgtaatggactcaggtggaagaacgaagtgttccggtagaagaactgaaggaagctgaagaagttttctgcactggaactgccgctggagttgcttctgttggaagcatcacttttaagaacacaaggtctcttcttcctctctggatacatgtatacatatgcttagaattttacatttatctgttgataaataatctgcaggactgagtacaaagttggagatgggattgttacacagcaacttcgatctattcttgtcggaatacaaactggttctatccaagacactaaagattgggttttgcagattgcctaagttactttcatatcctataaataatgttgcactctcttgatcacccatcaaaagcttttgaaatagtttttggtaaatttgtgacataaatttgtgatatatcaccacatcgtattagtattaaacatttgtttcactcttccaaagagacaaaagcaaaactaaagaccttcaacttcaaggtcaggatatgtaatctaatggtttgtctttgtggcattttgccaccattggttcaaaataccattgctgtatgatcagcctcctcagattctatttgccagactctacggcggtatattcgcttttagaaaaaaaacaattttgtcgaaacttttttttttttgtaaatattgtagattccacacacaagactgtctaagattctttgataagacacgacaaatgcgatttaagatttttcaaagaaatgaggttcgttgattgttccactaggtttggtatatttataatttgaatttttttttttaaagatatttataagaaaacgaaggagtgtgctcgcgtcaagtgtgtactaatagtcgatgacactagtgatacgacgatactggaaagggacatcaatattcattagtaagccatcttagcaaaaacgttgttatcagataagaaaagttctcagactgacgtggctgtcaatctccacaacgtgtttatctcccatttgggtagttacggacaaagacgttgaaaagacaacaatatggtctaaaagattgacatggaaagaaaattgtttatccgacaaagacctcttggtccaacgtggctttcacatcactagtttactatttcacatctcatggaaaattactgaaattagtacttgtctgtattttgttttttcgtcaagtatttgtttgtatactttaggtaattgcgtgccgaagaaacattgctaaattgatatttataccaacttacaatagtttacagttcaaaaatagaaatctccattttgaagatacaccactaattttcttcatttatttaccccataagagaacgagaaaagaacaatagtccgttgatttcgttaaaatctagtttcagaaagacacgtctagatctgtctgatcagggcagatagacacaagtgacgaagcaaaagaaacacaaaaataagataagaactcttaccactaaaagataaaaataagaaaaaaaataaaacaaattcaacgatttgccaagataaaagcagacactgtacataagctccgcattcacttacgtgttggatacttaatttgacactcttctttgtgttttctcttccaccttctttttcggtatatcattcaacaaaattctctcttcatttctttattttgttgttttttttattattattgaaatcaagagaattaaaacagaggctctgcaaaagaagatgatcaaaacaatcacatctctacgcaaaactctggttctacctcttcatttacatattcgtacggtataaactggattcttacaatctaatgatgattacttacttagagacataactcggatctcagatacaaacatgttttatgttctgttttttttgtcctgatgaaatagctacaaactttcgccaagtacaacgcacaagctgcatcggctttgcgagaagagcgtaagaaacctctttatcagtaagttctctttttcatgatccagccaggtcatatagatattttgttaccattggaaaaagctctgtttcaaatttgttgtaattgtatcatatagaaatggagatgatgtatatgcggatttggattgggataatctcgggtttggtctaaatccagctgattacatg

SEQ ID NO: 20642 - DNA, 3003 bp, Unknown
  misc_feature (1)..( 3003): 2750-1469P.txt file - cDNA_ID_1827575; gDNA_ID_1620764; Annot_ID_50080
tattgtgagcgagaaatctttgcagcgttcctctgaaactaacatcaactcgttcccagctcagttttgttaattctcttatcatctcctctgcataagtttgttgtattatgatgactagaaatcaagaataagaaacacgagaatgagttttccactgaaccaaccttccatatctaagttcttgaacctgtctgctttggtccttgaatgatcttcctcatagttacttgcagtatccggtgcttcaacattcacaatgtgaggatacttctcattgactggaccacgttgaagctgcgaaggttatatcattatatgtgagacttgattcagcataacatacacagcattatcttattaaacactgaaagtgaaaggtttaaccttaggaagctcattgtgacgccggatagacgatgtactccacccaacaaggtctaagaacaaaggaggtcaaggtttcaaatgaattgtaatagccacaacagttctgagtcttttttttaagctcaattcacattgtccgatcagtgaagaagtagagaattagtttaaagacgtccaacaaagaaaggatacggtcgaaacttgtattcgcgtaagcaatacgccgtttgaagcattgcaaagcagaactgttcacaaaagcagaggagacattagaaatcatttgaactacgcaaaagcctcaatcagctatatatagaaaaatcattgaaggaactcacatgaatttaagatctctagaatctttaaccatccggaggagtaatggaggctttccaccatcactatcagccagaaaaagatgttttcccgttttaccaagacaacccgacatacgcgtagctaatctctccaaagtgtaagatccagaaaacaatgggacctaatgcagtcaaaatgccacaccattaaccaaattgtaacttttcatgttgcaaaattccacaaactgtatcaactatcaagcttacaggagaatgaggcataaaaggatctcaactttgctgtaaacatattgacagcttcaatgtaagaaaaccgttttcaaatcacctgtttatgtcctcttgaaccaaggtgtggtgttgcagaagttataaaatacacaggctctaatccagcgattcttgctttcggttcctctatcgagcatttatcaccaatgtcgtcactattatgtggaagctcttctcgggattcttgctcataaagacgcccaatagcatacctagcaatcaggccacctaaagaatgtcctacaaaggaaatcttctgaagacttgggtgacgtttgatcaccgacctaacctaaacaaaagagattaagaatatcacttgagctggaaaactcaagcagagacaaagatagaaacttctacataaaaggttctagcattgcgaaaacatctagccaagcggaagacaatataacattagatagaaacaacgctgaaatataagcagcctaaagataagaaacacaaacctcttcagctaatctttctcccataacatcaacaccatcaaatgtctgtgtggaatggttgcgtttactgcctgcaaaatgattataaagtatcacaagccattatttaaaaactattataaaaatccagtaaagtgagatcaaaatatctaaagtgtgattctttcttccttccaataatcaatctgtttcacttgagacttccaatcacaaatttactatagaccattaggaggaaactctgttttaattgaaaaaatatagagaaagaagaactcacagtgaacgaggagatcctgaggatacttcttaagcatctgcttagcggcgaatctccaattctgagcactgtacccacacacaaaatttaaaatcagcttaaaatagaacaaaatcaagcacataacataggaaacactaagaacctgccgatgagaccgttgaccatgacgactaggtgagtcggctcagtgcgttcgccagggaaatcaacagtcaaatcgacgtttccactttcgtctgattcagctctgagacaacccatccaatactttttcttcttcttcttcgtctctttatcatcactcttcctgcttctcatcttcttcatcttctttggcttacggattccttcaagatcacttccaacacgcccatctccttctgtattcttaggaatcacgctatcttcttcctccatgatcacgaaacgaagaatgaaaaatggaaactttatgcaggtgttaattcaaggtcgccactttgggaagattcgaaggtctcgcgtaggtttttatagacttcaaacatcaaaagttcaaatggtcagagagaaacagagaatagtttcagtcgttagggaaagtccccacagaagtatttgttgtcgtcgttgaaacgccattgacattttctttcttacacatctgagatttggacactgttgctttttctagaacacaacacatgttatataaagtcattaacttgattaaatgagccaaaaatgtgatttggcataagttaaaaagcatattcagacatgatgatgataattaagattatttttatataataactttaaaagacaggcccggcccatttaatgtcaaagattggatccaagttttgcccagagaaaaggaagcttcatgaatcatgagtttgtttcttcttctggaagagtcaaacaacaattttgacttttttatcagcaaccacaacgtcgaaagcacgacatgaatcattaaaaaaaaaaaaaaaaaccgacgagatttttgtacctttcttctccgaagtgttgctgattgatgtctgttggatttctctttcttcaactaatcacctttctgtgtcctctcgcttctctcttctcttctttcccattcaaaggtgagatttttaatttgactttttttttttgggttgacccatttcgaatttttatcatctactggttaatgttgttgatttgattatatccgaatttagtacaggctaagctcatg

SEQ ID NO: 20643 - DNA, 3000 bp, Unknown
  misc_feature (1)..( 3000): 2750-1469P.txt file - cDNA_ID_1827591; gDNA_ID_1620764; Annot_ID_50075
ctatattttttcctaactgtctaattaataataacatcttatcttcaaggtattcttattttacctctctttggcgaaattaataataacaagcaaatgaaaacaatagtaaacggaagatagtaggaatcagtagtacatgcctgaatctcgatgagaatagtggtaaaagcgtatgaaaaggcaatgtctccaatcgcttgaaacaatttccaaactttttcagacgcagttacgtccacacctatcactgtccctgtcaattctgtcttaccaatcttcccacctttcatatatattgtataccattttcacggttagtgtcaactttgaagaatcatccatataaaccactatgttttaagataaagaaggggaatgtacttgctacagtagcgatggctaggcctattccgatagacgcataagagaaggacataaccgcggcgatgatggataggaaagagagcttgtggaagttaggaagctggctcagaatgatctggacgatcccaaatgccgccatgtatggataattcgatacagaacatttcgctttatgtcccttgtcatgataacaatttgatttcccaatcgctctaacgaagacgtacaaaaacaccaatcaaacaattattagtaattttattcagaacaacatgttagtataaccataacaaaataatcgaaataaatcagaatctttgacttacactaagcttatggaggcagtgatggtgtaaccaatagtgacccctacgagattcacgtactgtgccactccacatagctgaacctttttaccacctgcgttttatgttattaaagaagaaaaatgattactcttgtactactatcaaatactaccaatcttttggtcttatggcaaagtttctaaacatcccgcataattccaaattttcaacgaggggtcaacaatcgaatttataacattctttaacgggataaattgaattgactatgttaccaatcctaatcaatttaatttattaactaagttatgaaagaatgaagattatcttccttttttttatatagattttgataattaattcatatcttcccatgaaagagcatgcacacttggcaaaatcgtaaatcatttttttctaacaaccatatttttttctttcattgttcaacaacaataatgttcttcaacaaatttacatggtaaaaaattgttgaaatgagccaattatactgtagatttacaaattccaacttagcattaaatatatatttttagatcagattttttttctttcgccagccatcatcattgtgacagaaatggaagaaaatcaaaacacatgtcctaaattgagactagttaggcaaaatctaaatgatatcaaatgaacaaaatccttgttcatctgagaaaaaatgtctagaaaactgaaaaatctgtgaaaaacaatgctgataaagacacaaaatgaatttgtttatatgaatccataccaaggtaagatcggacgacgcccatgtaattatagttgcgtgttccggtgatggagtccggcgaacggtaacagtcggcgagcaaggtggacgtgtagtaagtaatgatggcgaaagcgaccaaaactgtggttcctgccacccaaccaagctgtgctatagcccaagccaacgacagcacccctgagcctatgaccgccgtgattatgtgcgcactcgccgtccaaaatgttcccgttctcttctctcgaccatcgtcgtcgacgcttttcacggcggcgtcacccgactccaccgccgagggattgttgtatgcgtccatcattgtgagagaaccactgaaccagaggagagaagagaggggaagagagttattgacagaggtcgtcttattagagtactccctcacaatcacgtacttacatgtattatatacacaaatatcgatgtttatatggaaagagcatctttgtacgttgaatcttatttattaagagaatcttctattacgaggatttatttcttttgactttgattttgaatgtgtaaccactattgcttattccggaaacaaaaattggtccgcatgttgaaaagaggatttacctacattaacgacactacgaataatcgaaattaggtaactgattaaaattagatgagtaaaacagagagatatttccttcagatcttggcctcttgcatagctatatcctctcttctatcttgctcatttatcttctcaaatcctcacatgcacatgattcattaatcgggaaattaaatcattaacattgagttataatgatgtattgatgtgaatctatatatatatattgttgtatcaactaaatattatgatatatctacaacattttgttattagtatcgcatcaaatacaaaattatgtggatttacatgtttgtattatattttactactattttaacggtttacaaaaacatgtaaaccaaaccataaatttcactaatttcaattatgtacgattttgagtcttcattacttcttatcgtttctttcactcttatagtcttatctcacaatccgtaatttgtgcacaattaatgaattcaatgttgtattttgtcgtattaaatatggattttgaccaacataaacctgattttttagtggattattttaaaatatatccacaaaatattccttcgaataaaatcccattctaactatatccataaaatgcccatcccaattgtcgagacagaatcagatatctaaaatgacacataataaatgtcgcatattacaccattaaagtacggtacgttgacctcctacctgactatgaacagctcatcagacagctccctgtgccctcaagtaggggtgtggataaattggtctggttaccggtaaaatctggagagtatacctcaagatcaggttacggggtaacatccttgacagtgctaccaacagctcaggtccgctttaactggcaagcaaacctttggaaactccacactatg

SEQ ID NO: 20644 - DNA, 3000 bp, Unknown; identical to SEQ ID NO: 5121
  misc_feature (1)..( 3000): 2750-1469P.txt file - cDNA_ID_1827594; gDNA_ID_1620764; Annot_ID_50074

SEQ ID NO: 20645 - DNA, 3000 bp, Unknown; identical to SEQ ID NO: 5137
  misc_feature (1)..( 3000): 2750-1469P.txt file - cDNA_ID_1827598; gDNA_ID_1620765; Annot_ID_50107

SEQ ID NO: 20646 - DNA, 3000 bp, Unknown; identical to SEQ ID NO: 5135
  misc_feature (1)..( 3000): 2750-1469P.txt file - cDNA_ID_1827616; gDNA_ID_1620765; Annot_ID_50101

SEQ ID NO: 20647 - DNA, 3000 bp, Unknown; identical to SEQ ID NO: 5133
  misc_feature (1)..( 3000): 2750-1469P.txt file - cDNA_ID_1827622; gDNA_ID_1620765; Annot_ID_50099

SEQ ID NO: 20648 - DNA, 3003 bp, Unknown
  misc_feature (1)..( 3003): 2750-1469P.txt file - cDNA_ID_1827655; gDNA_ID_1620766; Annot_ID_50118
ctccttcttttgtgctatttcacgattttcaatcttagggtttgtgctcagagacgtgggggagaagatgagtcaataaagttaatgaggctattgggccattatgtaaaataggcccatatattaatgggtttcgttggattagaaatcttaacttgtaggaaaaaaaaaattcacgccggcaaaagaaaagaaaaaaaaaaccttcgccgtcgtttgcttagtcttcttcgctctatcccaacactcgatcaaataatcccagtgagcttcttccattccaaggtacgaatcgataaagtcatcaaacctataccttttcaggatttaatggtaattagtcaggatctaaatcgtttcttcgaatttgatttcggtgatctagaaccctaatttggtcgggaattttcaaatcaattgatttccctgccctaatttaatttgatgattgttctgtttgcctatgaataagtttgatttcaatggcaaacaaaaaaaagagagacattgatttgaatatttttacttaggtgcattgattctgcagattgtgttaatgtgtgtcactcttaatcttctgtcttatgtttttctcagttgataaggaatttgaagaagcctttgtttaatggaaagcaaaggaagaatccatccatctcatcatcatatgaggcgtcctcttccaggtcccggtggctgtatagcgcatccggagactttcggtaatcacggtgctataccaccttctgctgctcaaggtgtgtatccttccttcaacatgttacctccacctgaagttatggagcaaaagtttgtggcacaacacggggaattacagagacttgctatagagaatcagagacttggtggaactcatggtagtttaagacaagagttagcagcagcacagcatgaaatacagatgttgcacgcgcaaattgggtcgatgaagtccgagagagagcaacggatgatgggtcttgctgagaaagttgctaaaatggagactgagcttcagaaatctgaggctgttaagttggagatgcaacaagcacgtgctgaggcacggagtcttgttgtggctagggaggagcttatgtctaaagtgcatcagttgactcaggaacttcaaaaatctcgttctgatgtgcagcaaatacctgctctgatgtctgaacttgagaatctaagacaggagtaccagcagtgcaggtaatggttgtagaatggaagtttctgatatcactggctcccgacactcttcttatagttattgagtttgtcagcttttgtatcatcctcttatgaaggttgggatgaatttgattttatctgattctggcagggcaacatatgactatgagaagaagttttataatgaccatctcgagtcacttcaggcaatggagaagaactacatgactatggctagggaagttgaaaaacttcaagcacagttgatgaacaatgcaaattcagatagaagagcaggtatattgaattatttagttagtttctgctctatttagcttcattgttccacgaacttttttcagtaatttaagagttgtatctgtcaatcaaatgaaggtggcccttatggtaacaacataaatgctgaaattgacgcttctggacatcagagtggaaacggttattatgaagatgcttttggtcctcaggttcgtgagtttctctttgctagctcgtctttttgagacccattatagttttccacattagttgatttagatgtgcttgagctatatacgttttgttacttttgcagggatatattcctcaaccagtagctggtaacgcaactggaccaaattcagttgttggcgcagctcaatacccttatcaaggagtaactcagccaggatacttccctcaaagacccggttacaactttccaagaggccctcctggttcatatgacccaacaacaaggttaccaacaggaccttacggcgctccattcccacctggaccatctaacaatactccttacgccggtacacacggaaaccctagtcgcagatgagtccaccagctaagagtacatatataaataactcaccagctacagattccttcaactgtggaattgttgcctgtttggtcccataatctttatgggtaaagagaagttggtacagtggtgaacgttgagtgctattgtttaactgattttgttgagagcttgacttttgtgagacggttttcaacaagttttgtgatacagagagatgtaacatcgggaaagaaaaaacaaagaaagagaaatttgttgtttgcccttcaccattttgtctctatgactctatgtttcactcagttaaaaagtttacaaatgaatcgaaagttaaatttatctttgtaatactgtagtttctagttttagtttacttttgaagggcccattttattttttattttattttgtgagaagggcccatttcatatatatatatatattatttattttatttttggacagaatacgagttgttttaaaaaaaaaatatttttgaaacaccgtccgataaaattattgaaattttttgatatttttaaattcccgccagactcccatctaaatttcgcttctcctttagccatttgcttccattgtcacggacctgagaaagaaggggaagagagattgaagcaaacaaagagataatcgcagcaactttgtaccaattagaccaggtaattcttctccaataaagaaattgcaatttctaaggtttcattgttcgatttctgtaaaaaggtttttgatttctcaattcaattgctgaaatttggttcagttacctcgattttaagtttagggtttaccgattctggcccatttgatacgaaagatgtaagcttttcccaatattgaatccccttggctatataggggtttaatcgcacaatttgatttagaagaaattgttgcaatccccaatttacgtttttcatttgggtctgatatttgtaggtatg

SEQ ID NO: 20649 - DNA, 3003 bp, Unknown
  misc_feature (1)..( 3003): 2750-1469P.txt file - cDNA_ID_1827663; gDNA_ID_1620766; Annot_ID_50115
atccggcccagcaaggctacgccaaaacggtatagaaataatcagtcattaactgtaaagatcctgatttaaagaaaaatcattctaatttcttgattaattttcttcatcagattaggaccagcaatataaaagggacaaaagaacaagagggcgataaatcaaacacggaaggttcgaagaaaaaaaagataccaatcaccaaaacgtgagaaagtcgaaagatgaggatgcatgttttcttatgtggttattgtggattttccaaagtaccctttgtataatattgaataatttgaatctacgttggaagaatctttcttcctctaatcttttctggatcatatttttacttattttctgcaacttttgtaccaagtatttattgtaactttccatatgttctcctattttcttaatgctcttcctttctctatcttccattcccccaaaacttttataatattacaaattttctattaaaaaaaaaacaatttccacaaaaaagttcttactctttcatttttttttttcggatctagagagtccaatttaatttcttattgtcttgacgtgtagcactccatttgtacctttatctaaagatgaacatacggtatatttaattatcttattaatattaaagatcacaaaaattactttaggagattatggttgttgcctattggcatcgcggtaataaacaatactagtataatagtaacatgagcaattagcctctaaataacattagttaagttcactagctactttctttcttattttagttaatacgaagttgcctatgttgactaacttttaattattttagttaatacgaagttgcctatgtcgtctttgttaaggaagatggtttccagtacatatactataaaattttgtgatgatacaaaatttaatatttgttagtactatctatagcaaaattttgtacgtgatagtataaattacataagcggaaaattgtactattttttggcaacacctttcgtaactaaaatggttcaaaatttaaagcggatatacaaaatttacttgaaattaaaatgtataactaaacgagaaaaataagaaaaacaaattgcttattgctcacgaactccgttagtagacaacatacatcttcaccgattcagaacagtttgtggcaaatgctattgtcatcttttgttgatcgatcagacagtatataactgatcaaatgagtgcagtctaattcagattatatcggagagaggcttcttcgtttgttttgagcttctataatggatcacatatcttcaaagcaaaaccatttcaaacatgcaaataagtttgtgttttttttccaagaggcatctactagcatatatatagaaacattatatgctctaattagttatttcgttgtttgcttcgcagttcaatccgaactaaaaccaaaaatatcaatttggtcagtttggtttgttctggttttacctaatgctgagggctactggctaggtacacttcctcaaaaatttctattttatgaattaaaaagtatggactgtatggttgaccaaatcagaggcttctgtgagggaaaaaataatcacataattaatatctatatatatggtaacagcatcataaaacaaaaccaagtttcttatcattaacgaatctactcttctcacaattccttgtttagttatttctcaactatggattcttcccccgttcaaccaggaccaggtacgttcaagctaattggtacctgatgagttaagccaaaatagtttgtatattgcttttgattatttaagattcatgtaattaccttatatgaaattaatttatcttcttcgtcatttattcagttcatggacaggatgacaaacccaaaacggtatataacctatcacatacttatgaactgttaggatccagcaactatttgctggtttttagaaagatctgagaggaaagactaatcaatttcttgattattttccttcatcagattaacaccagcaatatcaaaggggcaaatattaagaccagcaatatcaaagggacacaagacaaaggcaccaaataaatcaagcacggaactcgaaagatgatgcatgttttcttgtctaattattgtggattgaatcatttggattgggttaccaaaaaaaagagagaataatttgaattgacgttggaggaatctttcttcctcttatcgttttcttcatatttctactttttatcattttatgtaacttttgtaccagtatctattcaaatgccattgaaataaaaatatggtttcgtattccaatgttgttttactcacatatatattaagaagactttttgcccaaaaaaaaatatattaagaagacttttgttttattctaatttttttttaacatatgtagctataaagaaaaactacaaaaacttgggaaactatataaacttataggattgaatgaattttcatttattcgatgagaatcatagtatattttctttctgtttattttattaatcataatttatttaaaatagtttgacatgaagtaaacttatgagattactattaattattaaagttttttaaaattaatttagtgaaacgattgacaacgcaccctcttatgcaagtataatatataatagataaaaaaatataaaattataaatagcgcactctcttgtgtaatttttatttttctaatcccaaattgccattttttaattcgaaattctctctttgttatcagatccacatccttctccaatttgtaatttttttaaaaaaaagacttaaaaatcctacttccatagctcatttacatccgtatcacagtaagcttgtgtttccttaattttgtgtcttaaatctcataagcataaagacgaacttttacaacaatttcttttttttcttcggtatctctttgatttttttttaactattattgatgttgaaaatataaagctcataagcaattggagatg

SEQ ID NO: 20650 - DNA, 3003 bp, Unknown
  misc_feature (1)..( 3003): 2750-1469P.txt file - cDNA_ID_1827663; gDNA_ID_1620766; Annot_ID_167345
gatggtttccagtacatatactataaaattttgtgatgatacaaaatttaatatttgttagtactatctatagcaaaattttgtacgtgatagtataaattacataagcggaaaattgtactattttttggcaacacctttcgtaactaaaatggttcaaaatttaaagcggatatacaaaatttacttgaaattaaaatgtataactaaacgagaaaaataagaaaaacaaattgcttattgctcacgaactccgttagtagacaacatacatcttcaccgattcagaacagtttgtggcaaatgctattgtcatcttttgttgatcgatcagacagtatataactgatcaaatgagtgcagtctaattcagattatatcggagagaggcttcttcgtttgttttgagcttctataatggatcacatatcttcaaagcaaaaccatttcaaacatgcaaataagtttgtgttttttttccaagaggcatctactagcatatatatagaaacattatatgctctaattagttatttcgttgtttgcttcgcagttcaatccgaactaaaaccaaaaatatcaatttggtcagtttggtttgttctggttttacctaatgctgagggctactggctaggtacacttcctcaaaaatttctattttatgaattaaaaagtatggactgtatggttgaccaaatcagaggcttctgtgagggaaaaaataatcacataattaatatctatatatatggtaacagcatcataaaacaaaaccaagtttcttatcattaacgaatctactcttctcacaattccttgtttagttatttctcaactatggattcttcccccgttcaaccaggaccaggtacgttcaagctaattggtacctgatgagttaagccaaaatagtttgtatattgcttttgattatttaagattcatgtaattaccttatatgaaattaatttatcttcttcgtcatttattcagttcatggacaggatgacaaacccaaaacggtatataacctatcacatacttatgaactgttaggatccagcaactatttgctggtttttagaaagatctgagaggaaagactaatcaatttcttgattattttccttcatcagattaacaccagcaatatcaaaggggcaaatattaagaccagcaatatcaaagggacacaagacaaaggcaccaaataaatcaagcacggaactcgaaagatgatgcatgttttcttgtctaattattgtggattgaatcatttggattgggttaccaaaaaaaagagagaataatttgaattgacgttggaggaatctttcttcctcttatcgttttcttcatatttctactttttatcattttatgtaacttttgtaccagtatctattcaaatgccattgaaataaaaatatggtttcgtattccaatgttgttttactcacatatatattaagaagactttttgcccaaaaaaaaatatattaagaagacttttgttttattctaatttttttttaacatatgtagctataaagaaaaactacaaaaacttgggaaactatataaacttataggattgaatgaattttcatttattcgatgagaatcatagtatattttctttctgtttattttattaatcataatttatttaaaatagtttgacatgaagtaaacttatgagattactattaattattaaagttttttaaaattaatttagtgaaacgattgacaacgcaccctcttatgcaagtataatatataatagataaaaaaatataaaattataaatagcgcactctcttgtgtaatttttatttttctaatcccaaattgccattttttaattcgaaattctctctttgttatcagatccacatccttctccaatttgtaatttttttaaaaaaaagacttaaaaatcctacttccatagctcatttacatccgtatcacagtaagcttgtgtttccttaattttgtgtcttaaatctcataagcataaagacgaacttttacaacaatttcttttttttcttcggtatctctttgatttttttttaactattattgatgttgaaaatataaagctcataagcaattggagatgggatctcaagacccttgtatatacagagtgccaagccagttgcgtgaagtgaatccagaagcttatagacctcggatgcttctcatcggccctcttactcattccaagaaacctaaagttcatacggattcaaggtacgcagacatagcctggacgacctttgtagcctataatcaatttttttttttttgcatataatcatcttcttaacatttatttcatacaacgtatttttttttaatcgtaagaaagaaaaaaagaagaagaggacttttgttaagtttttggctgagttttaccctctttgttttgttagcaaaaaaaaaagtaaaaattctgcaatataccactttcagtttgctattgttcatatatttcgtacaaatttgtataatctatatatatgtaagtattcatctctattgttttgtggtacttttgagaatatctcaaaacataacaacgaaagtaacattaaatccggtaatgtcaggattttaattttgttccgagagctttttacgaactacattttacaatcaaattaacatttaaaccaaacaaaaacaatttgcagttatataaaacagaaaacgtaaacagattaatgagtctcttcaagaaaaagtttagtaaaatcttgattaaagtagaatccaataacatcaaaatttaacagagcttaataacatattgattgaataacaacaaattcttcataacattagaacactctgtaaatcacaaaccaataacaccactttagtctctttagctcctacttcatatcttttgtttaatgattaattacttacacaatatagatattaatgtttagatgctttattaggtatctagaatataagatg

SEQ ID NO: 20651 - DNA, 3000 bp, Unknown; identical to SEQ ID NO: 5141
  misc_feature (1)..( 3000): 2750-1469P.txt file - cDNA_ID_1827667; gDNA_ID_1620766; Annot_ID_50114

SEQ ID NO: 20652 - DNA, 3000 bp, Unknown; identical to SEQ ID NO: 5140
  misc_feature (1)..( 3000): 2750-1469P.txt file - cDNA_ID_1827671; gDNA_ID_1620766; Annot_ID_50113

SEQ ID NO: 20653 - DNA, 3000 bp, Unknown; identical to SEQ ID NO: 5139
  misc_feature (1)..( 3000): 2750-1469P.txt file - cDNA_ID_1827675; gDNA_ID_1620766; Annot_ID_50112

SEQ ID NO: 20654 - DNA, 3000 bp, Unknown; identical to SEQ ID NO: 5139
  misc_feature (1)..( 3000): 2750-1469P.txt file - cDNA_ID_1827675; gDNA_ID_1620766; Annot_ID_167340

SEQ ID NO: 20655 - DNA, 3000 bp, Unknown; identical to SEQ ID NO: 5164
  misc_feature (1)..( 3000): 2750-1469P.txt file - cDNA_ID_1827707; gDNA_ID_1620767; Annot_ID_50136

SEQ ID NO: 20656 - DNA, 3003 bp, Unknown
  misc_feature (1)..( 3003): 2750-1469P.txt file - cDNA_ID_1827714; gDNA_ID_1620767; Annot_ID_50134
attgaacaaattggatgtttggtatggaatcgagagcttgtggatgtaatgcagtttgttgctggaggagaaactctttccattcgtcttgcaagttctgagttaggtacggcattaagctgagcataaagtaattctaaaaaatttcgagtttcttcgtgatgttcttgtttgctgcagcatggtttacagttttattttatggtgcatctctcagctggaagcaatcgagtgaagattattgttgctagcattgtcagcatttctgttttcatgatcttggtttttgcctcttattggtactggagatacaaagccaaacaaaatggtgagacactgaaatgcgtagtagcccttatttctctgttttcttttcaatcagctacgttagtgtagcctttgaatgctaattttctacaatttagtactgacttggatacttgtaaatcatagattcaaatcctataccattggagacatcacaagatgcatggagggaacaactgaaaccacaagatgtaaatttctttgatatgcaaaccatattaactatcaccaataactttagcatggaaaataagcttggtcaaggtggattcggtccagtgtataaggtaaactttatcatgctttatctactctttttcttttgtcatcctctttcttgttcaccatatgactatctccaactgtggatccagggaaatctacaagatgggaaagaaatagccataaaacgcctttcgagcacctctggacagggtctagaggagttcatgaatgaaataatactcatctcgaaactccaacacagaaacttggtccgccttttgggatgttgcattgaaggagaagaaaagctattgatttatgagtttatggcgaacaaaagcctcaatacctttatctttggtcagtcccttattgtgcatatctctgcatctttccaattatattcatcatgtggaactcttgtacccttgtttatgtgtgaagctgaccaatctgtttttaatttggctagattcgacgaaaaagcttgagcttgattggcccaagcggtttgaaatcattcaaggtattgcttgcggacttctttatcttcaccgcgactcatgtcttagggttgtacaccgagatatgaaggtcagcaacatccttttagacgaggaaatgaacccaaaaatatcagattttggattggctcggatgtttcaaggaacccaacatcaagccaacactcgcagggttgttggaacgctgtatgtatctctgcctcctctatagatagataacaagcgtttacttgtttaaataatcaacctgaggaatttttgtcaaaatgaacagcggatacatgtctccagagtatgcttggacaggcatgttctctgagaaatccgacatctacgcatttggagttctgctattggaaatcataaccggcaagaggatttcaagtttcaccattggagaggaaggcaaaactcttcttgaatttgtaagccattgccctctatatcctccttgaatctgagtataaatcaaaatgtttctaataggactgtgttcatcgaatttgaaggcatgggattcttggtgcgaaagcggtggatcggatctactggaccaagatatctctagctcgggttctgaatccgaagtagcgagatgtgttcagattggtttgctctgtattcaacaacaagccggggatagacccaacattgcacaagtaatgtcaatgcttacaaccacaatggatcttccgaaaccaaaacaacccgtattcgcaatgcaagtccaagagagtgattcagagtctaagactatgtactctgtcaataatataacacaaactgctatagttggtcgataaaagcaatgatcacacatgtctacaaaagaatctcattgtaaattttagaggttttaatattcaaaaaaaggtgaccttggttattgtaaaacaacaaaacaaaaaccatttaatccttatgcacgagggatagagacagagatattacttcaacagtacggcacaaatctccaaaggcacgacgaatatttgtgttatttgagttttgacttaatcttcccaagccaatacaaatcgagagtgtggcttgtttctcacggcctttgaattcttttttatctctaaagttgttgtctttcttttatcatcaattgtgtgttgttgacattgtttctcagccaaagtttgagactttggatcgaatcacttatgcccagatgatctctgcatgattaatcacaatttctttttaaaaaattgtttagtcttgcactatttaaggtttgaccgcttctacaataagatatgcactgaatgtgttcgacgaaatgactgagtgagatttaactttcaaatattttgacttcgtgcggtttcttttttcaacagatttaccaaagagacatgttgaagcgactcgagaaagtaggtacattgaattgctcttaattgagagaactgtaagtaaactaaaatttgtgtactgtgttattattattaagctggcttatctaatagtggttttgtcattatatcactcttaggagattattcgagaaatggaaagcttatgtaacatccaggtaaattctgcaaatgggtcctgtttaattgtgttaatctctttcatggaatggaaggtgacaagtgtgaaagcttaaaagtatttttcagaggttggagaaaaagttgacttctttttagacttaatgcaattggaatgtttcaatgttttattgtttattctgtttaatattagaaaggaacatattgcattattgtaccagagagagagctgaactttgaataagtcaagttttgtgaacaaaagcttggtcaacttattaggtgtcttaagtagaagcagaccccatgaatttttatgtatatacatgaaacttgaggaagattgttctctcaattctttgagttcaccaaaataacgttttttttttgtcaacatg

SEQ ID NO: 20657 - DNA, 3003 bp, Unknown
  misc_feature (1)..( 3003): 2750-1469P.txt file - cDNA_ID_1827718; gDNA_ID_1620767; Annot_ID_50133
tcagaattgggtaaggataaaatacatttcttccgagattatgaaattcaactttctttataatgttttgtagcagcatgatttagcgtttttttatctgtttctggtgaatatctcagctggaagcagtcgaaggaagattatcgtaggcactactgtcagcctttccattttcttgatcttggtatttgctgcaattatgttgtggagatacagagcgaaacaaaatggtaagagactgagaaacttagaagctttctctctctctctctctctgttactctcttttcctctatatcgaaactgtagtaaaagacacttctatatatacacactaattagtctataatctgtcaaatcttgacgttaagcctttggttgttaaactgctacaaatcaagcaatacaacatgcacatatcttattcgtatttctgttgtctttgatactttataagatgcatggaagaatggttttgaacgacaagatgtctccggcgtcaatttctttgagatgcatacaatacgaactgccaccaataacttcagtccttcaaataaacttggtcaaggtggatttggtccagtttacaaggtatgtgaaattatgttttagttcctcaaatggaaagtttggtgttctctagataactttctgcaactttttccagggaaagttggtagatgggaaggaaataggtgttaaacgccttgctagtagttccggtcagggtacagaggagttcatgaatgaaataacactgatctcaaaattgcaacacagaaacttggttcggcttttgggatactgcatcgacggagaagagaagctactgatctatgagttcatggtgaacaaaagtctcgatatttttatatttggtatgtcttttattccatacatctctcgttattccttttccttccatcttatgagacatttttaatgtgtcactttcactaatctgttctactttattggctagatccatgtctaaagtttgagcttgattggccaaagagatttaatatcattcaaggtattgcgcgtggacttctctatctccaccgtgactcacgcctcagagttattcaccgagacctgaaggtcagcaatattcttctggacgacagaatgaatccaaaaatatcagattttggattggctcggatgttccagggaacccaatatcaagacaacactcgcagagttgtaggaactctgtaagaatctgtccacaacaacattcttaagaaaggatttatagtatagtcttatatattgacattttagtgaaactatttgatatttgaacagaggatatatgtctcccgagtatgcatgggcaggattgttctctgagaagtctgatatctatagcttcggagttctgatgttagaaatcatcagcggaaagagaatttcacggttcatctatggtgatgaaagcaaaggccttcttgcttatgtaagtgaaacaacttactgttttaacaatctaatatttcatcaaatgcagacacttccctgtttccttttctaaaacacttcttcacattctttagacatgggattcttggtgcgagaccgggggatcaaatctacttgacagagatcttactgatacatgccaagcattcgaagttgcgagatgtgttcagattggtctgctctgtgttcaacacgaagccgtcgacagacccaacactcttcaagtactatccatgcttacttcagcaacagatcttccagtaccaaaacagccaatatttgcagtgcatactctaaacgatatgccaatgttacaggctaattctcaagatttcttatctgtaaatgagatgacagaatctatgatccaaggaaggtaagcctaaggatcttgttatctcactacagaagtagtagtatatacttgtaaattcatgaacatttaaagcttaagattttgatatctcactctattttcttaagcatgtgatctcataaagccccaatattgcgttgacacgtcatcattttcggtataatattgttattaagcgtcgcaaagataaaaatatgctttttgatgacttctctggcattctcttctctgcattttataagatcatgttgatggaaagtcttcgactttggttacaagcgtcgatgcccagttggttagatttggatttctccgctatactttgtttctttgtaattaaaaaccatgttgcttcgaactttggaacgtttgggttatgcactgaatgtgttcgatgaaatgcgtgaacgagaatttaaaattcaaagttttgggcagtgggggcccaatgtttgaagccgcccatgaaaagtcatacctccactataggaaatcggagctagaactctgcactcttcttcaggtaagcttctcctaaatccaaagtctgttgctttcgatttcatatcagggtaacattctttcccaatgaattgaaaagttcttgtgttggtatttattccccaaatttgattaatctacagaggaaatagaacttttagctgcaagtaaaatgttgcaaaaacgttcttgtgctctgttactttctagaaaatggagaaagttttagctgcaagtaaaatgttttgcttttgtctttctgttactttcctagaaaatgtgttggctttatttatggttaaggcccagagatgggaatatacaaagttatcttctaaagcaacatggaatataaaactagtaaaacatttagttttttgacttctaatttggtgtcaccgtgtgattttgtgaatggaaagatgtgactctagtggtcaacgaggtctatgatttttctttccttttttatattgcggtcacgatggctttactagttattataataatataagttaggagtctccatagatataccatccaagaggtttcatattttatttgttctgttattgcattgactttataaagattcatacattcaaatccttagaagagctcttgcatatcgtatg

SEQ ID NO: 20658 - DNA, 3003 bp, Unknown
  misc_feature (1)..( 3003): 2750-1469P.txt file - cDNA_ID_1827733; gDNA_ID_1620767; Annot_ID_50128
agcaaggatctaatggacacaaggcaattttctgcagcaggagaacttctttccattcgtcttgcacgttctgagctaggtatgacttacaatataattcaaggaccttttgtatcttttgtaattatatcttccacttctttgatattgatgttttcgatagaagcatgacttattgttcaattcttatcctaaattcctcagatgtaaataagcgcaagatgaccattgttgctagtacagtgagcctgaccctattcgtgatctttggatttgctgcatttggtttctggagatgcagagtggaacataatggtaacacattgatgactttactatcgaacaatctctcactgttcatctaatcatttggttgtcaataaaattgctctgttacatttgttataagatatcgttaaataaaaaggtgttttttccactactaaattgactgacttgtatattatttttctggtacattggtttcggcctgttttaaaaactctgaatatactcacttggcactgacacacatattctaacccatattttagctcatatatcaaacgatgcatggaggaattttctgcaatcacaagacgtcccaggtttagaattttttgagatgaatgccatacaaactgccaccaataatttcagtctatcaaacaaactcggtcctggtggatttggttctgtttacaaggcgagaaacgttttatcctctttgctctttttcttttctgtcatttcttgacatgacatttgcaacttgtttcagggaaaactgcaagatggaagagaaattgcggtaaaacgtctttctagcagctctgggcagggcaaacaggagttcatgaatgaaatagtactgatatcaaaactccaacacagaaacttagtccgggttttgggatgctgcgtcgaaggaacagagaagctattgatttatgggttcttgaaaaacaaaagcctggatacttttgtctttggtgggtcacttcttacccctttcgtgtagttttcccctttatatctggaatttcttatctgatagcttgtatacttagatgcaagaaaaaagctcgaacttgattggccaaagagatttgagatcattgaaggtattgcacgtggacttctctatctccaccgtgactcacgcctcagagtaattcaccgagacctgaaggtcagcaacattcttctggatgagaaaatgaacccgaaaatatcagattttggtttggctcggatgtttcagggaacccaatatcaggaaaaaactcgcagggttgtcggaactctgtaagaaccatcccttgataacatattaaactagattggtagtcatatattaaattgggtgaaactatttgatctttgaacagaggatatatgtctcctgagtatgcatggactggcgtattctctgagaaatccgatatctacagtttcggagttctgttgttagaaatcatcagcggaaagaagatctcaagtttcagctatggcgaggagggaaaagcacttcttgcatatgttagtaagactttatgttttcatgcatttgcagaggttgcaaaaggtttgttgctttgatattcttaagagtggaaactgaaaaacaggcatgggaatgttggtgtgaaacccgagaagttaattttttggaccaagctcttgctgattctagtcacccatctgaagttggaaggtgtgtacagattggtttgctctgtgttcaacacgagcctgcagacagaccaaacacacttgagttgctgtctatgcttaccacaacatcagatcttcctctgcccaaaaaacccacatttgtagtgcacactagaaaagacgaatcaccgtcaaatgattcgatgatcactgtcaatgagatgacagagtctgtgatccaaggacgttgaaactgtagaattggaattattctctataaggatcaaaatttctaatggttgtaaaattacatcccttcctttattattcagaaactttttatctatgtggaaactgtttggtaaaattgactaaggtatattttattaggcatgattacatgattccacttcccactaaattgacaaaatactttgctcaaaaacaaatcgttgactctacttcattttaagacttcccgggagattattctcgggcctagtggcacaccaatgttgactgttgaattcttcggttcttttggacagaaacagttaagcccatatggttggagttgggaatcagtcgattagggtcattacgggtctaacgacattagcgaggctcggaggttttttttatgcactgcaagtgttcgaggaaatgtctaaacgagataaaacatagcctgcatttcaagaaagttattgtgttgtaatggtgaagcaaggattggattctttcgattgatgcagaactaataaggacttgaacaatgacaacgttgcgtatctgattgggtaaggacttcttcgtgccaatctatcatgtatgcattgtttctattattgatgcagagctaataaggacttggaattgtctcccactcattcacgttgttatttgtttagtgagcagttactttctgaacaccttttttgtgtatttaagtaaatgattgtctttgaatggaatagaagaaaatttgcagtaacttattctaaagtctttgataaccaaagtcttcttctttttgttcttgatagcattgaacaatgacaacgttgcgtatctgattgggtaaggacttattcgtgctttgacacttttgttctctattatcaaataacgcatgatttttggaacattagtaaagattattaaataacgcatgatttttgttctgtattattctcacaagtcagtccctgagttgacaaaacaaaaaatgtgcaaagagagtttttttttttttttttcttgctttctcgctttatgtaaagctaatctaaaaaagatagtttttggagagaaataacaaatatg

SEQ ID NO: 20659 - DNA, 3003 bp, Unknown
  misc_feature (1)..( 3003): 2750-1469P.txt file - cDNA_ID_1827737; gDNA_ID_1620767; Annot_ID_50127
acgaacttacgatatatcgtgaaatacaacaaatctacactaaactgacggaattttctatgttctctttggtacattggttttggctggttttaaatactcttaatatgctcatttggcactgactcacaaattctaacccaaatttcagctcatatatcagaagatgcatggaggaatgatttgcaatcacaagacgtcccaggtttagaattttttgagatgaataccatacaaactgccaccagtaatttcagtctatcaaacaaactcggacatggtggctttggttccgtttacaaggcgagaaacgttttatcctattcgctctttttcttttctgttttttctgaagatgacatttgcaacttttttcagggaaaactgcaagatggaagggaaattgcggtaaaacgcctttctagcagctctgagcagggcaaacaggagttcatgaatgaaatagtactgatatcaaaactccaacacagaaacttggtacgggttttgggatgctgtgttgaaggaaaagaaaagctattgatttatgagtttatgaaaaacaaaagccttgatacctttgtttttggtgggttacatcttgcctctttcttgtaggtttcctctggaactgcttattttatagtttttacatggtatttttgcttaggttcaagaaaaaggctcgagcttgattggccaaagagatttgatatcattcaaggtattgtgcgtggacttctctatctccaccgtgactcacgcctcagagtaattcacagagacctgaaggttagcaacattcttctggacgagaaaatgaacccgaaaatatcagattttgggttggctcggttgtttcagggaagccaatatcaggacaaaactcgcagggttgtgggaactctgtaagaaccattcttcgataacatgataaactaattcccttgtcatgatagtcatatgtgaaactatgtgatgtttgcacagaggatatatgtctccagagtatgcatggactggagtattctctgagaaatcagacatctacagcttcggagttcttctgttagaaatcatcagcggagagaagatttcaaggttcagctatggtgaggaaggaaaagcacttcttgcatatgtaagtcagcctttatgttttcttgcactttccgattttgtaaaaggtttgttgctcttgtattgttaagatctgaaaccaatgcaggtatgggaatgttggtgtgaaacccgaggagttaatctcttggaccaagctcttgatgattcttctcatccagccgaagttggaaggtgtgtccagattggtttgctctgtgttcaacatcaacctgcagacagaccaaacacacttgagttgttgtctatgcttaccacaacatcagatcttcctctgccaaaacaacccacatttgcagtgcacacaagaaatgacgaaccaccgtctaatgatttgatgatcactgtcaatgagatgacagagtctgtgatcctaggacgttgaacatcaatgtgtgatggaaaattttagaattggaattattctccaaaggatcaaattttctaatgttgctaacttcaacgtagattatttcattatgttaaaacttaaaagagaagatcacatccaaaattatgcaaaaaggcttgttcaaagagaagagagaagagttggtcatttcctaaacttccaatttggttaaccaaagattatccagttcctgtttcgtaagcatctcttgtgttttacttcgatttcccgattgatcagtgtcattcgatcacagctcaaattaagctaaagacgagaaaccataccagtgaagaagaagaaggagaagagtagaacctgatcaagcatgtcctagaaaccataccagtgaagaagaagaaggagaagagtagaacctgatcaagcatgtccttgaaaatagagatttgacatagaatcgcacctgaattctcgatctccaaatctctctatctctctctcaactctcgtgcttacgcttgttttcaaattcaaaaacataatcgttaagagttgagttgggtgggggggggggggaataatattttactgggccttatgggcttatattggccattcgtattttggaccttttaatattcgaaaatacgacccgattcggaatgtgtttggttcggtttgtatttttttgtggtccggttcagatttcgagtttggatttggagaaaagcttgtgttcgaaattctagtgttgtagaattgactgttgaagtcgtcttcttctctccggcgaaactggcacaccaatattgactgtagaattcttcggctattttggagaaaacagtcacgcccagtcgcccagatggttggagtcttggagatggaattgggcactagtggagctctgaaagttttgattatgcatttcaaatgttcggtaaaatgcctgaacgagaattaatgtagtctccaattcaagacagctgttccaatgaatcaagtaacatttaaagacgagtgttgatgtttatcatttgcagattctggaaactaagagctggcgacaagaacatgggaacatcacgggatttttaatctgcggtcaatcaatggattcagacttgtgaaagttctcgtctttcgatatggttgcagagtatcggtggctatctttcactggttctcagcgcaagaagctaaacggacatggaaatgacaatgttgcgtatttgaatgggtaaaatagttggactttgtttgttgaagttatgtaactattttgataaaattttgtttgtattcattaaatagggtttaacttgatcctgtataaagataagtgtggttgatctggtcaacattgtttataggtgcttgaaaatagttctcactaagtccctctgtgtttttgttttggctttcttactctgtttgcttcttaaaataatctgaagaagatagtttttggagaggaaaaaaaccagatg

SEQ ID NO: 20660 - DNA, 3000 bp, Unknown; identical to SEQ ID NO: 5187
  misc_feature (1)..( 3000): 2750-1469P.txt file - cDNA_ID_1827773; gDNA_ID_1620768; Annot_ID_50157

SEQ ID NO: 20661 - DNA, 3003 bp, Unknown
  misc_feature (1)..( 3003): 2750-1469P.txt file - cDNA_ID_1827785; gDNA_ID_1620768; Annot_ID_50154
aaagtagcctcctgctctaagcattctattaacttcaagaagaagtatcccatctgtgtaattcatagaaacaaaatgctgtagtcacttactatgctaaagctcaaataacattagaggagaagcaaaaagccagaaattaaccatcgcgtgtccaattaattctgcatctggaacaatgaatcatctcaaaagactggcttggatacaacaacctccgtgtggcaaagacagccaccatcgcaggaacaccacgctccaatgcaaactgtatctgattctcatgaacatcttttggtgctacagacaaggttgtcgtgttacgctgcatcaaaaacgcaccaaagctcgccacaccacagccaatgtccaaagcaacacgggtgcgtgatccaaatgtaatatcaggaatcatctgcaaatttcaatctaagagaatataagatcaacacaaaaaaaaacagattagccaatacaccaaaaaaacaggtaggaagaatcaaaaaacaaacctgggagatctggtctaagtactgatcagctccatggatgaattgagttccacctccagggaaaacaaacttatctttctctcttctaatccaattttgacctcctttatcttccactaaacgtgtatgaggcacattattgaaccatatctacaaagcacaaatcaaagttagtgactttacacttaaggcttagataaaggtaagaacttgatcacactatttcaccttgtctctgctctgtggccattggattggtttcttataaccatctggaggtggaatcaagcaatctaagctctgtttaggacaatgtctctcgtaattttctcctcgatctgtattgttcaatctctttatctcttcttcgttgtctaagcaaggaatgtaatctatcttcgtcttgtcacacaatttgagtttctcaatctgaaaaccgacttccggcgattctttttcctcaaccgacgaatttccggtggctgatttaagctcgtcgatggaatctggatcgaatccgccgatttcgaaggaatcagacatggcaccattctcgttgatgatacctgttctcaccactgtcggtggaagcggaggaggtgatattttgagacgaggacgcggtggaggagatggtgccaccgccgcgacggatgttatgttggtttgaatagcttcggtgacgtttgaagaagaggagatgggaaaaggaagagatggataagagaaggaatctgagaagtgattgaagagaaaaattgttgagattgagagaaacgcaaacgcaatcaatttaaccaatctcggagttttgacaacgtctaatccaacgtcggagagtttcatggcggtttaaaacgccggcgatctgatgatcgctacagagtaaattacaacagatcgagcaaaacagagagagaaaggtggttcctttttttctttcagagagacggcgaggaattgatgaagcagacgctgcagacgccggcgacggtggagagacgtaggagagtggaggttgagacacgtggatgtggtggtgcggaatttgatgtgaagagagtgaagggacgaaactcgacgagtcgcatgaagacaatgaaacagaagaagaaaaagaagaaagtgtacagattaagcaaaaaataaaaaaacgtattataaacctaattagtacctataattcaagtttatagcataaggtctctatttttttatgatttgcttacattcccctaatggaaataaattacaggttttggtcaagacaaatcagaaactagtgtcttttaaatgtggattttaaaactttttaatttaactgttagaagatgagattttatttatttaatgtgatggttgaggatctaaattgaatgacaagtttcagttaggtattgtgttgacttgctgactttaagagagagtatggtatatcaaccacatgctcacgtgctttaatttacagagtgcattcgtaccaataaaatatcaattcaaattttattttaaactatgatgaaaataatataaaaaacttaaaaatctttttttctataaatgaaaacctttatactagtggatgagtaatggaatttatacagaggattgtatttaataaaatgctcttagacttattgattctgctaggtaaatagagaagctcttctcatttagcaccattgctaaatggaccttttttgtgtgtggtagccttattttttgtaaaggccatgtttatgtttagaatagaattttgtaaaggccatgtttataaattaataagaggatagaagttggaaataatctcaactgggccaaaaagccttcatttcggcccatttataatactttggaatagagattagattcttaatatttgttattacatatttgagcgcgtactttaacggtacggaacaccgtatatcgtgttgggatcatgcatttatggttgctttactacttccggtgactggcgacttcgacgagctttatggtttaccgtcaaatacggtataaaaattctagggttttcttctaatcggaaaacttcctcgagaattgttgtgaatttgggttcttcgtctctacttagaagctggattcgttatttggttggctctccaacaacaaatttcaggtaagtagcgagaccaaagatttcaaatttcagtcttcttcttctgtttcctttccctctcgttacaattgggttctcaatttctaacttacatttgtttatttgttctttaaatgttggaatttcgtgaaaagacccgagcttgagtttagtggactgttttgtactactttgtgagactaggtttgattgatttggtaatttctttgtggttgaatcaaccagatctggtcgctgcaaatttcaaatgtgaagaaaagtttggtcgttggtcaatttttcttcgtttcccaagttgtttttgtttcaggatctggtagagttatatagcctgctaagttgaatatg

SEQ ID NO: 20662 - DNA, 3000 bp, Unknown; identical to SEQ ID NO: 5176
  misc_feature (1)..( 3000): 2750-1469P.txt file - cDNA_ID_1827789; gDNA_ID_1620768; Annot_ID_50153

SEQ ID NO: 20663 - DNA, 3003 bp, Unknown
  misc_feature (1)..( 3003): 2750-1469P.txt file - cDNA_ID_1827799; gDNA_ID_1620768; Annot_ID_50150
gttaataaattgtggtgttttttttgcctggtttccgaatccaatgcctatgccgaggaagattcgaccaaggattaacatgaggatgtttttggctgcagcgttaatcactcctccgaggaagaagctgacagagccaacgaggatgcttcctctcctaccgtagattctggtgacgtaagaagctccgaaagttgagattaaaccggcgaagtagagagaagaagtgaagagtgtgaggatttgattgtcgtatttgcagtaatctgtttcgtttagatgcatttgctttcttttgtagatccctgggaagaactctttcaagaaatcgtccattgatgtaacaccacctgcgtttaacaaggacgaataaacaaaaatgagcattggtcttgcataggttccttgatttacaagaaactaagcagtcgacacttaaacaaagctgaagctaactctcgtcagagagggaactgatattttcggacaaaacaggggaaatttaacaaaactgaagcaggcccttttcaaaaacaatacttggcagtttcagaatctggctatttgattggtataagataaaaccagatcgagaaagttatctaaccagagactccaagatcatagccgaaaagagagcctcccatggatccgacgatgcaagcgaagatgaagtaagaagtgatccgatgttcatagagatgagctctctttaggcctccttcatcggtaagagctccaccggccatggctttaaaatcttgaagacaaaaggaggaatattctggtctccctctttgtaataaaatttgactgagggttgtgaactagttgtgatcactatgatcaagattttagagataaataaaaaggttggatattagcagactagctgttacactttgaccatctatctttccttatccctttttctaaggatatatatatgacttcatctttcttgattattacaatgactagttggtaataattttcttgataagctatgtccttttaaagaaatttcaaatatggtgatgatctaaaaaataaagatatttagatcattttctatataaattatagtatatctcgactccatgtcatattttatccataatttaatgctagcataccattaattattttctccataaatgagaaaatacatttccctttctattgaattgtatcataactttgatattaaaaccgtcttaattacctgagttgttcagttgatctagagattttttttttttttgcacaaggtattgagaaggtgtgtccaaagttggatcgaacttgatgaatgttatttgagtgacaatgtcatcattttttggcgatctacatgacagaaaaaaaagaaagatgttgtaagagttgtttataactaccacagatacaaacaaaagaaagagagatgctaaaaggagataaacaatatttttactctttaagacatcatttatcctctgtgtcctctaccacataaacattcctttgttggcttgagggtttcttgagttagcttcaccaaatactaattttctatagcttatacctttcttcttgttactggtttcaccggcccctacattgtggtaattgttggttcatatacttttgacgcattatttggcttaattacatataagattaatagatacaaaggacatgcatttgttgaacttacatgtgtttggacataagttggtatcgtatccaatccatcatccgcattaagcttcctttgcgcatcgctcttaaacaaccatagattctacgaacctataagggatctcaacctataaactcaacgaaacatgaatgagatcagagagagagagagagagagagagagagcaatggtaataagaatacaaaaccgatttctgatacggttttgcaacgtgaaaagatcatgtgagatattttagggatttctaaactgattatctatccgcattacaaaaatgtaccgtaaaacatatatctaaatacacaccacatttacgatgtataactttacgtaatagacatgatatctacgatgagttaatttttaaaataagatgtgtttgccatttttatcaactatcaccattcacccatcaaactattattttgacaagggaaattgtcaaaagtttgaatattatacgtagctcatgataacacaccgattaaagaactcatctactttgtgatatcaatttaagagtgatccatcattttcgattagcttgaatgatagaaaatactgattgttgaattgttttaaacgagctaataataataatttctacaaagtgatcggacaaaagaataaagtccaatgaggatgagacacatcagattatttaacataacacgtcagcaaattaagggatcgaagaaaatggtttagcttgacacaaccgccaaagcaaaaaggctgaagttttcctttttaggctctttctcttccacgcggaaattaataataaaaaagatccaaactttgaagatagcgaagagcaaaaagataatctctggctcgatttttgttggagtccttgattcgagcaagtttaaagactcgagggttttcttctggataacgtaattagatactcgtgtaagtgcaatttctctctttttcttctgttttatgggtgttggtgatttagggttttgcaaaatcgttttgtttgctgggtgattaagcttgggtgatttagaaagacgaattagatcaaggaacttatttcttgttatgagtcaatttgggttttaaagattcaatttttgatcagaatataatctaattgttgtgtgttgttactcgtaatgcaggttttctgaaagggtcatcactgctattgtcatagcttgagaaaggatctatttttaatatcagtgatattggtatctatgagatttggagtagttgtttggaggaacgtgtcctcttgcttgatgtgaagattgcttcttgttgtttgctgtttcttaatg

SEQ ID NO: 20664 - DNA, 3003 bp, Unknown
  misc_feature (1)..( 3003): 2750-1469P.txt file - cDNA_ID_1827819; gDNA_ID_1620768; Annot_ID_50144
gacgaagactaactttgagaacgagagtcgatgtcttgactccatgggacttgaggaaggtatcatcgtctccgtaagaccagggtcggtttcgagaatttcataatcgcctggtaaacaacaaaagacgagacattttagggatttgggaaggagaaattaatttgattttggaccaaggcacaaaacggtgcgtattaggaaaatgagatttttagaagtccgtgttttgcaaaacgaacctttacttatcaggtatttgttattttaacccctactctaatgtttgaataaattttaaccagaaaacgaaaatcacacacagtagtacggttttacgcggtggaggaagaatcagcagcgacggtggagttggtctgagtctcaccccaatgccaaagcatactctcccagaaacagaaatcttcaaaacaagtcgtaagtctcttatctttgatcttaatcctccaatgtccgtctctgtaattcgctttctcagcttgtctccgatcccactcaagttgcgccttttgtttcgaactcagtagacaaaacctctgcaatttcttaggcatcgcgtcgtgcactctccaccaagttttgtgtgcttcatcgctcgcgaattgatggtatccaacgacattccaattgcaatcgtagtctctgaagcatacccatggtttgttgtaacctaggtaatgaagaacgtagagtatcggaggatcagctccaaatagtctcgtcttagatttcctgtgcttaggtgtgtctccttcccagaaatgcttcaagaaattcatgtgttttggaatccgatgccaccatgtgaatatctcgttaaggtaaccttggtctcctccattgtaggaattgatatcgttgatgtgatccattagtaactggaatgttgaatttgatggttcaatcaccattagaccggagttgaagagcgtaccgtcgtttccagttgtggagatttcggggtactcgaagaggaaatccatgtttctgaggataagcatgtctgcatcaatgaagatgatcttgttgtattctgtcaattcccaaagacggaatttgctgtagttccattggttatatgcatttgcttcagctttcgggtttctgattctttgaaatgtgtgaatcttccatccagctgattccaagccacttctatggtattcactgatcgaatcatcgactagtattaccaaattgcgagtagagcctgacattcgaatgctctgtgctactgcaatggctccacagacaaaagcatcatctgagtgcaagatcgtcgcgtacgcttctttcttggcatttgccgagtagaaattatctgcaattgaatcataatcagcttaggaggagagaatagagatgtcaaatttagctgatacaaaagacgaagaaacttactactgagtcactgacctttagcttgaagaggaacagaaagttcacaggaaccaacaggaagttgtaacttttgtcttaactggtgaagtttaggcttatacagccatatgtttccttgacgggcaacaagttcttgacccgtaaaaagattcggtattggaaagcaatctgataccaaaatcacatgaacatcatgaagcccttcagaagatgccgccactcgagctgctgcaagttgtaagtgcaatctagccacatctcttgaccattttcctgacttgttacatgggagcttggcaatgataagatcgattcgagacttgtcaggaacttgaatccaaggaagagaaggacaagtggggactttgaatttttcttcctcgtcaatccattccgggtataaagatttccaagttatgttacttgcagcatggtctagatgcaaagctatatgctgacagtgagattttatgaccacctgccatcgattaatctcgttatcgttgagatttagaaagccaattccttgatactcgcttctgccagataagtaatgctcaacaacaagtgacatactgttccagttgatctcagatgtagctatatagcgaggatctgtggttacagcaggttctagtatccatttgtttgcaaaacttgatggatcttcaggaatttgcaacggtggagaacagtagagtgtgaacatagcaaccagcatcataagaaacaaaacaagtttcagactagagaagttgacacacatttcaacatcgagagtgtatccgtttctttggaatctcttcgtttttgttttctcactatatatgtaaaacaaatgcactatgtcaagccaacagatgaatacagatctctgtaatgcacatactcaaccacattgctctcatgatctatgatcctatctgattcccctaagttaggtaaagtagtttccattgaactcaagaaactgatgaagtagaagagaaaaagacttacctggaaatgtaaagtcgatgacttgactgacttgacggcgccatgggactttcagaagagagcttcattctcactgtaagaatattaagtttgactttcctgagtgagagactacatgaagctggatgcatcgagcattacaataatcacacgtttttgacgctaatccaaattatattatattagcggacggatcggaacaaaatcaacacgatgggtcaatgttaagtttgaatttttttgcggaaaaatcctgatctattagatgtttcctttgtaaaaccctgatgttttattacttaataaataaaccctcaaattaggttcagttaatcaaaaattaagtttgtgttgaaaagaggaataaccaataaaatatagggtttgttttgcaaaaacacttttcttcgtatgagtcgacgagtctggggaccttttagttttctcgattaaggaaaggaagatctgaaagtgaacgcgaaatcacttcgccagcgttattgttaacaagaatcatcagattagtcgccgtagatctgaatcaacgtcgtaacagtagcagaattttgcggtgaaacgatg

SEQ ID NO: 20665 - DNA, 581 bp, Unknown
  misc_feature (1)..( 581): 2750-1469P.txt file - cDNA_ID_1827827; gDNA_ID_1620769; Annot_ID_50188
ttctaagtgcaggtctatatgtgggtgcattcgggccttatggcaccgagatagtgcaacttaagcgtaagtatggtcggtgggatgatgcagaaggaagtaactcctcagatatagagttctttgaatatgttgaggctgtaaagttgacaggggatccaaatgtgccggctggccaggttattatcttttttttaattgtattcaaatcatgacatttttgtatgaggtgaacaatctaagatagggtcacaaattgttggtaggtgacattccgtgcaaggattgggaatgggagtcgcatgacgaatcatggattgtttccagaggaattgggagtggtaatgataactttcctcatctcctgagcttcagtttaaaaaacagacccaaaacataagcatgctcagacatgtaaatcaataaaagatcaagaaccataagcttaagctaaacactttaccagaaaaagattaaaaacaatctaatctcctattgaaacaattgcttagacatttcatgggttccagccacattgacatttgaatgaacagcttatccagaagttgtttacatatatg

SEQ ID NO: 20666 - DNA, 3003 bp, Unknown
  misc_feature (1)..( 3003): 2750-1469P.txt file - cDNA_ID_1827838; gDNA_ID_1620769; Annot_ID_50184
tttgtccattattccgtgtttaaagtaatttacattctcttttaagatctctcagtccaaagacaatgcaaacaataataatttctccacttgtttctcatcgtctctgtcttgctcgtgctgttccttgcaaccgtcttctcaacaaccaccaccgtgctcctccttcgatccgcctctcaaaccaccgttcaaccacctcactccgcctcttctcctccgccggtagaccccaccaccttctatttcccttttaaactttttgtttccttttgaaaaagatattttgcttgcgtggggcaattccgtcaaagcgttaccattcgggataaattggtcattttttcatcactgtgtctctctattgagtctttagggtctctctgtgtttgcaaatctgacgccgagtattttgctaaagcagcagccagtcgggacagtgaaatggcgactgaagatgtgcaagatcccagaatcgctaagattgcctcttccattagagtcatccccgacttccctaaaccaggtctccattttttccatttataccgattaatatcgtctctagtcttgatctgcgttgggatcttaaggttttaatttggatacttggcaggaatcatgtttcaggacataacgacgcttcttctcgacactgaggcctttaaggatactattgctttgtttgttgatagatacaaagataaaggcatatctgttgttgcaggtaacaactcgtatggttctgtttggtactccaatcgattaacagcttgtggatttagtttcttttggcctttttagatactgagtgctttagcttaaactgaaaagttgaaatgaattggtggatgatttttggttctgcctaaattgatgttgtggtaaatgcaggtgttgaagctagaggtttcatttttggccctcctattgcgttggctattggtgccaaatttgttcccatgaggaagcccaagaagctacctggtacatttttatttcttcctctagttgcttgtgattttgacattaagttacatgaaaggtctcaattaggaagttgttagtttaaatggcttcttgctccaagtctacactttatcattatctcgaacattagcaaggtgacttttatcttgcagtgtctttgatcaatatgatgctactcatttgctagatcatttttctttgtggtaacttgcagtaacttaagtggttgttattttttctgttacatatcaatggacttagttgtgtatcttgaccagttacaagaaatgtattaagccatttggaaacttatgagcagtgtcaaataattgtcgcattccttgtttatccatggacgttaatttctaaactgcctctgcatttggttcctttaacagggaaggttatttcggaggagtattcgttggagtatggaacagatacgattgagatgcacgtaggtgcagtagagcctggtgagcgtgctattattattgatgacctcattgccacgggtgggactctcgctgctgcaatccgactacttggtaagtccaagatttgataatgcagcatatgcagttcagttaaacttgactatttctcactcccacaattggttggttttgcagaacgagtaggagtgaagattgttgaatgtgcttgcgtaattgagttaccagagcttaaggtttagcttatttatctctgttttactatctgcttccaatctcttacactgatttgcttataaagagatatgtgggctgcaatggttttgtagggaaaggagaaactaggagagacgtcgctatttgttcttgtaaagtcggctgcttaacaagaaactggaagagaaggttattggatcgagtgttgatgctatttttcatgtatggtgagacattttgcgtgggatttgatccttgttgtttcaacttatcataattggttcagactagaaaatggcatttgaatgtcaggattcgattgcagtttcctattgttccacttaaaatccccgattaataaggtgttatgggttttatttatagaatcaagttgtaatagtagactccaacaggggctaaagtcttggtaacgcaattcttcttttaagtttcgcagcaccttgctcgttacttctcttctcaactcgtaaggacacaaatcacaatgctcgtccatgtcccatgctgatgagtataatttgacaataagcttaggaaggtaacaaatctataaacttaggtaagatcctcgtttgcgtagtaaaaacgaataattacatatttgatttaatctctttttctctctcgtttttgggcaaacattacttctctctttcctcaaaattattacttcatgttgttacgtttccatacagatgtatacaataattattacagtagggtattttgggaatgtttgaaacatgctatagttgaaaacagatataaatgtgggacctaagacaaaaattcaaattatcttaaattaaaaaataaaaataaacaaaaagaaaatcacagcgtggttgctgctggcttgttgcttacattgacatgaacaagacacacagtgcaaaatgacaaagagcccttcatcgatttcgaatcttctctctgagtaaatcaatttcacaaattcgaggtttttggtttttagcttactacactactccaagaagaaaatctcaagttaaagtcatttcctatcaaatctcttttcatggcggctgctattctcgtttctcctgttcgctaaattgcgtcattttcatgtaagcttctttcattttgcttaccaaagctcgttttcactatgctttagcaacaacattattgtagaggttaaaggcagcaaaatctataggttaaggatttcttgtggttaatttctgaaattcatgtttctgtgtgttttcttagtgaagcttattataaaagcggcgtagatctgtgattctactcattgcatttccgcgtttgtgaggagaaagaggagaagatg

SEQ ID NO: 20667 - DNA, 3003 bp, Unknown; identical to SEQ ID NO: 20666
  misc_feature (1)..( 3003): 2750-1469P.txt file - cDNA_ID_1827838; gDNA_ID_1620769; Annot_ID_167440

SEQ ID NO: 20668 - DNA, 3000 bp, Unknown
  misc_feature (1)..( 3000): 2750-1469P.txt file - cDNA_ID_1827842; gDNA_ID_1620769; Annot_ID_50181
atacaataaaagaagcacatatacatcaagatctacctattaagataacaattaagcattcctcattaggaagttaggttatatataaggttagctaagatcaaattgttttagaatctgctgactggaacttctctctttgtatagaggtgcaagagcagcggtgtgggagaacttcaagaacaaccctttgtttgacatctcaacagatcacccgacaacatactacgaagacatgcagagagccatcttctgtctatgtcctctaggatgggctccatggagccctaggttagttgaagcagttgtgtttgggtgcattccagttatcatagcagacgacatagtactgcctttcgcagacgccatcccctgggaagaaataggagtctttgttgcggaaaaagacgtccctgaactagacacgatcctaacctcaataccaacagaagtgatcctcagaaaacagagactcctcgcaaatccttcgatgaaacgagccatgcttttccctcaacctgcacaaccaggggatgcattccatcagatacttaacgggctagctcggaagttaccccacgacaaaagcatatacttgaagacaggtgagaaggcactgaactggactgctggtccggttgctgacctgaaaccttggtaaagtcagaaagagaggaatctttttgtatatcttgggtttcacctagagcatacgttgttgcctttctatagcacttcaaaaacattagaagtccaagtcctccgagtggattttttttgtagataacattagtacatttactcgaggtacatgtaccaagtttgttgtacattttctcttcgattgatcatataatactgtacactccttttgtcttggctaactccaatcatgtaagtttcaatgtccaataacctgaaaagttatgaaaacatgtggtaattaattttgttgtgaatcaaattagaatccttattaaaaaagaaaattatttattcaaaaaaagctcgtagatgaaatgggcctaaagtctactaaatgggctgattgaaggaaaaactcgaactaatctaagatctttgctcttgagagagaacgagagaggcggccatgggaggaggaatgggtgcgttttggggaactcgagtgatggaattagtgaagaagcacgattccggtggtcttctttggaagcggatcaagctaacccctactcgtaaagccaatgccaaaacccgcctccgtcgtgtttggcaggtactctcctattccatttttagggtttatgggtttttgagagaacatttctcttttcgtagtctagatcctcttatctgcgttcacttccctacaattacccgccaaggatagattaggattgaatgtattgatggatttttcgtgttgaaagtattgatggattcatttcaagatcatcagtttcgattgcaaaatgttgttcagtctattgtgatgtgctctccttaggtctgagtagatgtaatgagttaggacaaggccaactgtgtagtttgttcttggtatatggcctttaggcttctatgtatctttctgtggaactaggaacagagtaggaacacttggaattcatttttcccggtttggtgtttggtatcatgcaaaggttgtccatctctcaatatgcttgtgttattttcgagctattttgggctatcttgtgcatcacagtgtgttatacattttttggtaaagcttgtcgatctaccaagatgtatgtggtgattttgagctcataccacctaggaatttataaatattataagacccaaccctcctatatattcttcgacgcaagtattgttttaatagttatgagagtctcttgcagaatgaggctgttctaagggcgtgtggtgaatcagatgcaccaaatccgccgggagctagcaacacaaaaagctctagcaatgcggtgaaaaatgcgtaaggccgaagagaagctagtcctagtttgtaaggactcgtagatcaagtctctgtcgttacctgattttacaaaaataatatttgaaccttgtgtttggttattagttttgcaaaagaagaggcacctccacaccaaagcaaaatatggtatttgagtattggtgtttttttttttattattcttgtcatcaagaaatttgttcgtcgcctgctcaatatagttcttttggctacacccgtttatccttgtcgtgccttagttatgttggccgtttagtggctacaagtggatatgtttgtggaacatttttgaaaatcacttgaagcactcttttgtttttgtttctccggttgatcgaaaaaaagtttttgttttctccgtgatttttttcctccgtaattacatgttgaaacaacaggtgaaaataatcttgttgaaaagtttcaagtatttttaaaccatcagtaaataatttttttattcagttaccacttttaatatattccttctcaatgtatactatcaaagtgaaaaaaataccactattatactcattagacctttaatgaaacttttgataaaatatttaaattggaacaaaacagtaaaaggaaaataatactggaaaattaaaatgaatacattagatgtttgaatagaaagtatagcattaataaataaacaatgataaattaaataaaagaaaacctggggttgacaaaaaaaaaaatgaaagaaaaaacaaaaaactgggcaaagtcggatcggtgttgttaaacaagcaaagccctccttagcctttccttcctcttgctccttcactcactctcgatctcgacgcgaaatagctttctctcttccaaaggcaattatcgaaaacctgcaaaaagtttctccgccaagtctctccaaaacccctttctcatctctacttttcttcttcttcttcttcttctactgcgctcgctcctcgctcctccgtctccgtcttcaacgtaatctcgaagtcggttgtttcaatcctgccatg

SEQ ID NO: 20669 - DNA, 3003 bp, Unknown; identical to SEQ ID NO: 15536
  misc_feature (1)..( 3003): 2750-1469P.txt file - cDNA_ID_1827854; gDNA_ID_1620769; Annot_ID_50178

SEQ ID NO: 20670 - DNA, 3000 bp, Unknown
  misc_feature (1)..( 3000): 2750-1469P.txt file - cDNA_ID_1827856; gDNA_ID_1620769; Annot_ID_50177
tgagaagcaattatatcagcaacctgcaagtaaaggagatgaggaatataacaaagagaaacatgattcagggtttaaggcttttggattagggtttaggtcgaaccaattgaacagcgactagacgggaaggaaaactgtaaattggattgcagtaagtgttatccagatagagaatgtcgactggaaactcgtcaatagcagcaacgagagtggttctagcttcgtctgatgcatcagaatcccaccggaagtctccagtgtagagaaaacatccgaaatctccccggaacaaaaacattatggatcctaccacattataccagcaaattcaaatttcaccactgagaaagcgaagccttatatagaaatagattagacttttatcataccaggacagtggtgagcatcgatggccatgagatggaggcggactgtggagccggaggaaggagagcggagggagagagatgtccaggaaaagagagggacgacgcgaagcaaggagaggtcgaaacctgggaaacgggagggaaatagagaggcggtggtgcgggaacagtagagaggaccttgggaccatccgccggagaggccacgagtgtgatcggagtgtatatgagtcaagaagtaggcttgacttccatttctccatcgatccactgatatcagaccactctccatttcggattccttgaaaattgaaattgcaggtgttttgcagtttcaccatttttgtttgcccacttagtgacgatgattccttccgtcttttgggccgtttatgatgatttatgattgggtctgttttgggttttacaaacgaatgaaagtgttacttgctcttacgtaacataacatttcgaactttctcgagttcaaaactaatccatccgttttatcagactgtgtagtcgatgtattggtcattatattaatgagcgttatgaacaaactgggcgacgatttaacaagtcttaactaatccatctctaaaacatatttcaagattttactatgagttattcatctatcaataccaaggataaagagagattctttcagcaatccaaaaaccgataatcatcatacttaaaaattgagtattggtcttatagagagaagctaacaaaaagtattaagggtaacacaagtgagcacaaatagactgtctatgttatagcttaagatgaggctcctttctttgactttgctgccaactgtgtctccggctgtgcaagaacccaacaaaaattatgtgagatcagtgatgaagatgaaatataagtatttgaagatattcagagaggcgttgggatcattaaattacctctttcttcacaggctcttctttctctgacaaaatcaactcaatgtggcatgggtttgacatgtaagctgcataagatagaattaaatcgagagtcagcacaatgtgaatgaagaaacaaacgttgtaaaaacagtcgaatagaaaagaagacatacgattgattcttccatgagcacgatatgtccttctcctctgttttgctgcttggttcacttggatgtgagaaatgaaaagggcatcgacatccaaacctttgacctgataaccaaatggtttacaaaaagttttagtaactaactaaaatcaccatggcaacaaaacaaaaagagtcgtaaaaccaacctcagcattgctctcagcattcttgagaagatcaagaacgaattgagcagatttagcaggccagcgaccttgtccgttcgaatgcctgttctttgcctgagcggtacgaccaacaccacgacagaaacgggtgaaggggatagcttgcttgtgagctatgacatcttccaagtaccttttggccttgttcaatggtagcttccttatggcgtgcgctgtttctctagtgttctgtttcatacaaattcaattcaaaaacacaattagacacatccaaatcatcaacaatgaaactagaatgacaacaatactgttcagtgtgattatttacctaatggcacagtaacatttagcacctcaaacctaatgtaaatgatttggtgtattgcaaattattgaacgactacatctatacaaacccagatactacaatcatgacctaatcaacaatactgaaaattgaaaaaggattcagagctaagctaaaatgtaccatcatgtactgaaccatatgctattagaagtaacattggctcacccattcacaatgaccaattcgattttcctgacatttacgtgaggtctgttatataaaacagaaccctgctttttgttaatcaggttttattcaaactacaagcttaatccccataggaaaatcacttaatctaattcatttttgagatccggaatcagtacaagaaatttaccttgaagtggaccctgagatcggctcctctcgccttgcaagctgcaaacgcaaaaccaatcgaaaccatttcaatgaatactcattgcatagcttgaggtaagccaataacagtgtagcttgaagcaaaaaataacagagactatgaaagtgttcttacatttggtgatattatcgggctcttgagagtacttcacctgaagaaaaacaataagaagacgaagaacataagtataggagcataagttagaagtgaaaacgttgtaacgacgagtctagtgtaacgcatttaccatggcggccaatgagaagaacagaggacggagaggatagagatctcagtagttggagacacttaatatatagtgaaacagaagaaaccctaatcggcgaatacattagttgaactagtgtattaaagtactatttgttcatatgggccttctgggccacttatcttgataagtaggcttaaaaagcccaattatgtgctggtaacacccgacttgtaggctaaaaccctcggaacttgtttcacatcgagacaactctttagacttttctcagtaacaaaaacaccgaaccctagattttctttcacctgaatctgaagatg

SEQ ID NO: 20671 - DNA, 3000 bp, Unknown
  misc_feature (1)..( 3000): 2750-1469P.txt file - cDNA_ID_1827860; gDNA_ID_1620769; Annot_ID_50175
agatgatttcgtgtgcgattcacttgctaactttgattaaaatgattagattagattcacttgctaactttaattaaaatgcttgcacaaatgggcctagtgaaagactctaataaccccaaagcgaatggtaacagaagacaaaaacctatgggcataactgtctttaccttatccctcgccaacgccagaaattttataaataaccaaacgcagcgttgtgtctttttttcgttcgactcatctccaaagagaagcttcaaaaaatggcttgcaaaacgattttgcgttccgttttcgtatcggaatcacgacggacttccggcgcacgtagatgcttctttctccctccttctccagcatcagttccagtccatggtttgttcccggcgccaaagagtctatgtttcaatggttttgcatctgttcccgagcgggctactcggcttaattgcagccataacgatcaatccgatcaaggtccgcctcaagaagctgttctcaaggcaatctcaggtgcgcgccttcgttaatttcttcctagtatctcaaatttttgtggttttgttcgtttggccgaaatggatttgattatcggatgcttggatccttggtgaataggagacggagtttttagattcgattgacgtactagtatttcccggccattagtcggaagttaaaaactgttccgttgtgtcaatttaactcttcctacacttgtagtgattcactaggaatttagattattttagagttactaattaagctggaatggtgaaagagacagatgatgttaattcacgagtgctagtttattggtacttttgtttcccttgtttcattcattttgctggtgggatgcagaagtgtcaaagactgatgggagggttgggaaaactactaacatgattattggaggcactgtggctgatgattctgctaaagattggctcgaacttgaccaaaaggtatcccattccgatattttattcttgtttggtcaatttctagtagagttgctgttcactttgcgttcaaatactatgtgttggtatttatgaagccccttgtcgatttggaatgcattcagtatgtgaaatttaagaaggagatggatattggctgactcaaagctggtgttttacttgccaggtcaatacatacccaacagaaagagggtttactgcaattgggactggtggcaatgactttgtgcatgctatggttgttgctgttgaatctgttattgaccgacaaattccagaggtaatatttcgtcctcttaaaagtatctagatgatttaccggcttatactatctttttttgatacgatatttgctagtgtcttctatacaatattttggctactggcttgataattacaaacagaacatgtatacaagtgcactacttggctttctttacttttgttctcttgctttggtctatactttgtcttctgcagtatagctgctaaatgtttattctgtcatattgttatgtttggatgtgaactatttattttatcaaataatcaaataagagtatatttctatgtagtgtctttcaagcaatattcttataccgagaacacgagtatcctactaatgttgcaaatatgtttttcctccattttaggactgtgtaaagcagactttatcaagcaaaggaaaatatgtgtcggtgaatattggccctatccaagtcgtctctagtgagcaggtttttcccttttccctccttccctctctctcccacacacatacacatatgaaaatccatatgggtttataggcacaagaagcatagagaatcaaaccttatttacagagaggatgtgagaaagttaggagttgaaaattaatgtgatgagaatttgtgttgtttggtttgacaggttcaagctgtgtataatgcaatgaggagagacgaaagaatgaaatacttcttgtaggtttgaagtgtgtagaatcacgggtcttctcttttctatcttctccattgcgactatgtaaattatgcagtgtaaggccaccattaattattatttatacttatctacactaacttctgttagacactccttagacagtgtcttatgcatctgaaggaattagtggatatatcaaaaaatgacttatacgcagatgatagttagataaagcttaatatttgttttaggtgggatgggaaaatcccttcgtatttctctgaagtagagttggagttggttctaagattaatacccagagagttgtaacttcttttacaagtgaggggccagggtcaagaaaaagaatagcttaatgagtgatgaactcttggactataatctaatcttggttagatatagaaacatataagtatcatactatcaatttattataatctggttaggagcataacgaggttataacactaatttttgtgtcggtttgatctagcgcggtttgttatcgttttgctgcttttgcagcaaggttcttgaattttgcggataatcctaagtgtgtatttcacaaaagatgaaaagttgttttaaactgagtactgtagatggaacgatgtctctctgtgtcgtgggagggtggctcacagagctacttagtctaattatggtattgattaaaatacaaagatggagattattgggtaaggagaaaaaagtggaaggtgtggggatttatcttgaatcttttaatcttgcaattaggttaagtggcactgttggccaactaaaagcaaccccaagtatactcaataatgacactcataatctctttctccctctgtctattcctttattgggttaggaattacaaaattcttcaaggagataatgatactaacttgcttacaaagttataaaacatacacgacattgcaatataaaccctaccaaaatccctacttttccatcatttcattcactcacacacgcataacatatttgtagcatccatacataaatacatacatttcgagggaaagagatg

SEQ ID NO: 20672 - DNA, 3000 bp, Unknown
  misc_feature (1)..( 3000): 2750-1469P.txt file - cDNA_ID_1827864; gDNA_ID_1620769; Annot_ID_50174
gaaaccaaaccaactcatcaagagtaccttcttgctcacatttcttttgttctatatccttgcttcttctctctttttctttctgaatagtctttttctctgatctggttttctaaggaagagaagaaagtcatgagaatggatcatttgaaaaagaatacacaaagatggacagaaacggtgctaatatgttagatggtatctctacaaaattattcgaggcttcaagagtttctctcacttttttattcgtgtatgtgcctttttgtactgtcttttatttctgaatgatcgttttatcctttttggtttttataaggaagagtagaaagtgatgcaaagggctcatttagaaaggattacacaaagatggagaacaacaacaacggtgctaatatctcagatggtatctacagaattattcgcagcttcaagagtttctcgcactttttcatacgtatgtcccttattctactctctttttttcgtattgtgatcacaacatttcgtaatagtaagtaaagttgtgtttattaatcttttttggattctcaatgttcctccaatttactatagggacaattagctgaatagcctttttgataacttaatttgtctttatagcatgtcttcatttctcattcagtaacttacatgcacttttaaaaactgtaaaaccattcttacttgtgaattggcgttaatttagaatttcctataacaataatatgttccagtgaataacaaatattttagaatttttttacacaactatagaaattttcaatatttccttaaacctgtacattgttgttcatcttccacattgacaattggtcagtttatacatacgaagaaacatggtcacagtagtaatagattcatcatttatgtagtgatgatactaatactatatgatgaccaggttacgaagaggagacgaaagagagagaagcggagatggagataggatttccaacggacgtgaagcacttgagccacatcggagttgatggaaccatgaccactttcgacaacacctcctcatcttttccattctccggtttccatctcaccggcaccgtcgtctgattttcgcatcttctagtactaaatcaactacatatgacattttctttcaatagtttcataattagtcataagatcatcttatttggttgcaagtacgtacatacatacctcaaaattcaataatcaatctcattcctttaactattcagttttggtaagtttttgttactcatcatctttcacgaactcgttaccgttttacttaaatgaaataattcttagatttttttttccgttcttgtagattttctaggtaaaaaaataatctcatttgctctagatatgttacaaaacattttctatcaaatcatttttctatctacaagaagaagaagaagaaaaatactaattaataaatgaatatttgtctactattagaaaacttttatctgcagtaaactacttcaaaattatttgatgtcatgtaatctacttcaaaatttacgccaaaagaacacgaaatttacatgcgctgtaacaaaaaagttacccaatcatgaaagcaagaatcgaagagaaaaattatttaaaaagcaaaaagaaaacagtaagaaaaaggaaagggaataatggaacaaaaatgaaaaaaaattggaaggatgaaattaatcgaaagcagctcatccgattcccctgaggcgattatggtgtctcctccttctcactctcgctcttagtagtagtctttcttctccgatcgccgactaacctccggagctttcttcggcggtctctcctctctgttttctacttgaggtttctctcttctcttactttttttattctttgtgcatatctctcttctcttactttactcaccaaatttctaggaatactttttctcctgagatttgggcttttaatttagcttaattcttctgttaagtagaaatatatcatggcgaatctatgaaattatttcttctgttaagtagacattgaaatttgttacaatggcgaatcgtgttttttttttggtctgtctccattttttggtattgtctctaagaaaataagacgtttgtggtatttagtttattaggcgaattggatttgttgaagcatggataacttgtatcttaatcccttggggttagttagatgaattgaatggtcgagggaccattttgctttttcatgggaaaccctggctgaggggaccgtgattgggatcgaaacctaacttgctgtctcattttgttagttcaatctttattgctggagatagatccctttcattggcttagcttggtgccgttttctttgacatatacttaattcaatatgtgtgtatctgtagactcaatagtaagctttagattaaccctttatttcatttaaaccttagctaagaactttctgcaagtacaaagaaggaatgggtagggaagggtttgcaattatgatggctatagggttttaattgacttgttgaagtcgtgttctttaacaagttgttgattttctgggcaatctgatttgaggagtgtgggaccagttggaataaatgccacttagtttttgtgtgatggagagcacaagagggagctaagaaaagtaataccctttctcttgccctttttgttggtctgggtgaaacatagcaaggtttctcttgctgaggttattgataaacgggtgagttaaataaaaacgttgatcagcagtgtgtggtgcttggaattcataaggtttttcttctttcttatgcttttggtagttaatggtattgtctattaggtatctgtttgggttgccagcgttatttataggcttgacaagttttctcttatttttgatgtttggctttcatttacaatcactagttctgcaaacttatggttgtttcagtttttgttactctggcttttggtgataggtctatgaaatcaacccacatcttgaatg

SEQ ID NO: 20673 - DNA, 3000 bp, Unknown; identical to SEQ ID NO: 20672
  misc_feature (1)..( 3000): 2750-1469P.txt file - cDNA_ID_1827864; gDNA_ID_1620769; Annot_ID_167430

SEQ ID NO: 20674 - DNA, 3003 bp, Unknown
  misc_feature (1)..( 3003): 2750-1469P.txt file - cDNA_ID_1827870; gDNA_ID_1620769; Annot_ID_50169
cgtgattcacaacacaagagatgcatacgtagctcattacaagtaggtcaagttgacagaaattcatcccactttgctctatacatacattccacaagtttgatgttcatacaaatatgataacaaaacacaattagtaccttgatatgaagaactaaaatgacaaaaacatctcttatcgaacaaatctagtaaagagcgttcaacactaaaaagagaaaacaatgtcttacggcagatgatacaaacactgcaagcatctcaaactatttagagttgagacaatttaatcaagaaggtggcatatctacaactacaacaagatcacatatgagcatagttgaaaaaaactagcagaatcatggcaaagcagtttcccaatactacattcacgaagtgcaaggagatagaagctccacaagacaaaatctaaatgacacaagattacatctactgatctacgcaatcatttgggggaaacctcttttatctccaaccttatcacagatctatcactaaatgcatcagggagggtctaaaatttcgagacaattccagatcattgaagcttttagtgacctaatacacacatcaatctacagagcagtaaggataaaaaccctatcgtacatgatcaacagcgaggaatacaaaggaaacactaaaaatcgaagtgatctaaacccaagggaaagagataaggcaaaaaaaaacctggctgaacttgagagcgtgttgttcaccagcgagctgaagattgccggagacaaagacgagcataccaccggcgggaccagaaggctgacaatcgacggtggtgatgttgtgcttacactgctggaaagggaggccggtgagcttagcgacgatgttctgagagccctggatcttctggccttcgaaggtcaacatggatccttcttggtatagagaaaccaaccctggacgatttgcatcgaaggtggagtagtagtgctcaacgaaagcctttgcaacagcgtctggatccatctctttcttcgtcttcctttttgatccttagctcttgcgtcgtgctttttcaacaggcgagagaggatcgagagggttagataatttactgaaaaattatacgaatggaccaagactagagatactgaaatgagtgtttgacgatactttaaatgggccttatatttttcaagttgggcccgttaatatatgggacaatcaacagtatagctcaattggtaaattgactaacttcatttgattcctacaccatttaaagatttttaatcaaattctgatataactaagataatattttaaagcatttaactaacatggaaaattatgaaatgaaatattaattttggatagaaaatttaaaacatttatctttgtgaaataaaaagaaagtctcttataatataacttgtaaagtaatcctttaaattctaaaagatctaaaacaaaatgagttaaatcctatgtctatgtgttgaatctggaagatcgaggtggaagaaaaaggatcatgattcatgggtgagagaacaaccgttgattggtgtgtttcaactttcaagcaatcccattttaaaaaaataaatttatgtaagcaattgcaaacaaaatgaaatgattatgctttaagatatcgacacgtgtaaaacagatgacgtaccaagaaaataaatgattctgtattttgttttagccatttgttttttctttaaaggaaagtgtatgttgaaattgaaaaaacaaaccgagttatatatatagagttatttgactaaagaaggaagctttggttaaactaacttgtataattcttttgtgtagtttagttttgataaaatggccaaacaattttggtcactttaccaactactgcaaaaaaaccattttcataataataaattgtaacacgccttttatttttattattggagggtgagaactgagaccatatatgcctttgttcccttcttgtgggtccctttagcctttttttttcttttgcctgcgccgtttagtgttttttcttttatatataaatagaggtaagttattttaccaatcatttggtgttattaatagtagtattaatgaggttctaaacttgtttataaaaatcagatcttactaaacaaactcaaagaatctcaactatgaacatttttcttctagaatcgagttttaacatcatcatcagcaggatataattttttgtgtttgaattttatctgtattttttttaggagtacataagcagcttaagattaaaatatatattaatggaagtatgaatgaaaaaagaaaagaaagataatcagataatagagagagagagagagagaaggaagcagacatttgtcttccaccatattcttctcatcttttccgatgatagattcttcttcttcttcttcttctactactacttctgctcctctttcttaagtttctccatttgataattcactcaagtctccagctcctcttcttcttctcgttgctttattcgctctctttcactcatcatcatcacactcaaagatttctgttgtattggagcaagctctagcgaattttcgtactccccttgtagaattttagtttcctgttttagatttcgaggaatctcgctttggaaactttaagctcctgttcaaagtttctacctttgtttattttgtttttgttttcttctctcttatctttcgtcatctttgattaagtaaccactttgatctctcaatttcagcctttgggttgtctaatctgacacgttcctctgtcttagctttccttttctcttctcgtttgtgggaagcctacaaggattaattattaaatacccaaccccaaaaaattcttcctttttgattctctgattcgtccctttttgtacatggtttctgtttggttgttagagcttcttgctgagttgaattgagctggttgcaatcactctgtttcttgggggttgatcgtgtattcaagtggtggatg

SEQ ID NO: 20675 - DNA, 3003 bp, Unknown
  misc_feature (1)..( 3003): 2750-1469P.txt file - cDNA_ID_1827874; gDNA_ID_1620769; Annot_ID_50167
aagaatgaagcatctagcattggactatcattttattcgcgacaatgtgagtgccggtgcactacgagtctctcacatatcaacacatgaccaacttgccgatgctctaaccaagccattgcctcgtcaacactttcttcagttttcaagcaagattggagtgagcaaactccctccatcttgagggggcatgtagagtatataagtaaaggatagtttagtaaatcattaatccctaattcattctaatgtagtccctatatatattgtaattatatcatctaatgaattattcagccttcaatactatagtttgatcatgtgcttactttcccttcatttgcgatacttcaaggttcttgctgccactgtttctttgaatgcgtcacatgtttgaacatgtgtgttctttttggatcgaagcttagctctttagatggaactgaataagtaaaagaggtcactggataagctctgttactagaataataggagggcttctgcttcacatttgtaatcctctctctttctctgaattgatgttgcaattgcttgtcatcagtatctgtatttccatagataactgaactcattaaagggcaaccgaagctgcttcgtggtttatgtttcttctttgtgggctattttgctttgcactttcacttgtttcttagttttggtttgatttttcatactgggccctgagcaaaacaattttagttatatgacttgtgaaacttaaatgggttttaatcgaatggtaacttcatctaatttgtttgaataattcatcatggaccttaatgataatatcttgagtctactaatcatttcacaaatcctttcattttccaacagcaagtagcctgatttttgaacctcagcgatagacagcttaaagtgcggtcattctcgcaaaaagctatcagtctttatttgattcacgaacattatacacgaaagtcaaaattaaataaccaaaaaaattaaacaaaaagcaaacaagaaaacgacttctctggtatgattggaacaaatttaatagagagagaggttagataagaatgtggtagaagataagacccaactacgcgtcataactgggtcccatctttgtctctttcccttcttcactcgccaaccccatcgcgtgtccccacgctccttccctttactttttctcgttatccaaaacacgacgattcttcattttagatttttttcattaataaaaaaaaaaaagtcttttattgcagaaatttcgatcgtttttgttgtgtgtacagagagattatcgtgttttgttggcaatcgccattaaaccttcttccctctaacccaatcaaatttgcggctctttcttttatcttctcgcctcggttttagcaaaccctttagttatcttcttcctcaagcaatttttcttttggattagattggtgttttcttttggtttgtgtggtgatgatgagaaggcaacgagatgaacaacaatctagggttttctacgatctatcatctcttgttttgaatcttctccgttctcctcctatgccgatttctttacctgatcatttccccgatccgcccgctagaattcgtcctcccttttcttcgcatcgtttttcgtcttcttcgccttctttggctcatatttctccgtctggattcgcgtcgttgctgcttggtatatctgtggctcttatgctatgtggatctgtgactttcttcatcgggtttctcttgatgccttgggttcttgctctgattttggttttctatgtcgctggcatcgtttctgccatttctatggtcgggaggtcgattctctgttacgtcttgacgccaccttctccttccggaaaggagatttctggtaattttgttgaattttagggttaagtttgtcaaattggtttcaatgattcaagctttctactttcgtctcggatctgtttagattttaaccaaagtttccttattgatcatctagaaatgattccactgggttttggttctgtccttattttgatagaaatggaggttcgaattagggttttattgaaaagcacaccgatgtttgttctgtctttgactgaaacgatattgttcttttgtttcctcgtggatcatattattcatgttcacattacttttgttgtctgaaattaaacctatgtttgtattagtttcatgttcttgcaataatgtttgtgtttgacatgtctattcgcagaatggaagcttctgtgaaatgattaaacaacagaggtgaagaatctatacatcatccggaagcagagcagagcgaagcagaacaaaaaaaagaagaagaaggattgattatataaacacatatatccgatagagtttttctatgttctttatctgtattttgttgggggggtttgggaaaatcatgtggatatcagggagttttatatttctttacatttcgaaaaaagaatttttctatttaactactgttagaaatagagaagccttgttatttgtgctttcatgtatgtcgtttttatgtaacatgatcatttcttaaagcatacaaaaagattttaggatttctgttgcacttctttcgatttccttgcattttcgaaacactctgtgttgatatctcttcctttaaatcttcttacaatatttgctcattcttgatctcttttatggttttaaataattgtctcttcaagttcacacggaatctagtgtgaatcgaggtttagtcgtgcagagttgtgtgtgttattacatgttttattattgtttaagtatatttatttagtggaggactatacgctatttgcacatctcaatgtcaaattgctcaaaaatggtagaggtgccgtgccgtcaatagatgtcacgtgtcctgacttgccttctcaatacaaacaaaaatactctctacctaaaaaaacacaataaacaacaaacgcatctttggagcggcggtgagattagagaagaagggtttgtgaaatg

SEQ ID NO: 20676 - DNA, 3003 bp, Unknown; identical to SEQ ID NO: 20675
  misc_feature (1)..( 3003): 2750-1469P.txt file - cDNA_ID_1827874; gDNA_ID_1620769; Annot_ID_167421

SEQ ID NO: 20677 - DNA, 3003 bp, Unknown
  misc_feature (1)..( 3003): 2750-1469P.txt file - cDNA_ID_1827914; gDNA_ID_2684237; Annot_ID_192467
atgagtcacctacaacatgaatctgtgcaagacacgttgtgacgatatacatctataaaaacatattattaaattgtagttacgaaatatacccaacattgcatgctgattgttacatttgttttaccctcctctgttttataaaacctcaaaacagactcttcacaaaagcttccacattcttgtccgaagatcctccttctctacccgcttcagtcgctaaacgcttccatttctctgcgttttccctcagctccaccgatttcgcctccatcactgcttccaaacaccgcattatctctcctctctctactaaaccttccgagttctctctcaccctcacacctgtcttccatatttcttccaaaagcttcgcatttgctggctgatccgaccacatcggaaacgccaccactggaacgccgagaaccaaactctccagtgatgagctccacccacaatgagtcaaaaaacaacctatggctcggtgtctcaaaacctctatctgcgaacaccacgagacaatcatcccaacctcttcaagctcgtgtctaaaaccagctatcttctcaatctctgtctcttcttctccttctattttcgcttctctgttgagtttatcagttataacccacaagaacggtcttcccccttctatgagtgctctcgctagttcctctatctgtttcttcgacaactcaaccattgttccaaaagaaacataaataacagaggactctgttttcgagtctaaccaaagtgtataactactactttgatgatctcttgataaatctttacctgattcgcttccagtgaaaatctccgcaggaagtaaaggaccaactgccaccatttctatattcggaatagctgttaagaactctggctccagcgaatcgaatgtgttgacgagaattttcgggttagattcttctttgagaaaatccatcagttcttgatatactgcttgtgcggctttgttcgtgttggaaggtgagaggaaagaaggcagatcgcggatttcgagagaaggtagattcgggaactcgaaaacggagttgtttcctgtagagtaattgtaataaatgtcgaaagcgaaggctggttggatccagagatgaacagagggaagatgaaatctacgcgccacttttggaacccagttgggaagaatcgtgtagatcaagcaacttacgggagagtcaccattctgattagcttcgatgaaatccgatagagctttatcgccattacgttcgaagtgtaccaaccggttttggacgtcgtcggtgttggagatgactccgtcgtcgaatccgtcggagaaagtaaggaaagagagattttcgacgttgttgtggtttgggatcatagagcggtgaatgacagagagacacgtggcgaaagttacacgtgcgccagttgttttgatgagccgacgagcaaaacggagagatgggttcacgtgaccttgcgccggaaacgttaccagtagaaaatgcggttgcgccattttttgaagtgactttcttaatacgtacgaggtgtgtctcctcgtggatttgtgctgttatatgtatataaatggaaaatatattagatgagagtaatgggatttcatttggggtcatgtgacatgagataacatgttttaccgcttttggcgtgatccacgacgtacgccatgatggagatcataataagtatcatgctgaatatactatataatttatttataaaaaaaatagaacgaaagaaaaagtatcatgctgtcaaaaagaaaaaaaatatcatatttttatagagaaaaaactcgaaaaatatctgtttaatatctatagttgtttgaataatatctaaattaattttatgtttttaaatgcttttttaattcaaacattcaaattcatgattattatattttaacggatgttctaactgtggttgaaatttaactcatgatattcacgaaatgtataatctattttctaaagtttacaaatatattagtgtaatctaatggttaaatgtggattgattctcttcataaatctaagttcgaatcccccttctttcctaattaatccaaatttattaagatagtcaatccctctttgtcctaattaatccaaatttactaagatagttagtcaatccacgtttaaccaccatactaacctaatatatttgtaaagtttagagaatagatagtatatatatttataaataccatgagttaaattttaattatagttagaacctccattaagtaccaaaatttaaataaacgaaagcttttaaatttgggaaaatttaataatatatgtattaaatggacaaataaaagttagatgagagtttttttaaattttttattataaaataatttttttgcatgaaattgtttttaagataaaattttgacataaccaaatattattttccgccacgaattgagtctacgagagatgtcctgtctttaaactcgtaaagttttggtcttacccaacccaatacccacaaaggtaaacgacataacggttaataatattctaaccggtttataagtttacataaatcatttactaatccgcgtgtaattaagttttatgaaatgtggttattttgtaggtcacgtgaaatttattaattttttagtacttgtttttcttttttgggttcaactagttacttttttcctttgacatcaaaattattgtagacgagtggtccatatatagatggtgaaatgaaatgaatattgagtaataaataaatatagaaagtgaacaaaaaaaattagtggaaaaggtaactggaaagaaaaggcttattggcttggcaagattccataagtttatttcaccaaaaaggaaagagtacttggccttgctctctctctcttttaaaatggtaaactggtaaagataggagactcaatttctagttcatcaaaacatatttggcgttattatttctgtggtcacttgaataataatg

SEQ ID NO: 20678 - DNA, 3003 bp, Unknown; identical to SEQ ID NO: 20677
  misc_feature (1)..( 3003): 2750-1469P.txt file - cDNA_ID_1827914; gDNA_ID_1620807; Annot_ID_168896

SEQ ID NO: 20679 - DNA, 3003 bp, Unknown; identical to SEQ ID NO: 20677
  misc_feature (1)..( 3003): 2750-1469P.txt file - cDNA_ID_1827914; gDNA_ID_2684237; Annot_ID_137739

SEQ ID NO: 20680 - DNA, 3000 bp, Unknown; identical to SEQ ID NO: 5641
  misc_feature (1)..( 3000): 2750-1469P.txt file - cDNA_ID_1827922; gDNA_ID_2684237; Annot_ID_192465

SEQ ID NO: 20681 - DNA, 3000 bp, Unknown; identical to SEQ ID NO: 5641
  misc_feature (1)..( 3000): 2750-1469P.txt file - cDNA_ID_1827922; gDNA_ID_1620807; Annot_ID_168894

SEQ ID NO: 20682 - DNA, 3000 bp, Unknown; identical to SEQ ID NO: 14979
  misc_feature (1)..( 3000): 2750-1469P.txt file - cDNA_ID_1827922; gDNA_ID_2684237; Annot_ID_137737

SEQ ID NO: 20683 - DNA, 3000 bp, Unknown; identical to SEQ ID NO: 5643
  misc_feature (1)..( 3000): 2750-1469P.txt file - cDNA_ID_1827934; gDNA_ID_2684237; Annot_ID_192461

SEQ ID NO: 20684 - DNA, 3000 bp, Unknown; identical to SEQ ID NO: 5643
  misc_feature (1)..( 3000): 2750-1469P.txt file - cDNA_ID_1827934; gDNA_ID_1620807; Annot_ID_168890

SEQ ID NO: 20685 - DNA, 3000 bp, Unknown; identical to SEQ ID NO: 14978
  misc_feature (1)..( 3000): 2750-1469P.txt file - cDNA_ID_1827934; gDNA_ID_2684237; Annot_ID_137734

SEQ ID NO: 20686 - DNA, 3003 bp, Unknown
  misc_feature (1)..( 3003): 2750-1469P.txt file - cDNA_ID_1828025; gDNA_ID_1620773; Annot_ID_50219
attttcttttcgggacattttgaaaaataactcagatttctgttgaattttgcttctttttgtaaataatcaaaataacatgtaaaagatataatatgagataaaaattaaagtttaaaaaacattaccataactaataatttgagtaatttagaaaaaaaaaaattaccacaactattcttgatataatatgagtaaaaaacttcgaaacgagaagattgaaaatttaaattttatttttcgaattctagctaattggttctatttttttggggatatttaaaggtctatttgagacaattattcatatatttaaataatattaaaaatggaaaattttgggacatacgtaacgacatacttgttacattaagttaaacatattaaaaacaagattattatttgacagaaaaaacgggtattgtatatgacaaaaactcggatgaatacgagataagatagtttctgttctttaccggacatacctaatctttttgtttgataattttcaaaaccaacgcacagaagaacataccttcgagtcttctatattggtcaagtcttgggaatcaaacaaacgcaaaacagagttggattacataccttgctcttaacgatatatagtttatagatatgatagtatttattagctttttccatgtcgggataagactgttcatcgaaggaaagttacgaatttgaagatgtataatactccaaaccttcgaagctatgcacatcccattcaggcgccattaacatatcaaaattagcctcatgcacgtttgttttggtttcttcgtcgtcactggtatcttcgctctcatcagcttccacagattcgatttcttccatcaacttgctcaacttttcttctatcatcgtcacgtttgcacactgattgaggaccatgatgatcgactaaaccctaatcctctatctgaaatcccaaaatcctaagatgtaattctctagaccgagcgatggtatttaaattaccttattatcctagaaacatgtgaaatttaacataattgtcatccaatttggtctttcaaaaaaaaattcttttttttgctcagttaaaaaaaaaagttcaacaatatatgttccaaagacaaaaagattcacgcattttcatgattttagagttcttagaattttttgttataaaaggtttgcagacattaatttttttccccaaattagagtttttagttgaggtattagaattctttttatcaagaaaggtacttataaaaataagtatcagtgtgtgaaatccactacttcaatgttggaatgttacaccttcctcaagaaggaatttgagtaagaaagaagttgtgtaacccattattatatgatcttatcttcgcaaaacatgcctcttcaactagttgatgtagttttaagctactaaaataataaccgggtaacttaaatagtgaaaactgataacaaacttaataggatatgtaaatcacttggttattggtccatgtgttgaaattgtgtggcaatgaacccacaaacggataacaaatcatgattttcaatatctcaaatgagaagttgtgggacgatccattctagatactaaatgctgtcatcaagaaaaattatctaaccacaaacaaaaaaaattgagccaatgcatcatgaacttcttcattctactactaacaattgattttctaaattaactttacatttacattcgggagtgactcaagataatctagatcaaaattccctaaataatctaaaaatcaagaaccttaatatgagtcaaaatctcttctaataagcagaaaataagctaaaacagcacaaaaagcagcaacaacattgccttctttcaaaagaaccttaaacacaaatccgacaacttctctcgtaatcttccttccttcaaccactaaaactcttcttgatttcccaaagaaggcaagcaacaccaccaccgatatccaaatcaccatcaccgccggaaccgccaccgtcatagcagccaccatcgacatagctccaaacatcgcaccgagcaccaccgacgcgtataccgccggtaatcttgaaggagaataatctgaatttgatgacgtgtattgaagcttgtaccagttaagaactgatctcaggaggttccatgaagaagatacgagaattgcgtagacagcgatgaagagacaaacccatgtccgtcttttactcatgattgtgatgaagatatgatacgatcttggagattctgtttgatctgccattagagattggaagttcttgcttatcgatcgaatctgttttgagatttgtctgcgactgagcaaaataaaatagagcagtttatgagaatccttacactcagtcgtagcgcgtgtcgtgtacgcttctttgtgaatttgtttttgagctggcaatcgcgtggttatggttcacacgcgctttaatatatttttttttgtgaaatatgaaaaacatttggtcgaatttgtgagataatgaaatggtaattggaaagattgtgactgcattgtttttaataattaagtaaatttaaattctgtggaagtatatttaatcaataaactggaaaaacaaaagaaaagatttcgttaccataacgatttaaatttaagattttgttatacagaaaaagaaatgtagaagatttttttctaatttagaggagtcaaacaatgatatataacaaaaaaaatcacaatccggtggatttgtggggtaagtcattaatcttttactattttgtttggaaaaattagtagtcaatatcattatgactacatatatcagtgtcaaagactcaaagtaatggcttagatattttatgttaataaaaggaatatatatactgtgaaaaagacaagtttgtgtaagggatcgcatataatctcaactaatacaataaacaaagatatagccgttggcattaatcagctttggctagaccaaccagaagatcagaatcttgagaagatg

SEQ ID NO: 20687 - DNA, 3003 bp, Unknown; identical to SEQ ID NO: 20686
  misc_feature (1)..( 3003): 2750-1469P.txt file - cDNA_ID_1828025; gDNA_ID_2926216; Annot_ID_142227

SEQ ID NO: 20688 - DNA, 3000 bp, Unknown
  misc_feature (1)..( 3000): 2750-1469P.txt file - cDNA_ID_1828050; gDNA_ID_1620774; Annot_ID_50246
cagacggacgatttgaggctcctatatgtaatggatcactatatcgaaagtatctccccctcaagaccctactcaagagagagtttggtacccagataagacgctaccgttatttagctaaaagagctagattaaattcttctagcgttctaaagtcaagatcgccctcaaagtgtggattacaaagcttatctcatacaatccagtggataccattactattttcattagttttttaccagaaatttgcaataacactattcaactttgagcaaatagccttaaaaaatagaatgcacaacataacatatgtcggaagggcttgtgctatagattttataagaacctctttaccttctttggacaagaatttggctgaccaagtattaagtcttgaaacttatctctcacaaataagaaaatttgggtttaaaataggaaaaaacttgggttttaggtaggagaaaacttgaccaagtatcgaccactgttctcataataaatgtaggagactgcaaacaacaaaaacagtggcaactaattaattgggcaggactaggaggcaaatccacaagtctttaaaaagcaattcctttaggtaggcactgaaaaagcaaacctttttttttttcttctttccggttggtccactgttatataaagcttggttggttcttgacttggttgtcaaaatcctaaatcccaaataaacaaacagagaaaaaagggagaaatatttaacaacagtaggagtctacaagtccacggcttgatcaatttgttcttcatctatttccttattctcagggaaatccagggtttttgaattcgtactctctctctcgttgtccctctcaaatcagaaaagtatctgccttttttaaaattcattccccttcgatctttgctttttcatcgctgattgttcttaaaaggaatctctactttttcaataagcattaacattgtccgtttcctcatctttggttcttcgattctcttaaagaggattttatacttgattctgttgaagccctttttctggggttttgtctgcgtttgtttccttcttctaatccagaattaaaactagctctctgcgctcaaagttttaagttttattcaaagaggtgtaagcaaattctccaattgatgatcaactgtttaaaagactcaatacatgttttgatgagtgttttgctttgtaagatccagtgtcccttttttctgtttcatctggaagccatttatatgtggcaagttagctgaagttgaaaactgttgtttcagccactagtgatgatgatgatgatcatgaagagattctcgaacatgtggatggtcttacgaatgctgaggatagagaagaagtagatgcaaaggaagaagaaggtcaaattgttggggacactctcactctcaaaagtagtcttcgaaaggttgattcaaattcaacagaagctgagaagagggagaagaagaaggtacaatgggtggatgtgattgggaaggaacttgctgagattcgagaatttgaacctaggttggtcttctattgttgagaatataagaatgagtttggtcataaggattttttctgatggcatcagatttgttttggtttcttttcattaagaatgagttctttaagttttcataagtacttgttttgtggagaatgatgtgattctttcatttttgcagtgatgaagatgatattgattctgatcgaggcaaaacctgtgtttgtattatcctgtgatccgtccacttaagtttaactgggagatttaaggcaaaagacaaagttggtggcttcagcattaaattccatatacatggaggtacatatagaatctgcatttgtgttctatagccattcttaagtttgcacgcttgaagccatatgatgatgattcctgatttaacacggaagcattctttttcttcttctttagaagtgtttaaagtataggtctttaacttcattcgttgcttcaatcatttaatgaagttctttctcattcagattgtggagcaagtttcaaatataacaattgctatgcatcgatatctagttctgcgatttagttcaaatgactttgatatcagtgtgtttgatcaatgtctaagtgacagcttacttcaatttgagagaaaactattgcttgttgtctttcacgcagccattgtttacatttatagtaagaatttctgtatagatattgctcttggtgtgttagcataattctgtcaaactcgaatcaaatgttatcactattatatttgggtgcaaaaacagcaagtttgatagtgcagactatatctcaaggcttaggctttggagcacttctgttttcaatttcttccactttaccagaggctcagtgaattccatcaagaatgtgaatagatctgtggtccacaagtatgtaattgaaagaagtttgtagcacccaagaactggtttaagactcatctgttccaaaactcaccgctcaatctgttaggagcaagaggtgattcattcttgatttggatctcagtatctttcctgagttattgtttgcgggcgacataagaatcatgaaactagaatctcctctgtttctttagagagccaatgacacttgctctgaacgttaccacttctgtcatgttgccttgtcttcttgtagaactggtcatattgagtcaaaactcaattgtttgtgtaataaacgaatccaactgaagggagatgcgaatttatgaagaagaaaaaaaggatcaaactaaaggtaccattacaatatgacacgtggcgaaacaccaagactgaagcatagccactaaaatcatgcaaacttgtgtaatccgaaactttgaagcttttgcgaaaaaccaaccaacgtcacataatcgtcttcttcaactaacaaaatccaactaatcatcatctgtctctctggctctggcttgtgtctgagctcgaacttaaagaaaaagaatctcaccatg

SEQ ID NO: 20689 - DNA, 3000 bp, Unknown; identical to SEQ ID NO: 5229
  misc_feature (1)..( 3000): 2750-1469P.txt file - cDNA_ID_1828053; gDNA_ID_1620774; Annot_ID_50244

SEQ ID NO: 20690 - DNA, 3003 bp, Unknown
  misc_feature (1)..( 3003): 2750-1469P.txt file - cDNA_ID_1828065; gDNA_ID_1620774; Annot_ID_50239
gtgaatatcttgccaacatagtctcacccggaaagacctttcgcagattcttcctcagaattcgacacatgagaattcatcatcaccagaatctcactggtcaagatattcttactccaaaattttagagcatgtatgctttccatagtgagaatttccgtcgtatctttcttattcgatgcatgcatcaacactgcaccaataacatatgactctgatattactcgttgggctggaaacattcaccacaatcttatcagtcagttttaaccttaaaaactcgataaatcaagaacacttgaatcggaaagcaaaaaaaaaaacagaactagaagaaactttcatgtattgttgtttgttttatcaaactcaaatcataatttgaatgtcttttgaatctgaattttgtggaactaaaacgttttagactttgatgcaactagaaaatataacaatgcatgcaaaacacttttacaagtttggtccctccatttgaacaactagaacaaaacttttaaagaaactctagaacacatttgattaatactaacaagcgtgggaagtaagaaactaatttgaggcatttgtacataccatattgtaataactccttagtgttgttatttgtctcactgcctgggattgttgttggtgaggaacagtgttgataatggcccattattaatgggtcgcaacttgcaagacatatgggtcttcactattaagactctgcaacattaaatacatttctcgtggggttcatcctaatatgcatattggtgtatgtatctgtgcctgcatgatttaatgaccagcaaaaaacagtaatggtcaaagtaaataacatgatgggagaaggtgaaaaaagagtttaaacctcggaagagttaatactggtaaaactctgggtctttcttcaacgttctcaattattacaactttacaagtactacaaacattttcgataaagacaacaatacacacacttcttcaagttatgtaacaatccacatttgaaagcaaaccttacaatatgtaacacatcaacgattttcacactataaatataaaactaaacttaccttcaatgtgttaacaaggacaggatccgagttctgatttgaagaaacatctgaagacaataactgtaaacagaagagagtactaagtaaaggagcagtagaaatcacagtagccaatgttcatgacatctaaatattagcaagaaagatgctcttaacgccagttgatttagataaattgaatagtcaactcataatgatacataaactcttacctctctgccaatgaacacgagtgcaacatcaacaggttgctgaagttttttctccgagcactaaacaatggagacaataaaatagatatgagaatgaaaccattgcattgtgtaaaaatatttgcttgcggactcaacgcgaacataccagaaaattagaccaacctcctagagtgaaaacagagtctactagatcctttgcagacatgacttgataatttacatccgtttcaccattagcatacctacaatttcatcaatgtggacatcaatataagcacaattccaacaaaagttctcaaactcttacaccaaaaccagagtacaataaaatttggtaaatttactcacataagccttgaaaatggtgaaaacaaggatcaacaaaaagataaaaagaggcaggcctaactggagatgcggagaccagaggaaagcaggaactgtggaaggtgaagctaatccaaaatccacgagagacgcaaactcaagaactaccaacaactacgccagtagagcagaggtaaaacgtcaccgtttgctataatttacccacaaaaccgatgtaggagaaccggtctgcgtttaacggttggattagctaagagaaccggtctgataatctcttgttaacggtctttgtagaggatgtgaactttatctaagtgtgttcaaaggcttcatattttgagactttatattttgattttcaacttggatacactagctagatgaaaacaatgatgatcctcttctctgccttttacgtgcgctttattattctgtgctagatgcaaagaacaatatcccctagcaatgaatcttttttaggatatacataagacagtacgtattgataataattaatggcaagcttcatcaaacagcaatgaagaaggtactcatccaatgcaaatcttgtcatccttgtatcgtcctttgtaggtgaatcatcattaggctgcagaacactgttttcacagagagcgtgttcagtttgatggactaaaactgaccttatattatatatcaagctcaatctgctggtctcacgaaaaactcgtctctctattgtacttaaacccttaccactaaatcccctgaatgtcttttactatttcttaactcttgaactactggaattcaatttgagctcatttcttattaccatgttcatttggagatacgatagagttagtttatcaactaaacaagatcacacgattgatcaactaaacaagaaatataaaaccaaaaagacaaagaaaaagagttgagatcggaaagaaggagaacgacgatcaagcctcacgatatttatgttccttcgagacctttggtataagcgaatcacatcttgtgcggcagaaatattgtaaatagtctgaatttcaaaataaattactatatatatatcacaatacatgtcggtctggtttagtaaagagaaccggtcgctgaatctggttcagctaaaagaaccggtctggtgtgtcagataagggccaattgggccattaacacattacggcccatataaatttaaattaacaaaccatgaaccgtcgtcggctcatcggaccagtgtggtatcaccggcacttgtaatcagagagactcactctcgagtttcgtcctctctacttcccgctcaaaatccttcggattcagccattgaaacaaccttgagaagagtttgaaagatg

SEQ ID NO: 20691 - DNA, 3000 bp, Unknown; identical to SEQ ID NO: 5225
  misc_feature (1)..( 3000): 2750-1469P.txt file - cDNA_ID_1828079; gDNA_ID_1620774; Annot_ID_50235

SEQ ID NO: 20692 - DNA, 3000 bp, Unknown; identical to SEQ ID NO: 5225
  misc_feature (1)..( 3000): 2750-1469P.txt file - cDNA_ID_1828079; gDNA_ID_1620774; Annot_ID_167617

SEQ ID NO: 20693 - DNA, 3000 bp, Unknown; identical to SEQ ID NO: 5270
  misc_feature (1)..( 3000): 2750-1469P.txt file - cDNA_ID_1828083; gDNA_ID_1620775; Annot_ID_50282

SEQ ID NO: 20694 - DNA, 3000 bp, Unknown; identical to SEQ ID NO: 5270
  misc_feature (1)..( 3000): 2750-1469P.txt file - cDNA_ID_1828083; gDNA_ID_2926205; Annot_ID_141708

SEQ ID NO: 20695 - DNA, 3003 bp, Unknown
  misc_feature (1)..( 3003): 2750-1469P.txt file - cDNA_ID_1828107; gDNA_ID_1620775; Annot_ID_50273
atagccctcttagtaaacgccattctccaatatgcatcatataaattaacgcaaacaatgaatctggacgtctaatgtcactttcgtcagagtaaatgggtcgcagtattagaggaatttgaaaaacaattgtgttaagcgtcaccatcacccatacaacaatttaggcatgccatcataaaatttggacagatattgggcttttggttaaattaaatgggctgaggtactgaactaaagtttattaacctaaacttgtacaaatattgggcctttggtttgtttaaatgggtctaaggttcagaaccaaatttggggctttatcattctgattaacaagacaccggcgtgtagtgagcttgtatcagctgcagagtttctctcccgattgacaaagtcgattgagcagtagggtagctttagcatccaataacgtatatcgcaaagaagaggtccaagcaagcgatgatcctcgtcattgttgagtaacgttacaaggtctctgttatcggtttcgaaccaaacataacgcaatccgtgaatccatatcacttgtaaggcatggagaaacccgagaacctccgcgtgtagtgagcttgttgatggatgtagtttcgcacttccacataggattgtatggccgttactctctcgtattatccaaccggaacgtgtataaggacttccttgcataaacccactatcgaagttacatttgcataaacccatatcgaagttacatttaacccagccaacagggggaggttccaactgactgcttcgatttcgtattgagggttgtatatcacttggtgcagcattctcatttgtattttcctagggctcattcacgttaagccactcctctgcttcttgaatacctttcttcgcttcacagtctggagatcgacttttttgttgaaataaaaactcatttcttgatttccagagtcgccacatgatccaaaacggaagatatttatcaagaggattgtttattaacacaccggcgtttgtatcaaaatttgctttttaacaaaacagtaccagtccgttcaaagataaattgttcgtagagaacaaataattagtctttcaacatgttttaatgaaatctcatattatagtcatgttcgtctgataatttgttaacccattctctagataacacaatcaccagagaccaaactgatgcgttaagacatccaatttttgaggtactcaaaaatagttttaataatttttgatgtattatctatcgtagatttctagtatcgacatattggattcacaattgaataagaaaacgtattcaaacaagtaaaaccaaaaaccaaagtgtaagatagtaataaaaagcctcagtcaaaatccatataacttcatagaaattacagtttctgccaaggggttctccctgtaaaacagggtctcagctccactgcacctcgaaattggattatatcatcatcagccaacaaaaagaaatatcactaaaaaaaaaaggctcagaagttttttggtatacagtttcttcgatcaggaattatctgaagcagaactggttttaatcatcactgccctcaatacaaacaaacaaaacaacaaagaagaaactttaagaggctcatattaagaaattcaaccattgattatcgtatatacttcatagaactaagtctcagaagcgcggataattttgtaatcatagcccaaaaacacaaattcatcacagagaataacaaaatctagacattgctttgacacagttaagccggattataaaaagagacagaactgcaacacgaatggcatcaatctagcaggagctttggggcttaattcttcatgaattattatcagactagcccgggaggctcctgcggaaatctatgtaaccagagaccctaaatctatatatcaaaaacaaaactgaagaaccctaaattaaaagctatcgtgaggttgagaatgatttgtatatatgattcaacgcggctattatatagagagtaccctagccctaaaacaccgtctctgaaatgtcgtatctaccctcgttcattgactttcctttccgttgttgtcggtttaatgtaaccgaatgttgtagtatttgggctttgtacaaaagcccatcttcaaatttgacaatacgaaagcccagtgtcaaaactatccccacgtctaattgatttgccttttcgtaatcggtattattgtaaaccggcttggttttcatgatactactattattttttactcgctaattttgtttattccgaaaccctaaaacctgtcgccgtcgaggaaattatggtgacaaccaccgatcgtatctctcttacattcctggcctcaaggttttttctcctctcatcattcattttgcactatttgatttttgtttttatcaccgttttactcatctgcttcttcgttttttctgtgaaatgtgtttttttttcttcgctcgtagaatagagaaagctttaaaagtttaaatccttaattttgttaaaattatatacatgtatgaatttttactagtgtataactagccctgcatagcctttaatgtgttttcgtaaacaaataaagcaggaaccaaagtccatcatatctaaagaaatacttgaaaccaacaagcttatgttgtttctccaactttggttcaccattcccaaaatcaagattgacaataatctcgagtttgcaaagaaagattgttcctcttctaggtaataactactaagttattgtcaatattgaaaacttgtcttgtaatggatgactcttttaattaatttactatactgaatatctgcagatgtggacgttgcatcaccatcacctttcaaccaaatatttgttcatgaccggaggctaacaaagcctgtgagtacactgagagcatctaaagatggaaactcgatcccatcaatagcagcaaacgtattgctaaagagacttttcttgacttttaacataatcattggaatg

SEQ ID NO: 20696 - DNA, 3003 bp, Unknown; identical to SEQ ID NO: 20695
  misc_feature (1)..( 3003): 2750-1469P.txt file - cDNA_ID_1828107; gDNA_ID_2926205; Annot_ID_141699

SEQ ID NO: 20697 - DNA, 3000 bp, Unknown; identical to SEQ ID NO: 5257
  misc_feature (1)..( 3000): 2750-1469P.txt file - cDNA_ID_1828125; gDNA_ID_1620775; Annot_ID_50266

SEQ ID NO: 20698 - DNA, 3000 bp, Unknown; identical to SEQ ID NO: 5257
  misc_feature (1)..( 3000): 2750-1469P.txt file - cDNA_ID_1828125; gDNA_ID_2926205; Annot_ID_141692

SEQ ID NO: 20699 - DNA, 3003 bp, Unknown
  misc_feature (1)..( 3003): 2750-1469P.txt file - cDNA_ID_1828131; gDNA_ID_1620775; Annot_ID_50263
aatgtctgcaaaaactgaagatggaaaggaaaatatgactgaagcagcaagtttactttatggctagatgtgaaactccattctcaggattcttgtgtatcgtccacacaaattcaggcgtatccattctcggtcctgcgactgttctgtatatgtatatcctctcaactggagagctctcaggtcttgactctggaggatgttcatcaatgacttcgacattgagccttggcattttctgacttagaagcttgcaagcaccaaaacttacaaagcaagatgacatccaaagggatcgcatggtctctagcttggcagcgtgctccagtagtgcagtgtctccaaaagggcagtctcgtatctcaagcttctttaaactctcacagcccgacaacaagtgatgaagcatcaaatcactgtccccagcaaatgctattgatagcatcctaaccttcttggcatgtttcccaatgtatttgaaggccttgtcagagagaagaccagagacggagagccgtcgaagatccctgcatccctcagctatggctttgaatcctttatcaagtggctcatttgttttgtaatcaggagcaaatggctctatcacacagagacggaagcacttgagattcggacgttttcttgctatggtaaacaaagctgcgtttgtgaactggacacagaagtagagaacagactcaagctttcgacagcctttagacacaaagaccaggccttgttccgtcagaggtatgttggttgcatcaagatctggctcagatggaaacaccctcagttctcgcagttccttgcaatatgaggcaacagcttcaagacctttgtcctcaatcaagtccatcacctaccaaaaaatgtctcactagtaagaaccaacataaatgggatactcactcaaagagtcttgaaaaatgtaaaatactcacccatagcttctgcagtttcgagcatcgcctaagaagctcaacaagatcaggcattcggacagtagcgtagctcaagttcaacgaggtaagaccaggacagacagaataaagagctggaagatattcagggaggacatcccagagaccagataagctctgaagttgcttacagtttgaaaaagcttctgataactttgaaaacgcttcaggtttcaattgagctgcgaaagaacctgtgccgagctcagtcagttgtggagcacaacgaagtaagctaacgagtccatctagagtcacagctggattcaacttcaaagacttcaagtttggagatctgctcacaagacgctctaaatccgagattttaacctcagaatctaaacaagagaagtcaagagagaccaaagaagttgaactctctggaaaatagctaagccaatctcctcctaaatcttcaacaatacactctcgtagttccaacactctcaagttcctatattgaaaatcagacaacaacaaaaaacaaaccaaagctacttactactatgagatataacttgcagccaaagaaaagattgtttttgtatttggttggaaccgaacctgcaagtagctgcaatagcagcgataccatcagtagagaaaccttcacaagaagtcaacacaaggactttaaaatccttaaacgaagcagcaattttctctaagcactcatcagtcaccaccatcctcttcattctgatctcttcaagagacgaacttttcgccgccatagcttcaatccacggccaagcataaccaccccaaccatcaggaacgagattatagtcagcgaagtgtggcttccccttcaaagtcaaagatctcatctccgggaaccgtcgtgtaaccgcagcaggactgaccgcgtaacagtttccgacaaagactcgcttcctagtcttccgttctgtctcaaaccatgacttgcagaccagagaaacagagttccggtcctcgttggaatcaatgaaggagaggatatgttccaacaccttaggtgggaatcggagacccatcagaaacagagtgagagagagagaggggggaagaaatgaagaaaaaggtttgagattttgattcgatatgagtgtgatctaaatcgaaagattgaagcttttgatatatataaacagagcaagtggaagacaagaaagagtatgacaagacaagagaatcgaaggagacagtgtccatgtgagaccattaataaagttgagcttgcacccatgtgagcctactgtgtatagctcactaatataattagtttccttaatcataattagtttactctgtgatccatcacatgtaagtctgtgtgagaactcgtggatctaatcatttatggtattacccagttcacacatgatgtcagattcgttaattagtattttacttatgcttcagtttcaaagtaaaaatatattttatctttggtaccaaatatcaattcatattgttaccaatcaaatgttacaactgaatctcttcaaacaatcaacgtttttggacgtgaaaaacatttttatgattaaagcttcgaatggcaactcattatcaaaacggtacagtttatacagttttgacaattatcatttacaaaaagaatttcaaaaacgttacaatttttttttattttcaatttttttatacagtttttttttacagttttgcattattctataacagtttaccgcgtcagttaacaacttatcgctctagctaacagctaaagttttgttaccaatcagactcttaaatcttaagaaatggagtaatccatctcagtgcataagtgtcacaaaatgatcgagactcgttggttacaaactctttatcacatttgaagaagcttaacttaagttgttttgattttcgagaaaccgatagagtaacaaagaagttaacatcccaattaattatgttcctaagctttattttcttagtgtcggattggttagattttctcatagacgctattccgctaaaaaactatgactctacacaattacacaagatg

SEQ ID NO: 20700 - DNA, 3003 bp, Unknown; identical to SEQ ID NO: 20699
  misc_feature (1)..( 3003): 2750-1469P.txt file - cDNA_ID_1828131; gDNA_ID_2926205; Annot_ID_141689

SEQ ID NO: 20701 - DNA, 3000 bp, Unknown; identical to SEQ ID NO: 5243
  misc_feature (1)..( 3000): 2750-1469P.txt file - cDNA_ID_1828143; gDNA_ID_1620775; Annot_ID_50258

SEQ ID NO: 20702 - DNA, 3000 bp, Unknown; identical to SEQ ID NO: 5243
  misc_feature (1)..( 3000): 2750-1469P.txt file - cDNA_ID_1828143; gDNA_ID_2926205; Annot_ID_141684

SEQ ID NO: 20703 - DNA, 3003 bp, Unknown
  misc_feature (1)..( 3003): 2750-1469P.txt file - cDNA_ID_1828147; gDNA_ID_1620775; Annot_ID_50257
atatacttacactgttaaaattgataaaaaggaggctagaactataaccttcttctgctgcttgactgtttcatcatccagattctggctgaataagactcgaacatgtgccaagtttcttcgtttccttaagtctttccacacgaagtcacctattttaccaggtcctccaaggctcgtagtaagctccttctgaaggaataacctggggaaatctttattgcaagggctttcatgacttccgtcatatattttccttggagaagcatgatatgcaacattcaagtcaatgactcctgattggcaagaagaggcttgtcttgtcccacttaacgatcctcgtaagctgcttgacaaagtgttggtttcacttctgtctttaactaaactagcaccccaagatctcctaggtgggacgtgatgtctttgcataagacgtgatcttttggctctgggatgcctccattcacataagttgagaagacatgttttaacagagacgttagctctggttctctcttcattggtgaattttctcttcttcttagagtttctttccctgtgtggagcagcactaaacagaccattcaatttgtctctttcaggttcaccctcaatggtatcattgttccttctagaaagattactaacttgatccctcatttctgatacactcccaggaattgggtctgattcacaagcttcttctgtagtacagggagcatacactaaagcactcattgcttcagcagcaatttgagtgttaataccaatgtcaataaagtcttcctcgggttccaagggctcctttggcgccttatcctccaactgagcatccttctgtgagataaacataatgccctcactcaaacccgatgcttgttccatcttgagatgctttgcagaactgttcttcataactctttgtgtgggatgacttgagacttttctaatatcacacggatccctagatcgtttcttcactccaaaatcatcacctgcaacctgatcttctcttatcttggagcatgtaatacttgcacgagtgactggagaggttttagggtcactcacatcacactgatcactactccaatcaaagacactcattttcctggttggacttctgctcataattcttttggccagagattgacatccttttgcacctgatacaggagatgacttccttctgcaactattaaccgggagatcaactggagacaaatttagatctttgtccatcaaaaagtggtcaacaaaaccaagggcatctgcttgtgttgactctcctggttcttgagaatccaaaaaatcaagccctggaccatggctactagcagtaatccgcaatgaaccttggaaaccggtcactgtatcacaatttgattcttgcttgccttgaagaaagagatgtagtaagatttatctgagttaatacaaagaagaagatagaggcaacataacaacacaaggatatgtttacctgtttgacattcgtgatcatttgatccatcagactccaaaagtatatctccagctttcgggcttagctccggcaaacacatcggctcaccagcagcgacacttccatcttcatcatcactatcatccaccaccacttggtcgagaccgtaacattcctggttcagtgattcctcgtcaccacaatttccgttatctactagctccgtatcgtcgtagagcacttgaaatggggtttcaagtaacgagctattaagtactaatgcttcatcaatcgcctctgtatcttcaatttccccacatcccaaaatccgattaacctcaaaccctaagagaatccagaaatgaaattggtactacgaatctatcacctcaaaaatctacaattatcagcaagaaaaagaaaatgtaaatgaatcgtaatctcaaaactcactatgatccgaagaagctgaaggagactgcaaatcggaggcgaaatcttcggtttccataagattgaccatcgaaactcgaatttcaatgctgtccaagaagaaatggaatcgctagaagctcccgattcgtatacggttggaatcagagaagaaaccctagaggttccattggtgctttagtcgaggtgattggcgggagagagacgagtacagagctgtgtcgaatggttttgaaaagctcagttccgtgaaacgatattttagttactatatatatttaattatgtcaaacgatacatcaaatagggcatttggtctagtggtatgattctcgcttagggtgcgagaggtcccgagttcaattctcggaatgcccctctattatcttttgttttttgggacttgaaaattcttacctcattttcttctcagtatttccactatgttcttatccctttaatcttcttcacctatgttgcaggaaaaaaaaagattatatattatgtcttctagaaggaaaccaaactacttattcgacacctcataaatgctttgctatttttctactctttgtgtgcgatttggtgaagaatctttgagaatttggtcaaatgaacatttaagaatgttacaatttatcgacatgtcaaagattggtaacactttggttttcttttccatcccatgaatgtgaacttgcttacttaaaatatttaactgtaattttataacattactttacgatattaattaatttagatttaccagcaacacatggtattaggattgtgtacctttgtaattgttgatatatgagtcacttgttctaagaacacatttcattactttggattttgaaattctaagttgaaaatctttgttttattttcttggctagatttgatgcgtgtcataatctaatccaatttgaaaatatgtaatatgttgtataaaaagttaatatgccaacaaaaggatagatcttagttggtggaatcaacaccattagatatcaaattggtcgtatgcaatgtttctgtataatatatcatttgtctactgaataatatatatcataatg

SEQ ID NO: 20704 - DNA, 3003 bp, Unknown; identical to SEQ ID NO: 20703
  misc_feature (1)..( 3003): 2750-1469P.txt file - cDNA_ID_1828147; gDNA_ID_2926205; Annot_ID_141683

SEQ ID NO: 20705 - DNA, 3000 bp, Unknown; identical to SEQ ID NO: 5292
  misc_feature (1)..( 3000): 2750-1469P.txt file - cDNA_ID_1828157; gDNA_ID_1620776; Annot_ID_50312

SEQ ID NO: 20706 - DNA, 3000 bp, Unknown; identical to SEQ ID NO: 5289
  misc_feature (1)..( 3000): 2750-1469P.txt file - cDNA_ID_1828168; gDNA_ID_1620776; Annot_ID_50309

SEQ ID NO: 20707 - DNA, 3000 bp, Unknown; identical to SEQ ID NO: 5288
  misc_feature (1)..( 3000): 2750-1469P.txt file - cDNA_ID_1828176; gDNA_ID_1620776; Annot_ID_50306

SEQ ID NO: 20708 - DNA, 3000 bp, Unknown; identical to SEQ ID NO: 5287
  misc_feature (1)..( 3000): 2750-1469P.txt file - cDNA_ID_1828183; gDNA_ID_1620776; Annot_ID_50304

SEQ ID NO: 20709 - DNA, 3000 bp, Unknown; identical to SEQ ID NO: 5286
  misc_feature (1)..( 3000): 2750-1469P.txt file - cDNA_ID_1828187; gDNA_ID_1620776; Annot_ID_50303

SEQ ID NO: 20710 - DNA, 3003 bp, Unknown
  misc_feature (1)..( 3003): 2750-1469P.txt file - cDNA_ID_1828195; gDNA_ID_1620776; Annot_ID_50301
aacaaatccctctgatttcatttcctcaggatggacgaagccaatctgtattggaaggcatgcttttggtgatcagtatagagccactgatctcattgtcaatgaaccaggaaaactgaaactagtttttggtaatctcctcctcccgttctggatctgtctaacccttcaattaaattgttcattatagagaataatgggggatcattgtcattgaattcacctacctgtggaagtttatttatacacgttaaaaatcatatcttacatatgcagagccaagtggatcttctcagaaaacagaattcgaagtcttcaatttcaccggtggaggtgttgctttagccatgtataacactgatgaggtagatattattgaaatagtcctctccttcatgtctgcactatctgaatacacttacagagtatctattgatatggtggtccgatttcatttttgaacagtctattcgtgcatttgctgagtcctcgatgtacacagcttaccagaaaaagtggccactttacctctccacaaaaaacaccatcctcaaaatatatgatggaaggtgtgaattcactggcctttatactttcttgttagagtctcaccgaaatcatttcaccatctagtcatactgccctgatattaccttttcatcttgttttcagattcaaggatatattccaagaagtttatgaagctaactggagatccaagtatgaagcagcagggatatggtgagatgtgcatgttattagcgacattctattacagtacaccatgcaaacttgtaaacaaagttaatgaaatccaggtatgagcatcgtttgatagatgatatggttgcatatgccatgaaaagtgaagggggttacgtctgggcatgcaagaattacgatggagatgtacagagcgatttcttagcccaaggtttttcctcttaaatttgagatctgtctagggactgaaaccttaattctgccaaatgcattttggtcttgtatcatggttctttgttctttacttgtgatctaaatggggacagaaacttcaattttatttctccttatgaaacaaagtttctgctctccgctgcaggatatggatctctgggaatgatgacttcggtgttggtatgaaatgacgcgggcctcagccaaagtttttggtctttatcatgataacatgtttcctgcgcatcattatattttatgtattaaatttgagatatattacaggtttgtccagatggaaagaccattgaagcagaagcagctcatggcacagttacacgccactacagagttcaccagaaaggtggtgaaacaagcaccaacagcatagcctctatttttgcttggtccagaggccttgcccacaggtaacgcatttccactgtctttaaacattttcatacttggtaattcgtgttgctactctggagaaaatccagtcccttgcttcaataatgagttagtctatcagggattgtttgtggtaagatttgtcattacttgtctctttataattgatcactgaactatgtgaaccgttttacctttggcataaattgagtttaaagtctctgaaaactggttgagttcatcttaacaagatgtttggtatgtgatggtaccagggcaaagctggacagcaatgccgcactcttgagctatactgagaaactagaagcagcttgcatggggacggtggagtctggcaaaatgaccaaggatctagctcttctgatccacggagccaagtaagactaaaacttgagagaaagttgatgaggttgatgcacttaataaaaaatgtttaaagataagtttttgtctactatttgaacagggttaggagggatcagtatgtgaatacggaagagttcattgatgcggtggcatgggagttaaaaagaagattgttaggcaacaactccaggttgtgagaagaaagaatggaaatctgaaaagcaaagagtctcagcagcgtgatgtttgatttgatgctctttcataggtgtagaacttaaagcctgaaaaggggctattgcatgaataaaaggagatagactaattgggtaatttattgaggaactcagatttcccaaagccgagactcactcctcattgattcgttaaaaattgaatctttttagcccttctttctctgtataatctctgttgtaaaagctaccaatcaacagaaatggctacgttctcgttgtcattatcttctctttccctttgtattatttatctggcaaagaaatgaatggttgagctttagttataagtgttccctcttgctccctcaagttgctatggctatgtgggattagtaagaagacgacggaggatgattttgatgataacagctcccgtttgtcctcctcaccttctcctacgccattcttctttgcttcgccatgaatcatcgatcggaaactttcatcggaagaaaaatccacgtttcagaaccgtatcatgttcttctttgttgccgcaaccgtcggttcgtccggataaggcatcggagttgaagactctgtggaagaaattctacaaagtcgcgtcgccttattggttttccgaggacaaagaccaagccaggcttcgtctcgccgccgtcttcgcccttactctcgccaccaccggcattagcgtcggcttcaatttcctcggccgtgatttctacaattctctcgccagtacgaattcttcaactctctctctcatttctcacttttcaaaaacaacttgctctgttgatcctcttttctctgtgttcaatagacaaagaccaagagcaattcaccaagcagttgttctattacctctgtgctttcgccggcggcattccggtgagttttcctcacgctcctccctctgtatccaatctcaatgaatgatgttgttcactttccctggattttgcagttctttgtgctacgagattatacaaaagagactttatcactgagatggagatcatggatg

SEQ ID NO: 20711 - DNA, 3003 bp, Unknown
  misc_feature (1)..( 3003): 2750-1469P.txt file - cDNA_ID_1828199; gDNA_ID_1620776; Annot_ID_50300
ttcttatcccttgtgctgtaaaagtaccattccatgtcgtttcccggcaaaaatgacttttctgttccgcgtattatccaaataaataactcataaaacctccaatatcatatgtatgaatgcatcatgaccaatatatgtaatctataacgtcagattgacataaacaagctgaaccatatatagagagagatataaagagttggatcgtaccaggcaagtcccatggctcgcatttataaagatcaacttctgggatgatctcgagctcaatggcttggccgttgaccttcctatcaagatagtaagccaccagttcttcatcagtgggatgaaacctgaatcctggaggcaaactcatgggcgccattcaaagtgtatgcgttagaaaacgagagagaaagagatgagagagattaattaaagtgattaggatgttcgtacgacatatgaaggtgactatatataattaaaaagatgagactctgaagaagatatgatatgggaatgtgtaaaagtatgccatgggattggcatcttctgagattaatattttgtcttactttgggttgctttttggtcagtgtttgtcatgatactcatcacacatattttctaaaaccaatatatatattttaaataaaaacctaactctggcttttgaagattctgcaagtgtgaaaaccctagtaggaggagagacggaaaaagctttagcaagaaggccccatctcacaaatactcacatatatgaatgtatatgcttataattccggttagaccttaacgtgggtcatgaatcattatagagggatttttataacgtttgctttaaaccaaaaatgaaggctttttatgattcaacagtttaggggacccatctcttcttctcaaaccaaatctacctggcgacacctaaacactcggctttttcttttctttttttttcggtttgacagttttgttatattgttttatgttgttatggtcttataataagaatacttataaattgaattcatatatatgattaaaaaatgggagaataaaaaagcaggaggcatccaagtcgactttggctttagtgttgggaggcttctttagtcccttttacatatggattaaagacgttgttcggctcttttacatcattactcccacacaatctttgactctctttctctcggcccttcaattttactaacttccggtcaaatctcttttgcctcgactctcggcctcgatccaaaagataaattaaaaaaataaggacatcttcattcttcacatgtatgatatatataactcatgtcatatattagatgtctcgtttacatggttttttttcgtttgctaatatatataattcacatgtagacgaagaacattgtaaacggaatttaacagaatgaagtaatcaaacgttttatgtaaggaaatgatcaaatactgagggagtccacaagttgcgacatatataaaactcctccattcttataaagtataatattcaaacttcaagtaagtaactctcccttttccgtgagaaagaaataacaataacattttagggaagctttaagatgtggtcaccaataacttagggagagagagagagagtgacagatacaaaaaacaaaagatagcaactgaaaaatattttggcgaaagatgctttaacagtttaacttatcaaacgacaacaacaagacatgccccaattgtttcaccactttgtttttcttggtcacaaatcgagtctaagtctatatgaacaagtaattaatgtgagtactatatataaaaaaaaatgtgactatatatataaatgttgtatcacaaatgcaaaaggaatgtggattaattaattaataaagacaacgaggaagctaacatgcaagcctaactaaagacatgcaacctttgatacgatctaaggggaagcgaataaagctaattaagatctaagcatcttatcttatcaacccttttatatttccatttcacatgtatcaagtacctatactctttctcaagcttatagtattgatatctagagtatcaaataaacattaattaattagacgtaacacaatagtgacattattaaatgaatagtaaacaaactttacgtgtatatatatccatgacgaaattggcaaaggcgggactctatgggggaatcatgataatacatacatacgatatacatgttgacatgtatcatgtatcatgataatacatacatcatcccttttttgttggtttgttaataaaatgatcatacatcatcttaaacatcaacatcaatcacaattcttctaaaagagaagaagagtcttgttcagaaaaagtagcatctgattccctacatgtcggtttccaaaacatattttttttccatctcatattagtttgtgctaaacaaactgatccaaggaaaaaagaaaagcctttaaataatacaagttggaatccctgtgtctctagagattcttgctttcatgttttttcacgcatctcaattatagcagaagaacaatgtcactgtccaaaaacatttgcgttatttgccttttgcttttctccatgcattaaatctcatttctacccttgttaaagtggtcacactcattactctttttaatatactaatcctacaggaccacctcgtgattgttatctcaaattttgattaattattcaatcaattagccaaagcagatcttcttcaattttaagattttgatgattactgttaaagctgactatcactgcggggaattcaaagatgatgctagtatacaaaaagagaagcatggtttcaaattgcagaatcaggcccatatataagtgggcttgattatttgggcttttggaagagtgtggcccaacatagagatatagagctgttatcgtctgtctttcatggcggagcagaggtgatcgtttcactattcaatttcactcgtcgatcattaccaacctctgcgggcaaagatg

SEQ ID NO: 20712 - DNA, 3000 bp, Unknown; identical to SEQ ID NO: 5294
  misc_feature (1)..( 3000): 2750-1469P.txt file - cDNA_ID_1828257; gDNA_ID_1620776; Annot_ID_50317

SEQ ID NO: 20713 - DNA, 3003 bp, Unknown
  misc_feature (1)..( 3003): 2750-1469P.txt file - cDNA_ID_1828261; gDNA_ID_1620776; Annot_ID_50315
cccttcctttctggttgttggcaaacaatccggaacttaaagtattacagttgcaggataatttatttaccatcttccagatgcctgctacaatagtgcatgagttgcagttcttggatttttcagtgaatgatattagtggactgctccctgataatatcggttatgcgcttccgaatctgttacgaatgaacggctcaagaaatgggtttcaagggcatttaccatcttctatgggtgagatggtaaacattacatcccttgatctatcttataataacttctccgggaagctacctagacgctttgtcactggttgtttttcactaaaacacttgaagctctcccacaacaattttagtggccattttcttccaagagaaacaagctttacttccctggaagagttgagagttgatagcaactcattcactgggaagatcggagttggtttgcttagctccaacactacgttatcagttcttgacatgtccaacaattttctaacgggtgatattccaagctggatgtctaacttatctggtttaactatcttgtcgatatcaaacaattttttagaaggtacgataccaccatctttgctagccattggctttctttctctcatcgacctatcgggaaacttattatctggatccttaccgtcacgtgttggtggggagtttgggataaaattgttcctacacgacaacatgctcacggggccgattccagacacgttgttggaaaaggtccaaatacttgatttacggtacaatcaactttctgggagtattccacaatttgtcaataccgagagcatatatattcttttaatgaagggaaacaacttaacaggatctatgtcaaggcagctctgtgatttgagaaatatcagacttttagatctttcagataacaagctcaatggcttcataccttcatgtctatataatttatcatttggaccagaggatacaaattcatatgtaggtacagccataacgaagattactccgttcaagttttacgaatccacatttgtggtagaggattttgtggtaatatcctctagttttcaagaaattgaaatcaaattttcaatgaagcgaaggtatgattcttattttggagcaactgaattcaacaatgacgtacttgattatatgtatggaatggacctatcaagcaatgagttaagtggggttatcccagcagagcttggaagtctctcaaagctacgagtcatgaatttatcttgcaacttcttgtccagttcaataccatctagcttctccaatctcaaggatattgagagccttgacctttcgcataacatgttacaaggaagtattcctcaacaactaaccaacctttcttctcttgttgtctttgatgtgtcttacaataatttatccggaatcattccccaaggaaggcagtttaatacctttgacgagaaaagctacttgggaaatcctcttctttgtggaccaccgaccaatagaagttgtgatgctaagaagacctcagatgaatcagaaaatggaggagaagaagaagatgatgaagctcctgttgatatgttggccttctattttagtagtgcttcgacttatgtaactacattgataggcatttttatacttatgtgctttgattgtcctttgcgtcgagcatggctccgcattgtcgatgcttccatcgcctcagtcaaaagtatgttgccttaaaatcatttcacttcagtttttacgtaccattgtgtttctataactatattgctttggattttacctgacatggttaataataatgtgtgctttggattttaccatacacggtaatgagtcgtatggaagaattattgtgtacgatcgatagttttttttgacagatttattcttttagtgatagagaaaaaagtaagtaacaatttttttttaagagatatatatttggtaacgacagagctgtttctttcaatggatttatttttcatagcgacatagttaatgtaacaaattaatgactaaagtagcacaacattgactctagacttattctacgtcctagtaaatttgttaattaatggaatcaacttttagaaatagttgtgacatagtaagtccgtattggctgtgatagacttgagtctgattgaaatgggaaaacgttgatatgaaagtggtgacaaacttaatatcaccaaactaaattactaactctctcataactatgaatataactgtcacaattacaagtataactctatcataactcataactatatatggttaaatgagtatgtaactaactatagttcacaagggtaatatatatagtaaattcttgattgctagatgcaggagggtaaacttgaactttgttgtggtatctagatactttcggacaaataacgtataggtgatgaaacaaagtgcatatcttattgtacagttttagactttaatttggataaccctactcattgccaaggttattatcgtttagggatatgattttgcaaagataattctcccaatagaaacttaggaacttgccgagttctaaatttctaatgaagaaaaccatatctcataaaatttaagaatttgtggcttattgtgttaagttactaaatcctagagatgaatgcttagtttggtaataaaaaccaagaaaatctcattacgtcactttgagaccacaactaaacccgtttgaacaaagtgggtaaagtaaatccggcccaataaagcccatttatttccaagagaataataattagaaaccggagagacttcacggatagggtaaaaaagaactcagaggttaatcggaaaaataaatatttggggtgaagagaagcttcttctgctcaatcatgtctaacaactttggtgacagctaaagaaaaactaagttagaagaatatttagataaccttcaagctcgagaccactcggatctctctctaatcgccgatcggaatccgccatg

SEQ ID NO: 20714 - DNA, 1123 bp, Unknown; identical to SEQ ID NO: 5342
  misc_feature (1)..( 1123): 2750-1469P.txt file - cDNA_ID_1828272; gDNA_ID_1620780; Annot_ID_50353

SEQ ID NO: 20715 - DNA, 3003 bp, Unknown; identical to SEQ ID NO: 16530
  misc_feature (1)..( 3003): 2750-1469P.txt file - cDNA_ID_1828287; gDNA_ID_1620780; Annot_ID_50349

SEQ ID NO: 20716 - DNA, 3000 bp, Unknown; identical to SEQ ID NO: 5340
  misc_feature (1)..( 3000): 2750-1469P.txt file - cDNA_ID_1828293; gDNA_ID_1620780; Annot_ID_50347

SEQ ID NO: 20717 - DNA, 3000 bp, Unknown; identical to SEQ ID NO: 5328
  misc_feature (1)..( 3000): 2750-1469P.txt file - cDNA_ID_1828295; gDNA_ID_1620780; Annot_ID_50346

SEQ ID NO: 20718 - DNA, 3000 bp, Unknown; identical to SEQ ID NO: 5329
  misc_feature (1)..( 3000): 2750-1469P.txt file - cDNA_ID_1828299; gDNA_ID_1620780; Annot_ID_50344

SEQ ID NO: 20719 - DNA, 3000 bp, Unknown; identical to SEQ ID NO: 5329
  misc_feature (1)..( 3000): 2750-1469P.txt file - cDNA_ID_1828299; gDNA_ID_1620780; Annot_ID_167911

SEQ ID NO: 20720 - DNA, 3000 bp, Unknown; identical to SEQ ID NO: 5330
  misc_feature (1)..( 3000): 2750-1469P.txt file - cDNA_ID_1828307; gDNA_ID_1620780; Annot_ID_50342

SEQ ID NO: 20721 - DNA, 3003 bp, Unknown
  misc_feature (1)..( 3003): 2750-1469P.txt file - cDNA_ID_1828315; gDNA_ID_1620780; Annot_ID_50339
accagctatgttccaaataatcacataatagcaaaattagtaacaaagcttcatctaatacacaaccttgaaacagatgtagctgacagtggaagaaacaattaaaaggttcaaatcctataaacaatctcaaatagtcacgcgccagtgtaacttggattccatcatgccgattagatctacatgttgttcctctagagaactagatctccatgatccagaatgactatatttcttatctacttatctattactctgttcttgtatacaagattaagtcactggtgaaactaagtatttgttttgttctgatccactgaagaacacaagcaagacacaaaaagttcactgtcctgcatcaaaacgtacctggctggggatctggcggtcgtaaaagggagaatcacgagagacattcatgtcgtatccaggaggcgtatgaacataaacggacaagtacttttcattgcctttaaaaaacttctcccaaagcggaagcataggtaaaggccctctcgtcagaaacataaacgccactttcggaaccctatcgtacggatactcttccttcaccggaaccatcgaagctctccagaacaactcatcatcagtcattccatgactcagattctctggccgaacaaacccatcaatgctccaacaatctcgaacctttggtttctccgccttgactcctccgtcgtcgctctcgttgtcgtcgttacctgtgcagtctcggtggatgattgtgcaattggagtaatcaggagtcgaaaaaggaatcgattggaggttagtggttgatgagaacatcctcggcaaagaattgaagtagcgatcgatgtgagaacttgcggcgagaccgatgatgattccagccatgaaaattagcaaaaacgacagcgtttgcgccagctttagtaaccctatgtgtttttctccttcctctttccctcctctcgccattgttcgagaaactcaaaacttgtctacccaaacaacaacacagtgatgatctctgttccccaaaaataaagtttcagggaaacattcttatgattcaaagagaatctgattgtttcaagcacaaatccattgcattcaatctcctcgagaaatttcctaaatttgtaacatataattaaatccaaggatcaaacgaaatcgaaaaaggtaagtggataaatggaaattggatctgtggaaatcttcgaggaaagtgagaaacgatgactgaaacagatcagaaactgaatttcatgcagagaggaagaagaagaagaagaaacataaacaaatctggtcttttgtttcttccagttgaaatctatgtgtgtgtgtggttgattttgatcttatatatataaaagaacaaaattaattggaatgttatgcttaatttaattagattaattgagtttaaaactccacgtcgaaaagcataacgagttcaaagtccgcagatcttgccagatgggaataatctattggttttaagttattgggccggagggcccacgtttaattgtgacgtggtttagtgctcgtcaactctttggtccgacatttcacttttttttttatagaaataattctagatatccagtagtcaaacttattgattatctaatttctatatccttactatttttaaaaaaattacttttaacatttctagaatttttcgattttttctgtacttattaactattagtaaaatttattgatgcttcttttggttatgttatagtattgagacaatgtattgtattctaattttgattttttttttcctttttaatgatttgtagattttgttttttcattattatatttgaaaaaatatcttcttatatcttaatcaccagaaaatctaaaaccgatggctatactaatttccggaatatatgaaatgtttatttttctattaaggatccaaagcagctaattaagattaaaaacttgggaagaactagtatcccaaacaaacaatatgatatccagatgtccaaaaggaaaaagaaatggtatcaaaagaaccaagaaatgtgcctagaaatttcatatagttagcttggaaatttctgatttttatgtccaatgtttatttattttttccttataattatacttgtcatacatcacaaagaattgtcaacattgccaaactagtcctaagatgttggaaggtatgatgatagacaacagttctaaagaagggaagatgagattcaggcaacaaaaaacacatatagttcaaaaaaattaggttggtaggatcaattattcaaaaaacatacaccaaatagattttagtaggggttgtttgtccaaaaaaaaactataatagtttacgaaaatagttacaccttgtgaatagattttttgtttgccttcccttgaggtaaattatgtcgcgagaactatatgaacaacaacgagatccacaacaacatttgattacatttttatttgaaccttcacattgatttagtaatgtgggattccaacatcatctaatgttatatgaatggatctaatagatgataaattgttaaatgaactgataatttttttttatttttttatgtgtatttcacatcacattgtttttttttttttttttttaagtaagaaaaagaagaagcacttgagaccgatcagaaaaaaattagaaagatatgatttttgtaagtcttttgaaatttgaatcttgtcccgtgtaattgtgaaatcttacgtacgtcctctttatgacctcgtcttcgctcatttctgccttcccttacgaaatccccaacgaaaaatcttagcttaacaccatcgcgaccggattccaaattccggcccatcgtctcaccgggaaagaccccgcctattgccgccgatttcggttccggtctgctcagatctaatcgagtggcttccttcttcctccagatctcttcactttgaatcggttactcgatctcgattcgcggagggcttttgctagtcgcgatg

SEQ ID NO: 20722 - DNA, 3003 bp, Unknown
  misc_feature (1)..( 3003): 2750-1469P.txt file - cDNA_ID_1828334; gDNA_ID_1620780; Annot_ID_50331
agaaacaaaaccaatatatgttatcgatcgatggagaagtagtgactcttttgattcttcgatagtcaaaatcatcccagagagattgaattgtttctttaagcagcgacgactttgtccttggcggcattctctcctcctccttcgagctggctcaagtttcctttctccttgatcagctgaatatgatgatgcttgcaatatagcttaccctcgtgagctatgtaattcgaagggcttatcgtgcagcctccatgtgtacacttgaagcagctcttgtggtacaatgttccattcaccgatacctacacaaagtccacattataagcaatgtttcagctctggtttaagccaagaacagatcagattcgttatggaaacaatctaacaatcttctttgacacaacttgattctgatcaggaaagatttgagattggataccttctcaattggatacacggttttgtcgcaaccaacgcatttctctcgtgttccaccaaacatattcgaaactttggttccagcaggtctctgttaaacttctctcatgttaaatgttaaaaaaattcaagaacctcaaaaacagaaaaagggttttgttctgctgtccgaaagtacctctccctccaaaggcctatcaggtttcccaatctttggtgtccctgtacatatatatgaatcaaactttagatagataattccaaatttgaaatccccactcacaaagcttttcacattttgatctgtttttggtaatttaccttcgaagcttttctcaagacttccagttctcttgaagttttgatcgaaatgtggtctgcagtagagaactccttcaaaggagttgtaattgctaagctgactcatcaagaagaagaagaagaagaagaagaaacagaacagtcaaatctttagaccaatcagtttccatagccaaaaattcaaagatttctacttaattgattggacttcttcatctacatatatatctactagatctacttctggattaatgagaaatcatcacaaactagaatcaaagatcaaaccttgagagttcctttgcaatggtgacatcggaaacaagctttgtggtagacccggttatcggcggttaacttgtcgacaagataaactgttttgtcacatgccatgcatttctgggttgttcctgcgaacgccattcttgtaagagatcagactaaaagactcaggaaaaaagaaagaagctcaatagtcttgagagagagagagagataaagaagaataagatgaagatgaaagaaagagattgtcaattattgttgcttgttttaatatggggaccagatatattgaaaaatgaacatgcttcttctttttaaatatttaaagtaaaattcttttaggaaaaattgaaatttttaataaaatgtcacaaacaaaaaagttcaagatgagtatcgaattttggatgcaaattcgaatatttggtgtttctgacaaccctagcattgtttttcgtggttgtctaatccacaaaacaagataagcgatgaataaataaataatttgaacgttagcaacaaaactaaaaactgtactacaaaaagaaaaggtttcaacggcattttttgtgttcttaattatttttgtccaaacttgaagtaacccgtcaatatctgtctcctagatattttgcttatattttttttacattaattcagttcttttatatctagagtcaggtaattatttagagaatgcatgcagttgcttgacagtgcgtaagatttacacaaatttttctcaacagtgaaggcaatgctcaatagtcaataactgtttgtaaggaaatagaacagggaaaaccaactggaaagaatctttgtctggttttagataatgattaaaagctgtattggttatgttgaattagttggaaatctctaaatatctatacactatttattttctttaatactatatgttgtgtagtgtgtatatgaataatgaaaatatctgaaacatgctttaccataaaggcttttgatgagctgtagtattgacataattggttgaagagaatgagtgatcataatgatacctaacatcttttatttaatcaaaaatacctaacgttatttttatttgctactataatagactccaaccaatttattagtatcattttatacagtttctaacatttttgccactgcttagatttatgggctttccctttctgtctgcatgggcctcctctcttatattaataatctgacttaatgaaaacttttaaatcttttgtagtttattttcctctagatgctaattttagcaaaatgaaaagatgtgtgatggaaacgtaaagttaaagcaaaagaagatggtgaattggtgatgcaatattttagtcatgtgtcattgtttacatttatgatatattttactttaaaatacttttcttcattttcaatttttataaatcttcgtagaacacatattcacaaatgatgctactttggtgatcagttactaaaaaataccgaaattgattttagaagatagagacgtgaatctgtttgccaatattaattgggctcaacttaagcccaaattatataaggaaagactacctagtaacgaacaagtagcaggtcaactgtccgagcgttggccaaatctctctcacttccacaggtttctctctccggccaaatctaacctccggggaacgtcgttggtcacttatcaccggttagaatttccttcccgctttatcccgtaaacttttttcccattgattccgatcgtttatgttccttcaccaaatcgataaagtttgatctttttccttttcactattattaacagaccaatctgtttacacaagaaatctacagtaacttatcacttgaaaagttttgataaatagttagtataataatttgttaattgtgtgtgtaaatttgatttcttgattgtgtgtgaattgtgatgaagagggaaaacaaaaaatg

SEQ ID NO: 20723 - DNA, 3003 bp, Unknown; identical to SEQ ID NO: 20722
  misc_feature (1)..( 3003): 2750-1469P.txt file - cDNA_ID_1828334; gDNA_ID_1620780; Annot_ID_167899

SEQ ID NO: 20724 - DNA, 3000 bp, Unknown
  misc_feature (1)..( 3000): 2750-1469P.txt file - cDNA_ID_1828338; gDNA_ID_1620780; Annot_ID_50330
aaggttgaagcttgtggatggtagtgaagcatctcattccacatcatttctcttatcatctcctctctcaaatcctcatctacatcgagatcgataggaacttgagcaggagggtttgcattcgggtcatatagaggcgccatgtatggatgctggagtgcttcagagacactaatcctctttgacggatcaaaaacaagcattttctgcagaaggtcgatggccaaaacatgagcgcccgggtaaagtctggataaagacatcccaggtgagtacggaagtgatctaatgtatcttttagctttcgggttatctatgaactcaagatcttcttctctttggcttccgagaatgttgacaatgagcttcagctggttaagacattccgttccttggaatatcggtttcctaccaagaagctcggcgaaaatgcaaccaacagaccaaacatcaatggatgttccatagttgtcacaacagaggagaagctctggggctcggtaccaacgagtcacaacatattcagtcatgaactgacccttggtgttgctcgcacgcgctagtccaaaatcgcatatctttaaatcgcagtttgcgttgacaagaaggttaccaggtttcaaatctcggtgcaggatattggctgaatgaatatacttgagccctcgaagcaactacacaaaaagaacaaagcaaagcaaaatttcaggagaaagcaaagctagaaccaacagtaaatgaacgggatcaaccacacacctggaacaagaagtattggcaatgatcgttactaagaacttgagaagacttgataatctggtggagatcagtgtccatgagctcataaacaagataaacatccttgaagctcatcttatgaattggcatcatgacatctttcaaagcaatgacattctcatgtcgaagatggcgtagaagcttgagctcccgaagagtcctcaacgcatcgatcctattctcataaacattgtgaatcttcttgatagcaactttctcgttggtgtcactgttaacagaggagcagacaacaccgtaagctccacgaccaataggcttgataggcatgtacttagtgtcgatctcgaacagagtttgccacattgagaagtaatgcttcccttcattccttatcccattaggaggatcaaccaaagtcgccattttttgttttccctcttcatcacaattcacacacaatcaagaaatcaaatttacacacacaattaacaaattattatactaactatttatcaaaacttttcaagtgataagttactgtagatttcttgtgtaaacagattggtctgttaataatagtgaaaaggaaaaagatcaaactttatcgatttggtgaaggaacataaacgatcggaatcaatgggaaaaaagtttacgggataaagcgggaaggaaattctaaccggtgataagtgaccaacgacgttccccggaggttagatttggccggagagagaaacctgtggaagtgagagagatttggccaacgctcggacagttgacctgctacttgttcgttactaggtagtctttccttatataatttgggcttaagttgagcccaattaatattggcaaacagattcacgtctctatcttctaaaatcaatttcggtattttttagtaactgatcaccaaagtagcatcatttgtgaatatgtgttctacgaagatttataaaaattgaaaatgaagaaaagtattttaaagtaaaatatatcataaatgtaaacaatgacacatgactaaaatattgcatcaccaattcaccatcttcttttgctttaactttacgtttccatcacacatcttttcattttgctaaaattagcatctagaggaaaataaactacaaaagatttaaaagttttcattaagtcagattattaatataagagaggaggcccatgcagacagaaagggaaagcccataaatctaagcagtggcaaaaatgttagaaactgtataaaatgatactaataaattggttggagtctattatagtagcaaataaaaataacgttaggtatttttgattaaataaaagatgttaggtatcattatgatcactcattctcttcaaccaattatgtcaatactacagctcatcaaaagcctttatggtaaagcatgtttcagatattttcattattcatatacacactacacaacatatagtattaaagaaaataaatagtgtatagatatttagagatttccaactaattcaacataaccaatacagcttttaatcattatctaaaaccagacaaagattctttccagttggttttccctgttctatttccttacaaacagttattgactattgagcattgccttcactgttgagaaaaatttgtgtaaatcttacgcactgtcaagcaactgcatgcattctctaaataattacctgactctagatataaaagaactgaattaatgtaaaaaaaatataagcaaaatatctaggagacagatattgacgggttacttcaagtttggacaaaaataattaagaacacaaaaaatgccgttgaaaccttttctttttgtagtacagtttttagttttgttgctaacgttcaaattatttatttattcatcgcttatcttgttttgtggattagacaaccacgaaaaacaatgctagggttgtcagaaacaccaaatattcgaatttgcatccaaaattcgatactcatcttgaacttttttgtttgtgacattttattaaaaatttcaatttttcctaaaagaattttactttaaatatttaaaaagaagaagcatgttcatttttcaatatatctggtccccatattaaaacaagcaacaataattgacaatctctttctttcatcttcatcttattcttctttatctctctctctctctcaagactattgagcttctttcttttttcctgagtcttttagtctgatctcttacaagaatg

SEQ ID NO: 20725 - DNA, 24 bp, Unknown
  misc_feature (1)..( 24): 2750-1469P.txt file - cDNA_ID_1828357; gDNA_ID_1620780; Annot_ID_50323
gaattccagagtgcttcagatatg

SEQ ID NO: 20726 - DNA, 3003 bp, Unknown
  misc_feature (1)..( 3003): 2750-1469P.txt file - cDNA_ID_1828377; gDNA_ID_1620781; Annot_ID_50359
acttaccaaaaaagtgattgtttggtttgactatgcgagtggagtcagagaattagtacttacaagttacatcttagtgctaatattagtagatgtagatcttaggattagtgtaaacttagtatcatcaaattaaatctactttatcattcttttagttatatatgtagatgatagtaatatgattaagttataaatgagtcactttcttattgcaattttactagatattcacaaaatattagctatgtaaactttctatctctgctttggctctctaaaccgttttagttatgaaagcggtttagataaaaagaaattctttatttgaacaagtacaaaatatgtatctcgaagtcgaacaaaaccatatttatttcatcttgcatctgactcgtttgattggtgtttgaacgaaatagataaaaaccttgctattttgttctttttgataatttgatgaaaccttgttacgtacggaatatgttgtttgtatgtactgcaaagcataagaatattcgtggagatgcctagttatttttctctgtaattcatacatttaagtcgtcaaaataaacatgaaggatatagattcattgaatttttaacgaatgaaaaatttattccatcaaaaactgtgtttacattatatgcagcctttttaagagagtttttgaaaagcattgaaacgtaaattgaaattgagcaacttctaaacaaatcttatcctctagatccaaacaaaatccgaagaacatcgtcgtgcttggatgaaccgttacttgaaaaatcattaatcatagctgatatcggacggatcgttcaatgaaagtgatgatctgcttgaccatgtttgtatcattgtatgctagccgcgttcgacgacggcaactttttttttctcaaaaaaagaaagatgattgtgtgtaaaattaaaggcaggcagaaaaatctcgtaagcataattataacgttaatgttgtaccaaagtgacgaaaattgatttgatttgactttttttttaaaaaaaatatttgattatatttacttgttttttttttttttttggggcaaaagattatatttacttgtttagtatgcatatttatgagtgttttgtggctttgggaatactatgcggctgagaggttaagatatggaagcaaggctacatgatatcatgaaaaatctactacttttgtgttggttgtataaacattataaatttatgatcatggatatgtaatcatttttgtagaagctacatgatattggtatattggctaaattatgggatggcacatagttgaagcttagattcaattaaaacttaacctcaatatactgatttcaagtaatttggtctcacgaacatagagatatcccctccattaccccccaaattggctgcccaagcggcagtatatcacatatggagacagcggaatcatctccttcacaatggcatctcaattccgcctccaattgttttcaagaacatcaatagcgaagtgagaaacaccattactgctagaacgcccccgtaaagtctttcgtgccttaattgctctttggatccgttaatgggttgattgatactcaactcttctttgtattattatttttcttgacaaagtttacatttgtaggttcagctttttgtaaaacttcaacacttcattctaatgatgtttacattcttataataataaaaacatagagatgtcatatttatttctatttatttatgtactatattacgacgaagtttgaacttgtgagaagttagaaaagaagttattactttctgaatcaacatttaaaaaataatagatgaacttaaatagtaaattgtacgtaaaagtcgaactccatcagctaatttctttaagtcttaccacaaaagactaatatgagtcaaacttgagacttgttcgttggaacgctgaagttaccaaaaaggtcagagtgaacaaaatcttttcaggcatttagtcagactgagatccaaactaagtggtgaaatggtaaattacactaatgtcattgccctccattggccattaaagccttctattttctgacattggtcagtgggaatagaaactgtgaagaagaatggaatagaagaaactcggattctgagaatccatttaaatttttttagtttaatcctaattagaaacctgaaagcaattgattagtgaatttaatttcgaatcttttgtagttgcagctggcctcgatcggcccttgtatccttttattaattaaagacttcaaaccaaagcgacaaaattaaagcggttcttaattggtctttaataatttttcatctcgtcctccatatatacgattatacacatacactgttcacacaaaaatacatacgtagatttcatgcacgtcaatgtgtatctatgttcgttgttcaccatatgtcacgatacacacatgtgcacgtgtgtatatatgcgtacacgatatgatgatagtgcatttttgtatcatatgcgctgattctagaagtaatggcaatgcttcattagtaattaagtatcgataacatactaaagtatcgatatgtacatatattttttttcatgataagaagaaatacgaaaggcctcaggcctgagatatagtatatagtacgttattgtcttattgattatattttttcttgatcttgtcctcgtgtttataacctttccttcagctccagttttgaatattgtttaataagtaaaaccaaagatagctttcaaacaaactttcttgggaaattaattcaaaaataaaatgaaattttaaaaactcagctgaaatggcggctgatccttcgggttcagacccctggcaaggaagcatatattgatttcaacttaagctaaaccacttcacttacttcacttcctcttctctaccaaactcactctagctagttccacttagggttcctctcttccaactcttttttgtttttagggttttagagaaatg

SEQ ID NO: 20727 - DNA, 3003 bp, Unknown; identical to SEQ ID NO: 20726
  misc_feature (1)..( 3003): 2750-1469P.txt file - cDNA_ID_1828377; gDNA_ID_1620781; Annot_ID_167943

SEQ ID NO: 20728 - DNA, 3000 bp, Unknown; identical to SEQ ID NO: 5347
  misc_feature (1)..( 3000): 2750-1469P.txt file - cDNA_ID_1828381; gDNA_ID_1620781; Annot_ID_50357

SEQ ID NO: 20729 - DNA, 3003 bp, Unknown
  misc_feature (1)..( 3003): 2750-1469P.txt file - cDNA_ID_1828392; gDNA_ID_1620783; Annot_ID_50391
agttacaagtgaaagaaatcagtaattttttatttattttagaagtgaatttggtttgagacaaacacgaacaataaacttataaatctacttaattaattttctgcttagctgaatgagtttctaaaaaaatttggttgcttattaaagattaaacaaaatgccgattgcagatctttcacgtggttaatcaatttataaatttttaaaacaaaacaatcgaagttcaattttatttttgtcgtaatcgaagttcaattgttggatacaggtctgacgcgatcgtgataagattttatatgctatttaaaagaaatcatgtggcctggccaaacacacaagtgttattagtaaaaaactatcttcagacttgttttatataaatacatttatttgtatcacctattatgaattgttttttctccatatatatacgttgggttatatcttatttcaagtgggtagcttatactctctctgttcctttttgtttgattgtttagaaaaaacacacatattaagaaaatatattaaatgttgattataaatgtattatttttagtgttttacagttttctataactctaaaccaatgatagttaactatttttcttgaaaattacaattcaccaatactaaccaataaatattacatagaaaacttaaaaaattaatcttttagaaacaatttttttttctaaacaatcaaacaaaaaggaacagagggagtatttaattgcatcagttacaattttgagaaactctcttactaaaaataatataaacaattaataaataagtagagagaatgacaaaaataaaaaatagtttctctgcagagaaactttggagtaatgatggaaaaactatatgtataggtatgtgtttataattggacagaaactaaattatattaaatatatattttttttttttttgaaaaacttttaaagtatatgtaaatctattggtgagatggctaagtttctcttcttctattttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacaaaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaaatg

SEQ ID NO: 20730 - DNA, 3003 bp, Unknown
  misc_feature (1)..( 3003): 2750-1469P.txt file - cDNA_ID_1828396; gDNA_ID_1620783; Annot_ID_50390
agttttgattataaaaaaaaacaaaacgaaggcatgccaattttagtctgtaattaaaagttttgatgacaaagttttgttctctttttttatttggaaacaattgaaagcaaaactatcagttgttttagcttttttcccaaggaagttatatttcgacaattgagtttacaaatgtaatagaggaaagttaatttagcgtcaactattcagataaacttgaagatataatttgcaaagagaaagcttgtgaagttgaaaattcagggattgttccttttccaaggttgatttatcttcgtttaatgaacctactgaagttgaagagtatctactggagtcctctttccatgtctagagacaatcactatacacgaatgtcctaatctgaaaaggcttccactcgattccaacagtggcaagcatggtgaaaatgcatgcatgatacgctacagatatccagaatggattaaaggtgtggaatgggaggacgaagctaccgaaacccgattcttatcttcatgcgaacaggtctaacatttctcctcttctcttagttgattttgaaggagtctaactgcttccatctttaatgcctcttgtctctttttatgtgtgaacttttgttataggtggaagaaccataaaccccaagttgagaacatatattgggctctctacttataccgctctaatgtgtttataatggaagttttagtgttttcagtttctttaataggtttgattctagtcggcttgagttcaatggctcacatggttgcaaatttgtagctcctacttacattatatttgcagtatagacagatttgtgtttcgaatattgtttgtggctactctgttcctatccatggtctttatatataaatgtttactactactaagtctaacctcaaagcctttatgtgtctctgtctcatccaccaaactatgaagcctcttttgttattaagaagacggtgcacaaaccaactacatatgacaacatttgcatcttctttcacgtttgtttttttaggcaagaaatattttttcctttgaatttagtcacttcgattattattattattttattttatttttttattttgttaaagcacttcaataaaattttgaaagtggatttggttaatctcttattcttctttaagttgttcaccaaacccctactgatatatgatcaatactcaaccaccttttgtttttgtcccaattatttgcattatggccttgaatgttttgtagattttgtaagagtttttggattttgtttttcaaaaacttattttcataccaatcaaaattttaaaattttggttttcctacaatttagaaaaactatttttgttgtagttttccattcatgattttagttttttagttttcctaaagttagaaatctagtttttactccatcaacgttatttttaaaacaaaaatatattaacaaaaatctaaaactaaaatctaaaatctagaaactaaaatctaaatccaaaaactgaatcgaaaatcagcatccattcagggcctaagttactaaccacgttaaaaacgaaatttaaacccatgaaacttgaaatagcgtatcaccgaaattgttggtgttggggatgaaaattctcacatttgaaaccaaattttatatttaaactattaaatattgtatcactgaaattgtgtttatacaaggggaacgcatgtttcacttggaatgtcttcaagccaaaagacaggaaagcggacttatatttcccaccaccattcggaaattaaagtcaataagcgacgaggcgcaattgtcaagacattataaatgccatcgttgtattgactcatcatatgcatacttgctctaataaagcgtcgtaaggggttctctatgctgagcttacgagtcatgcaggtcttgcgaaaggtcgaaaaaatggttggtccacctaaaactaaaagtatcataatctagtcttataaaaaaaattatataagaagagaaaaattctaatatctacatttttaaaaaataaaattcctaaatactaaatttataaattaactaacaactatcctcaaattcaaataaatatattttgatttgagcattggaagaataccctatcatcccacatcacctcccatgaatttacgggtatttttgtggtacatatatttttcttatatgattctactgttcccactaataacacgcataattttggaatgacgttttctaatatataatggtaaaagtttactaatcaagaaaatatgcataatgtataacaaaacaccggatttacgtattttctaaaataatacaaaaaaaaatatgttatataagtaagtgggtatatacttgtttatttcatgataaaatgttaaacaaatatttttaattttaaacaaaatattaacaattaaaatatcacccttgtgaataatatttaaaacttgtgactatctaatttcaatcaaatatcaatcatatttgaaattcattaaaaaaattatttaacttacttttcctaatcattgagaaaaaaaaaagttttccttatcataaaaaaaaagagacctaagattatatgtgttagatgtttctatttaccatatgaattggttgggtgtagtaagtaaactattcatctatcataaattaatttcgatattttgtaagaataactaatcactgaacaaaacggtagtttacacttttcagtggcattggaatctcctcaaaatcgagctgtcacactcacctcccctgtctcctcttcgcttcggtacttccgaagatttcattttctagacactccatcctctctcacacacaccttaatttcgaatttttgtcaattggtgatgcagttactctgaactcgagctgagagagaggcatagagatccttgcgattcgttgtatccgtaacatttaacaatctcgttttgtttttcttctgttcctctattatcaacaatcaaatg

SEQ ID NO: 20731 - DNA, 3003 bp, Unknown
  misc_feature (1)..( 3003): 2750-1469P.txt file - cDNA_ID_1828416; gDNA_ID_1620783; Annot_ID_50384
tatctcaaaatttgatatagtataaactatgtcggtatagtcagatcttctagagagttgtggtatccacaaacaaagaatacaatcgcagattcgcaaaacacttttcattaaatagtaattaataatcacatatagtactctttaaaatgtataaaagtcacttttggtttaacccatgtgggagggattaaatggaatagattaatttgctttgatacatctttaactgtataataataaaccaaacgttgactaaaccatacattaatttgcaggtggtggtagtaatcgggaattttgcgagtggagccgatatcagtagagacatatctaaagtcgcaaaagaagttcatatcgcatctagagcaagtaaatccaacactttcgaaaaacgtcctgtacctaataacaatctctggatgcactctgaggtaaaaactattttcttataatggttaatcttgataagaaaaaattcgaaacaaattataaaattcttgcttctattaattattttatttttttgatatcttgcagatagacaccgcccacgaggatggtaccattgtttttaaaaatgggaaggtggtacatgctgataccattgtccattgtaccgggtatttaacaattctcaatttttttattttccgttacacaacggaaattaacatactaaaatgttcggtttactaatttttttttttaatatgtgaaggtacaagtattactttccatttcttgagaccaataattatatgagagttgatgacaatcgcgttgaacctctctacaagcatatttttccacctgcgctagctcccggactttctttcattggtttacctgcaatggttagttagtttcaatcgattaaaattttccgaagttttgagtgattcaactcttcttgatttttagaaaactcatcaatttcttggtttgatattgttataaccagggtctacaattctatatgtttgaagtccaaagcaaatgggttgctgcagtcttgtctggacgagttacacttccttcggtagatgaaatgatggacgatcttaagttgtcgtatgaaacacaagaagcgttaggtattcccaaaagatatacacataagttgggtaaatctcaggtacgacattttttagttacgaatatgctatggtaatatatatcaacttgaaaaagaatatagtttcaataataaattttgtgtcttttagtgtgagtacctcgattggatcgcagacctgtgtggattcccacatgttgaacattggagagatcaagaagtaactcgcggttaccagagacttggtaatcaaccagaaactttccgtgatgaatgggatgatgatgatctcatggaagaagcatacgaagattttgctagactaaatctgatcaattttcatccttctcgttttctcgaatccggaagatgaagtttgactacgattgtaattgtgtctacttgtttggatttaaagtacattgcattataaaaataatgtgtgagtaaatagtttataagagtgtgaaggtcttcttggctagggttacatgttgttcgatctccggaattagcttcatggtgtctagaaacttttgttttttagaccaatatgttaagaataaaagtatgtagttaattcccgtaagtttttatgaatccctggttcattgtgcaaatgtttttttttttgttattgttctgttaatatcaaagagtgtccttaaatgtatgcataattccctctttttggctttttgattcttttattggaagcatataagttagccaattgactttttcttacaataagaatttgaccgttcctcacatggttctgcatcaagtagattatactagagatcaggccccgcttagagggagtgctcgtccacatttttttccaaatgattttaagctcctaagtttttgatatttttgtaataaaggtcctaaattttaatattctgatgatgagactgtaattagatcaagtatagtgataaaggccacgattgttcaaatgaaaattttgcatttaacgtttgtgtagaattataaaataatctcagttttctttatacaattttcaggatgctaacgtaaatgaaaaaataataataaggaaaaaaatgtaaaggccacgactgctttttttttttttttttttgcttaaaattttacaagttcttatagaattgtatggtttttatctaccttatactccaatatatgggtcaattttgggttgttcacatattgccaaatctagctgcaaagctcgttatctcgaaattcacgaagcagaaatattgtgattggtcccaatcggcgaaagtgaagataagagtacttcgacaattgaaacaccggaaaaaagagcaaaatcatgtacgtaacttcaggattttgtctcttttgttatttattttttttggtttttccttttgtgggcaaacaagatattgtcttatattacaaccatggttcaatttgagacgtcagattgcagtgatcaaagtgaacttgctaacttcaatagagattctttctttttccatgattggcgactgcgtctcatatcatttatcactcttgtcatgtgagactgacacactcattgttcacttttgctgcgtcataaatcttttaattattaacttacaaaatatctcttaacaatttgaaatcattcaaaaacaagagtgatttgaatcaaactcttaatccaataaacgctaaaactctataacactgctgtatttattacaggacaaattttccttgaaaataagtaggacaatgattacgcagtagttaagtgaaaatgaacacgacaggtacgttgtgtttctccttatataattaacacatcgacatcatctccacaaagtctatatgaccaaaagatttgaaaacacttaaaaaatcacatattaattaacatgacacaaaaatcccattacatatcctaactaattatg

SEQ ID NO: 20732 - DNA, 3003 bp, Unknown; identical to SEQ ID NO: 20731
  misc_feature (1)..( 3003): 2750-1469P.txt file - cDNA_ID_1828416; gDNA_ID_1620783; Annot_ID_168044

SEQ ID NO: 20733 - DNA, 3003 bp, Unknown
  misc_feature (1)..( 3003): 2750-1469P.txt file - cDNA_ID_1828420; gDNA_ID_1620783; Annot_ID_50383
tactagaatcgtaaaacgtatggattattttacattagttgtgttgaaacaacaaccaaaactcacattttgaagattccctcgttgtcgcctaatatattttgggcaaaatatccattccatgtcggcaacgtgtgccctactagttaacaacacttggcgtttgatccattccatgtcggcgtgagagatggtgagatggcgaaagctgatacgttgatcaatagtattattttaaagtacgtatacagatatactgttttaaagagttagtttcgtggtgatacagactgacaggtacgttaagttcgacttaacgtaataacaaataaaaagaataacaggttgttttgtttggtctacaagactacaagactacaagactacaagtctacaacgaacaagactttttataacataagtaagactttaaagtaatcaacatagatgcctaagatgatttgatttacttggccgtcttactagtcactggttagtggttacccagtttcttaaaaaaaatgttattattctgattaattaagcagatattttttttttcttttttaatagatatacagataaacgcatttatcatatttcataataaagtaaaaacgattatgatcggacatacaagcgaagtaagtaagtgtgattattaacaaacaaagagttgattgaaaattcaattgtggctgtaaataatatgtcagtataaaacatatcaatttttaactcattatttttaagggttaatatgttaagtgatcaaaacaaataatttaatatttcttattgatcgataaattaacccttactatttttagaattttttactttttattttcaaatctaataatcataggaaaaaaaaataacacacaaaacaacaaaaaatttccaaacatagatcgactaaagaaatttccccctcataaatttcttccgcatgtacttgataattacagcttttattctttaaaaccattttggcatttttgaatggctacttaagtgtggtatcttccgttccaccttatataactgtcttgcttcgtgctccattcatttcatagtgtacttattccataaagatgactttacacttaattcttatcatagttaataagcacttaattctttttctaatgtgtcatgaacacatgtgcacggtaattcgataaagccagtatgctaaagtgtaaaggcacttgtctattcttaagcaataaatcactgaaaacaatatttatcggacaaaaaatcagatgtaatagatcatttatgtttaaatcagtcaaattcaagcatattaaagggtgaagttttatgaagaaaaaattcaactaaaaaaacaaaatgacacttacacagttacactgacataactaaccaaatctaaaatttataaatttgtcacatcgtttaatcgttatctgtagctttattgccttttatctatgtcatctacatagatggagtagtaagctgagaagagaaggagaaatttaaggtcaaagttacccatcttccgacatgcacgtggacggccgaaagttcacgagaatcttagattattccacagtgacacatgtcggcctttgcgtgaggaagttttttggtctctaatttttttttttttgaaatataaaaggagataaaaataaatacgtaattaattatacattttaatattaccgttaaattattcgttataatctcctatattgaaatttgaaaacaaaactttattaactataagcatgataaatatataaccgtttatgataattctgatagtatacgtagtttttttttttttttttggtgagattgtttatgaaattagcaaggtttgacctatcatcaaaccttttacctcatgcaactaattaatgggtgatttcttttttcaaaattgtttttaataataataactaattagtaattagtgggtattttaaataccattatgccatttagctaaggtaaaaaatcaattgttaattataacacccaccaccaacatagattcgtctatggttcattcatcgtgtttaagagttgaaagaaataaattcgcccatcgtgaataatagatatttattcatctcaaacttataactcaaatatatttcaactatatatcgatcaaatagtatagcttttggttaatgacgaatttttattcttttgatccataattcttcttcttcttttttttctgtccggatacatgaaattgatgatacacatttaaaacaacaattcgaatcagggaacaaattacagccacaaccagtgatgatagaccatatatatgatttagtttatttaataaataatgtgtaagcaaatttggctttgctgtaaaaaaagaacacgaattttggcaaaagtttctgttaggaatctggttctattctcctctgcaacctccagtctctcatgaatctggttcggattctctttttccttgtttctatataatttagatacatggttttataattctatcatatgtctattttggatatagtattttaaaaatatatatatttttcataaatggttatggtctattctatgttaatgataatcattagtctttttgtcaactatgtttttttttccaacaaatttagtatgtaaacttttttttactaccgttttattaaatcgacggttgatcagatcaactccggtataacacaacataagtttcgttatcaaaacaaaaacaaaaacagatttttttttgtcaactaccagtgaagattagtcttacgtgtcaagaaaccggataaaaatatataacgtatttgggcaatcagctaagatattaactaacgcggagttcattattaaaatggagtaatgatgttttcagttttctatataaatcacgtcgagaccgtagagtcttacacaacaatccttcttacatttctaccaacaaaacacaaaacacaaacatagcattcaaaactttgaaaaatg

SEQ ID NO: 20734 - DNA, 3003 bp, Unknown
  misc_feature (1)..( 3003): 2750-1469P.txt file - cDNA_ID_1828432; gDNA_ID_1620783; Annot_ID_50380
tcaggccggtttatgggctctgcccacggcacaaggccaaacttttttcgttttatcaacttcattagcttataagggccttcaatttatattttagttttgcaaaatagggtccaaggcccatttatattgcttggaaagagtgagaaactgttgctagttatcttttgagagtttgattttttaacgtcttttattatttctaaacaagttttcatacctagcgttgggtggtccggcttggttgcatgaacggatagcagtggaaagccgttcgagtcgatgacgtctaaagtacaactcttgcatgggatgagctttttccgttttgtctttggttctaatctattatgttttgcagtccgttttctctgtatttctgttttttttactctgtttctttattactctgtttcatttattaagacgttaaggagaaaaaacaagttttcaaaccaattatacaaacatatcatcaaaattatcaaaaataatatagaacgataaaagataaaaacaagttttgactctgctttttttcgaaaagccttcctcgctatcggtttatcaaatttgttatttttctttttcgtactcgaactcaagcatgcgttatcacatataaaaccgacattactttcgcggataactcttgtttttactgctcatgatgctttactcggtagtccaatctttgatctatatgctctagttattatacccaagggtaagggatgcttgatcgactaatgtatcttaaaaatgtttcctacatgatgacttttgaagaatccctacaagaccaaattattgatgtagattgatcacctacacaaagttaatgtataagacttttgtaggaaccatatatggttaagatctaagaccatgttattgatggtttttgtaccaaaaaacgtcaaaatcgtttatttttgtaattttatccttcacgtccaaaaaatacagaataattatatgaaatcaatatatgtaaagttgttaaaataggctatatacaataccgtattatttttttacttcatatgattttgcattttttcgacatgaatggtagttgaaaaattgttgattttaagattgtttttttttttgcataaaactctattattgatggataaagtcagaatttgatttttctggattagaaaaaatcaagaaatttactaaaaagaaaaaagaaatttacggatgtcaaaaaaaaataaaggaagaaatgtacaagctacaaacaaaaatcgggtagttgtgtcacgtttattcttcacttgattctacaatgattgagataaagttgccgattttgccgggtagcaaaacacgtgaattatgcaaagactgaaataacatgacttgacgatttaaatagtaagcttattaaatatttcactcaacccacaaaacgcaattaaccgaacggtccaagccttcgtacttttaggtggctattcgttgaagaagataaatgaaagagagggtacgtgtccatccatttgcggttaggtctgggtccatggcccgtccctttcaaaatgcaatcaaggtccgtaaatcggtaaatgtaattaagaaattgtaatatccaagctaaaacttactctttccgttttaaaacgggatataagttgttttagagtttttcttttgagtcaaaatatagatgttttcatatcttcatataaaagaaatattaattaaaaagttttatctaaaaggtttataaagaattaaatgactgtttttcttcattggctttcaccgagtatttcttattaaaaatatatatttgactaaaagcataaattttatcaatctctgtcctaacttccaaaacatcttacattttgaaatggatgaaatatttttcttccttctctttcttcatttgaggtatatatgaatttaatcacacattttaaataattaatgttaaaatgataaatcctatgtttttctattatgaattttaaaactagaactattgaagtattgattgtggaaaatattttaatatccagttattgaaaatatttttaacaatggtttttcaatatggtttcaaaattcaagatgatttgggaaaagttaagtttattgatcacatgcaccaatatatatatacactaatacacaattatatatattaatttaagcactaaacttactaatccttatcttaacataagatttatcccgtacccactctaattaataaacatatatctccgaaaattgtagaaccatataaaactttaacacttcctttcaagtttgagtatatatgtaaatcacaaacgctcaacttggacaagtagctaaaacaggaacttctcaaggctatgtggttcgaacattatatgtaataatattgaaccacatctcttatactaagataatccgctttgatatttttagttttctcatagaacattgggttaacagcaatgtgcaatgctgatttcctatcacaaaacatcaacatcggatcactatgcttcactactcctagatccgtcaaaagtctcttactattttagttcaagctggcagccatgcctatatactctattttgacgatttggtttacaccggtaacggttgttgaatgaagaaaatcagattttaaattcgatcatattcttttattaagttaaattagtttgtgtattgttctgacaacaaaacaatttcagctaattttataacaaaataaattgtgctttttcggatatttccccttccatttttacaatagaatgatcgaatatttttgtatgaagtatattgttcttacaacaaagatggttttttttttgtttttggttaaagtacgaaaatgatgatgattagccatcttgtttcagttctattatataagcccattaatagcacggaacgacctttaaccaaaacacagagatcatacgacagtctcctaccaaataaagaaaaatccaccataccataaagttcaaatatatg

SEQ ID NO: 20735 - DNA, 3000 bp, Unknown; identical to SEQ ID NO: 5375
  misc_feature (1)..( 3000): 2750-1469P.txt file - cDNA_ID_1828446; gDNA_ID_1620783; Annot_ID_50375

SEQ ID NO: 20736 - DNA, 3003 bp, Unknown
  misc_feature (1)..( 3003): 2750-1469P.txt file - cDNA_ID_1828462; gDNA_ID_1620784; Annot_ID_50407
cggttgatggtcgagtccaaggtagaatgcttcgatattttacgcatgcaccagtcaacatttaggactttatgcaagattctttcagaacaatacaagttagaggagtcctgcaatatctatcttgaagagagcgttgcaatgttcatagagatggttgcacaagatttaactgtacgggtcatagctgagagatatcagcattcacttgagacagtgaaaaggaagctggatgaagtattaagtgctcttttgaaactcgcagcagacatagtgaaacctacaagagatgatgtcacaggtattagtccctttctagtaaatgataaacgctatatgccttattttatagattgcattggtgcccttgatggtacacatgtgtctgtgcgtcctccatcaggggatgtggagcgatatagaggtaggaaatctgaagctacaatgaacattctagctgtgtgtaatttcagtatgaaattcaatattgcatatgtaggagtacccggaagagcgcatgacactaaagtactaacctactgtgctacacacgaagcttcatttcctcacccacctgctggaaaatattacttagtagattcaggatatcctactagaagtggctacttaggtcctcaccgtaggactagataccatttagaactgtttaatagaggaggtcctccgacaaacagcagagaattgtttaatcgtagacattctagtttgagatctgtaatcgaaagaacatttggtgtgtggaaagctaaatggagaatacttgataggaagcacccaaagtatgaagtgaagaagtggattaagattgtgacatcaacgatggctttacataattatatacgagattcacaacaagaagatagtgattttaggcattgggaaatagttgaatcatatgagcagcatggtgatgaaaatgatgggcatgttccatatgtgcctactggtgacagagtaatggagaatatacgagattccatcactacagagatggccaaaggaacaagactcccatattaacaggttccatctctctgtcttatgttattgattgtctctgtcttatgctattgtctgtttctgtcttggttttaaattttgtgactaatagtgacagctgaatggtcacgtcactacataagttggttgattacacacgttttaaattttgtgactagtagtgacagctgacaagtaattcgttgaacatagtgttcattagtttggattagacttgattcaattgaatagcttgacataatgacagctgaatggtctatgtttctggttttagctcattgttgaatagtctctctctcaatctagttgttgtattcttgagcagctgcaattctagtgtctcttgatgttgtttgctttagtgttatggtttggtaatatgcataagaccatactttggtttctgattctagtttgtgtcatgattgaattacttttgagaatgtgtcatggttgaatcgttaggtaagtactagccaatatgcatgcttgctcttattggagaattggtgatgattcaggttattgctcttctttacaggtttagtaatttgaaattgaagtttgaaatgggaaatgatcaacgacgacaagatttgaagcacaaaaccaaattctctttttcaaactttactttgatttataagaatgtagcaattgacttgttacttaacagagggtattttagtcatttatatatatatgagaaagtgaatgattcatccaaatgatcaaacaaacaaagctctatctaaatgatgcatttagatgaattagcaaatgattagcaaatgatcaaacaaacatcattaagatgaatcattcaaatggattatttggatgaatcatttggatgcaaattccaaatgatcaaacaaatagagcctaaattttttgtttattccaaaatattgaagttgttttgctataattttttatttttatatttaaacttactaatttcggtttctttttggtttcaattaaagcgtaaaagccgcacttataaatagtttagtcgactgttttttgaaattagtaacttaatggtctcggaacagttatgttctacctgagacacaccaacgttcactattaaagtggcgatttttttcaagatatagttaagtccaaatggtgggaattgaattaattggccatactatctgtctcgatcgtgattttaggcccggcgacattagcaagtctttaacatgtgtctcttcgaacgtttagattacgcactgtatgtgttcgatgaaatgcctgaccgaaatgtgagagttcaaagctacgctctttttatctggagataaaaggagtctcaggaatcgcttgtagatcctataaaatagaaagtgaactgctcaagcctaagctctccagttgtttctttttttaattggtctttggtctatatttgagttcttgcatctcggtaagtcggtatattggcttacacacgagatgacgaatcacagttccatcttttttattgattcagagtgtagacgtctacctctcactgagtctggtcaattttgcgtggtttgattgggtaaaagtttggagttcttggttcagacaatgaaaggtaagagctacaaattttcatcttttgattggttcaaactgttgatgactatctattattggttgtatcaaagacatgaaagtgacacaatgtttctatatgaggccaaccgttgcatggtttatttggaagaaagttggaatttttaagattcaattctttgggttcaacttgtaataaagttgttttataaacaaggtttaagttgattgtgaataaagtaatgcagaatcttggaagatgggtgctgtggtcaacactgtttagagaattattgtttattaagtacttgagtttgttttcgtggattactttctcttgcactaatctgaagaagattgttcttggagacacaaggagcacacatg

SEQ ID NO: 20737 - DNA, 3003 bp, Unknown
  misc_feature (1)..( 3003): 2750-1469P.txt file - cDNA_ID_1828477; gDNA_ID_1620784; Annot_ID_50402
tttcaacaaggaatgattcggataatgtagatcccgagaggtttaggtttgcgcgggatacatctttcgggcgtagacatctgagtttctggagcaaatcaactattacgctgtggattgtatgtttcttcaggcagttctttagatctgtaaccaaagttgattacttaacactgagacatggtttcatcatggtataagtcaatcttttgatctttaacttttctgttgtataataacttatctctcaaggcaaagatcttacagcattgcacgaatgcttcttctttttcttctgtttcaggcccatttggctcctgggagcgacgcaaggttcgatttccgaaagtatattcagagatcactagaggaagacttcaaaaccattgtcgagatcaagtatggaactaattaagattacaaactccacttcactaaccactacttaatctgatgttttaactgcttatatcttcagccctgtgatctggttcatagctgtgctattcctcctgacaaacacaaacggtacactcgttttcaaaacgtcgctgcatcgatacctctttaaaagccttcaacaatccaaaactaatagattactctgcttttctaatgaacaggattgaattcttacctctggctaccgttcattcccttcatcgtaagcaacaaccaaaacctttagactaaacctattttgtttcggtttcaactccgtaacaagaatgaatgtataaacaaactgcaggtgattcttattgttggaacaaaacttcaagtgataataacaaaactaggacttagaatccaagagaaaggcgacgtagtgaaaggcacaccgctagttcaacccggtgatcatttcttctggttcggtcgtccacgtttcattctcttcctcattcacttagtcctcttcacggtatacattcatcttttactttctactctctctccttacaaaaatgcctgaaatttaaccatttctttttcgccatcatcagaacgcgtttcaactagctttctttgtctggagtacggtaagcaagcaatcctgcattctccatgaacttgaaacgtaataatacctatacaatcatcattttcatcaaaatcttttgttatctcttcagtatgaattcggtctaaagaactgtttccatgaaagcagagttgacgtgatcatcagaatctcaatcgggtaagtggaaaacataagcttcaaaacccttcatagaaaccatcccttaacatctaacaaagtcacaaccttttggaaaacataagcttcaaacatagaactgagaaaccattccttaaaatctaacaaagtcacgaccttttggatcttgcagacttttagttcagattctttgcagctacgttactcttcctctatatgctcttgttactcaagtaagatccacgcacacacaaaaacacataaagattgaaactttcaatttcaaaaactgacatttttgaattcaattttggtgaagatgggttcaaagatgaaaccaacagtgttcaacgagagagtagcaacagcgttaaagagttggcatcacacagctaagaaaaatatcaaacatggaagaacttcagaatcaacaacacctttctctagtagaccaacaacaccaactcatggttcttctccgattcatctccttcgtaatgctcctcacaaacgaagcagaagcgttgacgaaagctttgcgaattcgttttctccgagaaactctgatttcgattcgtgggatcctgagtctcaacatgaaactgctgagacttcgaattcgaatcatcgttctaggtttggagaagaagaatcggagaaaaagtttgtttcttcatcagtggaacttcctcctggacctggacaaatacgaacacagcatgagattagtactataagcttaagggatttttcgtttaagcgatgatttaatgttttcttaattcattatttagtgatttgttaatatgctaaatgaaaccagttcttgtaaattttctatactatgtttgttaaaaccagcccttgaagctttaatttctcaatgtaaaagtctgatgattttggattttaagactatggagattcatgggtagttggtgaagagtgttcttgtcttttgggtttgagagtttgtggaagatgtgttagcagatttagaaagcatgcaaggggtttgataaaatgcctgagtgagacttggttttcctgaaacacagtggtttctgggtgtagatagattggattggcgaggattgtattttgatatggtttgtagaatctgaagactcgttttatcgccactatttttttgagtattgacaaggtgattagggatctcttgtgaatgccttcaaggatttggttgaaatgcaatttgctagatagctctttagtggaatgttatattcatggggttcgatgaatgacggggtatgtgcaaaatgagaattttaaaaaagcaattcgtgaatttatgccggacaaagggttggaaaccaagatcattggtgctttgcatgcttgtgcttacgcaggtgatcaggacctagtggccaggccaggaccgttgtatcttggaatactagatggcagatacgttgtattggggtcaaaaaaggtcagtggtacaattctcatgtttgaaaatgaatggtagcggtgttgcctatttttcattggttgtgggctcaatttacctgaaaataataggtcaactgttgcatggttgattgggtaaacataagcatttcacttttctagaatctgtattataaaacaaggttttaagttgatcgtgaataaagtaatgcagaatcttggaaaatgggtgctttgtagtcaacattggttagaggtgcttccattttctattcagcacttgactttgttttatttgcttacttttctcttttttacagtatacatgttctcttcctacaataatctgaggagattgttcttggacattggggatg

SEQ ID NO: 20738 - DNA, 3003 bp, Unknown; identical to SEQ ID NO: 20737
  misc_feature (1)..( 3003): 2750-1469P.txt file - cDNA_ID_1828477; gDNA_ID_1620784; Annot_ID_168077

SEQ ID NO: 20739 - DNA, 3003 bp, Unknown
  misc_feature (1)..( 3003): 2750-1469P.txt file - cDNA_ID_1828481; gDNA_ID_1620784; Annot_ID_50401
gttatttgtatacactctttacatcctcatattcatctgttaatttggctttgtaattgattgtaatcacatcgtgttatggtcaatcatatataaatattttaacgatatatcgagctatttttcaatttcttatagacatttgagcgattatcatacttcttgccacaataacaagaactatgggaatatacaataactattaatccctaggatggaacttggaagaggtttcactttttgatttcactttcaacaaatgcgtgtggccacataaacttttgagctttgacccaaatgttttatctaaagtgggcttgccaaaaagctcttgttaaaagacttgatcacctctagattaatagggcttgactcggacatttgtgccaataggaaacaaaaatggataaccaaaaagaataccaaaagctgttagatagaataggaaaaagtgttaagtgatcatcagtacaacaaatgtcacatctaataaacaagtaacaaagtactacacggttcatttacaaatgagcttgtttgcaatcttcaaggaaaaagtagtatgcagcaaatttcttccaagcaggaacattttgtttgttttcgcgatttgcagtagcgaacagaattgaccatgcacgtttgtattttgtaagattgacgttgagatcacagcccaccgggactggtgagattaaagcatgttagagtatgttagagttttgtaaggtaagtacgaccggataatacacatattgaattgctatttgtcattaataaatgtcatcacgacagtcgaaataacatcatttgtagtagacatgtatgttgtcgtttgttacaatattttcttaccagattagtattcattatagacgtcaatgcataaaattacagatgtacgaacgtatatgtagtaccatgtgcatggttatatcaatattcgttttaggtttgttagaatgcaaattaatcgttgtagagccatgtccgcattgcattgaaaaatgtaagtctataacacagttttacatgacatgttaatgactagggtttgccaaaatatataaatacttgatttgattagttatatgtccgaatctgttttaaattatcatacgcgcgccaattacaaattgtttatcacaatatacaaactacaacaccatatttcattatagtaaaaccaaaatttaactacgaatctgaacgtagccctgctttatgataaatatttcccgaaaaaaaatcattagaattcctataatgataaaaaaaacgctggttcttatggtaacaccatgtgaaaagtgatgactttttcatagcagtagaagtagtcaactacctcagataagtactgtaattaaataaactaattgcccaaaatgatacaactttgtcgcattaaattaaaagttaaaccttcactggatgcattaccaaaatggtcatataacaatacgtaatccaactcgctgtagctatcaatctctttatcacaaccaaccaatattcaacaatgttgttttatttatttttcatatggtttatttaatcacctcgacttttttggcatcgatcacatctacaaataaattgttagttagcacgaccgttattattactttatgaagaattgttaatctgaaaaatatccttttgatatcagttggaaatatttttttaaataatttattatgtagagcttgcggctgagtcaaataaaaataaaattgaaaactaaaagcgtgattgacaaaatgactttaaaggctgatttgtttttgaaaaaaccaagttcttaagaacacatttgaaccaatcatcgaaatatatggtggaaatatatttctaccaaagatttgttttttaaccaaataattgaacacaacgctaactgaatattttataaaactgatacagatttattaaaaattttgctaataaacattataaaattgcttttaccaattataggatgtattgtatctcttggactttaatatcgttgacgatcttgacaaataaaaagctggcgtttcattaaattggtatttacaatgagaaaaatgtgtgggatccaaaactggatataggattcgctttactgtatctggatccgaaactctaaaatatgatgtttcttatgatctggattttttcaaactataaatgatttctgaatttccgtgtatgtcaaccaatatttaaaaacagattatatttcttaaatatttttcagattttttgaaaaatattctgtaaattacaaatgcaaataaattatttaagaccgttaaggatcaaatatgtttttagtttattcaaatctctcgttctctcatatcgctattttgtacttagtttagataaaagtattaagtttggcttcttagaatttgatgtttctttttttcgtttttgctatcgacttttgttttttttttttttactattttggtgttatttatctattccttaaattttggttttgtttctgatacttatattttctgtaatttatgtcgcaacttcaaaaataatataaatactttacattgatattaaaaaaaaaaaattgagctctaatgacctttggagctcatgctcatctatggaaaaaaaaatccatgcaggaagaaccaagaggaaacggtatacaaaataatattaaataaataattatttgtcaataaaataaataaaaactcaccaaagtacataacagttcacacagcatgtttttagaaaagatcatatactattggtttcaaagtctttgactttgaatgtttgaacttttcaaggttcgcctactcgccggtcgtctcctttaaccttcgtctctgtgtttatataagaacatatacgtatttgatgattacaaaaagacaattctttatccttctttagatttctgtggaaagttcactatttattaggagagacaatttcaaaaaggaaagctttttgcttggaactgttctgtgagttctaatg

SEQ ID NO: 20740 - DNA, 3000 bp, Unknown; identical to SEQ ID NO: 5381
  misc_feature (1)..( 3000): 2750-1469P.txt file - cDNA_ID_1828496; gDNA_ID_1620784; Annot_ID_50396

SEQ ID NO: 20741 - DNA, 3000 bp, Unknown; identical to SEQ ID NO: 5381
  misc_feature (1)..( 3000): 2750-1469P.txt file - cDNA_ID_1828496; gDNA_ID_1620784; Annot_ID_168067

SEQ ID NO: 20742 - DNA, 3000 bp, Unknown; identical to SEQ ID NO: 5399
  misc_feature (1)..( 3000): 2750-1469P.txt file - cDNA_ID_1828519; gDNA_ID_1620785; Annot_ID_50415

SEQ ID NO: 20743 - DNA, 3000 bp, Unknown; identical to SEQ ID NO: 5399
  misc_feature (1)..( 3000): 2750-1469P.txt file - cDNA_ID_1828519; gDNA_ID_1620785; Annot_ID_168111

SEQ ID NO: 20744 - DNA, 3000 bp, Unknown; identical to SEQ ID NO: 5398
  misc_feature (1)..( 3000): 2750-1469P.txt file - cDNA_ID_1828527; gDNA_ID_1620785; Annot_ID_50412

SEQ ID NO: 20745 - DNA, 3000 bp, Unknown; identical to SEQ ID NO: 5397
  misc_feature (1)..( 3000): 2750-1469P.txt file - cDNA_ID_1828533; gDNA_ID_1620785; Annot_ID_50410

SEQ ID NO: 20746 - DNA, 3003 bp, Unknown
  misc_feature (1)..( 3003): 2750-1469P.txt file - cDNA_ID_1828537; gDNA_ID_1620785; Annot_ID_50409
gattttttttagataagtaaaatttttgcaatctttatcttgattagtatttaaaatcaattaatttatgttttaagtgtaaactaaaataaggtagaaaaaagagataaaaacaataatgtgtgatacacttaaccatgattggtactttggatccactaatttatgttttaagaaaatgatattccattataatgtttcccggaaacaaaccgtgatttgcggatgttacaacgtcaattagttcaacatggctttacttaaggcaaaagactacaaattcaaatagtgagactatacagataataatattattaaaaattaagtggattgtttttcaaatcattaacatggtacaaaaattatttaaatatatgtatatttgaaataatcacaatttttcacaaaacacaactcattgctaaccagctcatatgctaaaaaagacaactcatttctccactcttttgacaaaaacagagcaccaaacattaaacccttcaaaaacacaaatctcaccatcacacgtaaaaaaagaaaatatgtctatgcttcttcttcttcttcttcttgtcccattcattactccatcttcgcaatcttccattcgaaacctcctcgaagctcgcggtttaccaggtggtttgtttccagacaacgtggagagttatagtctagatgataagacaggagagctcgaagttcagctacaaaatccttgtttcgctcggttcgaaaacagagtatattttgatcgtgtgattaaagcaaatttaagctatggtgggcttgttggacttgaaggtttaacacaagaagagctttttctttggttacctgttaaaggcattgcagtgaatgatccttcttctggacttgttctcttcgatatcggtgttgctcataaacaaatctctcgttctctctttgaagatcctcctgtttgttatcctcctggtgagtcaaagtttgttcctcaaaacgttttagtgtttaatgccaagtgttttatttattggtaacatatatatgatcttgaacagaatatttttgtagtaataattgtatgtttttatttgtaggatctataatggagaagttagaaaaaagcaagatggatattcagctcaagagatgaatgagtttttttttttttggggttgtgtaagattcaaaactcaaacttgtctctttgaaacttgaacaaaaaatgtgtttttttctttcttcttttacctttttgttcggggttgtttgggaaaccgtggaaagtgtcgggagatatgtgtaaaatctggaaagaagggaggaaaattttggaactttgtataaattatggggtccataaagtaatcaattttgtcacttgtcaattatttttcttttctttatatagagggaatatagagtactttagatatttgtttaacttttgctttaatttttgaggaatgatgttttcgtttaatcattatcctctagcataatcattgacatagaattattctttgaatggaagctcaaagctgcatttgttaccaaacaggcaatcacagctgttaacctaaacacaactgacggattataaaattctagcactgaaatacctatttaaaactttcactcatttttacacaagaagtttaaaaaaaaaaaaaatcaggtagatatttcgggtaaaataaatactcccatttgtaccaaaataaatgatgtttaacttttttacacaaagatcagaagttattatatttttttccgaaataaaaacgtaatttatttatttatacatattcaataaatgataaaataaaatataaatagtcataaggaaaaaatataaaaattttgcatagaaaaaaaagaacacgggtcaatttcaaaccaccaattattctgatatcacagatgtcaatacgcgtcagagtgtgatatatgttagttatatgcgattttagtaacatttttggaattttcagtgttgaatatcacatgtatatcgttgatcaaattattttagtaaacatgttttcaccagttttatttgaatttatagtcatttcaccaattgattctagaatatatttaaaattcttaaatgatataaaggtagttgaaattagataacctaacattttttatgttaaccaaactttttaattaaaaataatatatttataggcacaacctattgtaaattttttaatttacatagttttaagtaaacgagataaaagaatcagttggtgatcttcaaatcggataaagtgttatgagtgtataggagattttgatacaaattgaattctttttggagtcatatattttgtctatgctcaccacagcatcggaagatcttccatcacaaaacagttcacatttgtggtggacacgagagatgaagaatctgtctcaaggtttaatcactgtggtattatatagtaaaaattttatgatgatattaaatcatgattttggctatgttaaaatttgaggtttttggttctaaggattttttttgctagatttatgttaatatctaaagtttaagaaatttgataataattatagttacgtgacataattcaaatttatgatgaactacatttactatatatagccctcgagataataatgttatacatttatttagtagatatattattagataattcaaaacttaaattacattattttgtttatatatttcatattatgttaaagtttaattgataaatgatatttttacgaaaaatttgtataatactaaagataaattttaaaaacatcaatttcgttttatttttattaatagtacataaagaaaaataaataaattaaattaatttgtgactattttggtatatgatcaatgctcgtctttttaagtagtaatcgtgtctgttacaggtgaatgaacccaacaaaaatcttcgacgagcatcttctgctttcttcatctctgaatgatcaatttctagaatcagatcggatatttcgatg

SEQ ID NO: 20747 - DNA, 3000 bp, Unknown; identical to SEQ ID NO: 5395
  misc_feature (1)..( 3000): 2750-1469P.txt file - cDNA_ID_1828541; gDNA_ID_1620785; Annot_ID_50408

SEQ ID NO: 20748 - DNA, 3003 bp, Unknown
  misc_feature (1)..( 3003): 2750-1469P.txt file - cDNA_ID_1828549; gDNA_ID_1620788; Annot_ID_50447
tgtattaaataaaatctttttttattcaacacatttaaaagctcatttacgtcggtattaatcatattagaccaagaccaactcggtttcataagagttaagatgaaactagaagcacgaacactacacaccgttttcatcaaccccaactgagagataaacggcaaggctttcgcaattgaaattctcacagtggttaaaggcacttggatcgatggtgccttaggcttcattcatcatcttgctacataaccgtagaggaagacgaataggtttgatctgccgaggtaataattaaactgcaattaggtgagttcatgcttcttcttcttttaactgtttcttgatttttagtaatcttcaggaagcccttacatctaattttagttgttctatctctttccattacgatatctgttttgagtctctcaaagggcttttctttcatgtgaaaatttctaacatttcttaactggaacttaaaaggagtattttgcaatttatcagtattttgagaatcgcatccagattaggttgatacaatttatctcgttttttcactcgaaattagatggttgtttgtgggactttcaatattcagtcttggtaaattttgatgatgcagattatatataattgcgtgaagaaaagagaaatggtgggtggcaagaagaaaaccaagatatgtgacaaagtgtcacatgaggaagataggataagccagttaccggaacctttgatatctgaaatactttttcatctttctaccaaggactctgtcagaacaagcgctttgtctaccaaatggagatatctttggcaatcggttcctggattggacttagacccctacgcatcctcaaataccaatacaattgtgagttttgttgaaagtttttttgattcccacagggattcatggatacgcaaactccgtttagatttgggttatcatcatgataagtatgatctcatgtcatggattgatgctgcgactacgcgtaggattcagcatcttgatgttcattgttttcacgataataagatacccttgagcatatatacatgcacgacgttggtacacttacgactccgttgggctgtcttgactaatcccgagtttgtttccttaccttgtctgaagatcatgcattttgaaaatgttagctatcccaatgagaccacgttgcagaaacttatctcaggctctccagttctagaagaattaatactcttcagcactatgtatcctaagggaaacgttttacaattgcgctctgatacgctaaagagactcgatatcaatgagtttattgacgttgtgatttatgcacctctactccagtgtctgagggctaagatgtactcaacaaagaactttcagatcatcagttcgggtttccctgccaaactagatattgatttcgtcaatactggtgggagataccaaaaaaaaaaagtgattgaagatatcctcatcgatatttcgagggtcagggatctagttattagtagtaatacttggaaggtatacatcttaacatttgagcatatttgtttaaaaatattcctccacaaaagtttctcaccgtaacatttttttgttcacttatgttaccaggaattctttctatactcaaagtcaagaccattgctccagtttcgttacatatcccatttgaatgctagattttatatatctgatcttgaaatgttgccaacgcttcttgagagctgcccaaaacttgaatctctcatattggtaatgagtagctttaacccttcttgagagctcctatttacacatattgtttgagataacctcttatatgtatctctctactcaatttgttttcttttatttattcttttgttcctgtttttgcaggaaatggtcaagaaccaatccacgcgacgtcatggggagaagcgagaaccaaatgtgatggtttcaacagtgccttggtgtttggtatcgtcgctcaagtttgtggaattgaaacgttcaatcccaaggtatgaaggagaaatggagctagtaagatatgtcctgacgaattcaacagtcctgaagaaattaaggctcaatgtttactacacgaagaaggcaaagtgtgccttccttacagaactcgttgcaataccaagatgctctagcacatgtgtagtccttgttctttaattacttgaaaggtattgatgaacttttcgtttaaggtcaatcttttggtcgttaaattagttgattttcggaggctttgagccacatgtaaattttgcagttaagtccttcttatgctggttgctgctcatgtaataatcatcaatcaccaagtttgtttcgaatttgatggatacttccaccaagtcgctgtcaaatattttgtatgctcccatggataattattttgtatttttgtaactgcatggtgattccttacatttcaggcttgttagctttgcaattttgttatttgtattttggtttgagttaattacgagttggattgttcttcttacctactttatggttcctctgaataatctattcgtagtcttatcaaaaccaaatccaaaaaagtacttgtgaatctatttcctttttaattattgcgttcataaatgaaaatgacaccatttttatcatagtgaggagctcaaatttcaaaacttttgatccgagacatctaagtgtaccgaaatttgaaacgggttatgtctccggtgtaatttcgacggcggatttcgtcgattacagtcgtcgccaccgtatattaatacacatttggaagctcaaataatgggcttcttgcttgaagcccattgacgtcggtactattgtatttgcaatgattttaaacgtcgtcgtacaagtaataaatcagaacccctaaaacccttttcatctctccggacacttcttctcccgacactttcctcttcaaatcccaaacggctatctgactttggaagaaagagagattcagagtggagaatattatg

SEQ ID NO: 20749 - DNA, 3003 bp, Unknown
  misc_feature (1)..( 3003): 2750-1469P.txt file - cDNA_ID_1828549; gDNA_ID_1620788; Annot_ID_168222
caactcggtttcataagagttaagatgaaactagaagcacgaacactacacaccgttttcatcaaccccaactgagagataaacggcaaggctttcgcaattgaaattctcacagtggttaaaggcacttggatcgatggtgccttaggcttcattcatcatcttgctacataaccgtagaggaagacgaataggtttgatctgccgaggtaataattaaactgcaattaggtgagttcatgcttcttcttcttttaactgtttcttgatttttagtaatcttcaggaagcccttacatctaattttagttgttctatctctttccattacgatatctgttttgagtctctcaaagggcttttctttcatgtgaaaatttctaacatttcttaactggaacttaaaaggagtattttgcaatttatcagtattttgagaatcgcatccagattaggttgatacaatttatctcgttttttcactcgaaattagatggttgtttgtgggactttcaatattcagtcttggtaaattttgatgatgcagattatatataattgcgtgaagaaaagagaaatggtgggtggcaagaagaaaaccaagatatgtgacaaagtgtcacatgaggaagataggataagccagttaccggaacctttgatatctgaaatactttttcatctttctaccaaggactctgtcagaacaagcgctttgtctaccaaatggagatatctttggcaatcggttcctggattggacttagacccctacgcatcctcaaataccaatacaattgtgagttttgttgaaagtttttttgattcccacagggattcatggatacgcaaactccgtttagatttgggttatcatcatgataagtatgatctcatgtcatggattgatgctgcgactacgcgtaggattcagcatcttgatgttcattgttttcacgataataagatacccttgagcatatatacatgcacgacgttggtacacttacgactccgttgggctgtcttgactaatcccgagtttgtttccttaccttgtctgaagatcatgcattttgaaaatgttagctatcccaatgagaccacgttgcagaaacttatctcaggctctccagttctagaagaattaatactcttcagcactatgtatcctaagggaaacgttttacaattgcgctctgatacgctaaagagactcgatatcaatgagtttattgacgttgtgatttatgcacctctactccagtgtctgagggctaagatgtactcaacaaagaactttcagatcatcagttcgggtttccctgccaaactagatattgatttcgtcaatactggtgggagataccaaaaaaaaaaagtgattgaagatatcctcatcgatatttcgagggtcagggatctagttattagtagtaatacttggaaggtatacatcttaacatttgagcatatttgtttaaaaatattcctccacaaaagtttctcaccgtaacatttttttgttcacttatgttaccaggaattctttctatactcaaagtcaagaccattgctccagtttcgttacatatcccatttgaatgctagattttatatatctgatcttgaaatgttgccaacgcttcttgagagctgcccaaaacttgaatctctcatattggtaatgagtagctttaacccttcttgagagctcctatttacacatattgtttgagataacctcttatatgtatctctctactcaatttgttttcttttatttattcttttgttcctgtttttgcaggaaatggtcaagaaccaatccacgcgacgtcatggggagaagcgagaaccaaatgtgatggtttcaacagtgccttggtgtttggtatcgtcgctcaagtttgtggaattgaaacgttcaatcccaaggtatgaaggagaaatggagctagtaagatatgtcctgacgaattcaacagtcctgaagaaattaaggctcaatgtttactacacgaagaaggcaaagtgtgccttccttacagaactcgttgcaataccaagatgctctagcacatgtgtagtccttgttctttaattacttgaaaggtattgatgaacttttcgtttaaggtcaatcttttggtcgttaaattagttgattttcggaggctttgagccacatgtaaattttgcagttaagtccttcttatgctggttgctgctcatgtaataatcatcaatcaccaagtttgtttcgaatttgatggatacttccaccaagtcgctgtcaaatattttgtatgctcccatggataattattttgtatttttgtaactgcatggtgattccttacatttcaggcttgttagctttgcaattttgttatttgtattttggtttgagttaattacgagttggattgttcttcttacctactttatggttcctctgaataatctattcgtagtcttatcaaaaccaaatccaaaaaagtacttgtgaatctatttcctttttaattattgcgttcataaatgaaaatgacaccatttttatcatagtgaggagctcaaatttcaaaacttttgatccgagacatctaagtgtaccgaaatttgaaacgggttatgtctccggtgtaatttcgacggcggatttcgtcgattacagtcgtcgccaccgtatattaatacacatttggaagctcaaataatgggcttcttgcttgaagcccattgacgtcggtactattgtatttgcaatgattttaaacgtcgtcgtacaagtaataaatcagaacccctaaaacccttttcatctctccggacacttcttctcccgacactttcctcttcaaatcccaaacggctatctgactttggaagaaagagagattcagagtggagaatattatggaaggaactttagatgaagagaatctagtcttcgaaaccaccaaaggtatcaaaccaatcaagagtttcgatgacatg

SEQ ID NO: 20750 - DNA, 3000 bp, Unknown; identical to SEQ ID NO: 5428
  misc_feature (1)..( 3000): 2750-1469P.txt file - cDNA_ID_1828580; gDNA_ID_1620788; Annot_ID_50438

SEQ ID NO: 20751 - DNA, 3003 bp, Unknown
  misc_feature (1)..( 3003): 2750-1469P.txt file - cDNA_ID_1828587; gDNA_ID_1620788; Annot_ID_50436
agcccaacttctttccaagaaaatgtaatccgaaaaccacatcgaccaacctatgatctgtgaaagacttgtaatgtttcagtaaatcattaaagagagtaaactaaaaacaggaaaattcaacaaaagatcaaaagaactcactggaagatacttggcttctttcttcatgatggctaatgagcttccaagacaacctacacgctgttatatgattaatcagagacagtgtttatatttctccaaatttgaaaaatcatgtttcagtgaaagacaaaaacacctgagccatgacccatccaataagccaatcaatgtcacttcgatgattgcttaagacaagtgcgtgttctttccctgaaatttaatatcaagattaaaaagaatcattatattcaaatactgaagactaggttgcataaattgatctttaccaattaactctagagtctctgcatcgacgtataaattgatctgcagcaacaacaagacgaatcacatatcagactatgatacctctatgtaaaccacaacaagattcatgaaaatcaccaacctttatacaagcccaccaatcaaacaaccatatgagctgcaaccaaagtaattccgcaacatttttgtttattcttctatacaaacttcttgagaatggacgaacaatgatgaagaacacaagctggaaacagagaaaatgtgtccaaaaacctttagttgacacaagtttcgattttataacagacattatagaacataaaatgtttcagctatgtctcttccattgagaagacaatacaatgaagatagacttcttttggtatcagagcaaaacaagttttaacaaaaatggatgacctgaatgatgttgacgatgagccctgagatcaagaagaggacaccaacagggataaagacaagagccgcagggatcttcatgtctgagagagataaggaacaacacaaagcagcaacagaagaatatgaaaaattgttgaagaagacaccaacagaggatgactgttatctttgttctcaaattctttttgggagattagagaattgaaaataaggaaaatccttgttgttttgacgcaagagcgtttttcatgctctattttaagcccatcaaagctatgtctctctctcttacaatatttggttgccaaacacatggagacatgtgcgcatgtaaagctctcccatgaagtaatagagtaaaatgcaattaaaaacagcaaaactcacatatgtcataaaatttgattttggcggtttttgagtttatttttaacttcacggttgttaaatccggatttcacattggcaataagtggtgagatcaaccttccttatatactactaaagtccttttccatctttctaatatgtgatttttctccaatgttaagttttatggagttttaattcagaatcaattgacaaaaagtagaaaagcacatgttccttatatactactcaaatcatttcccatctttcgaacgtcggatttttctcaaatgttaagtttcataaacttccaactcaaaatcaactaacaatgtcttgaaagttacacgtttcttataaactactcaagtcccttcccatccttccaatgtgggatttttctccatacatccccattcccctcgaaataatggctcttctagccactaatctcgacataatccatcatacctctcgagataatgctcgtttctagctatttcacggaattgggctttattttggacaatcaattagtgagggtgatcaggtctcttttctgggccagattagcagggtagggtgtgttcggactctgatacaatgttaaattcgggtttatggactttcaattaaaaatcaattggcaatgagttgagagacctacatttcttctatactactcaagttacctatcatctttttaatgtcggatctttgtccacaaaaacttttgcaaagatcaaaaaacattaatcgtcccatgactctagaataacgcccgaaccattgcaagtggttcccttgtaaaatgctgcaaactgtccagcagctagagtgctaccttgaccaccttcaaataggtgtacaaccgcaacatgtgtagaaccaaaggtgtgcctagaatttttaatgccaaagtaagaaaattaatttcatgttctttttcttttggtacagtacttggtgggattcaaaaatgtacatactatatacaccaaccgccaaaaaatgagattcaaactacagtcaataagaagcaaggaagactaaatagagggagctagtgattatctgacaatcaaatcaagtagacaaccccgatggatgtcctctccctacataagggagttcagttcttactagcactttgagctccaaaacaaattcaatatttgaattttcccaaagcctggtcaagcaatatatggtcaaatttaattgaatgtttatataaaaatttatggtaactgtagaaaattgtaaactattgttaaatattttataagaaatataatacaaaaatttaagcaatatatttacttatttaggtctgggcatatgagtattctgggagccagaaattttagttaaagtttatatatatataatatttaattatatattatagtagatgatatatttaaagaatagattattgtttacatggtctagagaattgttttttttttcacctaaataaaactaaaattatattttttatatgtagtattgagtttttgaccatttctcaacaaactaacaagcatcactggttgtggataaatatttgaataaaaagaactctgacttttgatatatagttttgaaaatgacattatttccctctcactgtcagaggaaagaacgacgaaaggacgaattgttcttccgcgtatttactcatatatcccttcttgatcgacgaccatccaccatgaaaagggatcttccgttggcctcgtagatttaatttatcgacatctattcagaatg

SEQ ID NO: 20752 - DNA, 3003 bp, Unknown
  misc_feature (1)..( 3003): 2750-1469P.txt file - cDNA_ID_1828626; gDNA_ID_1620790; Annot_ID_50479
atagaaaatttaatattatcataaatgtaaagaacttgctaatcaagttatgatttttgtataaataatcctattagctaatgaataaatagagaaaacctgtattattgctaaagtttcctccaaacttatcagacaccaatcgatgatgtataatataccatttttcataacgtgattctattatttttaccattcacaatatttatcatacatttatatttgattttcatgtgtatgttatatttgatgcatgtggaaaaaataattcaaaattaaaaaaactacaaaacgtttttcttattatatcacaattatttaacaaaaaaaagttttgagctattttgtttataatgtttttatgcttttcaatcctacatttcactatcagaaaaatgaggccaagttataaaaataaaaataaaaactaaacccaataagcccattaaggcccataagtcaatacagcaaaaacagctcatctttgctaaaacgtagattactgatttaatctaccggaatcgaaaggcaataccaaacttccggtgaaccggaatcggatccatttgacttgccgtagaaattaggaaattgattacagtgttcttcgagaatggagaagaaggagatggagaagttgtgccaaaggtgcaaacaaagctacacagatctttcaaacgaaacttcctcttgccgttttcatccttccttcttcgtttgtcgtcgtcacgatgaccagaaaaggttatgtctcctacaaaccctaaatctattcactaatgaagaatctcacatcccaagcagcttgattcgctaatttataatggcaaagcacaaattgttgagatgggttttgaaagccatccactttattgtattaaggttctggatctatagctaatttagttagataccttagattctttgtagccaataattttgaagtgatagatgatcatgatctcagtttaatggctatttgtgggtcaaaggtcatgttttggttgatttgaaactagctcttagccttctttgcagataattagctactgttgtatttgccttgcccatttcaaactctttaggcataatcatgaagctgtttaatgattgtggtcactcttaaacgtcgaatactcttaaccactgaggataaaaaattatctcgacaagttttcaagctgtctagtggcctacactttgttctgctagttgaaaaaatggtttagtcgacggttaatagcataaataaagagtggtgaaaaatacagtttagagatttatcatctgattctatgttgcgtgttttatcttggtaataaactttggactaggaaggaacgtaggtgtctctgttccgttattggctcctttggttatttacttacttcctctgtttgtgattctctctgttccatgcattgtagttacccacatagcatagacttaactatcttttgttgagcttttatcgttatgtgcaacgaatgagtttattttggtgtttatggttgttggttttggcattcatattcttgctggtacctgatatttgttatttcattttaattttaaggtgtttcgaaactgaatatatatttattccaaaccatgtttaatcgacttgagtatgatgcatctgtttgatttctactttttactaagaagtggaattaactagaacttgttttttttaatcaataaatgaaggtactatgaattgaaaccagatgatccaccgtatgctgccaagttctatgattgttgcggggcagaggatcctaatgcaccaggttgtgtcacaaaccctcacatttcatatgatgactgatgtatgagtgagagctctcataagcctttttttttccataaaaacatcatgtaaataatcttaaattattgtagccttcttaggagtaaaagacttagcttgtgatctctctgctgggtactgtcttgaaccacttcttgcattgcacacagctacagagtgagctgttgtgttacagcttttgtcggttttgtgaataggagtgtcagaatcatttgacgtgagaaaattccggaacgactaacgattttatgtttatttgtaaggaatgttcttgtttctatggttgctttaaaaagagtcaaaactttatattctttttatgaacaccaacaacaaaaatctaaatcagacatataggttaattaactaatgcaagtaaatgtggaaaaatttacaaaacaaatttcagaagatctagaagtaatcttgagacagtacttatgagaaataatcttgcactatcatccctcttttctatgaacaccaagatttctgatgcacttataatttcttattttgtgtcaacaatagatatccaaacaaaggtagagaaaacatttgaatgtggacaaattataattatattaataaattgactgtctttaaagtttaaactaagtttagcagatctcattaagagaaaaaaaaaatcaacatgattgagtagagcacatgaagtccacatgacacaactccaagatctcaaactctctggtcttaaatcagatcgttagagagatttattctcacctccattattaaataaagccaacttgttttggtccacttcactcacagcttttattattcttcttttttcttttgtcatcataatatattactccccaaaaaaaaaaaaagcaaaagcggtgagaaagaaaggagagagagagggtgaccactatggagacagcgcaacccattactcattattagtctctcctaccattcttttgcctaaagttcaagactttgtgttcttctaacaagacccttaatcgtaagttcaagactttgtgctgttgtagtcctgtaagaagaagaagaagaagaccatgaaatcgatctgacttctcgcagcaatgctgaggatttagctgcatttattactctttttttgtcaattcaatttctcttttctttgaagctcttctcttgcaacaacaatg

SEQ ID NO: 20753 - DNA, 3003 bp, Unknown; identical to SEQ ID NO: 20752
  misc_feature (1)..( 3003): 2750-1469P.txt file - cDNA_ID_1828626; gDNA_ID_1620790; Annot_ID_168269

SEQ ID NO: 20754 - DNA, 3000 bp, Unknown; identical to SEQ ID NO: 5457
  misc_feature (1)..( 3000): 2750-1469P.txt file - cDNA_ID_1828630; gDNA_ID_1620790; Annot_ID_50478

SEQ ID NO: 20755 - DNA, 3003 bp, Unknown
  misc_feature (1)..( 3003): 2750-1469P.txt file - cDNA_ID_1828666; gDNA_ID_1620790; Annot_ID_50467
cagatagagtgacacgaatttagcttagctaatcaaatcctcacattccttatcttaaataaccttcgaaaaaagtgtgatccacatgtctgtataaaacgaaccgattagattgtgacaacaatacattccaacaatttatccatcacttttccatcctccaaaatttttgcagtaaaatctcttttcactttcaaatcaattatgtcacatcccaccgtagaacaactacatgctttccatgcacaagaaagagagatattctctaaactagttcaaaaactccgaagaccaccagctgagtcacttcttgtcatggccacatggctttggtttgaagactttggcttcggaaacattttctccatcatcacggtttttagcgatctactcattgtagatctcgctaacgaggctgtcttgtgctttcggtgccttgaatctgaccagcccccaaatgatgtcagtcagatccctctcaccgagagattcatgaaaaatgacatatcccttcaaataatccacaatcatcgatacactgccattacgggaataaagaactttttaaccactatttgttctagaatattctctgatatccttcaacgagttcttccatcttcatcatcctcattcatcaccaatctccgccaccctctcatcattcccggtttccctcatccaacttttgggagcatcaacgtattgcctaatatcgttgctagggataatcttccaaacgcaaattcatttctttttcctcatggtctttggggctggaacgctaaccatgtcgcgactgataaagaacggacggtatttctaacgttttctcgtggttttcccgtgtcacatgctgaggtgattcatctcttcaccgagatatatggagaagattgtgtcgaaagcgtttacatgccagaggacggtggaaattcctccaatgacaacacaaattgcaatggtcatcagcaacaaccactattcgcgaagatggtcttggactcggttgttaccgtagatcgtatactcagcggccaggaaaaacaaaagtataagatcaatggaaagcatatttgggctcgtaagttcaagaataataaagacggtcttatctaattaaataaagtcataaggatttttagtttctagtttttcaatttgctggtgtcaaatcccttatcttatattgtagtctaataattagaaaccatatgtaacgtttcgacgatggtatcttcacttaatttgacgggaatgtgtttcacttaagtttgaggtttgaggtgactttagatatccaatatatttcacatttcttttaagcaagagtggtactcaatatttttatgcactaccatatctctaatgttttctcaacataaaatataattcacacgtttaaaataaatagcttttgatcaaccaagcttctaacgatactacgctgatttgggggaaatcaccatcatcgtcaccgtcactgtcaccgtcggttcctcctttgaatgaattttagtaggatccctttgatgtcattgacaaccgccatcatcatcgtctctattaccaccgttgatgctgccacgagcaccactgacgttaaaaccaccaggactaccaccacaacaaccactatcaccactaacaaagagaccaagttttttcataaactaccttccatgtttaattactatagtttgaatatagagtgctagtttcttaatttattaataaaaaaatggtagtcttgcacaaatttttcttctttataaagaaagatatcacaaaattttatcaattaaatttattgaataaaacaaaagattttctctcttctattgtttacctttctttttagtaagtaattaagtctaaatgtgcaagaaatccacagataataaattcaaagagataaactttgatgttgttagaaatggaggataatcatacaatagacggatcggtttctcgagtaattgtttttttattaaacggattataccaaatttagaccgattttcaccaataatcaaatcaaacagaaccgaaccaaattaccttcattaattggaaaaaaatcgaatttagccaaaaataaccaagttaaccggatttttttaaaatgaatacagagattatcgacagtggaaaaaggaaaagaactcgaaaagaagaccataaacgcagaaccataagcatacacagacgaatgttaagcgattagttttaacacatttcataggtcttttaaatgtatattatcgagtctttgatatcgagaacatatagttttcgatatcttttagtgtttttggatttgtggacctgctggggttaaaagaggtgtgttggaagagaaatgaagccaaatgagtcaagtgaagtaattggagatgcagagcagtgcaaaagcgtcatcactaattagtttggccgcctctgatagaagacttcctaccgatagatctttctcaactttgtacacaagatagagtaggatataatctctttattgatcaaagtatgataacaaagtataacaatcaaggcacatcaaatcaatttataaaccctagtcacgtttcaagaatccaaataggaaatacacaataaatattgtcttgtagagattgcaaatagttgttaagacgaagaacaaactatttttatttattacgtgggtcatattcaaaattgaataaatgtaaatttactgtaaatgatgcacttttggataaatcctgacaaaaactagatttatatcgttcataaacctttcacatatcagccattgcaaccatatgaagttttgaaaataagcttgtaggtgatttttgggaggatttactcacatgactaaattgggcccatgagtgaaagtgaagcccatttgtaaaataaatgtcacactacacacaaaaaccctaaaaatcatttcagtcttctcaaggtttttgaaatttctatcttccatttccatctgatgaatctctgacgatg

SEQ ID NO: 20756 - DNA, 3000 bp, Unknown; identical to SEQ ID NO: 5439
  misc_feature (1)..( 3000): 2750-1469P.txt file - cDNA_ID_1828690; gDNA_ID_1620790; Annot_ID_50459

SEQ ID NO: 20757 - DNA, 3003 bp, Unknown
  misc_feature (1)..( 3003): 2750-1469P.txt file - cDNA_ID_1828706; gDNA_ID_1620790; Annot_ID_50452
tacaaaaaatgtctacattgatagcataacgtagtagcacaactactcaactattattgaagattaattgtaatttttaattttgtatgatagtattttacaaatgttagtaaataattttattaatatagaatttttattaacgctatgatagaatttttctaaccttgaaaactaaaatactcataccgccaaacacttagacaaaaatttctctttttgcatcaaaattatttttgccatattttctcgagaaaaccctaaaacttaaccatcactcctaaagctctctcaaaccgacgaatcgattccgggagccagtgattaaactcgccgccttcgtcgttgaaggtagccaccgtcgttgaaggtagctgcgacacataacctcttttcggccctaattcaccgattaaaccatctctttgagtcccaaattgaaggcatgtctctctgaatatgtagctttatttcttccctttcgttaacctagcttgtttttttttagctgtcgtgaagctcgacaactattttgtttcttaaagtctgaatttatagatttctctcattcgatacttcaaagtttttatcttttgcatgcccgtgttctttgcaaaattataactatttgtttgtgtggtttgatttaggcgtagctggataaataggatgcacaattttgctttgtaaaaatcttagatttttagataacttgtattggcctgataacttgtattgacatgttctcgagatttagaagtttttgttgacattctattacaacaatttgtattgacttgttttttgaatttttaaatcttttcggtgcttgtaatgacatggtctttaaatctttatattatttttggaacttgtcaaacacattcttgcataaacaaacacaaacaaacacatgaaactagatatactcattcaatatttttgttttgcaagtgctgctgtgtaaataatgagaatttgaagctgatatttggctcttattacacgacaggttagtaccatcttaaacattactgtgacttttgtcttgaacattattgtggattattatgtgttgaacatttctatgggttctgtaagccaatatatagcatgaacagcccattggaaaataatttcattaaactccggtacaccggaagttctagatcgaagagaaatagaatgaagaagctaacaaacttttattattaattaacagaatgttacaacaacttaatcaacaatgtcattaactaagcttatatacataagattaaaccaacatcaataaccagaaataaccaatatgtaaaccggtccatatttgcaataattatatctcagaacattcattaaattgttataaatgccatacgtatggcccatatatttttaatactaaaatagcaattttggtgaagaattttccgtaaatccatcacgaatgttagtaggtatgtggtcatgatggatttgttgttttgttgttacagtttcaattacgagtgattgattttaaacccgttgttgatagtttggcaactcattgctatgagttttggtgattaatgatcacataaatttttgaaatttggttgaagaattagcagcaatgaaataaacatgaatttactatcgaaacaagatgttatcaccaaaatatgttggttttaccacaaacaaaaatgcctgatatatctttggtttagaaaagtaagattcacataacatgtattggtacacgtgtcccacctcctttcactgtagatccgcccctatgttgagcagacagataaaacaacacgagcattaaatagatgggacattccatagcccacaagcaatttcacgaaattaaatgagaaatgggtcaagattggatcactcgaaaaactgaggaaaaaaagaagaatacgtaaggagttgaaacggaacgtggactatgtcagcccgaagaacacgtttaatgactatggccccatgcaggaccattcccctttttttgaggtgttaccctgttagatccatatttgttttgaacactatcaaaaaatatttgctaaagaaaaacactatcaaaatatgttacagtattctcttccgttttgcctaaactcgaactcataactttaaacctcctcttttaagattaccatatgcatgtacataaactggtttaacaccaagacaccaaattttaaccacaaaacaccaaacaccaaatacgttggatatcttaacctatttcttactcacttaacctttgtgtgtgtgtgtgcaagtgtattactatatatataaagtaaaatatatgcatatattgttaaaaatatcacattaataatggagacggtttataaaagataagaagttttttctttcacttattgttagttaattttgaataaaacaaatcataatttcacatagtattaaacctatatatgtattacttaaaaaggtaaaatttgatacgagatgaataaacaaaaaaaaatcaaccatttcaaatttacatgttaaaatatctcgatttggatatagtcatatagagatgattttatattgatatataaatcgccttcacttattggcaattagtattgagttgaaaatctataatttttctacatgcattgattcaactattatctttcacatcatgcattaaattagcttgggttccatcgtacattagtgtatacatatgccatcttcttcatcattagataatttttcttataaaataaatgcaattataacaatttgattggatatgtcttgtcatttagttgcggaaaaatcttgacgtctcttcttgtctgaagtcttaagtatataactggaaagtccgtattggagttcaacaaaagaagaaaacgaagacttttagttagatcctacattactgaactcattatatatatctggtgagacattctcctatatatgcagtttcaactttcaaagccagcaaataataaacagaggagaaatatg

SEQ ID NO: 20758 - DNA, 3003 bp, Unknown; identical to SEQ ID NO: 20757
  misc_feature (1)..( 3003): 2750-1469P.txt file - cDNA_ID_1828706; gDNA_ID_1971986; Annot_ID_177751

SEQ ID NO: 20759 - DNA, 3003 bp, Unknown; identical to SEQ ID NO: 20757
  misc_feature (1)..( 3003): 2750-1469P.txt file - cDNA_ID_1828706; gDNA_ID_1620790; Annot_ID_168239

SEQ ID NO: 20760 - DNA, 3000 bp, Unknown
  misc_feature (1)..( 3000): 2750-1469P.txt file - cDNA_ID_1828748; gDNA_ID_2926140; Annot_ID_138983
tcccgttacttcatcaaatctcttgtacatccaatctcgatagaaaccgccaccaccgccattattgaagtttcccgccattataccataaactaaacttatatttttttcttcgaaatcgttttttatttcttttgatgttgttttgatttgttggtgaatgagaatgaagagtgtcgtggattatatagaggattttttacaactattttacgactaaacactgtagacgctcagaaattaggtgtacctacccagcaacgcgaaaaacattttccaatggtattatacgacaactatgcgactattggacgacaaagtgaaaatagtcgtagtatcgtcgcctgttttgcgactaatgtttaaagtcggatatgtagtcgtcaatatacgactactttacgactacttatttttttcagtaatgtcgtcgtcaaatagtcgtacttggacgactatttaccgactaaagcttgtagtcgctaaaatacgactatggaacgaccaatttgtctattgtcgtaacgtcgtcgtccatcagtcgtaatatagtcgcaaaaaaggacgaatacattgttagtcgccttgcgtagtcgtcgtttgcctattttcttgtagtgattgactcattctctccatacatgagccaagctttgtaccccggcataaacccatccccatataaatgcatccaaacttaagataccagaataactcttaaaattagttatgtagaacacggacaatacatttgttttgatttgatggttactggttggtttgtcgcaaatgccatgaattgtttaagaccttctgtatattctggcgttagcaactccgtcaccggatcacgcatgggctggtccatccatgatcaaaaataattaaacggattcgaagaaaccatttctctctggttctattttgttgcttggacgattttgtcaatgagggtagaaaaaataaagatgagaattatcaatttttccgacgagtttttgacggatgtcagacgagttttcgactgattttcgttggagatttgatgatttttttataaataactatacgcacggctatttgaccggacggctacttaaccgagtgtattttgttggaattttgtcggaaaggtacaacatattctgacgaatattagaggtgtcaaaacggatatattttggtcggaaatccgtcgaaatatttggtcggagtttcgttggaaatcactgacgaattgtcgaccattttgaatccataggaaagtttcgacggtgttttgacgggaaacatgtcgtcagaaatccgtcggaatatcattacgaagccgtcgaaaatttctgactatttatttaacgtcggaaaatttgtcaaaaaagtctttcagcacaaagaagagctatacaatggattttgactcggttcctctcaacaagacaaataaggcttttgtgcgtcgatcccttagctcctaattcagattttttttctagattctctttatttctaatcaatttacttattaattcgttcttttgtttatctccctatgtttttttagtttttgaaggttaaaatcctgccaactttagtattatactatatatttcttccttgtatttcacctttggataatttcatgaattattcagacgaaaaaaaaaaaaaaaaacaatattcgttctttgtttgggaaagaggcccaataagggcccaactatttctcacctatcgaaaacaaaaaattctgaaaattgttcgtcgtcggtacgacggagagaaaacgtcttccaaagacgaattgaggcggtggaagaagaaaaaaaaaaatcaaaatccaatttgatcttcaaagtagtgaagaaagaagagaagcaatcgaaattctctgacgatgttgttacaaccccaaagatcctcttatcgattatcgtaattcgtagaaaacgaagcagagagaaaatgggaggcgaagatgataaagataagaaatggaatcctccaccaccgcagcagaagccggactcaaggccttgggaagtcctcgcggcttttgtaatctgcgcaaccgctactactttcgccgtgagtcaaaattcattagttttgttttcgttcatatctcgaaattgtgtttaagaactgtttaaagagtttgataacgttatagttgataaagttgtagttattcaatggaaacttataggctctgattggtgatataaagtgtgaatttcataggctttgcttgaggtcagagtagctttagttttccggttttgacgtgctttcgtgcgtgctcgtacgcgatgattgatggttttgaaatgattagttagagagtttgaaaaggttatagttgattcttttttgttctgacattcttagtagtaatggaaaattataggctggtgatataaagtgtaaatttcataggctttgcttgaggtcagaatagctttagttttcgggtttttacgttctaacgtgcgtgctcgtacgcgatgattgatggttgagaaatgattagctagagagtttgataaggttttacttgattctttttttgttgtgacattctaagtagtaatggaaaattataggctctgattggtgacatatagtgtgaatttcattggctttgcttgaggtcaaaatagctttagttttcgggttttacgtgctttcgtgctcgtacgcgatgattgatggttttgaaatgattagttagagagtttgataaggttctagttgattcttttttgttatgacattctctgtaagtaatggaaaaattatagagactgtgattggtgatacaaagtgtgaattttcataagcggcgtactttaagcgagattgatcttaatgtttgttggtgtgagggtttgatgattggttttagttgtgtcaatgttgtatcgaattatgcttgagaaagtagctttttggttttctgtgctttcgtgctcatagtcgaggattgatggttgagaaatg

SEQ ID NO: 20761 - DNA, 3000 bp, Unknown; identical to SEQ ID NO: 20760
  misc_feature (1)..( 3000): 2750-1469P.txt file - cDNA_ID_1828748; gDNA_ID_1620794; Annot_ID_50489

SEQ ID NO: 20762 - DNA, 3003 bp, Unknown
  misc_feature (1)..( 3003): 2750-1469P.txt file - cDNA_ID_1828785; gDNA_ID_1620803; Annot_ID_50526
gctgcttgttgttgtcaaggcacacatgtttattctttatttttgtcaaatatttgaatcaagatcagctactattctaagaaactggctatttctaaaataacactcacgaattagccattatttataaaatggtaacggtatattcgagattccagtccatacatgttattaataaagaaagattggatctccatataaaaaatagctgtctcttacattgtagcactagctaaagatctttcaatactacgtacctagtcatacaattctttgaatatggttttaaattgtatgtgaatattattaagtgagaatagtatcgacataacaagtatgaaatcttttatttctatatattttatttaacaacctataacaaacatttcacttcaaattctcactatatgtagtccatcatcaactactttcttttcgcatatctttgaagtttttggttttactaaactaactctatcataaaaggagaaagctttaaatttaaccagaaatgaagatgcccgtggttgtacaattcttcataatctctcttctcctcacatcttcattttatgtactttcaagcgctgattcatgtaagtgtatacttaatctagttagttattttttaggttatttatcattttgaaactagttgtctgaaattctaagatttgatttgtgatggtgataaatgaattagcagcatgcggtggaaagtgcagtgtgagatgctcaaaggcagatcgaacacatgaggagtgccttgaggactgcgatatatgttgccagaagtgtaattgtgttccttcggggacttatggaaacaaagatgaatgtccttgctaccgtgatatgaaaaactccaaaggcggatccaagtgtccttgaacattctttgaagatcctcatcacatacatactatctacgtactatatgtatggaaattacatctatatatgtttgatgtatgaaataagttctgtgagcttaatgaaaattttgttatcttcaatccgattcctaaacacatcaagaataaatcatgtcgaggtttatatttctcagcttcaatttcactaaacgaataacttgggatactatgatggaatgcagaattgagaatttactctctcaattgtcttaaattcataatccaagatctacaaggggtaagtattaggactaaccgattaagggtttaataattatgtaattcagagactctaacgctttgcatcgaccaaatactacattgtaacataacacaaactcattggatgtgaaagtacaaagtagtatgtctttataataatttgtttccaaggaaaaaagacgagaacaaaaactaaaacaagagaaagatcatcccatgatatttaaatagagaatcaatctacaaaaagacggcaacctgattttcaaaacaagaacagtagatcagaggcaagccggatagtacataaaaaagactcaaacccaaaccaaagaggctttctccaactagaacgtaagtctttttttgagtcgctctgttttcgtttgtggaggaaccatatcaagtttcgacgctcacaagctcatactcgatcagcgaaagattgttatcatccttcacggtgatgtctgtgggctcctctgcaacttcaacacgtccccatctatcaactgcaagcctcatagaacccttgtacatgtcgatcttcgcattacgcagagtcactacactgccttctttcatcatatccactggataaaaatgaataatagcatcagtcataaatctataaaaagtacatgagaaatactcaaattatgcaaacaactaactatttccataaagcaatccactctcctgctattatctgtttcacagattcacaaccagtatagactataaagatgccaacttagaacagaaacttgccattaaagaagctaactgagaagagaagcagtctcttaaaagaccatcacaaaagcatttattctctcaccttggtcatttcttgcagtaaagattatgattccagtctcatcaccaactaagcattcggcaatccgcatctgacgtgactgaggacccatgggacgacctcctcctctctgcatcaccatcttcgtgttgacaactttcacattcagagagtggccattggttcctggtctcaactcattaacctttgtgaacacaggcttcctcaaagcagacgttgcctcagccatttttataacaaccctacaaaaattagccataaacaacaacatctgctgtgatcagcacctaacaacaatttcaatatctgattagacaatcaaaacctcaaatgcgatcaaacaggtttaagctatcctcatttctcacataagaaacgttttaacaattcaacaaaacaatttcattctccatacacaacaaattcaataaaacgcagcaacatagataatgaaagctaaattacacaaaagatcatatactttgatcccagaaattcacggaatctcagatcggagaaatgaaattgacgtgaagaaaagtgtagtaacgttaggaagatggaattgaaacaagaaaaaagctagctagggtttttggaaactcacgtactttttgattttgagagaagagacgacgacgatgactttagcgattagatctgtggaggcgatatacacaaagacgcggcggtcttctttataactctagaactcagatattaatactcaccgtagatccgtgacctcaacacgtgtcatgtttctgaaacatcttcattaaaactacccttatatttttttatatatttaagattgaccttataactttgactaatactgattacaccctctattctccgaatcggttatcaaaaccaatttcactggaccgtgatatcagaaaccggttcactgaggtgggcgagattttttgttgtcactctcctctcctcgttcttcgatgctcatccattagaggaggagccgatgtttctgcttccatg

SEQ ID NO: 20763 - DNA, 3000 bp, Unknown; identical to SEQ ID NO: 5580
  misc_feature (1)..( 3000): 2750-1469P.txt file - cDNA_ID_1828789; gDNA_ID_1620803; Annot_ID_50525

SEQ ID NO: 20764 - DNA, 3003 bp, Unknown
  misc_feature (1)..( 3003): 2750-1469P.txt file - cDNA_ID_1828805; gDNA_ID_1620803; Annot_ID_50521
tcgtcggatcttgacatttccgactgtggaaccatccgaatcaatctccatagtcaccctattggactcactgattcaactcgccggcgacattctcacattcaagtcgaaacacttctctaccaataaacaaagcttcagagaaactctcaggcggatccaaaacctacttgttgtcttcgaagagattcggatccggatcagaaattcgagacgctacttccatgactctgccgccgcgtcgagcctcaaggagatccacgtcggcttccaaaagctcaagttccttctagaagactgcacgagagacggagctagactatgcatgatgatgaactcggatcaagtctcggatcatctccgggtcctgactcgatccatttccaccagtcttagtgcgtttcctgtcgcctccgttgacttaacgaccgaagtcaacgagctaattgatttagtggtgcggcaagctcgtaagtacggagtccaacctgaaacaaatgataaacgggccgtgagctccattaataggatccttgctctgtttgtgaacagagtcgtcccggatccggatgaaattaacaggatcttggatcacgtagggatcagaaaatggggagattgcgttaaagagataaactttctcggagaagagatagatgcagaacggttagatgagaagaagaagaagagtagcgatcaagtcgagcttctcagtagtttaatgggattcatatgttattgcagatgcattatacttggacggatcgagagagatgatcatcataatcatcatgaagatggtataaagaaagatcatgacttgatccgaggattgaaagttgaggatctcctttgtccaatttcactagagattatgacggatcctgtggttatagaaacaggccacacttatgatcggagctccatcactaaatggttcggatccgggaacatcacgtgccctataaccggaaagattctgactagtaccgagttggttgataacgtatccgtgaggcaagtgattcgaaagcactgcaaaacaaacggcatcgttttggcggggattagtcggagaagaaagagtcacgatgacgtggtcccggagagtttggctgcaaagggagctgggaaactcatcgcaaagtttctcacttcagagttaatcaatggcggtgaagagatgatttacagagccgtgagagagattcgtgttcagaccaagacaagcagttttaataggtcttgtctggttaaagctggtgctgtgactccacttttaaagcttcttagctccgtagatatcaggattcaagaaaacgcaatggctgggatcttgaatctttccaagcacgttaccggaaaatctaagattgcgggagaagggttaaagatacttgtagagattctcaacgaaggagctaaaacagagacgagactatactctgcttctgctctgttttatctctcttccgttgaagattacagcagattgatcggagaaaatccagatgcgattccgggattgatgaatatcgttaaaggagatgattacggcgattccgccaaacgtagcgcgttgcttgcggttatgggtttgttaatgcaatccgataaccattggcgtgttctcgccgccggagctgttccgattcttcttgatctgttgagatcgggggagattagcggcggactcacggcggattgtttagcgacgttggcgaagctggcggagtatcctgatgggacgattggggtgattcgtcgtggcggtttgaaactcgcggtgaagattttgtcttcgtcggaggattctccggtggcggtgaagcagcattgtgttggtctgattttgaacttgtgtcttaacggaggacgtgacgtcgttggggttctggtgaagaattcgttggtcatggggtcgctttacacggtgttaagtaacggcgaatatggaggaagcaagaaggctagtgcgctgatcagaatgatccatgagttccaggagaggaaaaccggttcggttgaaccgaatcttcaaagaggacggttcgttcacgcctggtgattttggtacacagtaactcttgagtattttaaagagttatttaccataaagaaaactaaataattttggttaagggtgaaattcttttattaatttttatgtaaagggtttagtgtttgtatatttagctcgggttttattttcataaaccaaagagctactgggatggcaataagcttcagtttttttaagaagctgtgtccatattccataatgtaattataactgaatcaataaaaactattacaattaaaaaaaaatacctaacttttttgttttgcatgtttcctaaaactaacattacaaatttcttggtccaaactaaagacaagaaaagtacctagctttctttgaggtaagtcctattcactcacatgatgcactaggttggaaacgcaaaatggtgtttgaagcagtggaactcgtttgtttgcaataacagggataaggttgtttaatctagttgaagtcgcaaaatgttgtttgagatctttagaattagcatctagaaatctcatatttcgtgtgacttacataaaaacttattttatgtatataagtttaatcaaaactacgtcgttttaatctttttaagacaataaacaatgttacaaaatttgtttgttaacatttcaaaattttaatataaaatgccaattgagtttatgctataaaattaattcgatcgtttttatgttcgattgattttgaattggaagcatgctattagtctacatataaacttttcaaatgtagttgttaattaatttgaatttgaaagcccacaattcaattcgaatttagttagttttgagttggaagcccactatatcgcaattatattacaatttaatgtaaaaaaagcgatgaaaaaccagaaagatttcagaccgaaacctaaataatattgagtaagtttattcgaagaagagatg

SEQ ID NO: 20765 - DNA, 3000 bp, Unknown; identical to SEQ ID NO: 5568
  misc_feature (1)..( 3000): 2750-1469P.txt file - cDNA_ID_1828817; gDNA_ID_1620803; Annot_ID_50517

SEQ ID NO: 20766 - DNA, 3003 bp, Unknown
  misc_feature (1)..( 3003): 2750-1469P.txt file - cDNA_ID_1828829; gDNA_ID_1620803; Annot_ID_50513
atctcgttgacttcaatctggttagattcactctctgagagtcacttattttagggaaatatgtactatagtcagatatgtaatctgcttaaataactacacaatcataagattctggtacagactcagacaaataatactaaccgcatgttcaagcttgatactctgtcttttcgtttggtttggtaactatttttactttgttatcttttcaaaggtttatgacatctgcaaaactctagctcatcattattttcaagagaagctcccagtctcgctgtcgtatgttcaagcttctgtactcctgtgtttgggcttgcaggagtcagatttctcgagcatcgaggtataacatatctactctttaaaataaatcgatgatctggaccagctgaattatgtttcaccacacatgtggagataaatttcttgacacatctggttgttctaaattggatcatgacgttgacttacagagacaaatgcagttggagaggggccaaatatactctcttctattgaaggttggaaagaagttatacaaatatttgaatggaatcgcaacaaaagagctcgaatccaccttacctcggttgaaagatgtaagttcagatgggaaaacttacataacatttccatgttcttttgctcagtcataatattccctcatttttgaaaattaacaaccctaagccctaaatacatacacgaatatcgagctgactgaaatgattcatggttgcttttggttgcagagagtgcttgaacctcacaaagtatcagtagacgaagatctcagggagggagcaaaagaagttgaggtaatcgcttctgtttccgtgcatgcgtatattttgttttggtttccatgtaaaatcgaaacaccactcacactctcaatgcttgggtttaaaggaacaaatgagggcaaggatagaagaattgttggaccctgagctacttgaccaatttgctattggggacaaagaagctgaggctttgcaaaagtcgaagatctcttcaagtggtcttatcagtatagagtccaccaaaactgataacaagaaagagaagccaagtggttttgataaatcagccaaaaagagaggcaatgataagcattcctccacatccaacaaaaagagaagagcctgagatggaggttgatgtcaacaattgtttttttgtaacagtgaccagaaaattttgatctttggtctttttacgaatttttgtaaccaggttgaataatttattaaaattatggtttgatcatacaatttttttaaaaaaacttacagattctgtttgagcattctacaaccataatacaaagttttctattaactataactatattgtttatctactgcaatgtgtgaaactggttcacatctcggcagcaaaagacttcccacatccacaggtttgtgtagcgttagggttcgagaaagagaagcctccaccaatcaaagcatcgctgtaatcaagctgcattccaaaaagaaagagcatgctctttggatcacaaactgcaaaagaagtgagtacaaattaaaaacctgagccttcaattcacagatgtaaaaatactttactgcagaagacaacaagagactgcaaaagacaacaagagactagaagtctcagttcaagaatcggcagctaagtagtatataattcaagctgcacatcaaaaagaatcaactgaccatctacttgacaataaaactttagcctatttgatcgaacaatctcagccttttttttatttggatgcatacttgaacacagaaactgacattcatattgtaagtatggcaagtctacatcatcaagaaactagctgatcttactctcagaccttattatctcagattagaagagttgatcctacatagtgatggaatagtttttacctatagtgaatccctggtattcgatagtggaatcatctggtcttgcatttgctctgttttcaaagtccatcgtgtaggacatacccgagcatcctccttgtttgactccaattctcaagcacaaatcttccccacgttctgatctcatcttactcagatgcttaagtgcattttctgacagagatatcgccggcttcagtccctccattgcaggtgcagctgagatattcaagagcacaagtcactacactttttgaattcaagagcagaacctcactacacatatctaagtaacagctattaccatctttttaagaattctcagacatcaccaacgaaagttatcaatttcaatagaaagtttctaattttaaaaccagaatggcaataacaacaaaaacaacccagaaaaaataaaaaggactctcataggaaaataaagcagagcaattttgtgaatcaattcgaacctggaaccgaagcggatcgaacagaaaggcggtttctccgattgaggttgagattcacatatgacaaagaaggaaacgaaatcgaattacatgaaaccacagaacgtagacttgtgttggagatctttagaccaagaaaagttggatttgaagacgtcgtgattccagtagcgaaagccataatcttctgagaattgaatcgccgagctgaggaattaatctctctgctgattcaaatgcgtgtagtagaagaagaccaatgaaaaaaacaaatctttttgcataacaattttttaagtccacatgttatttgttttcaggtaggtgattgattatttttgttatgaaccctaataaagtcgttctctttcgaatctatcgggtcataaatttaaacccgatttcgacccggtggatagtcgggtcacacccgtacctaaaggaatacacacacacatagcgcgaaggaaacaaacttcatcttcatcatcgtctcttctcttctactccaattcgtctcttttagtctcttacactttcctaattcttcagtggttggttttcacacagcgagagtttcaagcgtctatgcgtaattaagcagctccttaatg

SEQ ID NO: 20767 - DNA, 3003 bp, Unknown
  misc_feature (1)..( 3003): 2750-1469P.txt file - cDNA_ID_1828849; gDNA_ID_1620803; Annot_ID_50506
catacatagttcaaagagctgaacaataagatgtcataaaaaattccaaacgtttgtgctctttgtaattgtatcttaagtagagacaagacactgagacccaggaaggactcataactcttccaactaagtccacactaaggcctttagcagagaacaagaaggttacctcctgtatccgatccaagcttcggatattatcaagagtatccagagaaggtgaaagccctccatgcaaacagaaaacctacaaaatttgatgaagtcaaaaagctgtacttagaaaaagatgtatcaaacaccaactgagaaagaacagctctaacctgactctctatgagggcggtaagaggaagataatcgaaaaggtctgtaaaatacttccagacgttagcatttccgtacttcctcaagcattcgtcataaaaaccatagctgaaacagagaagcaaaacatgcatcaaaacaggatagtactttgctgatcagccagaaaccaatgaagaaaagtacgattcgctcaaatataagcttatttcaaaacaaaagcttacacttgagtaatctgccgactctcgtgattccctcgtaagattgtaagtctatccctgtatcgcacttttagtgccaccaatagagaaactgtctctactgaatagtagccacgatctgcaaagaacaaagcaagacaatgagaaaccaacaacactccttttaaactaaatctagctgtcaccatcttatggtacaccaacgaatggttaaagttccaaggatctaaagactagaattcaagggaagtgcaataatgaaagtgagcatcaacaagtctctatattgggaagtttcagtacctaccattccaaaaaaaaacagaacccacaagtaactcactctagataaataaaaaggtggatacttttccaagaattcaccattttggaatgatccaaaaacacagatctaaaatgagaaaaaaaagtaaaaaccccaaaaataaaatcgaaagaagaagaaagacagacctacatagtctcccatgaagaggtagttagtatcaggagcgttgccaccgatacgaaagagctcaataaggtcataaaactggccgtgaatatcgccgcaaacggtaacaggacacttcaccggctgaacattatattcctcgacaaggatcgctctcgcttgatcgcaaagcgtcctcacatccgcctccgataacggtttacactccatcagctgctcgatctgacggtccagatctccgttcgacggcatcttgaaaagccaccaccgatcctatatacgaaaattacggcggataaagaagatgaatcgccggagaatctatcggccagagctaagatatccgaatcggagagatcaaatcctcctagcttctctggtcttcgatagttcgatgtctctctctctcacctggctgagaaaaaatggatattcgttttttttttttaaagactaaaagtgggtcgtgtccaaatagacaaagtataaatgttttatgacccggttaaggttcggttttgtgttaattttattagtctcgccaattgttataaaacttatgattgttttttttctttggttcaaaataaaattttgagttttagttgttttttcttctgttaaattcgttggtgttttcaacttaattctagttgttttcggtcaaattatcaaaaaaaaaaatgaaaaaaaaaagagagaattgagaccaaaccggatcggatttgaattgtgaaccgttacacgtgggtagttggagcagagctattgtcatttgaacttgtctaaacgataagtatatatggacaaatcatctcctcctctcatccggtaattataattagtcaactaatgttttcatattatgttttagatttgacaaatttgcttttaagtttttaatgttgacatgatcgtcgactatgaggcaagttcctcgtcgaacaaatgggcctggagaatctggtagagcggcccatggtaacaaaaataaaagaaggggcgttccgagaattgaactcgggacctctcgcaccctaagcgagaatcataccactagaccaaacgcccattgatgatagctctgacaatacatatttatatttagaaaacattttgaaccattaattttgctattaaattgatgcaaatcaaacctaattaaagtttatcatctaacacagtatgaaaattcatagaccaaacatttttcccttgcatattcttcccacttgtaagaaaatgtgaccgagctttttaggtaaaattaggatattatactttacttactacaaacgaatattaataaaccagatttagtttgaatagactggaatattatgtttcgtttttataaccttaaatcaaatcctcacttacgcataggtaatgaaagttgaaagaaaaaaaaccctaactctgctttttacttggtttttgatttacataatattaaaccggtaagtttgatttggaattgaaaaataaaccaatttcgtacgtaaccttccatttagctccgaaggttctgattacatacagacatgaagatttctttgggtatataagcaaaacaagctcctctctttttcttcttcttcctcgttccgttgccttaccctcttccctcctccgcttccaaaatcagcgagagagggagacacatagagagacagagagattgctcctaatcagaagcaatctcaccattgaatcatctattttctaccaaaaggaagcttcttttgcttttcattttgccaagtttccgtctaaatctctctactttaaaactccggcggccaacgtttccaccgatcctccgacttctttccgagtttcatcttctaacaaaggaacgaagaagctctcttcaccgtttgagtaacgtgatccggtctacaaaggttttaaatcaaaatctcttgctcagaatttttcctcgttttttgtgatttctcttaagattttccgatg

SEQ ID NO: 20768 - DNA, 3000 bp, Unknown; identical to SEQ ID NO: 5557
  misc_feature (1)..( 3000): 2750-1469P.txt file - cDNA_ID_1828853; gDNA_ID_1620803; Annot_ID_50505

SEQ ID NO: 20769 - DNA, 3000 bp, Unknown; identical to SEQ ID NO: 5557
  misc_feature (1)..( 3000): 2750-1469P.txt file - cDNA_ID_1828853; gDNA_ID_1620803; Annot_ID_168713

SEQ ID NO: 20770 - DNA, 3000 bp, Unknown; identical to SEQ ID NO: 5623
  misc_feature (1)..( 3000): 2750-1469P.txt file - cDNA_ID_1828875; gDNA_ID_1620806; Annot_ID_50553

SEQ ID NO: 20771 - DNA, 3000 bp, Unknown; identical to SEQ ID NO: 5600
  misc_feature (1)..( 3000): 2750-1469P.txt file - cDNA_ID_1828875; gDNA_ID_1620806; Annot_ID_168874

SEQ ID NO: 20772 - DNA, 3000 bp, Unknown; identical to SEQ ID NO: 5623
  misc_feature (1)..( 3000): 2750-1469P.txt file - cDNA_ID_1828875; gDNA_ID_2926172; Annot_ID_140167

SEQ ID NO: 20773 - DNA, 3000 bp, Unknown; identical to SEQ ID NO: 5600
  misc_feature (1)..( 3000): 2750-1469P.txt file - cDNA_ID_1828875; gDNA_ID_2926172; Annot_ID_199584

SEQ ID NO: 20774 - DNA, 3000 bp, Unknown; identical to SEQ ID NO: 5622
  misc_feature (1)..( 3000): 2750-1469P.txt file - cDNA_ID_1828883; gDNA_ID_1620806; Annot_ID_50551

SEQ ID NO: 20775 - DNA, 3000 bp, Unknown; identical to SEQ ID NO: 5622
  misc_feature (1)..( 3000): 2750-1469P.txt file - cDNA_ID_1828883; gDNA_ID_2926172; Annot_ID_140165

SEQ ID NO: 20776 - DNA, 3000 bp, Unknown; identical to SEQ ID NO: 5608
  misc_feature (1)..( 3000): 2750-1469P.txt file - cDNA_ID_1828916; gDNA_ID_1620806; Annot_ID_50540

SEQ ID NO: 20777 - DNA, 3000 bp, Unknown; identical to SEQ ID NO: 5608
  misc_feature (1)..( 3000): 2750-1469P.txt file - cDNA_ID_1828916; gDNA_ID_2926172; Annot_ID_140154

SEQ ID NO: 20778 - DNA, 3000 bp, Unknown; identical to SEQ ID NO: 5606
  misc_feature (1)..( 3000): 2750-1469P.txt file - cDNA_ID_1828928; gDNA_ID_1620806; Annot_ID_50535

SEQ ID NO: 20779 - DNA, 3000 bp, Unknown; identical to SEQ ID NO: 5606
  misc_feature (1)..( 3000): 2750-1469P.txt file - cDNA_ID_1828928; gDNA_ID_2926172; Annot_ID_140149

SEQ ID NO: 20780 - DNA, 3000 bp, Unknown; identical to SEQ ID NO: 5605
  misc_feature (1)..( 3000): 2750-1469P.txt file - cDNA_ID_1828932; gDNA_ID_1620806; Annot_ID_50534

SEQ ID NO: 20781 - skipped

SEQ ID NO: 20782 - DNA, 3000 bp, Unknown
  misc_feature (1)..( 3000): 2750-1469P.txt file - cDNA_ID_1828943; gDNA_ID_1621163; Annot_ID_57155
taaacaaaaggaaaattttcttgctttctcttttgtttggtttctccgtcgacgataccaaaggcgattcaacttgatttgtttgatccagcgttttgatcatgaaatcgggagagcaaccacatatactcaatatacaaccgccagaatgatgatcgacgatgagattgttcaccaaatcaacttcaaaccggatcttgtggttatattgttgaattctttgtaacaccaggagcttctatcatgtgactatctcatgagttcttaccaagaggtagaatccagctctgtctcaagtatatctcttttaatgcacttggagttttctgaaatttttgctcaaaaaacatggttgtggcaaaacagagcctttatctgacatagagatggcgcttaagaacaagctaataaatgatatgttgtcttaagttttagtttctatctgaatgttgcatgtttggtcagaatgtacttcaccttctagtatttcggctttaagttttagcttctagtatttcggcttttagtatatgtgtaataactttgagactgaatgtttggtctgaatgtttgtgtttggtctgaatgtttagtctgaatgttttctgtttatggattaatgagatgagtatttgtgtttggtgagtatttgtgtttggtgaatgtttggtctcaatgttttcagtttatggattaatgagatgagtatttgtgtttggtctgaatgtttgtagtttacggttttgtttcatctgttaatgtcatgatttgcttcattttgcaggactgggaagaatagaaattgtgccaacatcaattgtggaagataccagattctttaaatgtatgtactgttgtgagttttatcgattaatgagtttggtctgaacttaaccatatccattaatgaatgaatgtatgtgtttggtctgaacttaaccatattgattaatagatgaatgtgtgtgtttggtctgaactcaaccatatcgattaatagatgaatgtgagtgtttggtccgaacttaacaattttggttacaatcgagtaatgagttttatttcatgagtttcatctattaacttatgtacttaaccattttttattttttttaagaaaccctcttaaaaattccaccattgaaccataaaaattataaaaaactctaaactacaaaactatcaaaattaactaataaacaattcgaagaaactcatattaaaaaccaaccaatgtggatgctctaagtaagcataaagaagaactatcacgtgtacagcttaaagtcttaacccgcaaatttctctagcttatcgtggttgattcacttcatcttccctttcacatttgagatatcactgctttaatttcctgaaatctagttgaaaattgccagatttgttaagttttatgaagttctaactcaaaaccaaaataaactgatcaatatgttctttatatattgtttttggtccgatcgcactttaatgggattttttaacaggtttacatcatacttagatcttggatattcattgattagctctgtttgagctgtgtttagtacatgttgaagcaaaagtggtccaatacaaattctgaattaaacttaattttgttaagttgactccacattttatcaatttttttcttgactaacgtgaatttttcgtgtgtgttaaattaccttaattatattgattatcaagtatcaatggtgcaactggtaaaggcaaagtctacaaatcgtctttttggtctcagcagttgatcattgggatagacaacttctgatttattaatggttaatcaaagtatctttttattggaaggtaatggagaagttcacgataggtcttatatgagttttgctagttttgtgtgtaatacttaaagtttaacaaaaaaaattatcgctgttaaatgtcatttagaattttttttagaaaagaaatagaaaaaacttaaaaggtagtacatactctttatgtaagaaataaatattaaatgttataaaacaatttaacaaatggcgtgattatgtgagttataaatttgatattttttgttttcaacaaatttttagtcttgtacattccattttatcaaagaatttaattctacacacttgtttttattgatgatatctaaattctaaataacaattatttagtattaaaaaaaggaaaaacataattcttccatgatgcgttaaaattcttaaaatataatataggtattcaaaaatttattcttataagctcatcattttttccattttttatgtttttatttaacaaatgaaaacactatattatagatgataaatataattttatccaattaaattaatgttaaataaattatatttttattttaaatttcaatgtcccgttttaattagtattattatctataataaatgattttaaaaaataataattcatgctaaatataatgttatcccatcaaattaatgttaaataaattatattattattttaaacttcaattaactttttaatttagtattattagccataataaatgtttttcttaaaaaacattaatgcatacaaaatttaattgaccaacaacacatgtaaaaataaatttgttaattttttttttaattaagggaacaaaatggatatataacttagtatatgcagattttttttttttagaaaatgacagccatcaaaaggcgcgcagccaaaatggatatataacttagtatatgcagatttttttttttttttgcttttttatctctttaagaagaaaaaaaaagttaaacattttctcaacatgtaaacatctgatcgacagacttgacatatgacacaatcttatgaattaaccatattttatataataaaatagaaactattttctttgttacaaacttttcatttatatatttccccacctttgaatctgatccaaacttgtaaaattttctcctcaaattttgttgctctactgctacaacaatg

SEQ ID NO: 20783 - DNA, 3003 bp, Unknown
  misc_feature (1)..( 3003): 2750-1469P.txt file - cDNA_ID_1828943; gDNA_ID_1620806; Annot_ID_50531
gtttaaacaaaaggaaaattttcttgctttctcttttgtttggtttctccgtcgacgataccaaaggcgattcaacttgatttgtttgatccagcgttttgatcatgaaatcgggagagcaaccacatatactcaatatacaaccgccagaatgatgatcgacgatgagattgttcaccaaatcaacttcaaaccggatcttgtggttatattgttgaattctttgtaacaccaggagcttctatcatgtgactatctcatgagttcttaccaagaggtagaatccagctctgtctcaagtatatctcttttaatgcacttggagttttctgaaatttttgctcaaaaaacatggttgtggcaaaacagagcctttatctgacatagagatggcgcttaagaacaagctaataaatgatatgttgtcttaagttttagtttctatctgaatgttgcatgtttggtcagaatgtacttcaccttctagtatttcggctttaagttttagcttctagtatttcggcttttagtatatgtgtaataactttgagactgaatgtttggtctgaatgtttgtgtttggtctgaatgtttagtctgaatgttttctgtttatggattaatgagatgagtatttgtgtttggtgagtatttgtgtttggtgaatgtttggtctcaatgttttcagtttatggattaatgagatgagtatttgtgtttggtctgaatgtttgtagtttacggttttgtttcatctgttaatgtcatgatttgcttcattttgcaggactgggaagaatagaaattgtgccaacatcaattgtggaagataccagattctttaaatgtatgtactgttgtgagttttatcgattaatgagtttggtctgaacttaaccatatccattaatgaatgaatgtatgtgtttggtctgaacttaaccatattgattaatagatgaatgtgtgtgtttggtctgaactcaaccatatcgattaatagatgaatgtgagtgtttggtccgaacttaacaattttggttacaatcgagtaatgagttttatttcatgagtttcatctattaacttatgtacttaaccattttttattttttttaagaaaccctcttaaaaattccaccattgaaccataaaaattataaaaaactctaaactacaaaactatcaaaattaactaataaacaattcgaagaaactcatattaaaaaccaaccaatgtggatgctctaagtaagcataaagaagaactatcacgtgtacagcttaaagtcttaacccgcaaatttctctagcttatcgtggttgattcacttcatcttccctttcacatttgagatatcactgctttaatttcctgaaatctagttgaaaattgccagatttgttaagttttatgaagttctaactcaaaaccaaaataaactgatcaatatgttctttatatattgtttttggtccgatcgcactttaatgggattttttaacaggtttacatcatacttagatcttggatattcattgattagctctgtttgagctgtgtttagtacatgttgaagcaaaagtggtccaatacaaattctgaattaaacttaattttgttaagttgactccacattttatcaatttttttcttgactaacgtgaatttttcgtgtgtgttaaattaccttaattatattgattatcaagtatcaatggtgcaactggtaaaggcaaagtctacaaatcgtctttttggtctcagcagttgatcattgggatagacaacttctgatttattaatggttaatcaaagtatctttttattggaaggtaatggagaagttcacgataggtcttatatgagttttgctagttttgtgtgtaatacttaaagtttaacaaaaaaaattatcgctgttaaatgtcatttagaattttttttagaaaagaaatagaaaaaacttaaaaggtagtacatactctttatgtaagaaataaatattaaatgttataaaacaatttaacaaatggcgtgattatgtgagttataaatttgatattttttgttttcaacaaatttttagtcttgtacattccattttatcaaagaatttaattctacacacttgtttttattgatgatatctaaattctaaataacaattatttagtattaaaaaaaggaaaaacataattcttccatgatgcgttaaaattcttaaaatataatataggtattcaaaaatttattcttataagctcatcattttttccattttttatgtttttatttaacaaatgaaaacactatattatagatgataaatataattttatccaattaaattaatgttaaataaattatatttttattttaaatttcaatgtcccgttttaattagtattattatctataataaatgattttaaaaaataataattcatgctaaatataatgttatcccatcaaattaatgttaaataaattatattattattttaaacttcaattaactttttaatttagtattattagccataataaatgtttttcttaaaaaacattaatgcatacaaaatttaattgaccaacaacacatgtaaaaataaatttgttaattttttttttaattaagggaacaaaatggatatataacttagtatatgcagattttttttttttagaaaatgacagccatcaaaaggcgcgcagccaaaatggatatataacttagtatatgcagatttttttttttttttgcttttttatctctttaagaagaaaaaaaaagttaaacattttctcaacatgtaaacatctgatcgacagacttgacatatgacacaatcttatgaattaaccatattttatataataaaatagaaactattttctttgttacaaacttttcatttatatatttccccacctttgaatctgatccaaacttgtaaaattttctcctcaaattttgttgctctactgctacaacaatg

SEQ ID NO: 20784 - DNA, 3003 bp, Unknown; identical to SEQ ID NO: 20783
  misc_feature (1)..( 3003): 2750-1469P.txt file - cDNA_ID_1828943; gDNA_ID_2926161; Annot_ID_139737

SEQ ID NO: 20785 - DNA, 3000 bp, Unknown; identical to SEQ ID NO: 7784
  misc_feature (1)..( 3000): 2750-1469P.txt file - cDNA_ID_1828945; gDNA_ID_1621163; Annot_ID_57157

SEQ ID NO: 20786 - DNA, 52 bp, Unknown; identical to SEQ ID NO: 5598
  misc_feature (1)..( 52): 2750-1469P.txt file - cDNA_ID_1828945; gDNA_ID_1620806; Annot_ID_50529

SEQ ID NO: 20787 - DNA, 3000 bp, Unknown; identical to SEQ ID NO: 7784
  misc_feature (1)..( 3000): 2750-1469P.txt file - cDNA_ID_1828945; gDNA_ID_1621163; Annot_ID_173755

SEQ ID NO: 20788 - DNA, 52 bp, Unknown; identical to SEQ ID NO: 5598
  misc_feature (1)..( 52): 2750-1469P.txt file - cDNA_ID_1828945; gDNA_ID_1620806; Annot_ID_168834

SEQ ID NO: 20789 - DNA, 3003 bp, Unknown
  misc_feature (1)..( 3003): 2750-1469P.txt file - cDNA_ID_1828945; gDNA_ID_2926161; Annot_ID_139735
attactgcaaaatctgtgatattttcgtccacaagaaatgtggcgagtcctccgaatatatcgagcatccatctcaccccaatcacactcttcagcttctaagtactagaggaaatagccatgactgtgatttatgtggaaagaacatcggggatctattctatcgttgtgagatctgtgacttcgacatggatctatactgtgccaagtatccaccaccagaggttattaacatttccaagacgcatcaccacaagctcaaccttctcaaggagctgatccagtttgactgtgatgctaagtgtggcactaatgattaatgggtttccatacaaatgttatgaatgcgatttattcttccacaaagattgcgtatggcatccgccagaggtaaatcacactttagaggtaaaccactcttaccactccttgcaccctcttaagcttcacactggtcaactaccgaattattctgaccgaaaatgtcgtctatgcgcaaaagaaattgaagttggattgttttatcattgttctttgtgtaatttcaccttggatatgtcttgtgttttaaatccaccacaacgatatctttggaatttgaaagctcatgaccaccaactcaccctgctcccaagtctccgttcttttttatgtagtgcttgcggtttgaatggcgaccgaagcccttacatatgtgttcaatgtgactttatgatccatcaagtctgtcttcatcttcctcgtgtcataaacattaatcggcatgatcaccgcgtctctcgaacttctgttcttggtgttgttaattcggtatgtggagtttgtcgccagaaggtggattggacttgtggaggtttttcttgtccgaggtgtcctggctatgccgctcattccctatgtgctactagagaagatgtgtggaacggaaaagaactcgaaggagtacccgaagaaatagaagatatagagccatatgtggtaatagatgacaatacaatacaacatttcagccacaaagagcattacctaagactccacgttaatagtgttctttgtgatgacaacaagcggtgcagcgcatgcacccatccaatctgtctccaatctttctacggttgtatggattgtgacttcattctccaccaaaactgcgctggatttcttagaatgaaatggcatgtgctacacaatgaacgtcttactctagttactaatgagactgaagtctttaagtgttatgcttgtgagagatggtccaatggtttcaggtaccagcaagggtataaatcattcgatgttcggtgcggttcaatttctgagccatttttccatccaagtcatcccgatcatcccttatattgcattttaccttacggaaaaatattctgcaatggttgttacaagttcaaatatggaatgctcgtgtgcgttgaatatgaatgtaatcatttaatatgcttcaattgcgctactctaccaccagtggtaaagcatagagttgacgatcatcctctctcactatgctatggtgaaaaggctagtggtatatgttggtgtgacatttgtgaagccaaagccgatccagagatatggttctacacgtgtaaagaccaacgtgctagtttacatacaagttgtgtgcttggagacttttcagggctcatgccgggaagcacactcaagagtgcgagcaattcatctgaggtgctgctcaacaatattgtatctcgtccattttgcagctttttagagctcatgccgggaagcacgctagagagtgcgggcaaatcagttgaggtggggctcaataaaagtacatctcgtccattttgcatctcgtgtaagttgcattgcatttttcctatcatcttgaaaagacttggaacctcagatgaatacttttgctctattctatgcatctgaaagcaagatgtctagggaatggggttctcttttagatttcttgtaccattataagttgatttccttaatgtattatttatctaagaatcttgcagttttagttcgatatgatctagctgtttcaaacgtgttatgcctttcgttttctattataaaacatcaccttagaaaatgaagaacacactactatcggtcttgtctgttcataaggtatatttaggttacattgtgcataaatgaagaaggatattgcttcataaaagctggagcagcaatctatctatataaaaggaagcaatatccttcttcattttattgtccatctagaagcaatatcctagaacaaacttcgattttggatgttcgttgattagctctgaccgttgactcggatcataagtttatgtagaccttaaggtttcggttttgagctgtgtttagtaaatccacggttgatcttacaaataacaatagatggtcaaattgtagatgttgtagtagtagtagccatttttctttaaaaacttttaaataacaaaactcattctcatcgtttaaaactaaaagacacaaatgaaaattattaatcaattttaaatttagttccaatacaatttttgaattttcggtaggcaaacataattttgttgagttgactccacattctaatttttttttttttttaagaaataacgtgaatttttcttgcgtgttaactcatcttaaaatcattgaaaagtaatactccaagttgaccttaatatacttggcgtcaaaattggcttcattgtgcaagttgttcttttttttttttgtcaaagaattgtgcaagttgtgatcttaataagttgattaggactggcaacttctgtcttatttaagattcattatcataagtgtaaagtaatgaagaagttcacgatagctaggtattatacaagtttaattaatttcgtgtgtgctacttaaagtgctacgaagaaactttgacttttctaatatatatttctctatcttgaatccgattcaagcttgtgaaagtctctctgcaaatcttgttgctctgttgctacaacaatg

SEQ ID NO: 20790 - DNA, 3003 bp, Unknown; identical to SEQ ID NO: 20789
  misc_feature (1)..( 3003): 2750-1469P.txt file - cDNA_ID_1828945; gDNA_ID_2926161; Annot_ID_198794

SEQ ID NO: 20791 - DNA, 3003 bp, Unknown
  misc_feature (1)..( 3003): 2750-1469P.txt file - cDNA_ID_1828950; gDNA_ID_1620807; Annot_ID_50572
ccttgtaccctatgtaacatgtcttgttagtataaattttgggtcatgttgtgttgatgactctttagcgcatttcttattgacaaaaggtatggaattctctagagacgctggaatgatgatggagaataagcggaatgtctgctctctcggagaaagcagtatcaaacgccacaagtctgatctctctttcagttccaaggttttgcttatcctagctagttttcatggatttctcggtcgaaatagtcttcggtacaacaaattgcatggtaatgatccgtccatctttgttctcttaatggcaaacaggagaggaaggacaaggttggagaacgtatttcagctcttcaacaaatagtttccccttatggaaaggtaactttgttttttttggcaagcaaatcaaaagaatctgtctctcagctcatacttttctctaatgttcacagaccgacactgcatcagttcttctagacgcgatgcattacatagagtttcttcacgaacaagtgaaggtctgcagttcaataccaagcatgattcattcatctttatctgagttcccatgttcttttgtacaggtgctaagtgctccgtatctgcaaacggtacctgatgctacgcaggtgagtatgatcttgaatctcaacttcatttatacttagttcactagttctactctgcatctgacagatcttcacttggaacttgaataccttgcacggactgattttcccgtcttttgtaaccaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaacagctcatggttggcaatgattgttattattattcgactgcttaatgcatccccttactttggacttgtgtaatatgcccaaacaggaaccaaatgattttaatgcaaagtaatctttatcccaaaaaatgcctcagatatcttaagcttttctttgtgtgattcttacctacagcatccaatacattattctagatctaaagacccaaggcaagctttctttcagtgctgaaggtatgatcgtggatttccctaatacatatagctttctttcagtgcttgtaatagtgccaaactgctgaccacagaattaagattatcctttcataagaacattggattaaatacattaccactgagaattgcaaaggttcagaacatacagactgttgataccaagggaccaaatagcttggacaaagataagataagtcggtcataatgtgtttttaactactagattgcaatgctttggcatatgtaaatgtgacagggaggatcatcctcttcagctctacatgggataaaactaacttgctgcagtaggcttgaccttctctcgcatatactgcagtagatgttcgcgtttccagttgtcgattctgcaaaacaagcaaatcaagaaacaaagaggtcagctacaaccttggaggaatgaagttgtgttgctgatagaggatgaggtgttaaagacatcacttattcatgctcacaacgagaaaatcctttcaaaaaccaatttaaactagaggtctaagtaaatgatacagcagaatgtaacagagcaacgagagagtgagaatagaaactgctgcagatccatggatagttatatttttatctaccaagctaacatggatatatcaggtcaccttgaacgtcttaaatcaggtcaactcgttcccccacccaaactctaatactaaagattctagcaaggagttgagcaaagggggttataaagcaacttacctaattgattccttatgttcaccgtcttcgtcgagcatgatcaacttgggtggtgagttgaaaatgtactgaactttgacgctagggaacttttctttctcttcttcaatgaaaccaacaatttcaggatagaaaaccaacttcctcatacacacctctaatatagcgccagaataggtaacctgcaatggcaaaaaaatgtaaacttctcttcattcatatccatgttataggagatgtttctgtattcatctaatctattcccattaaaattcaaaagcactacaaattacatgcctagtgatcgtaccttgctcatggaatcctcagaatcatcagcacaacatttcaagcaatcagataccaactctgcaaacaagatcaatcaatataagataaccaatttagtaattccactcctcaaaaccaactttagagagaatgatctagctcataaaatacacaaaaactaaaatatagaatcttttgggggaaaaaaagcaaaactgcagtaattgagatcaaataaagcacgcatagaaaggcacgaaccttggtccttaacgtattcagagagtgagtggcaatcggagcagagtgcaagaccgctaaaccctagatcctcacattctttagtgctgagctgctcttttgctgagatcgtcgatgccaatatcaaaatcatcatcgctgataaaacaaccatcttcgccatctctctctgtttcatcaacagatcaaagtcttcgcagatccgacgctactctaactaatgtcgctgccttgctatgatccgatccggtcaattccggttttttaagtatccgaaaaagcaatcttggtatagaggaaaccatctccggttataaataaaaaagtcttaaccgacgtgaaaagtgttaaaaccccaattcacattagcctgttgcgatctaaaacctctaaaaccctagaatcaaaatcgcccattcgagatcgagagagacgatg

SEQ ID NO: 20792 - DNA, 3003 bp, Unknown
  misc_feature (1)..( 3003): 2750-1469P.txt file - cDNA_ID_1828953; gDNA_ID_1620807; Annot_ID_50570
ggattgaatgagtgtcttcaaagagaagagagtaacaagaactattgatgtcacaacgcaaagggtgtagaataagtcaaggggttggaaacagaaagatgttgaaaacttgggagtgtttatatatttaaatttttgaaaggctttttaaagtttgtgttgctaatgctatatctaaaagcccaaagtaataatgtaatggaatagaaaagaatccataataaataggaaaaaacaaagaaaaagtacctaatccggtagccacaaggaaaaaagaggacaagaagatggtgacaacaagacaaagaccgaagccgcgtaggaccccaaacgtaccttttaaataaaacgctgattcctttcggacttttgcgtcgcacggtctgtgccgctgtccccacaaatctctattttttacacacgcaatctctacctctgcgtctgcgtttcgaaacgtgactcttctaaccgctccacgtgagtgacttttagagcgagtttggtgtccgaaaccacgcgtgcgcgtctcctcaacgcctgagtctctctatgaagttgcattgacgtcagaaaaattaaatttgtcttacttgaaacataaaaatttacagtagtaaattatcattttcataacacttcatttattctcttgtagttaaacaacggatatactaatgaaatgaactcgttcaatctaattaaaatctcattattaatggtagacgctagagaatctcattattgtaggtgttaatttatgaaaataatacatcactttcaatcactgatttgattagattgatggattttatatacagcccatgtttttaacctctctagttgaaattttggttgattttaaagagaagagaacaaaaattcaaagacgaaaaaagcaaaaagtggaaagtagaaacaaaaagactgatggtgcagagagctggtcaaatatgttgacaaaataaaataaccttacaatgtcactatcatcaataaatgaaaaaatagttctctctatctatctataataataataataaaagcaacttctacctgggactgatattaactacgaagacctctcactctctcaatgggttgtataatagctgtcaaattatgatgtatttagtcacaagacaaaagactgattctgaacactaaagcctaattagggattagtctttactctttagtcatctgtttcatctttattattaaagtttgcaggagttgtagtagatggtgtgggggcaatatatgcagaacatgcatgcttccaaaatgtcctaactacgtcacttaaggttccatttttttctatctaaactaagaaatacttatgtatctattaatctacatctaattggttgtcaaaaaaaaatgtatcatagaagtctttggagcacataaataaaacatctggagattttctgaacataatgtgaggtcaagaatttgtgtgcaaaattacaattttcaggcatgagtggctctgattttgaccatttgaataaatttgtagcttgttataacctttacactcgtaaggaaaaaattatcaaaaaatattgatagtcgataaaattgaaaactctagatttatacaaatcaataaataaatttgaaaataattaaatgagaagtaaatgacattacttcacccaaaaagagtctagacgaaaaagacagacataaaaataagtccccttctatttgtttggagcataaacaaaaacagacacagtttcttctctctctctctctgtctctttccttttctcacgccgagatttctgcgactgctctaatcttacgaccttataagaaacgacgcttattttcactctgcttgagctcttcatcgtgtcacacagcacgatcttggacgtcgttttaagcgcaaaacaaaggaaaaagactgacgtttatacatactaaatactggtttggagttttgccttttggactcagaaaactcaaaagagagagagagacatttctgtatcttatcgggttttgtgttgtcagaaagaagctcaaggacaaaaaaaaaagcaattatttttagggttcaaacgaagcaaaatttggaactttcagaagttgtgggtggtggcttcttgaacaataaagctttttcttagactcttcttccaatttgtgactctacctatctctctctccgtaagctctttctctctctctttattcgttctttctttatttgctctgtttctttactccatttttggcttaattacaccaaatttagtctgctaaaagctaatttcaagcataattacttatctctcctcttcttgttgctaaccttcagttggattaggttttgatttcgtttatacgacaatccccgtgactgaaaaagttaccaactttgatagatatcgttaccagattctactcatagttttgttattgtaatgcaagaagttgagttcttgtttacattaacttcaataattcactgagagtgactttttgttctcctctgatccgtggaggattctctatatgtgttttgttttttgggggggttttctcctgtttttagggactctattgattcatgcatatatgatgttattctctgtttatgagtttatgcaaataatctaagcaaggtatgataacatatttaatctttttgtttgagcttataattgtgcttagaaatcttaaaataatgcttaagctgatgtgaacttgaggcctagcctctgaccacaaatcctagcctacttcgttgaccatacctttgtcttggcttaatattctaaatttctcttccaaatcctgtctcccaatgcattggttggtccaaaacaagatcatcatttcatagatcttgtaatctttctggtctgtaatttgctctaggatggtaaccttgtaccctatgtaacatgtcttgttagtataaattttgggtcatgttgtgttgatgactctttagcgcatttcttattgacaaaaggtatg

SEQ ID NO: 20793 - DNA, 3000 bp, Unknown; identical to SEQ ID NO: 5627
  misc_feature (1)..( 3000): 2750-1469P.txt file - cDNA_ID_1828988; gDNA_ID_1620807; Annot_ID_50560

SEQ ID NO: 20794 - DNA, 3000 bp, Unknown; identical to SEQ ID NO: 5627
  misc_feature (1)..( 3000): 2750-1469P.txt file - cDNA_ID_1828988; gDNA_ID_1620807; Annot_ID_168905

SEQ ID NO: 20795 - DNA, 3003 bp, Unknown
  misc_feature (1)..( 3003): 2750-1469P.txt file - cDNA_ID_1828996; gDNA_ID_1620807; Annot_ID_50558
gaagaggctcgacgactagtgacatcactagaagcgcgatcgtcatatgagtatacatcggactatccagcgcctgcaaatggtttttttagttggagaaattaaataaaattgaataacgctgaaattttactatttgaaaaaaaacaatgaaaattattgctgacaaaaacaaacatactttgttctatgagtaaaataatgtttagaagaataatgattccttgacaaaaaaaaagaaagaataatgattaatgaaatatttctctaatgttttcactcattcgtatgttattcaactttatacttccctagactcgaaaagtgtcatatgcaataaaagaacgttgattgattgattagtaccttagtatcgcgaccagcattaagaacgacgagcgataaagttcccttggtgttcataagggctcctatagcgaatgcgtcacgcataggtatatgcataaataaagaggtgattacggtagtcacgatctttactaagaaggaagagcagatgactacaaccatcatgaacttgtcagtaaactggagcatgaaaccaatatctgctcgcaacccacaaatgatgtagaagagaggcataaggatcccggaaaggaagtcatggagcttctcctcgatcatgttacgtatgatgtggtcgtgcggaatggagagaccgaacaggaacgccccggttatggagtggaccccgcatgcgtccgtaatcaggccgcataggaccacacctcctaaaatgaaccaaacgtgagtgtctccgacgtgacctgccttcacggtcttcgcgaagatccatgcaattcccggacggatcacaaagatgcagaggaggacgaagattgcggtggtgattatcacgaacggcatcattttgttccatgtccctttttaaccaccaacaaaaaaaaagaacaacgaaaaaaatcatcagaattcttgaattaccatgcatatttttgctatatttctttttcgaggaaaaaataggattcattccattttcggccagtggatatttattttaacggttgtaggtttttgggtatgagtttgagttttggcatggggtcccaaaaagtttgaactaattgtaggaatctttacctgatttgctaaaagaagcaaacccaaaaacaaggaggacccatgtgcacaaatcagtgacaatggctgcacacatagccgtacgacccatatcggaccgcaacagcttaagatccgcaaggatccttgcaaggtcagggaagttggtacaggctagcgcgacagaccagaagacgcaaccagagatgatcttgtctggatggccatttcccgggagatagtaaagaaaggcaccaaccggtaaagcaacaagaagccctgtaaaagcaatgatgaccggtttgagctcggtgatccgcaccatcctcaggtccatccctagaccaaggaggaagatgttgtagacgagagctaagttagcgaatgtctcaagaaccattgtgaatctgtaggggaatacatgtgcgattatgaaacgtgtgttcccgagcacacttgggctaaataataatccacactgcaaaaatacaatcacaacaaatcaagacacatacggaactagagagctaaaaaattgatgtagcaaaaattgcatacgtacgaggatctgagctacgaaaggaggaagatacaagggtcgggttagatagtagaggacacgatagctaaggttcgcgacaaagagttgcgttatgaagaacggaagggaagaggctagcgtacttccgctctcccatcccttttgttctctcttctcaaagagaagactttggtcataacacacaatctttccaaaacgcgattcttcaatatcatagttaggatttgtcacattaaggggggctccggaagacatctcctcctacgatggctggtcggaatccccaaaaaaaatgacaatactatctgcctgaacccaacgttaggttcagacgaaacattgggttcatatagactgcaataacaactaatttgcaacctcttccaagttttagttcagacgagatggctaattatagatgatgtattagttgtcattggggaattcattaaccactcgttttaaaatgggcttatcagatttatgtttttgctgttaggtgcttttttaaacggctggttgaaaatgatcacttgtttcaacatatttttgtccgatttctaattgtacggttacaaaatctgcgaataaattattttcaatcaaacttatagatgttttttttcttaacaaattatacaagtttttttctttctttttttttgtttggcagttcttaacaataataagatagtttagtctattattaatttattattaacataagacaataagattcctttttaataataattaaaatagacaagtagtagaatacaataaatatgcaacgagaatttttttattactataatgcaaaagtatcaaatcaatccagaatccagatcttctggaagcaaagtagttcacaagactttgtagagtaaagacagataagttttgaacagactgaagcaatttttagattcctcaagtcaatttctctccccaaacagcttccgtgaatgacaaattgctaaatctaagggtaatactctgttacagtttctctcttcgctttcagtttttcgtttttctgcaattccaattacttctaagctctctctgtccttccttactatggagatttgataaacaaccaatcagatttgctgacgaaccccatttatcatctagggtttgcttcagaatgcttttgaaacattaaagttcaacacttcagcacttgggatcttaatgctgtttcttgtttactctgatctaggagtgtagcttttaccatttacttgtgtctgtttttggtgctgttgtttgatctgtaatgcatacttcaattttcttttcttgtagattgatttcaagaacaagtcatg

SEQ ID NO: 20796 - DNA, 3000 bp, Unknown; identical to SEQ ID NO: 5625
  misc_feature (1)..( 3000): 2750-1469P.txt file - cDNA_ID_1829000; gDNA_ID_1620807; Annot_ID_50557

SEQ ID NO: 20797 - DNA, 3000 bp, Unknown; identical to SEQ ID NO: 5625
  misc_feature (1)..( 3000): 2750-1469P.txt file - cDNA_ID_1829000; gDNA_ID_1620807; Annot_ID_168903

SEQ ID NO: 20798 - DNA, 3000 bp, Unknown; identical to SEQ ID NO: 5624
  misc_feature (1)..( 3000): 2750-1469P.txt file - cDNA_ID_1829007; gDNA_ID_1620807; Annot_ID_50555

SEQ ID NO: 20799 - DNA, 2932 bp, Unknown; identical to SEQ ID NO: 14982
  misc_feature (1)..( 2932): 2750-1469P.txt file - cDNA_ID_1829007; gDNA_ID_2684237; Annot_ID_192471

SEQ ID NO: 20800 - DNA, 3000 bp, Unknown; identical to SEQ ID NO: 5638
  misc_feature (1)..( 3000): 2750-1469P.txt file - cDNA_ID_1829007; gDNA_ID_1620807; Annot_ID_168899

SEQ ID NO: 20801 - DNA, 3000 bp, Unknown; identical to SEQ ID NO: 5666
  misc_feature (1)..( 3000): 2750-1469P.txt file - cDNA_ID_1829019; gDNA_ID_1620809; Annot_ID_50580

SEQ ID NO: 20802 - DNA, 3000 bp, Unknown; identical to SEQ ID NO: 5666
  misc_feature (1)..( 3000): 2750-1469P.txt file - cDNA_ID_1829019; gDNA_ID_1620809; Annot_ID_168983

SEQ ID NO: 20803 - DNA, 3000 bp, Unknown; identical to SEQ ID NO: 5703
  misc_feature (1)..( 3000): 2750-1469P.txt file - cDNA_ID_1829038; gDNA_ID_1620811; Annot_ID_50609

SEQ ID NO: 20804 - DNA, 3000 bp, Unknown; identical to SEQ ID NO: 5692
  misc_feature (1)..( 3000): 2750-1469P.txt file - cDNA_ID_1829042; gDNA_ID_1620811; Annot_ID_50608

SEQ ID NO: 20805 - DNA, 3000 bp, Unknown; identical to SEQ ID NO: 5692
  misc_feature (1)..( 3000): 2750-1469P.txt file - cDNA_ID_1829042; gDNA_ID_1620811; Annot_ID_169076

SEQ ID NO: 20806 - DNA, 3003 bp, Unknown
  misc_feature (1)..( 3003): 2750-1469P.txt file - cDNA_ID_1829058; gDNA_ID_1620811; Annot_ID_50602
gagtaaattttatttttaatttaacatacatatatgagaaagacgtgagattgtatatactgcaaaaaataaattgaatccctttgtacatcatcaataggataacaagtatatgataataattttgtcgaaatgcttacccacatattaaatcgtcattgatatgaataatgttaattattggattttaatatacacttggaattcttattattagtagttaaaaatcccactagcacggatcttatttgttatacgcaaaatatagtaaaaaaagaagctacatatttagattcatgtaaaaataataaccacataagacaaatttatgtagtagaaaaggttgaaacaattttgtacaacttttaagaattgtcaatataaactaaagcttcatattagaaaaaattgtttttattttccaaaacaaaaccaaattttcattagaatatatgctgtaattagaaagtgtcattgtattcttgctttttctaattcagtcttcttatttttgcaggagttcactaacaatagtgatcacaaatcaaccaacatcaaaattacacttatcaaatagaacatgaatctaaaaaaagataagaatactaacaaaatcgaaataaatgagaactaaagctcctcacatccttcttctctgcacatgtcaagaatatgacgtatattggcggtggcgttgatacaccaatttgaaaccaaccctaaacttaaaaaaagtttaaacgagatgaacacctctctatttaggagctcgttaatatcttgcttagacgtcacatgagattgatggtacatgtcatggagtaaaataaaatcttctcttctctgtgtctctgatgaggtcatggagtatgggtagctttatgataaaataggaacttgtttcagagtatttagaagtaagttatttctattttctatcatgaaaacatttcccaattttgaatatcttttatatactctcatggctgtgtttatcaagatcatcaaaggcgttttctttttccccaccaaaggctccttcatcaccaccaaaggtaccatcaagatcaaatcaaattcaaatggtatcaatggctccttctttcacctcactactaatgactttttcttcttcaccaccaaaagcctctccttgcctctccttgccaccaaaagcctctcctcggctctcctcgccaccaaaagcctctccttggctctcctcaccaccaaagccgaatcgtttgctctacttaccactatcaccaataaagtcagttatgtgtttcaaaacaaacgaggaaggggaaataatagacttctttgatatatttattgaccatttggtctcaaagaatcatcacatccttacctgaagagagagcgtgaagtatggttattgggttgagttggctttagaagcactgtttgatattgaagttgagtttgagtctagtatggatgaagataagatgaaaagtaaaagttgatttttcaaaatgaaaagtgctccgtttggtaatatatatatcttggagaaagagatagtctatatggagcgtgaagaacttttagaaaacatttcttatttcaatcttgtggagcaaaacaagaagaatggtcttcctcctcctcaagaaagaacatggaagtcactagagcataaaggagtcattcttccattgccttaccaaaaacacaacgttccccttatctacgataaaaaactcttaagaatttccaatataaactaaaacttcatactaaaataagatttgttttttctttcaaacgtaataaagaacacaaatatgtcaaaaaaaaacaatcgtgatatgttgataagaaaatatcaaaactatggtaaattttaagattatttttatagtttatttttttttgataatttcataaattctcaacttcattttttcttttattttcttcgttttaaaataaattctcagattttatttagggctcaaaagatccaagtatgaggagtattatttacataagttatattaagcggtttagtacgaatttttcgtgccaaattgttcgccttaacatttgtataattcaaaataccgaattaaaccaaatgtttttctgattcgttaagatatttgtaccaaaaaaaagaaataaccattttatttaataatcactaaaaaaacataagcttaaacttattattataaaaaatctttaattaaaaacctaatctactataaataggaaaattcaatttttcttgaccaaaagaaagtataaaaatacataaaatggcaagaaatctcatatgttttaatcccgaaagtataggtgataggatgataccctaattttgactgtaagaaattaggggaaatccattttgttaccaaaatctcttatcatgtttcaattactttaaatgcatgaatacatgccaaagattttgttattaacaacacaaacacttgattatatatctccttggtataatatacagaacagacacaatcttaggctcctccttctctcgctctcttccctctgttgctcggaaagctttggcctttttggttttcttatggctaattctcttctcaaaactattcgtatctgagagagattgagataataaatatagagagagatccaaaccagaagcaatctttttttgtttgtctctctgtgaagattcgtatcatttttctccggcaaactaacggcggcgatccactcttctctatagcttctattatgttggttttatcttcttctttggaagaaatgaacaagtttggttttttcgctttcatgaatgtgatccggtctatataaggtttgtatatataatcaaaatctagtttttgatttttgtttcgattttttggcgatagatctggtttgtgtttgttgtttaagagagagggaagtttttgaatttgtgattttaaacttggcttgttttcagggtacttagagtttggtgaagcttgaatctaagagatg

SEQ ID NO: 20807 - DNA, 3003 bp, Unknown
  misc_feature (1)..( 3003): 2750-1469P.txt file - cDNA_ID_1829062; gDNA_ID_1620811; Annot_ID_50601
taccggggatgaagaaagaagaggttaaagtagagattgaggatgatagtgtgcttaagatcagcggagagagacacgttgagaaagaggagaagcaggacacgtggcatcgtgtagagagatcgagtgggggattctcgaggaagtttaggttaccggagaatgtgaagatggatcaagttaaagcttcaatggagaatggtgttttgactgtgactgtgcctaaagtggagactaataagaagaaggctcaagttaagtctattgatatctctggctaagccaatttagcttgatttgagttctctctgggtcttgactttgtgtgtgtgtgtctctgatgattatggttcttcgtttgattgtagttttaaactaataatcaatggaagctagtaacttgtgtgacaagtaaatgtatggtggagaaatgtgtgtatttggattataatagaaatacctattttcatctagaagctcaggatctagttattgataattagagctcgaaactgagatggatcttattgtttggatagttgttttaactattcaggatcttattgtttggatagttgtttaactatttataactagagatcgaaattgagatggatcatgaatttcattgaaaattaaggctaaactgtttggctagttgtttaactcttaagcatgtatctggagatatctttattcattgtttgattttgacattgtggttcatcttgtttgatggagactctttgtaggaaatcgctttggccaacaccaatgtgaactagtctggccaatttagttaattgattgatcatcatattgtttttggcatttttcagaacgtgtaataacagtgaaggaattttgaggtacctgctcaactgaatcagattcaggagggttttaggagaggtaatatggaagtagcaatgcttaagaaagataaagctagagctcttgatgatctgctgaaaatcgactaaggaagccaatgacaaactcagacaggaaaaaactgtaagaagaagaagaaaataagagaaaagcaacaaagctatggaaagcttaactttggatttgcaagttaagtatttttaaagcaagggaagcattggagaagatcttgttgatatgtcaaccatagcttgaacattgtggagcccaaatgaaaaggtataagttggctgcaaaagatacaaatgaaaactgtggaaaaattcttgaagactgagataagtacacactcaaaatgagtttttcaattctaagactatgtgggaacagcgagaacttcagttgtgtggaaaattgggaacttggcaaagtgaatttgtctgaccttcaggaaaatgagaagaagaagaagcatgtatgaaaaatacacttaaggaacttgaggagaagagtgaggatttgtaggaaagagttggagaagcggagactggaagcatgaaagtcgaggcaaagaaggttgctttagaaaacagaaagctcagagcaatgaaggttttttctcttgaaaaactcgataacttgtcaaaggtatatgaaagcttggtggatacaagtgaagcgtttttaaagcaaggcaaggattggagaaggtcttgttgatatgtcaaccatagcttgaacattgtggagcccaaattaaaagttataagttggctgcaaaatatacaagtgaaaagtaaggaaaaattcttgaagactgagataagtaaacacccaaaatgagtttgtccattctaagactgtgtagagacagcgagaacttcatttgcgcggaaaagtcgggaacttggcaaggtaaatgagaataaactgaaggaacttgaggagaagaatgaggatctgtaggaaagagttagagaagcagaaactggaagcatgaaatttaaaggaagcttgttggtcaacgaagtcaagccaaagaacattgctttagaaaactcagagcaatgtaggtttgttctcttgaaaaaatcgatgagtcgtcctcaaaggtaaatgaaaacttggagtataaactgcagactgaagaagaccgagagcttaattgacaaagaaaccaacctatagagcattactaaagaagctgagaagagctcaggaaaatgaaatttgctggctgaaggaatgaattagacattggttaatacacaaaatgcagagcactaatcaaagattagttgagaaaatagccaaacgcagagtttaagaggaagtcaatggagtcttcttatcataacaacattgaggagttgtcactaaaacttcttattccgggtatttaaatggcttcttcctccgcaacttctcactttccagaacacaaagacttataaacaaaccatccttcacgtatgtgttgaattgaaatgtgaatgtgacttcatcaacacaatgacttcaaaacccaacgacggtcttcctttcttttctcaccaataaaatgtagaaaagaaacaaagtacacaagaaagacttttcatttaacgatatctccactagtagtagctataactaaatggggtcatcgttattgactttgaataagaaatgttcaaacacttcaattattacataatatctttgcaataaaataacaaacgttaaagagccgtcgcattattagcacaaaaaatatcttttgtaaataaaaaaacaacgtaaaagagccgtcacatttgaataataaaacccatcttgcacataaaaaacacgactttttattatttttgattatttcaacaaagtatgaatagtcaacataaagaaaagtccgccttgatgttccttcctcactccctatttatccattttctaatcccaccctcttctcttcattcatcatcttcctcctctctctcttctctgtatcacccaactaaatcctcacgggattagatccaaagtctcaaactttgatccaaaaacacaaactttgttcaaaagacataaactttgagccaaagtcacaagctttcttggtgaacgatg

SEQ ID NO: 20808 - DNA, 3003 bp, Unknown
  misc_feature (1)..( 3003): 2750-1469P.txt file - cDNA_ID_1829073; gDNA_ID_1620811; Annot_ID_50596
aaaagatggctcctcgtcagaagaaacctaacaagtctgatgatgatgatgatttgcgtaggaagaaacagagctttttcaaacagagatttccaggctttaagaagaaagcctctgagctctctgttctctgcggcaactctgtcggtttcatctgttacggtcccgacagcgatcttcatgtttggcctcagtctcaagatcataacccacaagccctacatgagatcgttgccaagttcaatgccttgagtgatgagaggaggaagaatcatgcatgtgatctcaatgacttccctcatcatctcaagggtttgtctcgtgaggagttaaggaagcatctccttcaccttgactctcaattacttggagtcagggaacaaaagatagaaattcttaagaagacgctcacgggttcttccgaaaaagatggtgctagggtttcagagaactcggccatctccgatcacaagttgaagatagagcctcatttgaaggatatattgtcggaagatcatctaattagggtttcagataagaagctgggttcgtgtgatgtatttgacgagttggcttacgtggtccgcgggtcaaggaatttgaacgagaatgtttccaagtacgaatcaaaagatgcagataacacgggactggatcatcttgtaactttaggcggtgattatcttcaggaggcggcagcagaactttaccaaacttacaatctagggaatttttgtgatgatcatgtttgggatctggagtttgcctcaagactaccactacttcatacttttagcgatcctctcatgaccaccaatacttgccaaacgatgagcaccgatatgatttcaatttgataacttgatgactacgttagtgaaacatgtttctttcaccttttctcggtgattgatcattttttagtatctaaacttgtatgtttgctccaacacaaatctatttttgtaaagttttggtagtgttttcttgtttattattgattaatcaaacttttcctttctttctgttacttaaatgctgggcttgatagtagtataagaaatttgtccacaaagcacaccgcaaagttccaaaagctaaaacccttgtaccttggagtctctgcatgtgagaaaggaatatgagagttaaaaagagttttttcgtaagacaccaaatcatctacaatgacgatgagcgcaactttctatcagtgagcttgcaagctagcgttcttgacttcagaaatgtgattatgattaatagttgagttaatcttccttaccaactttaaagaaagaaaacaatcactatgtcatacattcttcaggggttaaacatgtcggatatgaaagtaaccaaaagaatcctcattgagataagcaagtaataccttccaacctgcgaaattgttcttgtctggtgattctaaacagaaagaatcttattcttgttttagctcttttgttctagactagacactagtgaaagtgaaatttcaagaaaggttacaggatcataccttttgtttggtggaaacagaggattctgaaattcctggctgtggtcacatacatacatcaatcacatatttactagtttctaatgagaaagttcagcttggattcagttcatcttctctcatctttaaggtccgaactatgtccaaactttggcaatatatttcaacaaagactctaacattcttatatgtgagtatgtgacgttgtatctcagtaacttgctcatccaactctctgcgaatattcagattcttgattcaggagctcccaaaacttcggaattccaaatgacgtacacaattgcctaaaacacaagtctcctgcttaaccatgaatagttgagtgaatcaaaatctcactgaacaacgttgtacaagaaatcaaagttcacgatcaaacttacaagcatatccatgaagataaatgagcgaaaactaattacttggcgtatatatcagttttgacgtttggagctgggaagaaaaatgaaactgcaaatcaaataatgtcaccacattaaattatttctgatcgtgtcattattcaactgatagctgttattatttctggtcaacctcttatttgttgtctcttagtaaaagttttcttctagattgaacaatgttttaaaattttgacaagaagaaaaattaattgtttaccgatttaaagacaagaaagatctaagttagtgtatatttaattaatgcagctttagttttttttgttatttggtattttgtcaacaattttttttttataatataatgttcattccacgatcttcggaattgtgcacatccgtcgttcaccaacataattcaaaggaaccagccaattaaacttagaaaaatattgatgcccatgtcacaacaacgaagaccgttgaaacgacggtgttttacacagccaacgaacaagtccagcatggcggtttttgagaaccaataagaaattaaatgtattgtttactctctagagtaaatttattaatttttaaagaattcataatattccataaattaataagtttactagcaacaaaaaggtctgaagtctgtatctgacgatcacgcggcctaattgcgcgtggcaatttcttcaacgcggattttttttttcctgccatttcttgcatcaacgcggattaaaaaaaaaaaaaaaagtgttttcggtaataacccgaaagagaaaatacgtatcggaaaaaatgcaaaattttcaaaaacatttaattttaattttaatttcaagccaaattcgggagcgactttccaaagacgaacaaagccattgaaacggaagagaaggctgctcctttggtcctctctgtttctaccgtcgattcagatctctgcctctcgcaatcgaatcaatttgtgtaacgaatcgacgcgaattatagtggtgaagaagtcgacaattcgattgttgtgtaagttgacgagaggattggatcggtgtgaattcctcctaaatg

SEQ ID NO: 20809 - DNA, 3000 bp, Unknown; identical to SEQ ID NO: 5697
  misc_feature (1)..( 3000): 2750-1469P.txt file - cDNA_ID_1829085; gDNA_ID_1620811; Annot_ID_50592

SEQ ID NO: 20810 - DNA, 3000 bp, Unknown; identical to SEQ ID NO: 5696
  misc_feature (1)..( 3000): 2750-1469P.txt file - cDNA_ID_1829093; gDNA_ID_1620811; Annot_ID_50590

SEQ ID NO: 20811 - DNA, 3000 bp, Unknown; identical to SEQ ID NO: 5686
  misc_feature (1)..( 3000): 2750-1469P.txt file - cDNA_ID_1829093; gDNA_ID_1620811; Annot_ID_169046

SEQ ID NO: 20812 - DNA, 3003 bp, Unknown
  misc_feature (1)..( 3003): 2750-1469P.txt file - cDNA_ID_1829097; gDNA_ID_1620811; Annot_ID_50589
ctatatattattttgaagattttcactcaatgcaaagatgaacctcaaaattacttttatcaatgacacatttttaaagagaaaatatataaagatatgaaagtagtcactagggactatgtaatcaattgtgctatttactgtttaaacacactaaaatatatagttttaatgtaattaagtaatcctacaactttcatgtgaaaattcctagtcaaatatttcacgtagtgagttatttaaagtaaaacagaataataggtatgcttatacgggtcgagttgctttattatgaatatgattatatgaatcaaaggatatgaatttatatttatcaagttaccacgttacgaccaaatttgggttatgggtttcaaatcttgaacggttcatggtattccgccgcttttgtcctatcaagtatggacacatttttcaaaagtacgctggtgccgaagtagtttgttgtggccttggttaactgtaccattaatgcgtgtttataaactacatgctaactctaataacttctcatacattcacatcaaaggacgatgagcctcatatacatacatagtgatcagagccatcctctaagcaaaaagactatcctttttaaaaaagagaatcatattaagggcaaaaattaactttcaaaaataattggccaagaagcgatgactaatgtttttgccaaaaataaaacaaaatctcaaatctcaaagcctgtttcatatctcttttaagaagagagaaagaaacttaggattccagaactaaacgtcgaaagttcttagatatcttatttcaaagggttctcctctgtcagaaattctagaataacagattatttcatcttaggtggactgtcatttcttctaactaggctagtagcaaatcattatgcccaatttaaagctaactcgctctccatctccattcgattagattagtagttaactttaaaccaccaaaaaattttatacatttatttgttagagaatatttggaagaattgggtggtctcgctttgtgccgctttcttagctcaaggatttttggattctatctacatgaacttcgttatcaattttgatgcttgatatttttgcctagagtgtttcagtttttttgtttttcttttctttttctagcagaattgtcacatgttatattcatattttgagtattttctaagaaacaattaggatgctacatagacatatttttgaaaagaattaagaaaaagtaataggttttggaattttgcaaaacaagcgagaagatgctacacttgattgttttcaacaaaaataccctcagaaataatggatgagattcacatgatagcactaaatcgctacaaaatctcttcactagtgtctcctccatagtcaaatccgagctccagataaaaacattacagattcatatgacaatattaattttgtcactcatatgaatttggttaaatatataatctaatttgaaaatacaaaaatcatgattcatgatgcacctttcaattcacataatgttgaaatacagaaaaaataattactctctcatttctttataatataagttttagaaagaaaccaaaaattgtctcataaagataaatgtagatttttttttaattttatctcctattaactagggttgaattaataaaacaactaatgaatatttattaaacacgaatatatttgtagtagtaaaaaaattcttaatatgtatgcaaagtctaaaaacatacaagttcactaatctctactaaattaacagctaaacccaataaatccgttaattatggctagtttagtgaatttttctcaaagaaaagctcttttttcaaagttaaggagactagagagcaagtcatttgcttgtggttggaaacaaaaacccaaagcgacgacacaattaaaaaaaaatataaagaggagaggagaaaaagaggcaagccatagccaaagggttcgtgtcggcttcaaccaaacactgacggtgtgtgtatacacctttacatacacacctttatctctctctctctcacatctttgttacaaatcaatcttctactgttttctttttcctcttcttacattattttttgacagcaattcttagtttctcttctatcccctttctgggttttgtttgaaccctagctcgctttggatccagtggttttaagttaaaggttcgatttttatttctgggttttgcttgttttgcttggttctgcttagtaaatgttggaaaaggaggagactttagaggatctgtagtcagatttgagctgggtttgtcgattttactaggattttgattttggggataatctagatcaggaatcgttactttgtttcatatccaaaattcaactctttttctcgttcctgatctaaaaatcgttccttttcaagctttctaaatgaggtttctctttggtggttctgaaattttgtctgtagctgttgtgttcttctcttagatttgattctgtatgataattttaggttctgagtttgaagtcttgtcattgtagagatggttttagtaacagttttggtgttgctttgtgtgaagttattaaggactaaaatctgttcatttttggtatgttattgagcaggttcttgtcttgcttttgctttatttgttctttctttttacctctttgtttgagtgattattggattttctcttcaaattgggtaataaaattttgagaatctgagtcttgtgatgtgctttagacacaatgtagaacaaagcagttacataaatggcccacatttttgtcagtaaatttatgaatggggttttaaatgtttctacataataacatctatcagagttttgtttgtctaaattagaggaggataggtccatcttcttcttttctctttcagaataacatttcaatcttatagttttctcttcttttgttttgttgcccaggtaaatttatcgaaagtaagtagattcctaatg

SEQ ID NO: 20813 - DNA, 3003 bp, Unknown; identical to SEQ ID NO: 20812
  misc_feature (1)..( 3003): 2750-1469P.txt file - cDNA_ID_1829097; gDNA_ID_1620811; Annot_ID_169045

SEQ ID NO: 20814 - DNA, 3003 bp, Unknown
  misc_feature (1)..( 3003): 2750-1469P.txt file - cDNA_ID_1829116; gDNA_ID_1620813; Annot_ID_50629
gtatgaggcaagagtcttcctgctacccaatagtttctaccaaactggagtctaggaatttcgagaacgacgttatcactctcacatgggatatattctatggagagaatatcaagacgagctgcacgcacttcaatgctatcaatttggttgcatgacatggacaagatccttaacgttttatgatcaatcttcaaatgaccactggggttgaagaaaatgatttgtaggataagaacctcgagggaggggcaagacgagatgacttcgttgaaaacatcaacctcagcaaagatttgaaacaggtcaaggtacttgagatttttacaattgttaaaagcttgtgcatcttgtaatatgtattgatatagcgagagtgttcttaggcttggatggttgaatgtctctgtggacagcttgagcacattgtcttcacctgttggtgcgaagcgaccattaaaatttgcaaggataagatttttggtgtgtttcatactagtcagtgattggatccaagaagcaagcatcccgtcttccaattggtatgaataatgggatattatgcaagtctctaaatggccattgtgcttgtttataacctgaaaaatgcaaaaatgattaagatttaaataaggacaaacaattatgaagagtctatgttttcaatttatacgtgtttctctttatatcgtatatatatgttgaattttatagaaaaattgttaatatgtaattttatgtatgtgtgtatttattaatctatgtagaaaaaggcatgagatcatacttctctagattattgatcataaatttgtttaacataagataacgtttcgggcgaaataccgttatttgttttaaatgtaacaatgtttcaaaaaaataccgttatttatttccctctaaataccgttaaataccgttatttgctatttattttattttttaaaaaaaacataaatttgatacatatacatgtctatgatttcacatttatatgtatgaaatttcttataagtcctcaaaggcaatataacaattttcatcttttaatccaaaattccttttatcaataactgatttaaacttgtaagattgaatattgagagaaaaatgaaaagaacctcggttataattgacaaaaaaaaaaaaaaaaaactcggttatctgattagcggcacgatctaataattgtggcaggacaatcccgttgatggtgatggtctttcgcatgtcaaagcaaagatttgacacttgtttccatgtatccccccattgtttggacaaaacacatgtctttatcgcttcttctgtggacaattctgataagattttggacaacatatcgtcaggaagttgattaacattatcgattgcatcgatactgattcttttgttcgatgatatagaggatgcattttgtaagagagacatgaatgaagaaaagagagtttgactcaaaaactaaggaaatggaagtatagcttatttgattttattgttgcaaagaggcacatcgtagagtatatatacacaaaaggcaattcaggttaattaattaccttcccgtttttcaattggagaattttgattattattttttgtctacatttcaaaatgagaaagaaaataatcatttaatacgtggaattatagtttagtaatacatggcatgaaaataattttatcaaattttatttcggcatcaaaatttgtgtgttttttttttttttttttgaaattaaacttattgttatgatgcatttattgagacattatttgatcgatagtagcaattttaggagagtgtctgttgtatatatatatgaactatgaagattgaaggctatttgatgtactgtatatatgtaatacttgggacatagctaaatatgcatattgtgtcaatttcttttacttatctagcgttttctgtcaaattcattttcagtttgtagattggtaaaagtgaactgagaaatacaaaatgtctttaatgaaattaggtgtttactatctagtttctaaacttttggtaattcagtagagcggcacaatttgcagtttcctacgaagagatgattatcttgacttttataattagcatcagatatccgatcgccaactaatccctacaagtaaatcagtccaaatagttaagtggtccgcacagaacaagtttgtttgcagtggaaactgaaacatcaaatatgtgcgagtttacatcctaacctaggttctttagtgaaattgatcctctcacaacttacaagtccaaacaaaatatcttcatcacttgagttgagtccatctatcgttactgttttcagacaaatccaatggtccccatatcagcggctgctctcatctccttcgacaagtccacattatatcttatatcgatctatgctattttattatacaaaattagaaacatttagtaagacatcgacacatcggtaattatgtttcatcttatcatatttatcgggaaaaaaaaatgattttctctattaaaaaaaaaaattatccttttttaccattatgtagttgaatttaggttgcttcttaattttttttaaaactgttcaatatttactcacacaattaatattgtgcctttttaaaaatggaagtcctaatttttgttaggctatcaattttgctgactaattaatatattatccataagaaattaacttttatttaggcaaatatctctgctaaacttggcaaacatttatcaaaatctacatttaatacctcaaaggatttcataattgtcttgccaactgaacccaattattagaggtcaaacttgtactactaactttaacaagtcaaagatattaataacttgtactctattcttatcatctcattgcccaaaaaaacaactataaatacttacacaaaacattaccaattcggatctacgattttcaattaactctcttcttttttttttttttttggtttttcatttaagtctattcaatcatg

SEQ ID NO: 20815 - DNA, 3003 bp, Unknown; identical to SEQ ID NO: 20814
  misc_feature (1)..( 3003): 2750-1469P.txt file - cDNA_ID_1829116; gDNA_ID_2684091; Annot_ID_189939

SEQ ID NO: 20816 - DNA, 3003 bp, Unknown; identical to SEQ ID NO: 20814
  misc_feature (1)..( 3003): 2750-1469P.txt file - cDNA_ID_1829116; gDNA_ID_1620813; Annot_ID_169154

SEQ ID NO: 20817 - DNA, 3000 bp, Unknown
  misc_feature (1)..( 3000): 2750-1469P.txt file - cDNA_ID_1829128; gDNA_ID_1620813; Annot_ID_50626
tttcgacatcttctcttaatctctttcatagataggtgaaggggcaacatgtgttgataagtgtgggggcaatgtttagatgatttaagcgaaaacaaagaaaatgaagcaaaaaaaagtggcacgaggttcaagattagttggaagaactagattgatgggaaacaactttcattgttgtagatgagcaaaaatgtcacgatccaaggcatcttactcgtcagtttacacgcatattctcgtccttcatcaggaccttctctgagtatacgcaagcatatgtaattcagtgcggtgcagaacataaagctcttgccttcaacatgtaacccccatccaccatcatcgttctgcaaattaagggagaaaaacagaactcatgtgaggatcttctctggtcaagcttcttctttaaaatctgctgcaagaatacaaggtgacgatagatatatcgaagaatctcttcacgatgctcagcatcaaatatctcctcgagatgtcctatgaatctgtgatatacagaaaaaaaatacatgcaggaaaattctctccgtttcattgattcctcttcattatcccttcaatttcttataatttctcgcgcaatagaaacctaaatctctaattctaaccctaagagtattcgccgatagacgtaaagtaagaatcgaaaggaaaacgaagaagaaacataccaatggaggaaggaagaagagaggtccagtgatttctccaggccagtgaccatcggaggcctgcaaagtcgagaagaaagaaactcctctccgtaacgcatccgtcgcgtttcatgagttgtgctttcgccgtcttcaaccttcaccggcgggatcacttgctccacttttgcctccaattcaaaaactgtgcctacagtcaaatcaactgagatcaaaataaaaacattcttcgcgttgaaaaggaaaaaaagaagaaaaaaagaaaaaaagggaaaggaataaaaacatggtgtgagtaattgcacatggcccattaacttttacggcccgaaattaaaaagcttcatttgaataattgttttttctttacattacgaagaattccttaaaattattaaataatacattttttttttttccccttaaaaattaaaatgatacattattaccctaaaagatgccaatcaaaaaataaagagagcttttcgttcatgtaccaatcaaaggtggtgtcaaataattgatgatagttgccgacaaaaataaaaaaataattgatgatagtcaaagacattactgtttatgaagaaggcttttctaaaaagctttttaattattgctgaaataaaaatttaatctcaactattaaaaaaatgcgtcttttacgagtgctaatttatatttaaacaccgaaaattttcaaaaaatctatttgaatttttgatatagtacatagttataagttaatataaatattagtcaatgctaatgattactgagtcatatgactcatgaatattaacgtgacatattttttaactaaatcgatgccgtttagttattttgaatttaattttcttttttaaaattagcaaaaattgaattcaaaatagcaaaataacgttggtttagttgaagaatataccacgtcaatacacatgtatcatttgactcaacaatcgttagaattgactaacatttgttaacgttaactcataattacgcaatacgtcaacagtttaggtaggttttttgaaaattttacatgtttaggtataaatcaacatttctcgtttataccgattgaaaaacacattctctaaatagtcgagattgaaaaaaatattttcccccattttctataatgctataatttattctaaacagtagacaaactcgtctttgatgcataccaataatataaaatatcgaggagacacattagtggatccttcaaggacgagttggtcgatttgagataaggaagacaatatttattgaccctctttggctttcaattttgtttgctaatggttagggtttattattatttttggtttaatatgatgcaagtttaaataggtaactcggtttggtttattttatttcgttggtttcgactatcacatcgatctataatgtcaaatttacaatcaaattcttttaaaacttttttttttttataacttattttagttttataaggaatatacggatttctcaaacaaacaagaaaaggtgttatttgaacacttggaaagaattcaaattttttttatagtagttttcccgttaaaagttcacataaaaatatatcatcaatgtaagacgatattcagggaaattgaagatattgggtgcctgacatgtgacaatatatgacagcttctgtcggtcctgtttcttgtttgtcacatgcgattgcttggggattgtgatttataaccacacaacttatggtactttgatatatgtaaatggcgacgatgattttttttctgttgatgattgacgtattattgtgaatcttgttttcttttatatgtttcgtctatctcttacaaaatttgttgatttccaacttttcatcattttagtttttgacaattatatatgtgtaagaggattggtgaatcatcagtgattttcttacttttcatatgctttccaactcttcatcatcataaatttttaatattcacactccctagactggtcacagccaaaagatctcaaaaatctgacccggacaagtatactaataaaaggaaaaaatattgggagatatagtgtcatgcatggtgtgcaagagaaaaaactattaattaatgtagcttattaatctagaacttgctatatactagaacaattaaaacgtgactgaaaatttagtacttaatctctacaacactataacatccacatatattaatttcttcaattaaccttgataagagttaaaaaagtaaaaaacatcgagaagagttgtagctgtggtcaacacttgagaggcagcacgatg

SEQ ID NO: 20818 - DNA, 3000 bp, Unknown
  misc_feature (1)..( 3000): 2750-1469P.txt file - cDNA_ID_1829132; gDNA_ID_1620813; Annot_ID_50625
gttgtttcgaacaaacatttttggttccaaaaccgtggtttcgacagatccggatgtgatccaccagattttccggcaagagaacacgtcttttgagctaggctatccagacatatttgtgaaagtatttggaaaagataatttgttcttgaaggaagtgttcatccacaagtacctccaaaaaatcactatgcaaattcttggctccgagggtttgaagcaaacaatgttaggaaacatggacaaagcaacccgcgaccatattaggtccattgctagccaggggagcttcaatgttcgtaaagaagttgaaaacgtaagtttacacatcttcatttttgtctttaccaatttcagctcgtaccaagaaaatcttccttaatattgcagttggtagtagcgtacatgacaccaaagctgataagtaaccttaaaccagagacgcaatcaaagcttatagataatctcaacgccttcaatcttgattggtttaagtccttcttaagactctctacttggaaagctgtcaccaaagccctcaaggtgacttaaaacatttcctttttagttttttggaactttttatatttagtaataataagtagcacatgttttctcaactaattgcttgttgtattcagtcacgcgaagaagctatccaggtgatgaaagacgttctcatgatgagaaaagagacgcgagagaagcaagaagacttccttaacacgcttctagaagaactggagaaagacggtagctttttcgaccaaggatcggctataaatctcatcttccttctggcgtttgccttgagagaaggtacctctagttgtactgctttggccgtgaagttcatatccaaagacccgaaagtgcttgcagagctcaaggtaatatataaagaaacatgtatatatggctatcgtctttaagaacaagtgtggatggatttgatagagtcatatatattgtggcacagcgtgagcataaggcaattgtagacaacagaaaagataaggaagctggagttagctgggaagaatatagacacaacatgactttcaccaacatggtagattaaatacccccatctatatatatacatatttgtatgagatatttacaagtggaagatatgacattaatctataggttagcaatgaggtgcttcgcctagcaaacacgacccctttgttgtttcgaaaggcggtgcaagatgttgagatcaaaggcaagtactacttggaagttatacatgtatgtataaaaatattctctgaatcactagaagaaactttaatcctgggcaggatatacaattccggctggttggattgtggcggttgcaccttcagcggttcattttgatcctgcaatctatgagaacccatttgagtttaatccatggagatgggaggtcttagtgatacacttactataattttcagctgctctattttttctctttctccatcatcctttgtaaacctatagatgggatttggttggttgtggcaggggaaagaaatgatttggggatctaaaacgttcatggcgtttggatatggagttagactttgtgtaggtgcagagttttcacggcttcaaatggcaatcttcctccatcatcttgtggcatattacgatttctcaatggtccaagactccgagatcattcgttcaccattccatcaatacaccaaggatctgcttataaacatctctcagtctcctaccaagtgaaccatgcatgcagtttccaaatcttaataatcagatcattatatgcaataatctcatttcctgcttccgcaaaatctctggagtctttttatatgtaatatgcgatctctataatttttaaaaagtatctatcttgtcaaatgagttaaactttgtttatatatgtcttgaatctgatcacatgcatgggttcctaattctatgtactctttgcggctgtttctgtactgatgacttaaaagtcactccaatgattcatatttttttttgtactaattgctccgttagttctatactcccaactacatcacgtacatagatgaaggaatttaatctgaaataataataaatgaataaataaataaatattgtgaaataagtcgaaaaatatggatgaagaagccatatcaattggtaatttatacttttgctgtcaaaaataaaataaaactggtaatattttttttccgctaaatttatgagttattgcaaatcgcattaatggactaatttatggtcaagtgcgcacatatacccaaacgttttgaaaacaataaaaacattactccatatagatttacgtttggacatagggatttgatggatttagtcactatttattactttatttgatggatttagtcactatttattactttatttgatggatttaaataacttttattattattatatatgactttttttaggaaagagaatatttaatttattataaattttgttagatgttaattttaaaatttaatgaaaataagtagaaaaatagacaaaaattatgtctagcttaatgttatgcctttccgatatgatgaaaacaaagtatgtcccatagatatttgtttaagatttttttttttttaatcataataccataatgaaatctaatgaaagtttgagagaaaaggcacatgtcacaaagaaaaggcacttctattagtttaattgaattttattttatttattatataagatttaatgttatctctttcaaaaaaagaatgatagaagcaaaaatgtatctccttgatagtttcaagatatttttttaatatataataaaatttaatagaagtttgagaggaaagacacatattagaagagggatgctaggtgtcatctttctcagtgtgagcttgcgttcagaaaccttacacaatatgatggcattatttatacgtgctccaatgttttacatgcatgttcttgttgactttctaaaaggtttgatacaaaatg

SEQ ID NO: 20819 - DNA, 3003 bp, Unknown
  misc_feature (1)..( 3003): 2750-1469P.txt file - cDNA_ID_1829148; gDNA_ID_1620813; Annot_ID_50621
aaatgattattgacgatttttaataaagtcaatgaagttaaaaacaaaattaggtaagtaaaacaagggacggttggctacagtgcgtttacgtttgcgattgtggtatacgtgttaggtaccatgtgtggctctcaacttctcaaacctttcatttacgatctagggtcattttcgtcattagatagcaatcgaatttgtatttgtaatgatattcttactatattttaataatagtcttttaatatgggatatgtaatcatttattgcacttgcccatatgcttaattagagatcaccgacacattccattattgtcacttgtgatcttgtgagagtgaatgattaactaaaatatttgtaattgatttgattttcctaatttctttgatcattaacatctaaagacgccttggatgatttgtgtgaaaaatagtttaacgggggtagagtagagaaacaaatttaattcagggaccattttagcaaacaacgtgtttaattgacaaaaggcacgtgagaccacgtgagtacttgttttggtttcttcttcatcggtccgatcagagagagagaatcgccggtgagaaaagaaaatggcgtcggcgatttctctttctctcttaaacggagcaacgcctttgaaatcgaattcgctccacaaatctagactcactccacttcatcttcgaactatctcttgttctagactatcttactctccctcgagtcgcgaaatttctctcaaaactcaatctactgttcctatttcgtgtaggcgtagtaggtttgacttcgttcctcgttgcggcatttcgtcgaacgatttgcctactgagaaaaagaagagctttggggagtgggttgagtttgtgggagaggcggtttcgacggcgtttccgatatgggtttctctgggatgcttgttgggactgatgagaccaagtactttcaattgggttactccaaattggaccattgtaggtcttacgatcactatgcttggaatgggaatgactttgacccttgatgatcttcgtggcgctttatcgatgcccaaggagctcttcgctggctttctgttgcagtattcggttggtttgcttctcaatgctctatctttagtgttcgattgttacgaattatgcacaagttagaagagaaatcgagaaagatgagatcttgaaggaaccggtatagatgatctgataataggtttgtttggtttggtaacataatcttgtggagtagttagagttattgcttgagctcatgattcctgttttatgatcttaccaaattatagttttgaaagagtagtattagagcatggataagttcatagcttgctgatgaatagtgttgcaggtcatgccactatcagcattttttgtgagtaaactcttaaatttgccaccacattacgcagccggtctcatattggttggttgctgtccaggcggtaaaatacaattctttacttgattgcattatattaacacttgtatggtgctctgatgcttttccgtttgttgtttgaaggcacggctagtaatattgtcacatacatcgcgcggtttgtaatccaaacaaaaagaaacgacttttgagttccataatacaactggatgatctgagtttcttttttttcattgtacagtggaaatgttgcgctatcagtgttgatgacagcagctagcactgtttcagctgtggtaagttactagattatgacattggtttttctattcttcttgtagataaagacaccccatttaatccattccgttttctagattatgacaccgcttcttacggcgaagcttgccaagcagtatatcacagttgatgctcttggattactaatgtcaacactacaggtttggttggttcagtctgtttcttattcggattagaacgagcgagtttttgttcattgactttacccttcttggctcctgtttgtgtgtggtcacaggtggttcttctcccagtgttggctggtgcatttcttaaccaatactttaaaaagctggtgaaattcgtctctcctgtgatgcctccaattgcggttggaacagttgcaatcctgtgtgggtatgctatcggtcagaacgcatctgcaatactcatgtctgggaaacaagtagtcttggcttcatgccttcttcacatctctggatttctctttgggtatctgttttcaagaatactcggaattgatgtggcatcatcgagaactatctctatcgaagttggcatgcaggtaactaaacagtatcttaaatgaaacggtaaccagagctattgaaaactcaatgtcaactgaggctttttttcttttcattttgtattggtgaagaactcggtgcttggagttgttcttgcgacacagcattttgggaatccactcactgcagtaccgtgcgctgtttctagcgtctgtcactcaatcctcggtagcgtcttggctggaatttggagacgcagtgccccaaaacagcttgaagactaaaaagaaagcaaaggaaagttcatgaagtcctcactgtgttactcaatttcaacatctttcaggaccatttagttaagtttgttgaacaaatgaaccaaaacgggttatgtcttgtaaagctttggaagatttttttttttttttctatgtctgagatttctcttgttattcttcaaagaattttgtgaattcgaaacatgaaaatcatattttgttcatcgtgaatcaagtgatgaggttgaaaaggctaatatgtaatttctaacatttgtggagggtagttttggggttttcaattaggaacagctagtcttggtcgcagaggataaaagacgttttaagtcgtcttctccaaatcgattttctttcacctttctctctgatttcaatttcaatttttgttcgtttttttcttccggaaaattggttgttgggtggatcaaagcttacgagatttgtacttttgttctggtgctacaagtccaatg

SEQ ID NO: 20820 - DNA, 3003 bp, Unknown; identical to SEQ ID NO: 20819
  misc_feature (1)..( 3003): 2750-1469P.txt file - cDNA_ID_1829148; gDNA_ID_1620813; Annot_ID_169141

SEQ ID NO: 20821 - DNA, 3003 bp, Unknown
  misc_feature (1)..( 3003): 2750-1469P.txt file - cDNA_ID_1829152; gDNA_ID_1620813; Annot_ID_50618
attcgattttgctctgtttgaataagtttccggaatttaagtagaatttgatatgcaagtgattgtatttggatcctagaacttgatcttatgggatcataatccatataaaaagtagactaatgctaatttacgttagattagagtgacacatcttgtttcctgtttaaggcgtttactaatcttatttggtttacttactgatgacttatgagtgatgaccaccacatacataaatttaaaattataggatgctttctgtttcaatatccaaaaagtatagtaatgatggtgtgtgttggttgagttataacatcatcaactattgattggataataatctcgtattttttagcactaaaagactcatttgcatgtaaacttttccatagaacaaatcacaatcttttttagtgataaatattgttacatctttttcaaaagggatatttttactcaatatagaagatctttggtagggtcctagtgattgtggattccgtgcctacttgaatgaggtcactgcagtcttcacgggaaaaagcattttcattcttatgcaatctctcgtttatctatctagtttggttgaaacagtgccacttggttacattttagtcttagatgttattagaacagatgcaaggtgtaagagattcttgttgcatagtcatgggagttttcttgtgtgtgtttttgtttacttcactcacatgtttcttggggtttcttaacttatatagttagactttcaactataaatttgtaaactacaggacataggcgtaaagcaaaagtgagagagcaaatcgtataactttatttttgcataaatatatgatgcccttagatttgctgtcttattaggtggaccaccggtttcttatactttacttttccttgttttttttttttttaattatcgacacatacaattggacgcattatgtgttgtccacgcacacacactaatactactgtgtataaacactaagtcgtcttcttcttcttctaccataaaaaaaggaacatcgtgtcctcatgcttgttgttagcttgggaaatcatgcgacagtttttgtttttaatctattttcaaagtcaatatatgaacagtaaggtttataacaaaaataattgcatccccgacaagaaagacgttgaatgatcgatcttttgaagccatttcttacttactgtacattgttttctaatgtgcatatcattcaaaagtttgacatttgttatctctgcaagagagtgtgttgtagaaagtcagttgtcgaatttacccccctttttcaaaagtcacattcaggtcactgcttggaaaagaaacactttttttctttctgactcgggtatccgattctcttttcttctgttgttactaaacaagagttaatttgcttgacagtagtcttataatctttgggaaaaaggttagttaaattgtattttatctggtgtctttgtgcaacattatagaagacactaacttaagcatcctcctttatgcataatttgatttgaccccttacttgttagtggttgaaagctataacgaatatcaaattggagtttaattaatcttattttcacacgtgtttttgacattgtggctaccaacaacatctctgtccataccaagtgcttgtttaacgtttacatgagacttcagtttgtttgttttttggctagttaggggtaaaaattccattcttcttttttattggtctgtaaaaaaaattccatttcaagtaagaagaaagggagatgtttctacgttgtattccccatagtcaaatctaacgtcagcttcggccgagtgagaggggtcaatttcattcagcttaaatccaacttttttttctatgtctcataaataaatttctctttggttacaaaaaaaagtaaaaaagtttggtcaggaagagaggagcgaggacccaccgattacgtcatctcgtctaagaagtaatcagaaaaaaaaaaacctaatttttaaaataaaaacatcttctcgtgattgcgaagtttgtttgtgtgtgctgtgtggtgaagggtgatctctctctccgccccgaatctccgggcgatgcgatttttatcactgttggtttaataatctacttcacggtggtgtgttttaaaataactgaaatagttccggtcgaaatttgtaggttttcgagattttttttttttttggttggaaaaataaaaagtctctgttttcagaccgaatcttttgatgtatcacttgcatggctgtgaaggctctgtgtagcctgtaaagcttacacgaggattttgttgctccccttaatttccctctaatatctctccttctctctctctctacgataataatgtcttctctgcaccgtttcctttcgccttctttctgtccgtttccaaatttctttcgtttcttctttttggctctatttacttgccatctctctcgatgataacgacatgaaacccacctcaaacaaaaccacattcacttattattagcctttgtttttttttgagtggccgtgaaggtgtgtgattctggtgccctttcttcctttttgtttccctgcttaaggtattcctgatttttttccgtttcttgggatttattctgtgccattttttttgtttctgtttccaaattcttggctagttaattacgacctcaggatcatgtggatcctgttctttttgttatcctcttcatcagtgtttgacactatcttgtgttttttccctctttttcaataaccttagatgcttattccttggcctgatgggacacaagtgatatcagtgtatggtgatagacaacgacattttcatattcttccttttttttttttcttctttaatgttatttatgtttttttacttgacacttggtttcttgatatgtcctgatttgctttgacaacaaaaaatgcaggttaccgttgatagagtggtgttttggttctgttttggtgtgagcgtatg

SEQ ID NO: 20822 - DNA, 3003 bp, Unknown; identical to SEQ ID NO: 20821
  misc_feature (1)..( 3003): 2750-1469P.txt file - cDNA_ID_1829152; gDNA_ID_1620813; Annot_ID_169138

SEQ ID NO: 20823 - DNA, 802 bp, Unknown
  misc_feature (1)..( 802): 2750-1469P.txt file - cDNA_ID_1829152; gDNA_ID_1564119; Annot_ID_148887
ttttttttttggttggaaaaataaaaagtctctgttttcagaccgaatcttttgatgtatcacttgcatggctgtgaaggctctgtgtagcctgtaaagcttacacgaggattttgttgctccccttaatttccctctaawatctctccttctctctctctctacgataataatgtcttctbtgcaccgtttcctttcgccttctttctgtccgtttccaagtttcwttcgtttcttytttttggctmwattwacytgccatctcthtcgatgataacgacatgaaacccmcctcaaacaaaaccacattcacttattattagcctttgtttttttttgagtggccgtgaaggtgtgtgattytggtgccctttcttcctttttgtttccctgcttaaggtattcctgatttttttccgtttcttgggatttattctgtgccattttttttgtttctgtttccaaattcttggctagttaattacgacctcaggatcatgtggatcctgttctttttgttatcctcttcatcagtgtttgacactatcttgtgwtttttccctctttttcaawaaccytagatgsttattccttggccygatgggrcrcmagtgawawcagkgtawggtgatarvcmamgacawtttcawawtbttcccttttttttttcttctttaatgttatttatgtttttttacttgacacttggtttcttgatatgtcctgatttgctttgacaacaaaaaatgcaggttaccgttgatagagtggtgttttggttctgttttggtgtgagcgtatg

SEQ ID NO: 20824 - DNA, 3000 bp, Unknown; identical to SEQ ID NO: 5725
  misc_feature (1)..( 3000): 2750-1469P.txt file - cDNA_ID_1829156; gDNA_ID_1620813; Annot_ID_50617

SEQ ID NO: 20825 - DNA, 3003 bp, Unknown
  misc_feature (1)..( 3003): 2750-1469P.txt file - cDNA_ID_1829164; gDNA_ID_1620813; Annot_ID_50615
acattgagatacttagtcttttctctgcaatgctttaagttttagatttcaatatcgtgtttcaccccagagctggaaatagtaacagtaaatttgcaattgattctggcgctgaagttggtttagatgatttacaatatcacagggaacagcggcaacgaaggttaaaatgacgcaaaaggaagcacaaggtgtggccgaaaagagaaagggtagaagaggaccacgcagtgtgattggttcaagtgctgctggttgtgtctgtgcttttctttcaatatatcaagtgggaggagcagctttttcccagcttttccggcttggttttgtttccagtttctgcactaaagtatctgacactgtctcgagcgagataggcaaagcttatggaaaaacaacgtgagtatgctactgttatccagctatagcctcttctgttatggtctgtgtctgttttctgtctgatgtatggcatggacttgtggtgtcatgacatgaatccaatcgacaactgaaatgatcttactaaccattgccaattcgcaggtatttagctacgacatttaagattgtaccaagaggaacagagggagctatgagtcttgaaggaacattggctggacttttagcatcattttttcttgcatctgttggctgcttcctgggtcaggtaatagtgttatttgctaccaaaatttcccttcacagcttctttatgctactaaagactgttatcattacacgatttttaaacttcttttccttttgatatcttgaacacagataactcctccagaagcagctgtatgtgtactagcttcccagattgccaatcttggagagagcataataggtgcttcttttcaagacaaagaaggattcaaatgggtatgctcacttcaatgaactctcttctttttgttttattgatctcactctgtctacttgttgtcaatgcaagaagatgataatcaaatgaatataccgtcacttcttgcagaaagactgatagataactggcttgagtggaaaacgatttccattcaatacagaattttgaagttttcgtcttatgaatccattccttgcaattagttaccaactaaacaagaatgcaatgatctcgactgtattctgtctcatgttagtcactattttgctatgtgtagctaaacaatgatgtagtcaacgtgatcaacataagcttgggaagcattgtggcgattttgatgcaacagtttatactccagaactgggtcaagtaaaacctgccacgaaggtcatgtattctcagtgaggttagattctttttttatattgttaaacacagccttacgtattcagtggtgttataaattatactctgttgtgtacaactagtagtccaacatcaatgaggggaaaaaacttctgggaccattgtctagcaattattggatgatatttatgtgaattaagtttgcctttgcaattgtcccgtagatagagaaacttataaaatttcttctgcttagggatccattcacgtgatttcttctatttccttcacatgaagtccaaattctattgcgacatcataaattgaagaacatgtaaaaaaagttatgtagcaaatagagaaagtagtgatgaaaatgtaagaaaaaagtttgaagaaaaggcaacaacaaagtaccaagaattggttgagaaagaagtcgtcgaagagtcgtgattttctcgaatacattcttcttttttgtcattattatgtcttgttcctgtcatctttagcaatattctcgacgttgcataagatagtgtttctggtggccaattttaatttagaagcctctagagaaaaatgcatccatcggcctagctgttaaacaagacagcgagacttaacaggcttgtttacttttagacttatgaaacatgaagaaaaattatacaatgcgttgcttctacgaacctgtggtccgcaataagatacgacaatggcccatgggccgcaacatctgtctaacacacagctgacaagtgtcaaaattcacacgcgctcctcaaacgcgtgtattttacgactgatttttacaccgccgcagcgcaaatctcgctttttctttcttaaagtcaaatgtccgccacggcgcgcctgaagaagactcttgcttgccctttttcttactttttttcaatgttttttcacttttttggttaaattctctaacatgggtttactactgtctcgataatagtagtaagtttgtaactttcttatttctggaactgatctagttctaaaatatgcttaattctttattaagttctaaaagaactactttaaaaattaataacctattattaattacgacaacatctaactaagccattaaatacaatattcatcgttttgcgtgagtccttcatacatgtgacgaatgtcccttccccacaaaggcacaaacctaacctaataaacaataccaaaaatggaataatttgatttttttttgaaatactatatgctagcgtagaatcaaacaaaatatgtaaaacgatatccttaaaacaaaatgtatactaaacaaatattagtttgccaaagtttgacgaaataataaaaacctaaatggttcgccgtgagtaagttcccatcttcttctcgaactttgccaaagtttggtattgaaaaaataataatattaagacacagagagagagagggagaagaggatctctgtgtgtcgtccaaatttcaaagtgatgatgttgtagctgtgtggtagcgattggcttacacgcgtcatactttaattagataattttatttccttattacttaccctctcttttctcacaaagagtcatcaccagctctgatcaaataaaagcgttttctcttcttcttgctttcacagttacccaaaagtgtgattaaatctttcttttttttgctttccttctctaatcgttggtgtgtacgctaaacctagatttcgctggattgtttgagtaatg

SEQ ID NO: 20826 - DNA, 3003 bp, Unknown; identical to SEQ ID NO: 20825
  misc_feature (1)..( 3003): 2750-1469P.txt file - cDNA_ID_1829164; gDNA_ID_1620813; Annot_ID_169134

SEQ ID NO: 20827 - DNA, 3003 bp, Unknown
  misc_feature (1)..( 3003): 2750-1469P.txt file - cDNA_ID_1829172; gDNA_ID_1620814; Annot_ID_50648
ggtacgtgagaaagtgacaaagcactaatattataaatcacatgccctctcattgacgccatgttcgtctcctattgcatcaaaccccatctgtctcttaatttttaatttttgttttaaatagtagttttattgttattattgtatagtaatctttgtaatttccttccaaaatctataatattttttagccgcaaatttatagtagatccactattgtgtgtgtgtgtgttttatgtttatagctgaggttattaagccacatgattacatgtgaattcctgtaagatattcgcacgatatttttatccccaccaatcaccaatctatgattcaaagtgtgtgacatatactgactttcgaaaaatgaaatgagtaagcaaataagattacggaaaaataacaatgaacacgttattaacctgcgacgacggtgatttataacgtggatcctctgtatttgcatgttccacactaatccggtcctaatgtttttcaccttcattgctgtttctttttggtcccttctgctaattgagatatcataagatattatatcctcattttcaatatataggatatttgagttaaaagcagatagtttaagattttttttctaaaacaataattcaatattaaatttttaaaaattcaaccaatcacaaaaaaactacataatctaaaaagtcgtaaaaaatcaaatacattaatttgtaaaacatcttatataatgaaaaaaaattaaactctaaaacatccagtatagtgaaaaagagggagtagtactcaacaactactaatttcataaggtttccaactcgcgatatagaaaaaaaaaactaaaaaagaatttgattagtgatcagattttaaacagtgttataaatactgtttttaacgttatacaaaaaagctggatatttacgctggttaaaaaagataacaatataatcttgaaacaaaatattttttgagataaatttagcatatttatgtattagttgctaaaaatgatttatttaaatataaattaaatgtgacaaatattaggttagtttttatgaatgaaaaaactcatttttacatatttgtactttttagtattttagtgagtttaacatcaagacaatcaatttaactatttttttaacgacgcatcttggcgggttctaccaacttaaataatattgttcgttgttctttattccatgcaagttaaattttcaagcaacgataaattatgatatttagttttgtcgtttatgaatatttattttttagtgtcggcgattaaactctcgttttaactaaaattaaaaattgttagttaatttaacatcaataacatcagattaatttgtccatcttcttggccaattcttccatcttaaatgaacattaactagtttgatatttcaatgataatcgcaagaataataatagaaaggtatttaaaaataatttcttagtatttggggagtaaaacataaatactattttttttttgtcaacacattaatactagtattaaatttgccaaattttatgacacatattggagtgttcttccattttaaatgattttttgttctctcacgtaaattgtttattaaagaaaccacaaaatatgatatcgattcttcattttctggttttaactattgcaccctcatttttaagtaaaagaaattgctaatataacttttttttttggtaatagtttagtttataaagaaaatctaccctttcaattatctatcaatgttgctttttaatcaatttttggaaggtgtatctctgcaaaatataaataaactttgtttttctagtaaatttagagaaaacaatgactaaaaaggtccaacttttacacgaaagtgatagacatccggaccactcttaactcttaatataaatttgaaaaatctgactttcatattattttttatctaaacgaaaaaaccaaaatgttagtcgtaatccatgttgcaatgaacggaccccataaataattatcctcccaaaaatctactcataaacgagtcatgacaatgattttttaattaatattcagatattgtttcctcagatctctaatttttccccagatacttccatccgaaaaaaattgataaaataaaaaagctagattttattaatttattttaactagtcaattttttttcttttatgagtttctaactttctatataaagtttcgaaaacattaccaataatcgtcgtaaatcactccccacctcattcatatttttagccgccagaagaactgattggtgtaaaatccaattttcttgctgttgtgagttttcacttctccgaggtaaaaaaactaatcccggcggtgagaatctcttgggaacttgctctgaacgaaactttttgttgcaataattgtaaccaaaaaataaagaagacaaaatctttttgtccttattgtagattccatcgccggagcctgtccgaaaataaaatttaactaaacttggcaaaattcattcaaaacgagtccaaatcaaatcaacccctatttcaacgcctctttttctccctgatttatatatcggagagatttcaaggcaaagctttctcatttcctcgtaattgccggcgaattctactaaaggtgagacctttttcattttcccagaaagtgaagcaatctttttggggttttattctctttagctttcttaactgatcaaactaaaaaagcaattctgttttttctttcttccctcctataggttagttactctgcatttttgattactgtttgatgatttttatgtttagggtttttaattgagcaaattcttctgggtttatcagattttatatttttgtgaattggttaagatttagatctggatttagatttttctttgtttcatggttgactgaaagtttgaaacttcaaatggagaatcactgaatctgactgatttgaattttggtggtgtttctagagtttgttgagcaatg

SEQ ID NO: 20828 - DNA, 3003 bp, Unknown
  misc_feature (1)..( 3003): 2750-1469P.txt file - cDNA_ID_1829184; gDNA_ID_1620814; Annot_ID_50644
aacctatcaaactaaaaggtgttagaaaatattgttggattaaatattataatttgtatatagtaaacattaaaaggtgattttattgacgtataataatctaaaaaccaaaaataaaggtgatatattgaatagaatttaactatttagtaggaaggaagcaacatgggcaaattgccaatttggtttataaaggagcccacatgtttaccttactattttggactttctgagttagtgtcgaaggcctttgggcccataaatggaccccacaaaaagacaggacaaaatatccttagaactcgccacgtagatatctcgacgtggagatctgaccacgtgtacagtttatgtcctgattttcgcaagagtgacgtggacgggtcatgatccgcttatattttcactttgtctacaagccaagtatattaaattgggcctcaaattagcccaatcaatatatcagtacattattaatcaaaggcccaagtctcacgctagcgatcgtcgacaacgattttgagtctttctccgaagtcgccggaatcgtattcgccgatccaattgtcgcatagaaactgtcatctccggcgagagactgatctctggtaagtcaattcgatttcgcgcgttttataacttctggtattttcgtattccgttgctgagagaaaatattgcagagattgcttaacatgaagctgatactttaaccgattcatcaaattgacaaaaatcgttttcttctttagggattgatacagaactcgtaggatgatcgatttacgctataaagaatgctacttgctcatctgtcttatcgtcttcataaattttgtgacttgttatagcgatgagagactgtaagtgttgttgaaaaacctcacattatccccaaactcatcaatttggattcttttattggtactgtagaaatgatgttatcaggtttctcttaggtttggtggaaaaactttatatgctgggaaggaactttggaaagagacactgccattgaaatctggatctcgagtttacaaattacaagggcttaagtcgaactcttggtatgaagtcaagatatcatacccagcttctgtatgtcaaatttgttatcttgttctatgttcttatgtttccaaggttcttgtgcttgttaaaaatctcatccttttttgttatgataacagataccggctctattttcgctgcaattactgaagaacggtgtaatgggtttgaaggttaaccatatgaggagattactaaacactgagaagttgatcttcaaaacagaaagtattgaagaagttgataacaaggtattgccatcttcttcagttagttcctaaaacttagaaagaagaacgaatacaagtttaggagtttgtttctgatttaggagggattgtatgttttggtgacggtggaacctgaaggaatcgtggctataccaaatgttaaagaaagaccgtccatcatttacaacataggcaagcttttttttctacttactatctcatcaatcttcttcttttcacaacataagaacttgtattaagtgtagtgcttcttctagagtctgaaaactctcatgttgacagtttgtgaagaacagctcttaggcatccctcactcaagctggtcagtggtggttttagtagttttgtgtctcgttgtcgcgttgattcttccccggttcctcccatcttatcttctgatcaaagatgtagatcgtgatcgttaagaagaagcatggttaatacagtttcctcacctctttgttttgttactctgttcgcattttgatgtttgttcatctaattttgtatggtttttagttcttacatgtccactgcctcattcatataccttaccttaccacaccgcactcaaagaagagtatataagtctacatgtgttagattgatttcatgtttttcagacgcgggaagtcctattctgaacttgtatggtttgatcgtatatagttaagtaacgcttatccgtttgaatttcaatccaacaaacaacattccacaagatgaataactctaaagtacaccgtattatcttttgggaatagggagtaattaattaaaagcaaagaggttacacatatttttaataaataaatgaatttttttttgttcatataatgtatgaaataaccgttaatttcccggcagtaatccgctaaaataactccaaccaactgtgataataaaagaaccaaactaggattcggacaaaaccacaatttgtgttctaattaattacagcgttaatcataattactagatgatttcgagtgggacccagggtgaagaacaactccttttgttttctctctctctcgaagaatttatgaatcataatcacgcatcatcgtcttcgtcatcaccaacttcttcaccatcatcatgaatgttaaaacttccataaacaaatccttccttgtccccttgtatttttctatctaaatccctaaaaccactcaaaatcatccctctttctctcctccccattttccccaacgcttgattcgaattcgtctctctcgttttctgttgttctaccaattgagcaaccctagaatcattcttgtgtacctaccggaaccgagtcttctcttcttccgtggcacatctttcaaagttttaaaccccttttcccctaacttcttttcatttttctgtttttttcccgggaaattttctctctctctctctattttttgtttctctcgtcatgatcattacttgtcaagtatgatcctttattaggtttctttggggccgatctcactttttctgtttctcaccctcttctcttcgaaggcccttgtaaaccctagaatctcctcttttcaaatttatatgttctgtttcttcatcttcaggtttaatcattcaatctatctctagggtttaccgggtcaagtcttaggatctgtctctatccatacttcatcaaagtttccgtctttggttctaatccatg

SEQ ID NO: 20829 - DNA, 3003 bp, Unknown
  misc_feature (1)..( 3003): 2750-1469P.txt file - cDNA_ID_1829191; gDNA_ID_1620814; Annot_ID_50641
ttctaggatttcacccgtggtagtatttaattgtataattatattttaattgtcattctaggatttcactcctaattctatcgcaaattattatcaacccaaaccagtcaattctaaaatatcacccgtagtaaaccatcccatattaatatcgattcaaactcgtcaattataggatttcactcgtggtagtatttaattgtataattatattttgattgtcattctaggatttaactcctacttctatcgtaaattcttatcaacccaaacagtcaattataaaatttcacccgtagtataaagtttaaatatttataatgtttaaatttattataaaagaatcaaaatgtgttttaaaaaaattaaagttttaagttttttttttttaatattgttaattttgtttagtgtttaagattatgtaattatattatgattgttattatatgtttttttccatagcatactatcccatgttattatccactcaaacccgtcacaccatataaccccgtcccgtgaaattaaacacaaatttgtcattttattataaattttaaatatttataaaattagaaacttcaaaaaagattaatattgacccaaacttcatcattgaattttgagtgttatatctaagatttctctcgcagtatatcgtcccgtattaatatcttttatattgtttaaatttcttgtaatatttaatttataattttttaaactttttaaagtttcaattttttaaaataaataaccctagtaaaacaaaccattttaattttggacacctcataaatcaagtttcatgctcattcgtaatcgaaatcattttggtcctttttatagtatggctcttgaccattgtccaatttttttaagcgatatagaacattctaaaatcgtaattattatccacccaaacccgtcctaccatataatccagtcccgtgaaattaaacataattttgtcattttcttataaatttcaatattataaaatttgaaacttaaaaaaatacaatatcgacccaatttttaagatttttcctgtaatatatcatctcgtattaatatattttttctatatttgtaatgtttaaatttcttgtaaaattcaatttataatttttaaaactttataagttttaaaattataaatatttaaagcattttttaaagataaactttataaaaagtttttaaaattataatatttaacatttgataaagttataatatttataattttttgaaacattttaaagttttaattctttaaaataaaaaatccgagtaaaatcggataactattttaattttggacgcctgataaatcaagcttcatgctcattcataatcagaatcattttggtccttttataatatgggtctgaaccattgtccaatttttctaagcgatgttggacattgtacacatattatttcttcataggttgaataatatatgtccgttttaaaaaatttgaattacatcatattcagaaaaaaatataatattttattaactatatatattttatataaattcaaaataaataaagtataagatcaaataaaattgaaagaagaattatatatttatgtttaaattaggtagaaatattttaggaaattagttaaggtaaataagaaatatggttagtttagagatattgtttatattaaatttggtaattaaatcattaattttcgtttttaattattagtttttaggtaacttttccaaaaactaatgttatccaagatcagaactgaattaaacatgttatccaggatctgaacagagttaagccgagtaaaacccacccatttgaattaattgttgaattatggctcaaatcttcaacattatcttcaaaaatcccctccaaacatgtatatatagatatttccattatgatatagttttcacatcttaactccaaatcatgaaacctaaattttatttccaagtctcaacatcatatattttaattatcatcttgaacttcttgttaaaaatataaaattaattcataaacttttctataaacctaagttttttaatattttttgtatcgtatttatactaatttcgatcttctttgtttcctccgtaatcgttgtcgtaatttcgtaaacctaaatttcatatagctcctttcttctatgtatatatgttttgtacaatgtttcatatatataataacaccctttggcaaaaaaaaaaaaaaaactttttcaatgtttatctttcgtggttattacatatagtagaaatcccaacattcaacaacaataaaaggttacaaatcctatatttaccaaaaattaagaaagtctaaaaagactaatagatacaaaaagaagaaaagaaattgtttactttttgagtgtaaaacaaattaaagttaaaaaccacataacatcccccatcccatcttttttactaataccttcctccattaacataagattgtctctcctctttcgaattgtctctcctttttcagctctctctctgtatctccttcttcttcttcttcctccagcttctttcaatttctccggctgctaaaccctagcgcgccgtcggagtccctgcgttctcataccaacctttactcgccgtcgccgtcgctgcagaactggtaagcatatgtttttttttgctgctctctgtattctatggaagctgaaaggtcttctcggcttgtttatctgtggtagttttgattaggatgaggttttgtagtaatagagtgagtgagtttgctccaattcttaattgcgtttagagatagaagagagagagagagagaagctatagtttccaggcggagaagaaagacaattcctttttgtttaatctggaatcaccaatagttagttatatacagtttttttatcttcttcgtttttttcttctggatttgttcttttgtccttgtcttgctgtgactgactactccacaacagaaatcgaagcttaagatg

SEQ ID NO: 20830 - DNA, 3003 bp, Unknown
  misc_feature (1)..( 3003): 2750-1469P.txt file - cDNA_ID_1829207; gDNA_ID_1620814; Annot_ID_50636
acccgtaaacatgtccgcttgactgctgtggatctgatggcttattctcacatggataacccgcagagtcctgatttcttgttagggaagctggaagaactggacccttttgttgaacaaatccgcgaggaaacactgaaggagacactgtgtcatggtattggatacttgcatgagggtttaagcagtctggatcaggagattgtgacacagctctttgaagctggacggattcaggtttgtgtgatgagcagttcattgtgttggggcactccattaactgcgcatttggtggtcgtaatgggaacgcagtattacgatgggagggaaaattcacattctgattatccagtccctgatctgcttcagatgatggggcgtgctagccgaccacttcttgacaatgccgggaagtgtgtgatcttttgtcatgcaccgcggaaggagtattacaagaagtttttgtacgaagccttccctgtggaaagtcagctccagcatttcttgcatgataatttcaacgcagaagtggttgctggggttatagagaacaagcaagatgccgtggattatcttacatggactttcatgtacaggaggcttccccagaaccctaactactacaatctccaaggtgttagccacaggcatttgtctgatcacctatcagagctggttgagaacaccttgtctgatcttgaagccagtaaatgcattgaggtagaggatgagatggaactctctcctctcaaccttggtatgattgcatcctattattacatcagttataccaccattgagcgcttcagttcactgttgtcttctaaaaccaagatgaagggacttcttgaaatcttaacatcggcttcagagtatgacatgattcctatacggcctggcgaagaggacaccgttcgaagattaatcaatcaccagaggttctcttttgaaaacccaaaatgcacagaccctcatgtgaaggcaaacgcgcttcttcaggcgcatttctcaaggcaaaacattggcgggaacttggcaatggatcagcgtgatgtccttctatctgcaaccagacttcttcaagcgatggtcgatgtgatatcaagcaatggctggctgaatcttgctctgctagctatggaagtaagccagatggtgactcaaggcatgtgggagcgggactccatgcttctgcagctccctcacttcacaaaagacttggccaagaggtgccaggagaatccagggaaaaacattgaaaccgtattcgatcttgtggagatggaggatgaagaacgccaagagcttctcaagatgtcagacgctcagcttctagacattgccagattctgcaaccgcttcccaaacatcgaccttacttacgagattgtgggcagtgaagaggtgaacccagggaaagaggttacattgcaagtgatgcttgagagagacatggaggggaggacagaagtgggacctgtggattcactgaggtatcccaagaccaaagaagaaggatggtggctggtcgtgggcgacaccaagacaaaccagttgctggcaatcaagcgtgtctcattgcaacggaaagtgaaggtgaagctggatttcacagcaccgagtgaaccaggagagaagtcatacacactatacttcatgtgtgactcttacttggggtgtgaccaagagtactcgttctctgttgatgtcaaaggatccggcgctggagatcgcatggaagaatgatttgttattcaggttagttccacagttttctggtcatagttttcggatttagattctgtacatggttgtagtttttgtgttacgaacttggctttactagattctgctatgtgcattgaccaactcgctttcatctattgtttgagtaatttgttcatcaatctgctatttttctgtttcgtctgttttctttttgcatgagctatgtattaggttttactcttgagcattgatttacttatctaggtattagaatacaggtatgctcatggtatatatatacctagtattgtgaaatgattgattgataagttagtgaacaatgttgatcagcaaattgttagaaatctgtataattggatggtgatttgatgtgtgctttggatggtgatttgatatgtgtgcatcactgctatatgaaaactgctttcttgaatcatgtctcataaaaatctcacatgatgttcctttaaaatagctgataatagattttgtattttgaaatccagaaaatgacacataatttctcttctttgcaggctatgctgattctggagagtgtgacttgtcttccaaaaagcctccgtaccgtttgggtctctgcaatcttagctctctgagaatatatattaaggtgtaatcgtttttttctggtcttttactattccaattactctttttatgtcgtgcatcgatttttaatcctatgtatggcttgtttctagttttgtttggaccaaactcgacagaggagccaatgtcaaaactacaatttgagtttgtgactttgaaagctgagattacttgaaagaattttaaatgcagcagtgttcattttgtaacatctgagttgtgtgatactggcttattgagtcaccgatagtttttccttaaaactaaaatgtactattgcaagtaaaaaccaaacaaaaaaaattcattcaaacttgcattataaccaagtaaacgtgatcaatagaaacttgcaaaatcacaaccaaaatatttgtccaaacaatatgtagtcaaaacagtctgttgtgttcataaaaaagtcatataacgatacaccaaaaagaaagaaacggaggtgtttggttggtagtatattcctcctcctcctctttcttcttctccctcctcactatatattttgaagtttattaacaagaaccaaaaaaagtcacactcgaagtctcacaccacaccaaccacttcttcttcttcttcttcttctacataaaacctaacgccatg

SEQ ID NO: 20831 - DNA, 3003 bp, Unknown; identical to SEQ ID NO: 20830
  misc_feature (1)..( 3003): 2750-1469P.txt file - cDNA_ID_1829207; gDNA_ID_1620814; Annot_ID_169176

SEQ ID NO: 20832 - DNA, 3003 bp, Unknown
  misc_feature (1)..( 3003): 2750-1469P.txt file - cDNA_ID_1829211; gDNA_ID_1620814; Annot_ID_50635
ctataaccgaaaaataatttccctatagaaatttaaattgcatattgtaaagaagatagttattcttcattatttattttttactgcctaacttgattaaaatttactttaaataacttaaccacaactaagcgattaacgttcataaaaagatactcatcctatattttcatattgaagatgagaatttttcttttccaacctactaactgaaaatgacgtgcttactaaaactctaatgatatgtcggtttcggtggtaagattcaataaatacaatacaagacacacattatctaatggctcttttgttttcttgcctacatattatgacatttatttagttttccgctgtttgtttatttagatctactccacaatagttgacgaagatatattatacgcgtaaatagaattgaaaaatacgttaatatacggagacgactttaatttgtagttgccattagtttggtaagcactagatcgacaataaagtgagtagctggtaaaactaattaacaatataccaacttgagttaattcgtcaaagagacagctacacaaataaatcaatcaataggcatgaactaactgacaatatatgccgcaacacgagctatatatatccgtctatgatacatatttttctttatatcaagcttttcaaatgtataggtataagaactcaattttatgattatcgcctctacacgttgtttttgtgcttttttttttctacttttgtatatatttgggtcatgcgtgaagcggtgagagtactttcggttggtggaatgtcacgatgagcttcatcttttgaccttatcaattctagtagcggttcctgacatggaaattcacgtatacatgatacgaaaactgttacatttcgtcactttcgtcaatatttctacgcatattattcatatatgttatctattttcttcgtatgtttcacaaaaaacgtattttggactttctagggtttgttaaaatctctaatagtttattcatagtatatatggaaggaatattgagacaatattactcgaaattttaattatgcatggatatattcagaccaaaatgtcaattagcctccgaaatgtataaaacaagataaaggatttatagtggtcaacccattattgttataataaaggattttgtagttaactatgatacattgtaacacatttgaattttgtggcagactagcgatgattttctgaatgacctttttcaaatcaattgttacttgtaaaaatttgtcattaacaaccgtaagtgataatcggtagttaaatattccttccatatatactaatcaaatgcagcggttaaataattgataggaaaaaaaacagcataggcattgttactttgtgtttacacttttgaataaaaagtattattaagtaaaacaaataaataataaaaaatattattaaatcttggaataaagtacaccaattttgtcataaataattaactccggcaaaactttaaagataatggagccacactatgtcacatgatcgatgctccctctaatccgcaataggtgcttacatggatgtttaaaccgaatttaggcggacgagagttcttagttgtttatatatacgtaatttgttttgttgtatatgtgcagtaacaaaaataacatcgctttaaaacaaaaaaaattgaagtggtttagcataattttagatattaattaatcttggtaaactcttaaaaaaacagttttgttttagaatattaaacaaaaatacataattgaatatgatgctcttgttacgtggatttccacacatggcctttttgggacattttgattttccacgtctcaatatttcacacgcctacttatgtgatgactgatgcgtgattagtcaattttctgtattaaattactgttttgtttgtttgtcaccattctctgtatttccttaaagagtaaaagaaagtaaaaatttagtcaccggttgagtttttttctttccaaacaagagttttaatgatggagtgagtttttcttgtactttgtcatgttgttatggtagttgattcttgttatatcgatatataacatgagaactctttttaatacaaaactataaattatacgtgttgcatgtttgaaaactatattatcactaagatcaatagatctctttagagatttgacaaaaataaacaaagacatatatataaattttttggatatttttatggactgcccagttttcacatgataacacatgaaccttcgtctcatatacatgtgccatcttttactaatctaagattgcattcaaagtaatcagcctccatgtcattgtcaccatttaaagtttttcccattccttgttcattattacacacacattatatttgtcagcgattattaatgttgaggtattaatattttgacaattttaattcttataataaacaaaaacacttgcattcattctcaaattaacaaacgcaaaagaaagcatgagaccattgtcttattacgttgggcttaggaagtatgtacaggcccagcccaatccatgtacagagtcggtttcgttattggatccatagtttcaaaacggcatcgttaaagttttccaccttaaggcggtatcgctagcttatagaaagaattcgcagtcgaataaacgaaggagtgtctcctttagtcatttaggtcgattattaggagatagaggacgtgagaagggagagatctgagtctcctactagggtttcttctactggattgattcgttgcagagagtgaagctaagaagagattttcgtagctgtttctgtaagttttttttaatctccgtttcctcgatttgggtgtggttttattagggtttatcatctctgggagcttcttcgtttcacttttggttcgtttcttcgatttgaggttaacattgtgtatttttttttgttcctgtttgatttggtttctaggttttcggattggtagatg

SEQ ID NO: 20833 - DNA, 3003 bp, Unknown; identical to SEQ ID NO: 20832
  misc_feature (1)..( 3003): 2750-1469P.txt file - cDNA_ID_1829211; gDNA_ID_1620814; Annot_ID_169175

SEQ ID NO: 20834 - DNA, 3000 bp, Unknown; identical to SEQ ID NO: 5748
  misc_feature (1)..( 3000): 2750-1469P.txt file - cDNA_ID_1829215; gDNA_ID_1620814; Annot_ID_50634

SEQ ID NO: 20835 - DNA, 3000 bp, Unknown; identical to SEQ ID NO: 5747
  misc_feature (1)..( 3000): 2750-1469P.txt file - cDNA_ID_1829219; gDNA_ID_1620814; Annot_ID_50633

SEQ ID NO: 20836 - DNA, 3000 bp, Unknown; identical to SEQ ID NO: 5747
  misc_feature (1)..( 3000): 2750-1469P.txt file - cDNA_ID_1829219; gDNA_ID_1620814; Annot_ID_169172

SEQ ID NO: 20837 - DNA, 3003 bp, Unknown
  misc_feature (1)..( 3003): 2750-1469P.txt file - cDNA_ID_1829228; gDNA_ID_1620818; Annot_ID_50676
aacgcaaaaacttttgcgctggagtgacaaagagttggaccgatgtttgcactcgagcattctcagatttatgcgagacagctcataggatcaacagggagaaacaattggctttagagagagagaaattcatagaggatatgaagaaactcaggttgagtctccaacaagaaaaatctaataggttaagtgtacaacaagtaaaaattgcttctcctcctcctcctcgtcctcatcctccagttgaagacgaaacagaaaaggcccttagagagaaagagacaatggaggtaaaagagaaggaaggtgtgctggcggcagatgatcggacggttttcctgacgttttcaaaagggtatccgatctcggaagcggaagtaagggtttacttcactaggagattcggggaagtgatagaagcggtagagatgcaagaagttgaagcaaacgagcagccattgtttgcgaagatggtgatgaaactgcagtgtgcgtcgatgatggatgagattgtgagtgcgaggtttagaaacaagttcaccatcgatggcaaacatgtttgggctcgtaagtacgttcgcaagaatccttatccagcttcatcctctactcatttttgagtgtttctgaacttcttatttacatgttgtgcttgttgatgttgtcgttgttgttgtttatctaataaaattgtgtcgtcaatcttattattgtgctacacattaatatatgtttaaattggcgagtacaattacttttttactagttggtgttatttttatatattttgaatcatacaatgtttgagaaatataacgccggaaaacttccaagaacaaatgtatatctatgtataattaaattcataagataaaataaaaaaataatatatgattggctaattatcagtttctatatatttaattattattaattaattgatagttttttttatttgtttggtcttttgttataggatatttgatttagtatagtctgtcaaataatcaagaagatgttgtgccaacatcctccattagcatcatcgctccgaaatgttttatctaaggtcatgttacttagaatttgtgttgaatgatttaattacaaaatctacatcgtaattatatttgagttttaaaaatgtatatttttatgttgtatactttttaaaatcgacgtagcaatttaattattagtcaaaataaaaatgaaaatatgattagttcatagataactgtatcgttgtcgtttttagaatttttgttattacgtgggatatactccatccgttttaaatgaagtgttgttttagaataaatgcagttttaaaccgattaatatactacaagaacaaggtttttcttttccttcttcgatgaaaccatattggtgttaccctttcttctttggatttggattcaaaatggttttagaaatagaaataaactatcattgactcatccatctagatggaaggtcgggataccttaaataataaaacacgtagaacacgtagtaataataatgattagaaactaaaagttaatcgtaatgatcaatagtatcttgccaaggttagaacacttagatgaaagtaagcttgacacatatggtatctgtggttatgaaaaacattatgaaaaagttgtgcacatgttgaatgaagcagttgcttatcttctttcacctatatttatttaataaaatgatgataggattaagttttagggtaaaccaaacaaggatttagaaagagtaggaagattttgttttataccctaaggatgctagtagctcatgccacgatataccacttatggcgtgacaatcagcaaagactcatgtaccgatcattttcaagataattgaccgacatgtgttcgtaatgccaaaccgaagaaagtttagaaaactcatgggtttgtggcttccatgggagtgaactccagatcaacccatctcaaacttgttttgtactctatctttttggcaaggacacagttaatctttttgtataaccgctacatttcattatttatgatatttacatttttatcaaaaatgattcacgaagattaggaatatgttttcttatcgcacttaccattaagagggacatcgaaaacattgcatagaagaaaacaacacaaatgatggtttgattaagtaacaatggcgtgaacctctatagcaggatttaggctaaatctttgctgcgagtacatcatgtgacccaaatttttaaaaacgtatcaatttatcaagagtatgaacttataaggggtaagtaaatgagagataacatgtttatcagatgaaatcaaccaaagttttttttttttttgttgcttccacatgcgcatatgtgaatacgtaaactgccgacaaaaaaaaaaaacattctttctttattgcgttttctaagcgagaatgtcgatgtgatcagttaatgcgaacgggtaaaattagatcagtatttataaaaacaaaaaggcagtggaaaatctagggtttctaatattaatagccttgtaatcagcattaacttagagatatttaaatctcaagtttcattgtcaacagaacttattagttattattactgttgagtgatgactgatgaccaacaacgagtacttgatctttattgaagaacacgcaaagaacaaatagctctcgtagctcagttggttagagcacccgtttagtaagcgggaggtcttgagttcaactctcaacgaaagcaattttttaaacaaatttacattttacaaacagaaaatctagcctgtaacggaatattgtcgttgtgaatattttctttttgcctggctgtataatccccaaatatagaaataacaaaagaaatattcgaaaactttcttaaaaatagattttgagaaaagaaaaaaaatggttccttgttcctaggagaacaggaacagagttgggtgttccttgtttcatctcacattgaaaccaccggagagagagataatg

SEQ ID NO: 20838 - DNA, 3003 bp, Unknown; identical to SEQ ID NO: 20837
  misc_feature (1)..( 3003): 2750-1469P.txt file - cDNA_ID_1829228; gDNA_ID_1620818; Annot_ID_169367

SEQ ID NO: 20839 - DNA, 3000 bp, Unknown; identical to SEQ ID NO: 5788
  misc_feature (1)..( 3000): 2750-1469P.txt file - cDNA_ID_1829236; gDNA_ID_1620818; Annot_ID_50673

SEQ ID NO: 20840 - DNA, 3000 bp, Unknown; identical to SEQ ID NO: 5788
  misc_feature (1)..( 3000): 2750-1469P.txt file - cDNA_ID_1829236; gDNA_ID_1620818; Annot_ID_169362

SEQ ID NO: 20841 - DNA, 3000 bp, Unknown; identical to SEQ ID NO: 5789
  misc_feature (1)..( 3000): 2750-1469P.txt file - cDNA_ID_1829243; gDNA_ID_1620818; Annot_ID_50671

SEQ ID NO: 20842 - DNA, 3000 bp, Unknown
  misc_feature (1)..( 3000): 2750-1469P.txt file - cDNA_ID_1829247; gDNA_ID_1620818; Annot_ID_50670
atcatagcataattttgttcttggaaagtatagtttggacaaaagatgtcgtgagacagagagtaggtcgttaaactatagatagcggtagaaactttgttgtatatcttttgactgatctgcttaaaaaatctgagctcatctctttgtttctgtaatatttcagaatgcggcattccaagaaattttgccacaggttcggcagcatatcattgatggtttcagccccaacgccttggacatgttcactagagagtttgacttctttgacaaggttacttctatatctggggtgttattccctcttccaaaggaagaacgcagagccggtattaggaggtagcattttaaatttgataaaaccttatcatgttacggatgtgtctgcatagtctaataatactctccatggcagggagttggagaaaattgaaatgcagggagatgacctttatttgccaactgctcctaacaagcttgttaggggtatccgtgtagacagtggaatacccttacaatcagctgccaaagtccctatcatgataacttttaacgttattgatcgtgatggtgaccacagtgatgtaaaaccacaggcttgcattttcaaggtaatcctccgcatgattttcatacaaaatttctatgtttttccttatagaaaatgccagtgcagaaaaaagaaaatacttctcctgtcagactctaccacttgtttaagtaaataaagtttggaaaacgttggaaaaaaaacgtagctagtggtttctggacattcagatgctgcgcccagttggtgagtttactgtgagttagatgattctctcttgtattcattcaggttggagatgattgccggcaagatgttcttgcccttcaagtgatatctcttcttagagacatatttcaagcagctggtcttaacctttatctttttccatatggagtactcccaactggtgcggaaaggggcataattgaggtaaatctcactctaaaatgtttaatatccttgctggatgaaacagatacggtggtatgagaactttcttgtatcaaataaggatcagactttttgttcacatctcttttcttcccttttgttacaggtggtgcctaatacaagaagcagaagtcaaatgggtgagactactgacgggggtttgtatgagatttttcaacaagactatggacccgtcggctcaaccacctttgaaacagcacgggagaacttcctcatcagtagtgccggttatgcagtggctagtcttttactccagcccaaagacagacacaatggaaatctcctcttcgatgagtatgtttcctatttttgcacattccctttgttctttgattctttccacttggtgcattggaaaaaagtttatcaaaacctctcgatggaaaaatatagtgttggaaatttcatggaagtaacacaactttattaccatgtgttatgctaatgcagcgtgggaagacttgtccacatcgactttggtttcattttggaaacttcgcctggtgggaacatgcgattcgagagtgctcatttcaaactgagccacgaaatgactcagttgctagatccctcgggtgttatgaaaagcaaaacatggcatcagtttgtgagcttgtgcgtcaaggggtacttagctgctcggcggcagatggatggaatcatcagcacggtgcaaatgatgctagaaagtgggttgccttgctttagcagaggagatccaattggtaatcttaggaaaagatttcacccagaaatgagcgaacgtgaagctgcacacttcatgattcatgtatgtacggacgcatataacaagtggactactgctggatacgacttgattcagtatttgcaacaaggcatcgagaagtaagaagaagaagagggaacttaatgatatccgaaaccagagttatataatttgcaggtaaaaaaagtttaagccatcgagtattccgatttgataattgttatctcctctcggttgggacattctgactaattgattacttaagaggaacttgaggattattatttttatgtttttgtcgtaggattttgctatgcacaaaaaaaaaaagtaacaaaagagagaggtaggagtgttgtggtgtggggattttcgataacttgagatgtaagctactattatatatgatctttgattattcttgggtggaaatggtcacgtgtttcttgataattccatgcgttgtataaaacaatttatttgattcaatgccggatgataaactcattacaagtatatcatcccgcatacaccagaacccaatttagttctttcagttcctctgcatcagaaatgaacaaaaatgtattctattaacatgtagaggtatttgtattcagtggatgaacactttctggttgctcattccgcttttctggttactcattccgcttcccggatactctcgtttggcttttctgaaatagaggaattctgaagctgccctaacaggtattcatcagtttgtgagcttgttcatctctctgagattccttctcgaggtatccatctaacttggacaatgataaattcgttattcagtggctcgtaaactgaaccaaggaaacgagttagtattcggatcatggaacttatgctgtccatcgcaatattgttgatcattcaacaactttggaatctctcctgaatggcaattgactcgggagtctgtagtgcatacttaaattcaaattgatttttagaacaataataacaattttttaagaaaataaaatttaaaatttcgaaaaaacttaccattcagtgtagaaaatgtctgtaagtcaactaatgactatgagtgacggagttaaaagaaaaaaaaaaaaaaaaagagatagagtacagagacaatatagaacgacagaacaaacagatctatcagtttactgactacagagaggatttgaactgagaatcgaagaaagtctctgagggttcatctatg

SEQ ID NO: 20843 - DNA, 3003 bp, Unknown
  misc_feature (1)..( 3003): 2750-1469P.txt file - cDNA_ID_1829251; gDNA_ID_1620818; Annot_ID_50669
ttctatcttgctctatgctgtctttttttgtgtgtgcaaacatatgcatatgcatatgctgtctaatgtctaataataattagttcatttaattaatatacatgtttgccaataaataccattaagtttattctatagatctctataaataagtaattccattctgaatttgcttgaggttcacatagacctatttcatagctacaaattttcaaaatatttattgactatatcagaaaaatgggtgggtatgccggcgggtatgtgattggtgcatttttatatattattgtttaaaattttcattatcaattttttttttttttttaattttctttttaacagaaagatttcttcttcagtcgattttctctcttctctctcatgaatatttcagagagcgatcgactgaactttttgttaacgtccggatcttttccggttatccaatcccgtttagcgggctatcttccaacatgcatcagctcgtattgtgatggatggttggtttgtgttcggtatcgatttgactttcacagtctcgatgatcggttttcgtcggcgttttcctgccgttttgctctcggttgttcatgaccgaataaaggttatgtcatgatggccaattttgggtcaaaatcacaaacttttgaaatcaatttcaatccctaattatcctaccttcagttttagcttctcttcccaaggccttcaaccgattgatcccaatctctcatctatgagatggccagatgggtgttgttgcggttaggcagttcttgtagcttctaccaacaagaattcacaatcagatttggatcaagatctgaaaggtctatttctgcttatccggtcttctgtcgagtaagtctagagatacatgtgtcaacatatcattgatgattccaaagcttcatcatcaaaggttcatcaagttgggtttgcaagtagatgttttagggggtgttattggtttgtgattttgaaagagttttaatgacttttaaaagatatagaatccaaaatcttgtaaagtctttctagaatcttgtaaaatcttcctgaatataattataaactttgatttgtgatttctccaaaattataacatatctccaaaatattgtatactattctctcctcttctataaaatctatctccaccaaagtgaaaatcacacgcataaacacaataactatggtattcgtaagtaagctacatgaacatggaactatccatgaagaacttgaagttttattttcaaatattttgttggatatttacttttcatgtgttggattaaaatgctttgttctaaaaattgtttgtgtgttaatttttcacaaagattatagaggagcacgtgtgggacctgagccataatatatatacagtaaaacctctataaattaataatgttgggaccttgaaattctattaatttatagaggtattaatttatttataaaataataattattaatttatagagaatttaggttaattttgtaatttttttaaaaattatgtttgaaataattttattttatttataatcattatctttctagaagtaactgcaaataaggataaattattgtgtccaaaaaacaacaaaaaaacagtttttgatgtagtaaaaatattaaaattgaactttactaaaaattagtataaattaataaaagtaaaataatagcagattcatatttcactaattttcttacatataacatatatatattttaagaagttcttacaattattaatttatgatactaatgggaccatatatttatataagattttttaaaaaattattatcttattaatttatcaatttgtgtcattttttacactggtcccaactcgggaccagaagaatttattaatttatagaggttattaatttatcgaatattaatttgtagaggttatattgtattgttcattactgttaatgagatttctgcatctgttcgtatcattggtttttgtttatatccaaagtcatgattcacaatctctctctttttatgatacttttcatgattttaatttgtgaagaaaagagtataaaatcataatccaataacacaaaattttaaatcattaacaatcatgaaaactgttgtttaagttaaataacacaaaatttgtaatgactttattagagtatgaatccaataagttcagatttataaaaaatttagattatttttttacaaatcaaaatttaataacaccaaaagtcttataaaatcttaattaaataacaaaagatttttcataacattttgtcactaaaaatccatataaatcacaaaccaataatacccccttaatttcttaagtcgctttattaactagggaggacgagtagatcagagttttccggtggtatggcgagttccgtcatcaacagcaaaattccgttctcggaaaagaagtaattaggtgttcagatgcttttcaaaggataattaggggttaattactagattttgcttgtttaattattgttttgtgcctgtaattggtatatgttttggtactttcggtttgtgttttagtttcgaggaattttcgttttcgccggcgaaatatccggagatttacatgtgttctccgatcaatatcgttgtatttgtgtttctcttttttcgtttgaaggattgaataaaagttacttcctttgttccttttagtttgattgtttagaaatttttttttttttaaaaagattgactttttaagtttttcatgcaatatttattagttaatattggtgaattgtaattttaaaaaagaatagttaattatcattagtttaaagttataaaaaactgtaaaacaataaaaaataatatatttataatcaatatttaatatgttttttttttaaacagttaaaaaaaaaaaagagaggaaatatattgtaaaaagaatgaaataatatttttaaccgcgtagtgcgatcatcttctccggccctaataatg

SEQ ID NO: 20844 - DNA, 3003 bp, Unknown; identical to SEQ ID NO: 20843
  misc_feature (1)..( 3003): 2750-1469P.txt file - cDNA_ID_1829251; gDNA_ID_1620818; Annot_ID_169357

SEQ ID NO: 20845 - DNA, 3000 bp, Unknown; identical to SEQ ID NO: 5791
  misc_feature (1)..( 3000): 2750-1469P.txt file - cDNA_ID_1829259; gDNA_ID_1620818; Annot_ID_50666

SEQ ID NO: 20846 - DNA, 3000 bp, Unknown; identical to SEQ ID NO: 5791
  misc_feature (1)..( 3000): 2750-1469P.txt file - cDNA_ID_1829259; gDNA_ID_1620818; Annot_ID_169352

SEQ ID NO: 20847 - DNA, 3000 bp, Unknown; identical to SEQ ID NO: 5792
  misc_feature (1)..( 3000): 2750-1469P.txt file - cDNA_ID_1829266; gDNA_ID_1620818; Annot_ID_50662

SEQ ID NO: 20848 - DNA, 3000 bp, Unknown; identical to SEQ ID NO: 5792
  misc_feature (1)..( 3000): 2750-1469P.txt file - cDNA_ID_1829266; gDNA_ID_1620818; Annot_ID_169346

SEQ ID NO: 20849 - DNA, 3003 bp, Unknown
  misc_feature (1)..( 3003): 2750-1469P.txt file - cDNA_ID_1829294; gDNA_ID_1620818; Annot_ID_50650
tattcttaacgagttagttactgcatattttcttattttatagaataagttgaattcgatcgtacttattatctgtacgaactactggttttcgatgtaatgcagttgacaacaccataagagtataaaacctaaagctgtcaattgggcttgaccatgaccaaatggtcttgtccagttggacattttttttctcttcacaaaaatgaccaagcccaaagtgaccaagcccaaaagtgaccaagtccaagagtgaccaaaaccaattatatatgtccatggacataaaaaaaatgtttaacatcacaataataatctaaaatgaccatgacaaacattgtaattagacatcataaaaacattttaagacaacattcttaagactatccataaagttcaacatgaccatcattcttcaatcttctcttctttctccttctcgttctcctctttgttctcttctaaatctgcagttacaaccattaaacaagagagtaaacaaatctctaaagcttaaaacaactatacaaacaagaacttgtttcatttaccttaagcttcttctttctcttcttctttctcttcttctttctcttcttctacttcctcttcttctccctcttttggaaagcctcgcagccaattccttgtgcagattaatgcttggatattttcaggaagaagactactcctatatttactaaggactccgctgcctatgctaaatgacgactcagaagcaaccgttgttatcggaatggagagaacatcacaagccatgcttgataactccttaaagcgacaagagttatctttccaatatgctaggacattaaaatgtctaaaagcagccatatctaatgttggttcacctaaatatatgtccaattctgattttccactactaccaactttttgagagacaaatgcataaaatccctgagaaaaaattcacacaaatggagcatatgagatacaaagctgccagatagaagtctaaaaccaagcaatatataacacttcaagtctatcaagcttaaagcaaatcaagtgcaaaaacagattaaaactacaaaaacagtggctaagtaagaatttacttacactgtaacctgccggaatgtcttcttccaaagtttctacttgtgaagaggaggtgatgctacttggacgtttcttgtaagctttaaaaagcttatagatcttcgaacgcacatgagccaatctggacttactagttaatcgatctagagtactgaaacaatattccaaacatttcaacttaagtcttggatcgaatacagctgcaattgcgagaatgtcactatactcttcccagtatttttcaaacttaagagtcataatttccaccatttgacaaatagtctcatcaactgaaaactcatgagctctcaaccaacactctatcttccaaacttgcataaaatataagttggctgtaggataagaagaacccgaaatcagatttgtcatttcagaaaatggctttaagaattcacatatcaactctcctctactccaatgaccaactagtcaaacccgtttctgaccgtggatctatttaggcgtagtccattaaaaccatggtttagttgggctagaatttaattgtccacaacaatattggttgggctaagcccatggtccttttgaccaattgacagctctaataaaacctgtagataacaaaacaacacaagttttatatactataattaattgtcttctcaaagaacttaataggaagcaaaaaccatgtttgtttcatcccatttaaccaccttaaaatcgagatcaaacaattttacatatgcaagttcaacatacctccaaacatttagactcaagacgtctatccctacatacaaaatctccttgccctctttttttttgggtatgccaaaattttgaatatacgccaaactactttccaaatcgtttgcataacaaagatgaccataatctttttccttacgacgtttgtgaggtccactgtaatcatctggatcaagactctgatatagatatcttaaaccatatactatcgctaaaccatttagagtatcagtagtccatttattatttttaatggaccaaacacataaaattgagctgaaccgtatcaatccattaaaacttctgatatccaatattattataaataatactaaaaaactccttatgatactatatgaatatcacttatatacatgctcttatatggtgtgtagttttcatcccatccatgtagtcttctaaaggcgctgaccatgtcagtgatgacataagtccaacaaaggacatggttacgttggtctcgaatatactccgagacatctttgagcctttctctgatttcctcgtctagtagtagaaaattttctagtactcctgtctcctgatatcgtctaatatataataatatagttaaccttaaggcagtcaatcatcaatacgccatttatcctactaatttaactcatccaattggtgctacactattgacgtttgaaggttgggatgggtgtaacatatatcgcggacatgccttatccataaatacacttaaaattagtataaattttctgacttgccttacctgagtttgattattttcttagtaaagtattttgatattataatttggtagtaatataatcactataacatgcaagaactacaaaaccagaggtctctcaaatggacactcatttaattgttacgatagtaaatgtcacccatcaatgaaacctaagtcaattggatgatttgggcccaattggacctaattcggcccatttaatattccctcttttctaacctttgtttctcctcttgcttgctcacccttttccctgaatcttaagaattactaattcccggcgagttttcccggcggcggctagataatactggtttctgccagcaagatcgaaggagataaacttcgtaatcaaaaagtctccttctgataaaaagatg

SEQ ID NO: 20850 - DNA, 3003 bp, Unknown
  misc_feature (1)..( 3003): 2750-1469P.txt file - cDNA_ID_1829302; gDNA_ID_1620821; Annot_ID_50711
ttgacctctacattgtggaagtaaaagataggattggagtggtgtggatttatgttgcaatgatacttttgatgaaagtttcattttttgttatatagtagcttagttgagtgctagtaaaataaatgagatccattggctattgttggtgttataattactagaaatcttggaaaattttcaggatctgatgaaggtgtatatgcttgggttgttgctaatcatgcgctcggttcgcttggaggtgaacctttaaaaacaacgggaattgttgaactcggtggggcttctgcccaggttttatctcttgtcaaatctgttattgataagaaaatatgcgtatgatgccatttatcaggtttaggataaacctttacttgtatggtaatagattaattgtgagtgatgactgtttattcattcgtttaggttacatttgtgtcaactgagcttgtgccttctgagttctcgcgtacgttagcctatggaaatgtctcatacaatctctacagtcacagcttcctcgattttggacaggtaactcatgagagcagagttttttttttctctttgagaagttttgttcttggttggcccttttctgaagtttggtgtttggaaacttaatgtagttttgtccctatttactacttagtgatctctgattttctaagattcctcaagattgtagaccgtgttaccaaaagaaatgatttttgtccatactaattttcaaaaagctattaattttagtcgcctctgcaggatgcagcacaagaaaagttatcggaatcactatacaactcaggttaatttttgacaaatccttaaaataattgctctttggagttcaagcagttgaaataaacttctcttccctcaaaactcatacagtgtttcaatcctagcagctgcaaactctacaggggaaggaatagttcctgacccttgtattcctaaagggtatatccttgaaacaaatttacaaaaggacttacctggattcttggctgataaaggcaaatttacagccacccttcaagctgctggtaatttctcagagtgtcgatctgctgcatttgccatgttgcaggaagaaaaaggtaagagcatcattgttggtataggtgaatatcgttcctgtgtacaattttcttatgggtgcagttttggcacttttgtatacagggaaatgtacttataagcgttgttctattggatcaatattcacacctaatcttcaaggaagttttttggctacagagaatttcttccacacatccaaggtatataatcctttcaatttcatgttggtcgatgccaagattccgtcagaatgtgaggagaattgtttgaacattggtctttaatttctgtctggatcagttctttgggttgggagaaaaagagtggctgtctgaaatgattttggccggaaagagattctgtggagaagaatggtcaaaattgaaagtgaaatatccaacatttaaggacgagaatttgcttcggtattgcttctcatcagcatatattatctcaatgcttcatgatagtcttggtgttgctcttgatgatgaaaggtaaatgttattgcacaagttcaagatcaatcaatgttggttttctgtgacaaagatataaacaaaaagtcgaacctatgcttgttttgtctacagaatcaagtatgcaagtaaagcaggagaagaagacataccactagattgggcattgggtgcttttatccttaatactgccacagccacttttgattacagtggtaaatctagaaaaattcttgacttgagtaatgtagccaaatacaaaatatgacatttgttactatataaaacaaaattgtttcagataaaacaagtaaattattaatcatgtatatgtatttacgtcaactcgtgtttggagcttcagtcttcataaatctctttttgtgaattagttagctactataaaaaaattaaagaccaatttgaattagcttgtgtgaaaatgaaaatgtttaggaagctcagtccatgaagctatctgtgttgaagtgtattacaataatttctcaacaatcaatgagacaagatcaagaaccgtttatctgcaataacttctcaacatcaatgagggacaagatcaagagacgattgtgatggagaaagaaagtcaagacaattatgatgtgatttacactgtcaacacgtgtatcatatactgtagtcctcgataaaattaatactataaagattacagaccgatttaaaattcattaccacgatatgcatgaggacaactatttgatagtttttttttttatttttatgatagacaactcacaactaattgatccgatgcacaataatgagcttatagtatttatttcgacatttcgattgttcaagtcggatttcggagatggttttgtgatatttggctcgatcaaaattgaactcttgatggggatcataagctaaaccacgaaaatactcatgcttgcaataacgagtaggagagaaactgacccattgctagtgattcgtgtatccttgtgttaggttacacacgtttttttaaccactcaagtctacgtcacaaaaaaaatcaatttaccactaatattttatcttatcctcaattattgacccgtactataatttattttatagactagatgtagaatatattatataatagccaatagggatcggtgggaagagattcatttctttaagttataggtctggagcggccgttttgaacttctgattattaaatcagattctagactaattaagaagcaggcacaaaaagaaatagattacgtttcttattttcttgcgttgttttcactacatttattgctattgcgttacgtttttttaaactacgtttattgcttaatgctagtatttgattatcttgttaatataattttcgttacggttctttagacgttaatgcaacgatcccatgctccttcctgcaggttgaaaaatg

SEQ ID NO: 20851 - DNA, 3003 bp, Unknown
  misc_feature (1)..( 3003): 2750-1469P.txt file - cDNA_ID_1829306; gDNA_ID_1620821; Annot_ID_50710
caagataagagacacataaatacataattaagacttttagcaaaaatacataattaagatctaccataacaacgaaactgaaaacacgtaaagatataaattagaacttagaaaactggatttgagatggacagcttcctctaggcaaaactggacattcgataaactcagttcctgacgtatcaacacaaatatagatctgatgaagctgggcattacgctccggatctttgttacattctattcctggcgtaaatccaattccatcttttatcgcgttggtgatcttatccagattgtagaatccatcatccggattaattcctacatttacgaaaagaaaatggtcactggtgagtttaaaatgtacacatgaatagtacatttatatagtgatttattagtgtatataccggagtttttgaggatttggaggagatttgctttttgtttgagtttaagagcattttcaaagtactcatgttggtccattacggattcggagcatgtaccgtgtttctcccattcgtgttcccaaaagttgaacccttcgttgcttggacatgatagtgttggccaattctttttcaaactacttacgagatccgatatctatacattcatatacatgatagctaataatcgttgtttaagaattagaagaaaaaattacactatcaattatatatacctgagatctatcaaattggctatcgggatcacaatttgatggccatgaaccaccgttataattaggccatagaccgtggataccaaaatctgcagcgggtttaccggatgttggatagcaacaagcacgcgatgtatcgcaataggctccaggccactgcagcaaattcataaaatttcacattcagtttatatatgtactttgtcaaaaagaatgaataaaatgattactggatcttagtttaaaccagaatatatatacctgaagaacgaagtagaagaaatcaaagtcttcttgaggacgtgaaacgaaaagaccttgaaacactagaagcttgaggagaacgttaacacaaccctttgctcccatctttcttctcttcttttctgcgattgcatgattaagacgtttcggtttcaaaatttatagacagataaaaatgccatttcccttgtaataccatttttaattagttattcatctacgtgattagttaagagattggcatattctcttaagtaattcatttcatatttccgaccttattgaaaagtcatttttgtacgttttacaagtagacagtaaactcaatctcagaatttagtaaactgattgttagaagtttttttattttatttggtagcccttcattacgcgcaattgtcactatatatgtcacaatttttaattaaaaaaaaatagttaaacatgtagactagtttttgagaaactttatgattacaagattgttaatttacactatgttagaggacttttatatcccataccgcaattgcatggtatccaaaggatcgcagaccaactatcacttaactaaaaatataaaaggaccaagtcgatcggcaaatcgatccgagtggagattaaacaaaaaaggattgacttgaaaatatttccaagggatatccatttctatgcttaactaattttaaaatatgggaaggaattatagtatcaacgtacgttacaacttacaacatgtgagcacgtgacccaagcttcaagaaaatctcaaatattttatttatttatttttctaataaaaatgttaatatttcattagaaaatgaaaaagttaggaattacaagaatgtaaaacctatactttggtctcatagcaaaaaagaataaaaaacatggaagcaaatatcaatcggtccatcgacatcaacaaaaacagttaagcttttgaaaacaatgaatcgatacaacaattttaatgaatcgcatataagacacctcaaagaggaagataatgctgtcaaacggcaaaggtcgaaacaatgaaaacccaagtggatggaagcctttcaccggtaggccgagaacactgagccgtcaacggcgaaacacacatagcacacgaaaatctcaaatataaccaactaatgtacattttaacatggaattatgaattatatgctaattaatgctttgttaaggatccatccatattccatagcttagcaaaaaaggatccacccacgattagcgttaaacttaaacttaaacatgtcttatagtaacactttaacagaaataagcaaacatcatataaaagagctagaacatagaaaattaatcaataatgaaggagaaggaaggtacgtggaattataatttaattaggaagcactactaatccacttcccgatgatatgtactgatcctggtcgtggtttaacagctaggtttggtcaaccaagccaatgtaataaggtttgatttgattatttttgttgatttttgatttgatttgatacctaactgaatccaaagtttagtagtttaccatccatgaggttacttggattaaacataatgttgactgtaaaccggtccggttcatgaaagaaagacttgatacgttaaaaccggagtcaccctgtatcggtcagaaggacccggaaatcaaatggttttgaatgtgacccgaaacaacccaaacccgacccggtccgaatttgtgaggaataggtgtgtaatttgtaaaaaggcgctcccaattttcttctccactacgaaaacggagactgagagcagcagcgacgagcttcatcggccgtcgtctccgacctcactcgcgatctccgattacaaaaattagatcctcgattaagaattcgaaacatcaaaatttcatcaacaaaaaaaaatcagttactggatttacgtttcgtttgcgtcacagatcagatctccatgatcccttatccgctttcgttgcggttccttaaaccttgatgcaacggtctaatgctcgttccaggtcgaatatcaattcagatatg

SEQ ID NO: 20852 - DNA, 3000 bp, Unknown; identical to SEQ ID NO: 5844
  misc_feature (1)..( 3000): 2750-1469P.txt file - cDNA_ID_1829312; gDNA_ID_1620821; Annot_ID_50708

SEQ ID NO: 20853 - DNA, 3000 bp, Unknown; identical to SEQ ID NO: 5860
  misc_feature (1)..( 3000): 2750-1469P.txt file - cDNA_ID_1829330; gDNA_ID_1620821; Annot_ID_50702

SEQ ID NO: 20854 - DNA, 3000 bp, Unknown; identical to SEQ ID NO: 5859
  misc_feature (1)..( 3000): 2750-1469P.txt file - cDNA_ID_1829334; gDNA_ID_1620821; Annot_ID_50701

SEQ ID NO: 20855 - DNA, 3003 bp, Unknown
  misc_feature (1)..( 3003): 2750-1469P.txt file - cDNA_ID_1829350; gDNA_ID_2910741; Annot_ID_193690
tagggattcaagtacgggttttcagcagacaaactaaatatttccagcacgtgatggaccaaatcgtagcatgtacacaaagagagaaactgttacctgaatttgctgcacaagaagaagcacaagtaactaatacatcaaatccctccaaacttaaagctgttctggttacatctctgaatccagaatactcaaataacctaaagaagatgtattgggaacacccaactacaacaggagacatagtagaagtttatcagccaagtagagaaaggtttcagcaaacagacaaaaagcttcacgaccaaaaggccctggcagagatgtacctcttaagcctaactgataagcttgtcacaagcgctttgtcaacatttggatatgtagctcaaggtcttggagggttaaagccatggatactctacacaccaaagaagttcaaatcccctaatccaccatgtggccgtgtcatctccatggagccttgtttccttacacctccagtacatggatgtgaagccaaaaagggaattaacactgcaaaaatcgttccttttgtaagacattgtgaagatcttagacactatgggcttaagctagttgatgataccaaaaatgagttatagattttacaaatcgaaacagagcatctttctgattgtatgtaaaggcaaatgtatacagcagatgtattaaaaatcaaaacttggctactgcaatttggttacttactcgatccagaagttatggtccaaaggcaatgctcgaatacatggttactgcaattttaacagaacaggaccttctctgtcggatttgtgaggtcatgtcgatgttcttcaaaattcaagcactctcctaacttgtaatcgctcttcgttcacttcttctcaaaatagttaggttatctggagaaactggggtctattgaattattatatgtcagctaacctaaactatttggagaagaggagatcgaggcgtttacagattttgtgtttagtaaagacactagcgagactctggtgaaatagacaaaacaaaacaaaaataatcctaattttataggtttttggttaatatcatgtgtaatttattattatttttaaaatgtttaaaagtaaaaaaaagagttataaagctgagtttttaacaagtgtcaaaaaaatgaaatttgaattttaagttttagattttcaatattgcatataataaaattctggaaataatcatattattattttccgtataaaatagtcaatgttaccttacctattaaaatgttaatacatatcacaaaattaaatgctaaagattgttttccaagttaaatttgaaccattaagctgtctttggaaaaccaaataatatttacttatgacaattgacctaaactatatacattaaacagatatggaaataatcataaaggcataaatcttttcaccttttttttcttcttctagaaaacagtcaatattattaaatacgggcataataacttcttactatgaacgtttagcaattagcattaagctctctttgttgaaaaaaaaaaaaaaaaaaaattctctgttcttcttttgtaattttctttttatcaccttcttgttcttctttgtttctattttttattggcttttttcgtcttcgttcaatctgaatcattttttcatgactattttttaagttgcgttttcaattataaaaaaatttgtttatagattgattgacaatatggacaccaaaaaaccatccgatccatatgtcgagaacaaacatgttctcaaagatcaattcaaccaccaacaaatcaaggcaaggtacgttatgaatttatatatgaaactttataatttgttttctgttcatatttaagtacacattcaatatatacatattcaaaagatgaataaaacttcatttgataaaaattataatcttagttcaaaggtctatattgataattccattagaattcttaacatagttttcatagaacattcattcatacctctaaaaatccctgtggattggtttaatctgttttaatcgttgatttcggttggtttagtgaaaagttcagcataggcttttatctcttgattttgggcttagttgttaaaggcccatgagttcagattttctatttcaaaccgttcgaaacagagtagacctaaacagagtaacgaacgactctagtgaaggtagcttgttttgctagcaacgaaagctatttttattggtcattgcaatacgttttcataatactaataaagcaattagtggtctagtagcatttttttattggatggtagatgcaaaaagttttctataagaaacccgactagattagccaaattacatgcaacatctttaaaaatgatttcgagaagctgcctaaaaaaagaaaaaaggatttgaaacataacccattttaaaaccaaaacataaaagttgaattggcctatcaataagttgtcaaaatggtaagttttggataggctcatcactcataaatcaattttgtttactctctttattcttagtcaacaacgcgaatttccggatctgattagtattatttccataaaataaatgaatgtatgatttgtcaatttgaaaataatacatgacatgtgatgtattgtttggattccaagttctcaccattttgaggattattgctttactacaaaacaagtccctagtcacattggtcatttcttcgttagtttaaaattatatataactcaacttgatgattcacataaatcgaagatcaagacttttctagtttaaaaaaaagtggagtcacgttacgtagttcgttgattgtcacaacttaacaatgacccattagaatattcaaaagacttagtattatatacaaatgcatgtttcgtcacctttaattaagaataaagagttgtaatcacgctagatatataactcttttgaatcaatctcctagttatagctgatcatactaaagtcaacatg

SEQ ID NO: 20856 - DNA, 3003 bp, Unknown
  misc_feature (1)..( 3003): 2750-1469P.txt file - cDNA_ID_1829350; gDNA_ID_1620821; Annot_ID_50693
agggattcaagtacgggttttcagcagacaaactaaatatttccagcacgtgatggaccaaatcgtagcatgtacacaaagagagaaactgttacctgaatttgctgcacaagaagaagcacaagtaactaatacatcaaatccctccaaacttaaagctgttctggttacatctctgaatccagaatactcaaataacctaaagaagatgtattgggaacacccaactacaacaggagacatagtagaagtttatcagccaagtagagaaaggtttcagcaaacagacaaaaagcttcacgaccaaaaggccctggcagagatgtacctcttaagcctaactgataagcttgtcacaagcgctttgtcaacatttggatatgtagctcaaggtcttggagggttaaagccatggatactctacacaccaaagaagttcaaatcccctaatccaccatgtggccgtgtcatctccatggagccttgtttccttacacctccagtacatggatgtgaagccaaaaagggaattaacactgcaaaaatcgttccttttgtaagacattgtgaagatcttagacactatgggcttaagctagttgatgataccaaaaatgagttatagattttacaaatcgaaacagagcatctttctgattgtatgtaaaggcaaatgtatacagcagatgtattaaaaatcaaaacttggctactgcaatttggttacttactcgatccagaagttatggtccaaaggcaatgctcgaatacatggttactgcaattttaacagaacaggaccttctctgtcggatttgtgaggtcatgtcgatgttcttcaaaattcaagcactctcctaacttgtaatcgctcttcgttcacttcttctcaaaatagttaggttatctggagaaactggggtctattgaattattatatgtcagctaacctaaactatttggagaagaggagatcgaggcgtttacagattttgtgtttagtaaagacactagcgagactctggtgaaatagacaaaacaaaacaaaaataatcctaattttataggtttttggttaatatcatgtgtaatttattattatttttaaaatgtttaaaagtaaaaaaaagagttataaagctgagtttttaacaagtgtcaaaaaaatgaaatttgaattttaagttttagattttcaatattgcatataataaaattctggaaataatcatattattattttccgtataaaatagtcaatgttaccttacctattaaaatgttaatacatatcacaaaattaaatgctaaagattgttttccaagttaaatttgaaccattaagctgtctttggaaaaccaaataatatttacttatgacaattgacctaaactatatacattaaacagatatggaaataatcataaaggcataaatcttttcaccttttttttcttcttctagaaaacagtcaatattattaaatacgggcataataacttcttactatgaacgtttagcaattagcattaagctctctttgttgaaaaaaaaaaaaaaaaaaaattctctgttcttcttttgtaattttctttttatcaccttcttgttcttctttgtttctattttttattggcttttttcgtcttcgttcaatctgaatcattttttcatgactattttttaagttgcgttttcaattataaaaaaatttgtttatagattgattgacaatatggacaccaaaaaaccatccgatccatatgttcgagaacaaacatgttctcaaagatcaattcaaccaccaacaaatcaaggcaaggtacgttatgaatttatatatgaaactttataatttgttttctgttcatatttaagtacacattcaatatatacatattcaaaagatgaataaaacttcatttgataaaaattataatcttagttcaaaggtctatattgataattccattagaattcttaacatagttttcatagaacattcattcatacctctaaaaatccctgtggattggtttaatctgttttaatcgttgatttcggttggtttagtgaaaagttcagcataggcttttatctcttgattttgggcttagttgttaaaggcccatgagttcagattttctatttcaaaccgttcgaaacagagtagacctaaacagagtaacgaacgactctagtgaaggtagcttgttttgctagcaacgaaagctatttttattggtcattgcaatacgttttcataatactaataaagcaattagtggtctagtagcatttttttattggatggtagatgcaaaaagttttctataagaaacccgactagattagccaaattacatgcaacatctttaaaaatgatttcgagaagctgcctaaaaaaagaaaaaaggatttgaaacataacccattttaaaaccaaaacataaaagttgaattggcctatcaataagttgtcaaaatggtaagttttggataggctcatcactcataaatcaattttgtttactctctttattcttagtcaacaacgcgaatttccggatctgattagtattatttccataaaataaatgaatgtatgatttgtcaatttgaaaataatacatgacatgtgatgtattgtttggattccaagttctcaccattttgaggattattgctttactacaaaacaagtccctagtcacattggtcatttcttcgttagtttaaaattatatataactcaacttgatgattcacataaatcgaagatcaagacttttctagtttaaaaaaaagtggagtcacgttacgtagttcgttgattgtcacaacttaacaatgacccattagaatattcaaaagacttagtattatatacaaatgcatgtttcgtcacctttaattaagaataaagagttgtaatcacgctagatatataactcttttgaatcaatctcctagttatagctgatcatactaaagtcaacatg

SEQ ID NO: 20857 - DNA, 3003 bp, Unknown; identical to SEQ ID NO: 20856
  misc_feature (1)..( 3003): 2750-1469P.txt file - cDNA_ID_1829350; gDNA_ID_1620821; Annot_ID_169476

SEQ ID NO: 20858 - DNA, 3003 bp, Unknown
  misc_feature (1)..( 3003): 2750-1469P.txt file - cDNA_ID_1829354; gDNA_ID_1620821; Annot_ID_50692
cacatgaagaaatagctaactaaagaaaccacaaacaaacacaaaaatcctcttatagatcaaataacctatcgaatcatatacagaaggaaagagtattaattcagatggaaacactcccaagccccaactgatattccttgtaaacaaagaaaccatcaaaaaaccctagaccctcttaattaatcattctttcgagagaaaggcttgaagctccttctctatgtgttcttgagcagtttttttggccgcaagaaacggacgatagtgatcagtgagcatccataccatacatttggtcatcatcgcaaagactccaacgttggtagcttcatcagtgcaatcttcccagtcagtaaatggttccttgcaaccacctcctctcatgaacgctgaaaacacctctcctttctcttcttcttcccttacttcatttggggatacggattcccctggatctcgccaaacagttgacggcaagaaatccttcatcatcagttttcttcgcatcgagaaagggaagatagtaatcagaatgtctctccatacacttctccaacatcgtataacacaaagatataggttccttattcttcttctcagcttcctccacacaacctttaaaggccgtataatgtttccttggatgcaccttctttcataaacacttgtaatcgattttgccaaagacttcacgaatctcctactttctctggctagacttgttttttttttgagatttggtatcggaattctccggtttcagatccgtggatgacaattaatcagtgattatcatttcattaggtcagagaattacaatatatgtagggatatgataatttacaattaagtatttgataattgcaattttttaaaatattcgataattacagtttctttacgcatgtagggatgtagtcatgtagggatgcatcatgtctatataacataagacatattgggatgcatcagaatcatataacataaatagtttggaaccaaataaacgttgaacgaggcttttctcacaccatatatcttttcaaaacatactaacaagtcaaaaattgatatccatgtaacttgaaaatcatgcacagacaatgctacctttgaatggtcattaaaaaaagaagctaaacacacttcagatccaaccatatatgtgatcaaagccagtgataaaagtcgagtcattcttggcagctaacgactaaggtaagcaaagaatcatatggtcatgtatggaggctgataacagagatgaagttctgtaatgtttcacatctccctacaaattagaaacacgacatacatacataccaggcaaaactgggatctgtaaaaaaaactatcttcgaggagatatcaaccaaacagaacgtcatcgatcatgaatgaaagtgttaaaaacaaatgctagtgtatcttaagcacaaagtgagtcaacatagaagtaaacttgatctttagacaaactagaaaatgctggaaccagaagctatcactacaaaaggtctgaccttttctgtttcagaagcaacaaatcacattccaatgagaaatagcttagcaaaccacaaagaagacaagatttcttcactgaaccattaatgggtctcaacaaaagtcatgacctttaaagagcaaattctctctcgaatcatataaaaaggagtatgaattcagatgacctcaatcaatcaacttattaattagagaagaaacatgatcatcaatgggatcttataagttatgattctaacaacgaactttcctctgttcctagagaacaatttttatccccaaattccaatcttttgatattcccataaacaagaaaccataacaaaattacccttgagcttgcttcttcgcagctacctcctcttccgagatcttctcttcttcttccttcttcttctcagcttcaagctccttcttaacctctgcttcagcagctttctccgcagcgagaatgggctgatagtaatcggaatgttcatccatacacttcttcaacatcgaagtgacttccatacaattagtaacaatatcttccttgttcttctcagctgcttcaacacactcttcccaagcaacaaacgaatctttgcaaccacctcctttcataaacaagcaaaacccacactctccttcctcttcaccatctgcgtctcctcctcctccttcttctggtttttcatccgattcggaatcttctgggtctctccaaacagttgatgaatctccgagttcctcagatggagctggagtcgacggagacgcatctccgagtttctcagatttagctggaggagcttcttcgttgttttgagatttggggtcggaaaaagtctctgtttttggatctgtggatgatgtaattcccatttttctctcaggagagagtgagatcggatcttatggaaattggaggattcaggaggagaaaaagatgtctctttttaagggttttaaggttctctctcggtgccgccgccgattctctttacaagccagagagaaatgatcaatcgaaacgtctttatgttaaaacccctcaaaaacctttctattgaaccggatattctaaaccggaccaaaccgaacttaaacctttgttaaaccgtaagaatttaaccaaagtgaatatgataaaacaacaacaaaagaatgatctgtccacaagacgattcaagaataatgtattgttaagatttcaacatcaatgtttgttgctaattaaacacaagtctcctatttgctacaaatcgaatatagacaccaacatcattcgttttatagtaataaaaggaagataaatatagggagtaatcattagattaatattacagtcgctttcagatttcgtcaaatttcacaggcagacaagtttctttgacttggtcactataagagttgtaaactctttgataaataattgaatacagcaattatttcaaatctccggtgaagtttttctgggctctaagtatg

SEQ ID NO: 20859 - DNA, 3003 bp, Unknown
  misc_feature (1)..( 3003): 2750-1469P.txt file - cDNA_ID_1829358; gDNA_ID_1620821; Annot_ID_50690
gataacaataatatcacatcagttttttctaagttgttgatgagacaaaaatctagttattctagttaccaatgttaaaggcccattattctaaaaggccaaggcctacattttatttttgttctgatgtaattaaattgttaattgtctgtatttattttcatttttaaaaaattatctttttaacttatggtagcttcaacttctttttcttttttttttttgtcatctcaacctttgtaagaagaaaaatggtcaactatagcttcaacctcaaatctactgacttgacacttgagttttaaataggtaacatctcatggagatcccaatattcattctaaattcctccaagataatgcaacatgttacaacaacaacaacaacaacaacaacaacaacaacaacaacaacaacaacaacaaaagagattggccgagacatatatgtagtatgtacccaccatatcacacataccttcataatcatcatcatcatcataatatcaagtggtctaattcaaatgtttttgatttaattatgtgtttaagtagttcatatttaattgtgtgctaaaatacttattgtaattgaagaatcaaatatacaagtcttattcactattcttaatcaaatagaaattagtcttaaatttgtaatttagggggtacaatgatccactattctccatcaacgtagaagacaagtaatttactttgtaatataggtaatggtacgtacgtagtaatcacatgtaaaagcggaactttcctttctcttgttttgccggcttgaccacgggatatgagaccagtaaggtacatgtgtaatgtgatacctatcagaaaccctattacactcttatcaaaaaacaaaacaaaacctattacactctctcggcttaattaagattatgatcaattccaaatatgtttctgatataactttaattattaacgagaaaaccaaagtttattgctacttttttccgtcgaaatggccgctattttaagttttagacaataacttggtccatgaaattaaggtacaacgtcgatattgattaagatcagtttacttttgctaatataacgtgttaagtttgagatgggagacacgtgaatgacttttcattactttcaaaaattgttcaaaattccaaaattggcaacaagactgttttagttgttaatatgcaattagactgtttcaatagagtgtatttttctttgtcaaaatgtaataagtactaatttgtcatacaaaatatcaaatgtcaagaacataaactcttctaacggaaccgcttgtcgcgccgaaactcgtgtggtaaacctgaaaaacaactcactaatcgcaattttaaatcagagactgagaaaacacttctcacgaaaaccacaaaacgcggtcaatatcgggatgacgacatgatgtggtggtcggattgacacaattcaggttggtcaacaaaattcatccctctaaaatatattttcttagttcgttgccaaacagatatcttacctttactcttttttttttttttttaaaaactcatataaataggatagttattaaatttaactacaaatggtattgtatatgtatattctatggctaggtgaaaaggcttcctttagttcgagaaggtcaaaatggatggctaattaacttttatatacaaacagtatatgcctaacatttaataaggagagactcagattccttgtcaactactcactattgtctccatgactctttaaaaaatatatttttatagaatcttagtattcagaaattaaaccgtagcctttataggataacaaatgtagatgatgttaaatatgaaaattggctccacaactgtccatgaggcataaataactcgaaaacttaattagtttgatcttacagataactaattttttgtcacatttattataccccaaagtatcttaataatgcttgtcggttcaagttcatattttttcctcggttcaaaatccaggctatttatccgttcttttttaattaccttcatgataacttgtcaattttgtatttcttattcatgatttttctcatgcacatacctaatttacgtcgattaagatccatgcaacgttcataaaataatgagatagtatattagtattagtatcacatacataacgatataatattttacaatgtatttgcatgtaaagcattttcaacaactactacttaatccactttggttctgtgcaccatatcgaccttgagccgcccatataccgcgactagggtcgtccactacgaatataaaaatttatcgttataaatataaataattgatatatttcaatgattgatggattaattaatataaataaaacatgtcaatgtaagactaaatgactaatcagcgggactaatcaactcctctttttttttaaataattcaactggtagatcaacgcgggtttttaatctcttgtaagaactagtacgaatgtacgataataattccagtttctcacccgaaaaactgaagcataatgtttgctcacacactgacacacactgtggttaaataaaatatcgaaagttaaatttacaaattgttttatcgtaatacttgaaaaaccaaagattatattatgtaattataacaaaaagagatataataaattactggatttcaaatctctatatttttgtctccactttatcaaaaaaaaaaaacatcagtctccactctccacgcgccttttagtcgccctctctgaatacactacagtacaacgttgaaaagaattcaataaagaagatcaaaaagcaataaagttaatccttactttaattagaaacaattttctaatcataaacctttatcatatcgtcaaaacatatcatgaacgacttgtctctctctgttctctatatatatatgactcctcttcttcaaagttcagacacaaacataaactagcgtttaataaaaaacaagaaaaaatg

SEQ ID NO: 20860 - DNA, 3003 bp, Unknown
  misc_feature (1)..( 3003): 2750-1469P.txt file - cDNA_ID_1829365; gDNA_ID_1620821; Annot_ID_50688
tgctgggacgcagacatgaaccagagaccgtcgtttctggacattctcaagagacttgaaaagatcaaggaaactctaccatcagatcaccattggggcttattcacttcataatacacaaaatccattatttaagcacaaaaacaaccagaaacaagaaagtatcattctctgtttgccttattaatctctgtttcatttcttttgtaaagattgtttctttttcatcttttcatttgctttaaaagagtgtgagatagaaagcttttattgttgttacatggattggattgagtttgcaggttaatgagaagttcatatcatatcagacaggataaaatgtctgtttccgaaaaattcagtaacaaaatgaaaaatgagttcagtagtgtatataaagctatagtcatagggttttcaatacaatctctgccctcaggagatggtaatggttttcagataagcttctttttctggaagaaagtcttcaagtgccaaaactgaagacctgcgaccgataaacaaactgcaagcgacacgaaactcaaccatgccatcttcgaatttgtcgctatgttcagattgtgcatttcttcttccctgtaatataccaaatgaagaagggttttgagttttgattcactctcatcctctgatcaagtgacttcaagggaagacaggttttgttgtcattacctgtcgcggagatagaacatctcatcgtggattccattcacggtttcaaataacttcttaacctcaaactccatcgtctggccaataaataaaacaagatccaaccataacaaggttaacaaaacattccttcaaaaactctgcaatctctttaagaggctatgttacatttcaagctagtcttgctctgtagtatgttaaagcctagtcctatctaccacatttcaagatagtaattttctgcgtctgttaaagcctagtcctatccaccttcatttagcagggaaagaactcctgaatgagctgaagaaatcgatggggttcaaaggtgaaactaatgaagctattttctcatatgcaagactgcagacacaggtcagtaacacacgagccctgtcagcttaattcatggccttgttctaaccaaaccaatgcaccaacataacctataaaccaagactacatagcatttctcacttcagatataactttccactttccagcactatgtcttggtgtaacttaggcagctatcaaattctcacacatccggcgcaatgctctattgttcatgtcattagaagcatcaaaatctatttcctctaaagagattagtttgactaagttaagacttcaagagtaaagaaaaagcgaaaaacttacttcgacttggctcttctttgccacattcgaccaatccttggtatgaatacccgtcctccaatcaaagtcaatgatcagcgtcgtctctggtttgtgatcgacggcggagaagcaacttatgtaatcccctgtttccacagctacaaacgagaattgtcccgattctactccgtccgattcgtgataagccgtcccttgtggcgatgtgaccttaaaaatcaaacacattgcattatactgaaatcgccggaagaagaaattgaagggaaatgcgatccgatcggatgattattaccctgacggtgactttatgggaagaaggaagaggatgatcctcgtgagggtttataatgctgtattttccgatggtcattgcgtttgcgtgaatctcctctgagatgcatttcgtgtgcccagaaagtagctcgtatcgtatagagagtgtcacgggagataaaattgagaggatcaatagtacgatcgagctccgacgatgattcatgacggctccgatatagagagaaatcgatctgacggatttcaaagtttagctatttttcttgttaaacggaaggaaggaaacaaaagaaagtcaacacgtgcattgccacgtgttagtatttcattcgttaaaacacgtggagtactaccctctggaattgggctttaaaattaaggcccattaataatgttggacctatatacttgtagtggatcacactaaagtaagttagaagtaaataaagaaacaaataacacatccagattttataattcaagcataactacatatgacttggtaatgttaattttaaacttaattgggaaattttgttgaaaagacaattgtactcgagtttttagtaaagaataaaatagtaatctttccttggaagggatgttaataatgcaacattgaggtacgtgtcatgatttcgtttcagtttttgttttgttttacaacagcttgaaaatatctgaataaaggagatgaatataaacagtggtttgaatcgtgattagtgcaataaatagatgacagtaataaaaaaagtacgggagaacaattaggtgaatccgttgacgaatgacaacgactatcaaaaaggcaaaatgtgtcatctttctttatatgtttttcaatgttgaatattcttgaaatctttatttatcatatgtttttctgatcaatcattatccttgaaacctatttttttttttttttggttatagaataatctttgacatttaatgatatatataatgaaacaagttaggaaaattgaagctttctgaattaggaaataaattgtgtaagcaatagaatgagtttcttgggaaaacaataaatagaagaagaagaagacactttgacggttaattaacttattttcccatctctcaccgttaccacctcttttttttttttttccgtctcgtgatttttttttcttcttctgaatttcgaaagaaaaaaaaactcctcgagattcaaaccatttgacacaaaggagagaagaagcatttcatttcgcgtttgtcatctaatttcaatttctgacatctcacaagatcggagaaatttaggttatagtaattttattctcatgaagcggcgacgacgatcgtcggaggagggagatg

SEQ ID NO: 20861 - DNA, 3000 bp, Unknown; identical to SEQ ID NO: 5834
  misc_feature (1)..( 3000): 2750-1469P.txt file - cDNA_ID_1829369; gDNA_ID_1620821; Annot_ID_50687

SEQ ID NO: 20862 - DNA, 3003 bp, Unknown
  misc_feature (1)..( 3003): 2750-1469P.txt file - cDNA_ID_1829372; gDNA_ID_1620821; Annot_ID_50686
gtgtggaacccaccaaaggaaaaatatcagtagattcaggagagttgttaaattttgcctccacgagtttttttcttttcttcttgttgagtcgtttacgtcacgtcgagaattttctcttttcccgagaaaattaagaaaggatcgtttgattttctaagaagggaaagataaacagtgaattagaaagagaaggaagtttcaatggaatcgctaacatctatttctccttccataattcttcctccggccaccactactacgatccccgtttcaacttcacgatcagtgttgattcgtcttccttcacgccgttcttcttaccttttcggcttgtccagctccgggagacggatttcgatttctagaagaagacacttcgttagctgtaaatcgaccggcggcggaggaggaggatcagataagcttggtggcgatgaagaagagagcgaggaagttgagaaggcgcttcacttggatggtacgatccctgggacttccgatgagtttgtaaggcaagtttcgtcgcgtgcttacgacatgcgtcggaaacttgagcagacgtttgattccactagctatgacggtataatctctatcgctctcaattcctgcgtttactttgattttggtgatgcaaaattaatactttcgttgatgcaactaacttgatcagagtttcttaaagattgtctaggaagtttgggaactgtagtagtttgaaattcccttagtgccttgtttttgttaacaggagtcaaatcgttttgttgaacaatgtcagaatttagtcactgtgtcacacacaaccggtgaagaagctctccattgatagatgtagtgttagttatgattcaaaagtttgtgttctgcataccatttctttagttccccaggagaagagtgcttcagctgaactatgatgaggaaaattgttcatttctagattccactcttacagtaagattgcaagcacggttttatcatctcatctttcacatagtgctgatgcataggaatatcaaagcaataggaacataagtgttttattcaatttaagcttgtattcatctaaagttaataaattgatgttgttcctttagtgctctgtatctttgactgagtgatttcgttgagaaccatttctctcactgtggcttctcacaatcttagtgttggagtccaacccatggagaggagattcgaagcctgtatatgtattaacacatagagaaaaccagatatgtaccatgaaaacaagaacaaaccacaggttccaactctattccactcaagtttttttttatagttttagttttcttctccctatgacattagcaatccttataaacagtgaagtagaaaaagagcttggactgttgttccctagtaggatcagcaaccagacaaagcaggctagacccaaaactaaattcgatatgctcgtagaagacattcgagatggagtactggtaagtattctcactgaatcactttcaagaccttatgaaacccagacaacgtgatatgcctagtttttatctcaaaggttttcgaagatgtgaatgaggctgttagatactgtgacctattacaagggggagggaaagggtgtgaaggtgtcgctgagattgaggcctcctctgtaagattatgagacaaagatatcatctaattctagaacttgttgcctttaaacatttgaaatgatctgcttttttttttttgaataggtttttgatctttgtcggaaaacaaggtctctggcagtgctcttccgccgtggaagaacaccacctacacctcagacgctggaacgtaatctcggatcccggaagcgttctcttgaggacttgagggataataaatagcttgtgaaacaatgtattaattttacttgcaataattgaaaatactttgtatagactaaacagtaattaaccgtgggtgatactgtgtatatatataaaatgcattttacttgtgctccataacttttttttgttccttataattctcttgaagttgcgctcttttctttgaaggctttaaagctaacactagtaggtaatgtattacttggtcaatcaacatgtgagtatttatagtatctatgattagttgacaaaaaagaccattgtatattgaacttcttaacatgaaaaatagtgacttttttttgtttagataaaaatagatatgctaaaggcatatgctagtgtattattaataaaaatcatgtgatagatgtgattccatgttatccggatcgttgacttgacttagtacccataacgtttattatataattcatatagcattttatgattgtcaaatttatatttatacatatgatagactattatgtcaaaaagacaggtaaagccactttgtttacttattctttcttaactcaaaactccaaagggtaaaatcaaggtgaccattactctttcagtttcaaaagattgtattattgtaacaaggtgaccattactcttaaaatttattcaaaaataaccaaatctaaactaaaacgtaactaaaatttgatattattcatgaaattctaagaacaaatccaacatgatcccttaataatttccctttagtagtctagccttcttagtcggtcactaataataaagagtaaagagaccaaaagagagaagtcttagataacggtgacagagttaaaaaagaactcactaaaatagacggaggaaaaagtcatcaattcaacttgacggctaagttaacggcgattatcttcgttcacacaagcaacacaaaagagaaaacatgaatcatctctctctccctctctccggttccacagtaaagaattgattcctcaatctcacgcggaagcaaaatccaaattctaaaattctaagaaaccactctaatcacatcgctctatcgatcaaaatcgaaacccttattcaaaaatctcttattttttccatttttctctcaatcatctgaatcggttttgagatg

SEQ ID NO: 20863 - DNA, 3003 bp, Unknown; identical to SEQ ID NO: 16447
  misc_feature (1)..( 3003): 2750-1469P.txt file - cDNA_ID_1829376; gDNA_ID_2910741; Annot_ID_193681

SEQ ID NO: 20864 - DNA, 3003 bp, Unknown; identical to SEQ ID NO: 16447
  misc_feature (1)..( 3003): 2750-1469P.txt file - cDNA_ID_1829376; gDNA_ID_1620821; Annot_ID_50685

SEQ ID NO: 20865 - DNA, 3003 bp, Unknown
  misc_feature (1)..( 3003): 2750-1469P.txt file - cDNA_ID_1829379; gDNA_ID_1620821; Annot_ID_50684
atataattcagagtcatatcattaataaaattaatattaataaaataaatgactttttggcaagacgaatttggagggacgggtttttgaatcaacattaataaaaaagtaaaatataattaatccaccgttttaatacgggttaaatctttaattaattattttttaagaccactaatattaaacatatcaaatcatcctaatttagaaaagattatataaaaccaaaaatgttatgtggtatgtataatattactatatataaaattaaacaataaaatataaatgtattagagaatgatacaatgtgcaaaacttttatatataaaaaataattcttaaattttaaaaattactactttaaaaaaaaaatcacgggacgggtaaaaaatttacagaacgggttttattttggaattgggttatatggtggatgtatttgaatcaatatttataaaattttaaaatattattaatatgctgtttaagtagggattaaaacttcagttttttaacaattatctcatgaattcgtggtatagtgttatttaataacaattataaactgtaaaataaaaatattttataaaaataaaatttgcaagttttaatatatattacttttaaaaaataaatcgtcccgcagtatatcacatgttaaaatctagtttatatatcattttgatacttttttaaaacagagaccggtgcagtttagtagttacgtggataccaaatatatcatacaagttaatatagaaattaagaatcagatacgacgttccaaacaaatacttaaacgtgtgtagaccttaggaaacattgccaactggcaactttgtattatactaccaaaatctagatatctataaatctagaggtgtgtatgataatgaatattgaatagtatatgtttgatattcaatgttatactattcagatatcaaatacctggatgtatatatgtcaactgaaaacaaatataattctcttagtatgaagactatttacatctaaatcatatgaataactaattaactttttcttcttttttttgttaattttcaaaaactatgtcatttgttatgtattacataatcacttaagatatatataaaaaaaaatgccctaacgaatttcgtccacaacatatgaatcgagctagctatttagatatttctattatgcatatgatgaatcatagattgataaacatattatatattttttgaaaaatggtagttcaatttcttttgacactaattaaacatgaaagagacatgtccttcgggtgtaagaatacctaaacagacaaagcagagagtcataaatatcttatgattataaatggaagagacatataaaaaatgtttattgtgtactaatcccttatatagtttatgttggacaactccatattaatttaggtttacttatatttcggttatgaaactctaaaaagtattgtctcccactatccattaggacaaactggcaaaggcaaccacctcaacaacatcaaagaacaagaattattcaactgttctacaaaactatactagtactattacagttgtttgtagcatatacttttccaaatagaattttatacgattttcttttccatattttttgaaaatgacaagtgatatgatttgagaaaaaacaaaaaaaaaaaacaaatttatacagtgaggcctgcaagaccataaaacaaactaaagccgttcattaaggttccattaattgggcctatatttttctcgttatattatgagcctgttataggcccattagtaataatttatcgggttatgaagtaaattttcagataattaagggtctcaagtataaatatcttaaataacagacccatctacctggaaatatgagtatttgggcagagaggggtgttttcgtaaattcaagtacatactttatttttatttttttgctttcttcgccttttgctccctcctcgagaatttccgatcgtgctttcctcaaaagcatttctgtttctcgtcgtcggagcccgacgacagatctctgaatcgctggagaaacagtaagtaaatctacagatctcgtttcttcgaacttcttcttcgtatactatttgtttgtatcgttccttcgttgtgcattgatgttcttaatgattactagaatctaagtcagaagttacctctatttgttcttcttctatatttgaactagatttcgttctagcgtcgaacaaactcctcgttttctttgattcgcattgctggtgattttcctgaatttcgagatttagcgagacgtgtctcgagttctcttgtgttgacgggatttttcttatctggagaactgataatagtttcatgacactgtcactggtctgttgaattgtagtttaaacttattccatcggatatagtgactcttaactctataagttgctgattttgtagatgggtttagtgttatcaggtttattgatgtaacaacgagtttacaaactttgctatttagggatctgtaggaattcgtttttttgggggctcaaattgttggaaatagttgcttagctattcacaatctaaatgtgatttgggaaatctgcaacatatgttattactatggaagaggttactctatatagttactaaattatcagcatggtttctgaccattatagaattctttgcttgtggtttatttgtttgaatcaaagtggtttcattcagagacagcgttgtagattttgattatctctgtaatgtatgatgtgaaaagttacgccactttctatcttattagctcttgaaatgcatctattatctgttttaaaataagattttttaaatttaatttgtttttttttgccagtaatgattgagtttggcctctatctgtgaagggtatatgctccggctgtatctactttatattctgccaggaagattgtgagcattgaagtgccttgggctctggctgaagatttgagcagattaaatg

SEQ ID NO: 20866 - DNA, 3003 bp, Unknown; identical to SEQ ID NO: 20865
  misc_feature (1)..( 3003): 2750-1469P.txt file - cDNA_ID_1829379; gDNA_ID_1620821; Annot_ID_169464

SEQ ID NO: 20867 - DNA, 3003 bp, Unknown
  misc_feature (1)..( 3003): 2750-1469P.txt file - cDNA_ID_1829383; gDNA_ID_1620821; Annot_ID_50682
gctgcaaccatgtccgacgaggagcatcactttgagtccagtgacgccggagcgtccaaaacctaccctcaacaagctggaaccatccgtaagaatggttacatcgtcatcaaaaatcgtccctgcaaggtttcgttctcaaacatttctccactctcttcctctgatcttattagatctgttcattacttagattcctcagattcttttttttgtcacctccacgatgttcgactgatatttgttcttgtcatcattgttaaattcacattttattgcacttttgttttagcgaaattattaaattggtcatcttcagttttgttcgattagataagttttaggattttttcttacacaagttactggatcagctgctaaatgtcattttgtgtcgcaggttgttgaggtttcaacctcgaagactggcaagcatggtcatgctaaatgtcattttgtagctattgatatcttcaccagcaagaaactcgaagatattgttccttcttcccacaattgtgatgtatgtgaaaaaagctcctttgatcactttcatttcttgtttgtttctttcaagtcccatttgagattttgtttttgttgaattgggtttcaggttcctcatgtcaaccgtactgattatcagctgattgacatttctgaagatggatatgtatgtgttcttaaatagcacttgttcctttatatggtttagttacttgttctgttttgtaatcattttgcaggtcagtttgttgactgataacggtagtaccaaggatgaccttaagctccctaatgatgacactctgctccaacaggttaagttttgcatgttcatcacattaaatgttgctagttaattaaaatcaactctatgtcgatttctgaaaatggaagaaaaagtgcagagtaatgagtgacctgattgtgttaatgaaacagatcaagagtgggtttgatgatggaaaagatctagtggtgagtgtgatgtcagctatgggagaggaacagatcaatgctcttaaggacatcggtcccaagtgagactaacaaagcctcccctttgttatgagattcttcttcttcttctgtaggcttccattactcatcggagattatcttgtttttgggtgactcctattttggatatttaaacttttgttaataatgccatcttcttcaaccttttccttctagatggtttttatacttcttctaattgattgattctttatggttgtccaagtgtcaaagtgttccacccatatgattctaaccttttgatgagcgaagtctttactcgtgcgttatgtagagacgtagaagcaataccacaaaagagtataattatagatatatgctaacaaaactcaaaagttaagatcagtttagtattcaaaattgaacagtaaaaggttaaaaaaaatatgtatacttatgaaaataactaaattcatagataatcttttaaaattcagagtttctttttcttatatcaaattcaaaatgaaaacacaaactaaaataaacaacgacacatatcataaggtcttttatattttgtattagatcaaaactattattgcaatcacatttcttgtggtaataaatgaaaggaattctactcctaaagccaacgtgtgtcccacacaaagtaagaagaatgtttatattatcttttgctcttgcaaagtcaaatgtatcttcaaaaagtcatgttgctagttttcttttattcccctcacgtcatcacggttcctcctcctattacaaatatacacacccaaaaagtccactaacatgaaatgctaaagttaattttagaaatccattgctttcacgtgaaaaaaaaaactattacagaaataacatgtatttatacagtttactaatagtcatcaactcatcatatatggtataaatatttgtcgaaaaacagctctcatgatatgtgtaggcttatattcgacagcccattaagacacaaaatgggccttttaaaaggaatgtcagttgtcaatatctgattcgtacaacgtggagtagctgtggccttgtccggttgtctctctctgcctcttcgctccaggttcaccgtacaataataacaaagaccgacgcttttgtaaaagtgaaacctaaattgataaccaaataatttgatcaatttggtacaacttttgttttgactgatgttcagattttcttttcttcttaattggtatagttttattttctttttaaaatgtttggatttgtaattcatttagcattccattctaataagatttatctttttctttttaattatctctttacatgatactactatactatttgtttaaacaaaaaatatagatatacatgcatattccatatttaattaatgggatcgaaattcaacattaaattaatgtacctgtaaaaaattaaatgtacaaaacgacagaaaaactcaaaaaagcagattttaaacgttatattttccaattttctactgcctcctgaaaaattggatttggacatgtctgaacattactcaaaataaataaatttagctagtttttgaaataagaaaacatagtaagtaccgttttgaaggagaaaaaacaaataaagtactttttacacacgaaaaaaaagaaagtaaaggaaagagcttgtttcacatatatctgcagcgtggactttctctactgcgaacccaaaaagttttttaatctttttatgtttccagatccgttttaagaccagaagtacaaaaaaaaaaaagaaactcgaaatctccattaaaagagcctatcgataataaaaagaaaaacaaaacggcaaaaaagtgaagcgaaacacgacacggattcacacaatactcagatatatacaaaaaggattttagattttgattcagaaccaaaaataaaaaaaggaacttttttatttctttgtttgattttttgggttgttggttttttttttgtttgttaattttggggatcgatg

SEQ ID NO: 20868 - DNA, 3003 bp, Unknown
  misc_feature (1)..( 3003): 2750-1469P.txt file - cDNA_ID_1829387; gDNA_ID_2910741; Annot_ID_193674
ttatttcacaaaatagctgcaaaaatgtatatatagattaagtgtctttcgtatattcaaaaattaggagtttcagtttagaaactctcggtttacactcagaaaatcattcaaacctattcaaatgtagattgaattattgaataggtatgtaattgattatttaattattgactgtttctccataaaaaaatactataaatacaactatgtattataactccctttttcccctggaataagactgatgataagcccattgacaaatacagatttgggcctaaatcaccccaaaaaaaaagaaagaaacaacctctccttgcctttgtagcaatcaaatttcctaataagggcataattataatgatacacaattagtctacacaaacgagtgagacattgatggtgtaactcgtgttctacgaagtgtgactatttacatttgttcagcttgaagcttatttaatcccttttatttttcttgtcgtgaaaatctaatcacagtatcacactacgtttttttgtttgtcccagcagttaataaacacacacaaaaaaagcttcgatatttgggaatttttgtagttactagacatttttacaaactattacttaatatgttcatattattaatttcgttatggtttctttatttaattaaatcgttcaccggcttgtgtacgaatgatacttgatgctataacttggaatctgaaagagccaatcaccgaattttgtcgacagggacgagagaaaaagggagaaaaagatgctctttttctcgaagggtaatttggtaaattaataaatggcagatgatgtaattaacgtggaagttaggtggttttatttgtctgaaaaaatgtaagttcgaaacggaatcctagattcgtggacacagatcgttatggggattagagagagaaacaaatgttttctttttgtctccagaaaataagagagccatgagttactctcatatcttataccctttttacccttctatctagttgtagattttttttaatcatttctttaattattaattgcgttaaattaattattgttggaatagaaatattattttgcaatttgcaccaaaaaaatattattgtgcaatttacaccaaattagcaaaataaaataaaattatagaccaaactaaataaattttggtgctaaggaataccaacttatgtaggttgtcctttgaatagcctgacctatggttgctggttgcctggatcctatatatgcctagtatgtatgcatgaaagcgtgtacattgtaacaaaaagatacatgtattttatttattagaatttgagaaaataaattgcaagtttagataaataaaattaactaaaacgaattataaaagcctaattaacgagcaaattattcagtgtttatgatatatgatccaaaaatcaacatgcataaaatgttttttatttactagaaattgttgtatgatgtgattggaaaatggacgtattaattgttttgtagtatctacggttctttatgaaacattttgttccaatacttttttttttttggaaaattttgttccaatggtaagtggacaccatatccagagttcaaagttccttttcaacaatctctcctcttttttttaatgttctttcaaaaaattgttttaagaattttacatgttgtaaaaaaaagataattaaagatacaatccataatttactagaatacaattacaacacgtagttatttcaattatcatcggatatctatctacacagctctatttcatagattttccataaatatcatttaatacacgtagttacattttttgtttgtcttatacacgcactttctagaatcaaacaaatgctttcagaaaactttagtgattaattgatcgtagccaaattcatctagcaaattagtaattacagttataataccattattttgaatagtcattatttgttgaaaatatctttaataaattttgttaacttggagtttataaattataatcataaacgttgtttcgatttttgttacagttttctaacaatgttaaattttccagtatgtgtgtgaccctacaaaaatgggaatcaacaagaatcaaaagggcccatcaaagtctccaccaccaatcacctgtgaccgctctcacacttaacgatgatctttgttggattaacggcgcgtgtaatcttgatcccatcacgtgaactttcacgctcatagaccccactgttccaacctcagcaccatcagtcctattcgtcaagaagatttaaggccatacgtaacaaaagcaagctgagagaaacacatcctgtcaataatccttgagctggactctaaaattaggcccatgaaacttaatgacagccaaaaatattgtttgcattatgaattaattatggatttgccactttttttatggcatttgtagactttgaatttttttgaatagtttgtggattttgttttttttcctgattacaaaagtatgatttaacatgcattttatttgttatgtttgggtttagtcggttgtggttgtggttgttcttacaatttagttttttgaataaagtacatatttttaccaaaaacaaaatcttaaatacgtacattttgaaatgttaaaaatgacatattcataaaattttagtaaaaatgatgattttaaaagatctcgatgaaaaatgacaaaaccaacattaatcgcttacattattcgtaaaatttatcatgttttcaaagacatgaaaacattgatctctatatgaccggagaaaacattgatctctcatatcagatcacgtgatcgaacggtggagaaacgctctctacaataaggctttaaagcccataaaacccttaaatatatcaaagcccaaaagaaacgccttttgcgctttcccgatcgtggtcaacttcctctgttaccaaaaaatctgtaccgcaaaatcctcgtcgaagctcgctgctgcaaccatg

SEQ ID NO: 20869 - DNA, 3003 bp, Unknown
  misc_feature (1)..( 3003): 2750-1469P.txt file - cDNA_ID_1829387; gDNA_ID_1620821; Annot_ID_50681
tttcacaaaatagctgcaaaaatgtatatatagattaagtgtctttcgtatattcaaaaattaggagtttcagtttagaaactctcggtttacactcagaaaatcattcaaacctattcaaatgtagattgaattattgaataggtatgtaattgattatttaattattgactgtttctccataaaaaaatactataaatacaactatgtattataactccctttttcccctggaataagactgatgataagcccattgacaaatacagattttgggcctaaatcaccccaaaaaaaaagaaaagaaacaacctctccattgcctttgtagcaatcaaatttcctaataagggcataattataatgatacacaattagtctacacaaacgagtgagacattgatggtgtaactcgtgttctacgaagtgtgactatttacatttgttcagcttgaagcttatttaatcccttttatttttcttgtcgtgaaaatctaatcacagtatcacactacgtttttttgtttgtcccagcagttaataaacacacacaaaaaaagcttcgatatttgggaatttttgtagttactagacatttttacaaattattacttaatatgttcatattattaatttcgttatggtttctttatttaattaaatcgttcaccggcttgtgtacgaatgatacttgatgctataacttggaatctgaaagagccaatcaccgaattttgtcgacagggacgagagaaaaagggagaaaaagatgctctttttctcgaagggtaatttggtaaattaataaatggcagatgatgtaattaacgtggaagttaggtggttttatttgtctgaaaaaatgtaagttcgaaacggaatcctagattcgtggacacagatcgttatggggattagagagagaaacaaatgttttctttttgtctccagaaaataagagagccatgagttactctcatatcttataccctttttacccttctatctagttgtagattttttttaatcatttctttaattattaattgcgttaaattaattattgttggaatagaaatattattttgcaatttgcaccaaaaaaatattattgtgcaatttacaccaaattagcaaaataaaataaaattatagaccaaactaaataaattttggtgctaaggaataccaacttatgtaggttgtcctttgaatagcctgacctatggttgctggttgcctggatcctatatatgcctagtatgtatgcatgaaagcgtgtacattgtaacaaaaagatacatgtattttatttattagaatttgagaaaataaattgcaagtttagataaataaaattaactaaaacgaattataaaagcctaattaacgagcaaattattcagtgtttatgatatatgatccaaaaatcaacatgcataaaatgttttttatttactagaaattgttgtatgatgtgattggaaaatggacgtattaattgttttgtagtatctacggttctttatgaaacattttgttccaatacttttttttttttggaaaattttgttccaatggtaagtggacaccatatccagagttcaaagttccttttcaacaatctctcctcttttttttaatgttctttcaaaaaattgttttaagaattttacatgttgtaaaaaaaagataattaaagatacaatccataatttactagaatacaattacaacacgtagttatttcaattatcatcggatatctatctacacagctctatttcatagattttccataaatatcatttaatacacgtagttacattttttgtttgtcttatacacgcactttctagaatcaaacaaatgctttcagaaaactttagtgattaattgatcgtagccaaattcatctagcaaattagtaattacagttataataccattattttgaatagtcattatttgttgaaaatatctttaataaattttgttaacttggagtttataaattataatcataaacgttgtttcgatttttgttacagttttctaacaatgttaaattttccagtatgtgtgtgaccctacaaaaatgggaatcaacaagaatcaaaagggcccatcaaagtctccaccaccaatcacctgtgaccgctctcacacttaacgatgatctttgttggattaacggcgcgtgtaatcttgatcccatcacgtgaactttcacgctcatagaccccactgttccaacctcagcaccatcagtcctattcgtcaagaagatttaaggccatacgtaacaaaagcaagctgagagaaacacatcctgtcaataatccttgagctggactctaaaattaggcccatgaaacttaatgacagccaaaaatattgtttgcattatgaattaattatggatttgccactttttttatggcatttgtagactttgaatttttttgaatagtttgtggattttgttttttttcctgattacaaaagtatgatttaacatgcattttatttgttatgtttgggtttagtcggttgtggttgtggttgttcttacaatttagttttttgaataaagtacatatttttaccaaaaacaaaatcttaaatacgtacattttgaaatgttaaaaatgacatattcataaaattttagtaaaaatgatgattttaaaagatctcgatgaaaaatgacaaaaccaacattaatcgcttacattattcgtaaaatttatcatgttttcaaagacatgaaaacattgatctctatatgaccggagaaaacattgatctctcatatcagatcacgtgatcgaacggtggagaaacgctctctacaataaggctttaaagcccataaaacccttaaatatatcaaagcccaaaagaaacgccttttgcgctttcccgatcgtggtcaacttcctctgttaccaaaaaatctgtaccgcaaaatcctcgtcgaagctcgctgctgcaaccatg

SEQ ID NO: 20870 - DNA, 3003 bp, Unknown; identical to SEQ ID NO: 20869
  misc_feature (1)..( 3003): 2750-1469P.txt file - cDNA_ID_1829387; gDNA_ID_1620821; Annot_ID_169457

SEQ ID NO: 20871 - DNA, 1808 bp, Unknown; identical to SEQ ID NO: 6026
  misc_feature (1)..( 1808): 2750-1469P.txt file - cDNA_ID_1829627; gDNA_ID_1620836; Annot_ID_50816

SEQ ID NO: 20872 - DNA, 1943 bp, Unknown; identical to SEQ ID NO: 6011
  misc_feature (1)..( 1943): 2750-1469P.txt file - cDNA_ID_1829627; gDNA_ID_1620836; Annot_ID_169907

SEQ ID NO: 20873 - DNA, 3003 bp, Unknown
  misc_feature (1)..( 3003): 2750-1469P.txt file - cDNA_ID_1829635; gDNA_ID_1620836; Annot_ID_50812
agctctagaggtcaaaactacgctaatcattttgctacctaattgtctgccaatatttagcccaatccctctgtgtgcagcagaaactatatcactaggttattgccttattggattggatatttgcattgcattttagaatccaattacaatgttgtgttattcaatcaataatttacatatttaaattgacaatgctgtatttcacaattattagttatattttggtgttattcaatttatgatttttaaatacaagttatatgttagaccaaaataaaaagaaatataagttataagttgctgaaaataactataggtgaaagaatctataaaccacaaaaaataactccaagctcggattttttttctccgaataaaacaaaatattcactaaaatcattaagcagagacgccaacacaacacaactcaactctttgtgtctttgtacagttgtacgaatggtcatgtactatgttattattattattccggaaagctccactactctctcaatcattttgaaattgtctcctcaatattttgtttggctcactagctttgttatacgtatggtatgggcaacgatatgaaaggtatataaatcacacaattaaaattcaagatagtgatatttgaagttgtgttttgcacaaaaacaaagctatcgttgttagcttgtgagataggaaatttcgaggaaggtctttatatgtaattctcgcatgcatgtgagatgttgatcgatcattttccccacaatatttacgagatttctgtccctataaaaaacgattgtgatgataatagtcaagtggaattcctaagcaaactaagtgtatgctttactccctggaaccgaaccctacatatcttgaaatttgttatgtaaattcagccgatcctctagtccagtttcgcccttaaccgttacctatttcaagttttgataagagccatcgtggtatgaatgttaacccgctacttaactagttacaatttacaactacataagttttggagtcacgtgttatatgatttatagacatttgaattattggctaatattggcccagtcttggtctctccgtgataatggatattctcttttgattccatgtcccttgtcaaatctctaacaactacactctgatgatttggaacaagctggaaacaaaaaaaaagttcttacataacaaccctaaatgattgatcagtaaatgttatattctaacttcagatttagttgtatcatgtataaaggaaaaaaaaactaatcatataggattgttaattaaccaaagacatcaatatatgactattaatccaatgcaataagattaattatatagtttttaaatatttaaattaatttaattaacttgaaaagctttcaaattattattagtgtacttgaatgagcgaaattggccaaaatgcaaacagccgcttatcgcctttatgtcttggtgctaaaactgctgccgcttcgaaaagccaaagccaaagcgttaattataaattttttggtacaacaaaagtgataacgagtgatgattctactgctaccacactttgagcccatcacacaagtttacattggaacactcctcttcaagtacacgtgtagtgtacaacacaattaaccttctgtttttcttgtcctatctttcaataaatagccatatcatacctacctaaaacgtaacccactaattttcatcaattaatgtcgagcaaatactatatcttaagtttgaaattatcaaaccaagcagaacaacacatgtagttataatcatataattatctttaaaacatttacaagttcattagaatcttcgtacagatacagccatatgcaactaatgaaagtctcaaactcataaatcaaagaaagcattaaactcaatgttcttaagttaaatatgtcaaatcatcacatataattccgattaataattagtcagttaagctgtttaagcatactctaagcattaataattagtcagttaagatatatcattgatccattctttcaagttaatgtcctttacatacatccaaattcatttgcacgaaaagaattaacatagagatatatagttacataaacacatacactgaccaccatagatttatttgaaccttatatataacaaaagatcgaaatgttaccggcacatatcggtgagaaatgaaatgcaatttattgttatagaatggcaagttaaagcacaaaagagtatatattaaagatttttttatacacgtgtcagtgaggattgcacatcacatgttaaatcacatatgtttaagcaaaatggaattctatatttgcctatagattagacgtcaaaaatagacgacaactttctaataaaccaaaaaatgtcgctcaaaatgatatattatatttattatgtattgtactagctagagtacgaaatcaactaagatcacaaacggatagtcggataccaatcaaaagtgttcaattctgactcttgaaaaactttatttatcttcattttgaattgaatacaattatctaactgtaactttttttcttactcgtcaatctatagaatcaagttaccctttctagagaatcaactaactagtagtctagtaccttcctcaatacaatagtcgtacgaacgcccatttatctaggtaccctcaaattttgtgtcgtctcacttattagttatctattactagttgattactcaatacaaatttccctaaatagagaggatatgagagttgcgtatttaaacaaacctaccaaaatatgattttcgtcaaaccaaagcaaaaacctaccaaaagaaattatttcttaaatacagaaaaaaacaaaaaggaaacttccgggaagctgcgtacatagatggacccaacataaaccaaaacaataacacgtagtcgccacctatatataaaaaacctgacgcaacacaaacagatgtagtagaatcaaaacgtcttaaaacatg

SEQ ID NO: 20874 - DNA, 3003 bp, Unknown
  misc_feature (1)..( 3003): 2750-1469P.txt file - cDNA_ID_1829639; gDNA_ID_1620836; Annot_ID_50811
tccatatagaaatcatggagggatttgagacatgcataattggtcgtacgtacgtgtgaggtggtggtgttacttaagaccaaaattatgctatatgcaacatgctacggaaaaatattaactgatgttgttcaaggtgagacttgcaatcatttaaattgtttatagcatatttttcattttaattaagaattttagctcgtactgagaatgagatataaatcaatacaaattcaactttattgccaagccaatgggggacacatgaaaagaataaaattagaaaatgttaaacgagatatgagtgcattgaaaccttgtttttgtagcatactcgagtttttatttatatatggcccatcatgctatgctttctctttcgcttataccattgagcttcgcgacatttgaggaaaagacaagcccaacacattttactttaacaataactaatcaacctctacttcttttctattaaacaaaatgttaaagggtttttttattttcttataatgcattcatttaccttgtcctaatgtcccgataaatcttgccttttaagttctttgactagtggctaccaaattcttttagaatctgtaatgattatcattgaccaactgtgtctgtgttttcctaaatttacaaagacatcacgatgtaaaagcttcggggtggattgtttatggaagcggtcaagcaaagaatatggatgggttcacgaggaatcactagtgtgtgtgacattatgatattttgttatcggtttaatggattttgccaattataagagaatctatgttgcaagatggtagatgatcgcactacaaaaaagtgatgagccaaaaatatagtcacacgttgtccaatggaatcttcaccacgaaatgaaaaaagttcaagtgatcttttggacgtcatgcaaaaatggaagatgatgacggttacaaattgatctgtctagacatcttatcttctttattcatggcaagtctttggtactactatacgtgtgatgtgaacgcatttcagataagttaagtagatatatatcttgttgtatgtgtgaatgcatctccacatcttgagatttggttggttaacattgggttaaatgtgaacgcgtctttggaatagtatataataataatttagacgcgcgtttgttaactttcaaacatttttgtgaaccacgctccaccaaataagacatgtggtggacgttgcaactagatttacgcatcttgatgggtttccaaaaatggtaagtagaaattggttttctctcaaaagcaccattatttagggtttgggaatgaaaaaagtttgtatctttatcgttatgattttactcatgctaaaccaaaggtttcttcatcgcgttttggacttcgtcttatctaccgccctatgtgttacatgatacgacatatatgatacccagaaaaaaattcatgtgtgcgggacaaaaagcctcagatgacttttgattttgaaaaactatgatcatttttaaaaaagttgtagaaattaaatcattttgaactattcgatgcaaccaacctatctaaaaatgaagtaaattccgcaattttagatagatggacatcctcagatcacatccatttaaactaccataatacacgtagatggctctagacctctagtagaagatatgatactactatctttgatatgtcgacattggaagatacattttacaccgtagagctttgtggatatttcgaaagtaattagtgtataattcaaatcaattaaatttagatatataaatgtaccattctaatgcaaatcctttataacaaaaaaaaaaaggactttcccaaaggccaaacaaatgattgttgacattgaccacacgatcgtttagaaacatcacaaattttcaatctcctcctagtctcctaggctcataccacttacgttcgcatgttacataccttttttgaaatggccagctcatttttgatcaaatgaatactggatttacaatgggaaaaaattctgcatctatgttcttagatttacaaaataaactagaaatgttcgttttagtattttctttctatgaaataacttgttgttttatgaattatgagtctaaaaatggcatattagaaccaaaaaagattagcacatgacatttcaaaatcttaaatggtaacattttcaagatttttattctatcattagttgtttctatcatgacatttcaaaatcttaaatggcatattagaaccaaaaaattatttgttttattttgtacgtacaattaccatatttttattcattgtcatagttgttcaggtggatcttagatatttcaaagtataaaatttgtgatcgtattttagatgattacacacatatcacatatgtaatgcacataatatttccaaattaaaggtaaaatattatttttaccggagtatgtatatattcaatccagattatttttaaaaaattagattttttttgaatgatcagtcttatcaagaattcaaaagatagtgttgttgtcaatcaaaattactaaaagaaaattgtttagtcaacatatatacgtaccttaataaatatttttcttagaatctaaaggaatttacagatgttaaaataaaatccaataaagtgtaaatttaccaaacaagtaaagaccatttttcaaaaagaaaaagaaaccaaggagaccaaattatgattgagttttacaaaatacagaaaataaagaaattaaataaatatcaaaaactcaaaagagacctctcttctctctctctctctctctctcgctactctcatcttcaccgtacgcttcttcgatctacgcttctctctagctatagcttccattgtcacgattcctcccaaagcgtagaatgtggaaccctagatacctcaaattcagctagagatctatctactttcacctctattactttctacttctgaaacccctcatcagagctacacacagtgatg

SEQ ID NO: 20875 - DNA, 3003 bp, Unknown
  misc_feature (1)..( 3003): 2750-1469P.txt file - cDNA_ID_1829643; gDNA_ID_1620836; Annot_ID_50809
caacataaaaggtttgccaaaagagtaccccagctatgctgtacaagagtgttagaacaacaacatctggcgtaagagtgccaaacaatgcttggccagcccacctatcagtcaagtgagcaagaaacaaatcaatgagatgagaacaacgccatatattattgatacacgagatatcttaccatggcaaactaatatagcttgctccaagtgcaaaatttccaacccatccattttgttttagctgcaatgagatcagttcagatatcgatattcaaaactccaaaacttggatggagtgtcttatcactagagagtggaagttaggaataaaacttaccttaagaggtggagcagagtatatataagatagcaatgatcctcccaaagcaagatagaagacagtgggagtggtatgccctgcctgataagggaagattttagcaaatctgatgtgccctttaactgtactagttaatgtcagaagggccaacttacccacacatctaatattccagcaataccaagacctcccaataatagcacccagacttgtgtaataacctgcattttaaggagtaaggagaaatcagaatcacaaaagagataaaagctcacaatgttctgtctcagttacctctggctctgatattgctccagatggaattggacgatatggctcattaattgcgtcgatatctctatcataccagtcgttgattgtctggaaatcgacaagtctaggttattgtagcaccaagcaaatgcactagaataagaacaagtcagctttttgttgtgtaaaaccagacctgtgtatagccagtaagacaaggaccagacatcatcatgcaaagaatcgacttagcaacatcctctggggtccaatgaaagttccctgccagaagaaacaattggaaggaaaatgaaaaaactttctgtacagtattgcatgatccaaaagaggttcgtatgattacctgaagcagcagcaccacagacgactccccaaaccagtggaggccaagtgactggttttgtaagctgaagacgaatcttccatttattctgaatacagaatataacaacaaactctttttagctaacaaacaacattttcacatcatttctaagctaaaaacaagacttgtcctcaaaagagattacctttagtaggaaaattcctaaactaacacatcattatccacaaatatgataatttaaaagattctgaggagatgaacaaaattacagtttcttgagatgctcctttgataccgagaagctggttaatgcttgaaccaccggctggtgccttgtcaggtgtctgagatttaactgccgtcggaaattcaaacgccacagtgtttgaaaagagaattttgaagagagagaaaataaaaacaactaaaaaatcatacctttatcagtatcagtctccgccgcacgcacaacaaatctccgccctacgagagatccacaacaagatcagtaaaaaaaaaatcgaagaaaacattcatcaatctatccaacagaatgctaactaccgggtgattcgtagatcaacgtcgagaaaccagaacgccggcgagtgaactcaacggaatccgaattccgaagagagaggactccgactcgatcgacggaggtaactctggaagagtggatggtggagacagtgttgagaatcgaagtcatagaaccgacggaagagagaatcgtctctggtggtagttaagccggagactggagtggtgtgagtctgtgagttgctgtttcgggaaacgagtggttgtccgttaccggagataagtaatgtctacgttacagttttggcggcctttgattcaataactgccatgtggcacgatcctcttggcaatactagttgtgtcggatgttagttttgttggacaaaggaccttcattgaagcagaatgggcccggtttaaatccaaagcccaaacaaaacccattagggtttcattgaagcagaatgggcccagtttaaatcgaaaacccaaataaagcccaaaaaataaatctaatattaatatgggatgatatataccgggtgaaatcataaaatttaacaataaaaatacaaatacacaattttaaaagctaaccaaaactaacaatattaacaaaataaatataatttcaaatttcaaatcttttaattataaaatcatcccgaattgtatcatacattaaataatcaataacatatatctatagttgctcaatacctccggggattactctactacataagtcgtcttgattgaatagatttcctgatgtctagttttcctactgtggaaatcctatttagagtagactcacttcaatgaaagctattacttctttattaatgactattaactattataagatattaagacaaaaagaataataaatctaacaaggggattatgatacatctagttgtagttgatatcttaaaaacaaaaaattcatgtatttgataaaaatataagcccgcgatatatcttttaatatatatcctataaatataatattaactgaaataatttttttaactttctaataaaaatatcaaccttcagtctcttcatgttccctcaaggcaaaattaccttcaagtctctatttttactacatgtggaacaatcaaatcaaggaagagtcggtaggtgatggagattcgctttaaatgtctacgtaacagttttggtggcctttgatttaactactgtaacaatttgtccggacgaaagactattgggcacagtttaaatttcaggcccaaagaagcccactagtatccggttgagagacacgtggcaacagtcaactttgaagaaaaataatgaacaatcattgacatttttttttgtttctcctgatccagttcttaattgaacaaactccaacagcatcatcatcatcatcatccttcaaattatttttcctattttgaaaaatttatttgaaatctcataatttacgttaatg

SEQ ID NO: 20876 - DNA, 3000 bp, Unknown; identical to SEQ ID NO: 6016
  misc_feature (1)..( 3000): 2750-1469P.txt file - cDNA_ID_1829649; gDNA_ID_1620836; Annot_ID_50806

SEQ ID NO: 20877 - DNA, 3000 bp, Unknown; identical to SEQ ID NO: 6016
  misc_feature (1)..( 3000): 2750-1469P.txt file - cDNA_ID_1829649; gDNA_ID_1620836; Annot_ID_169896

SEQ ID NO: 20878 - DNA, 3000 bp, Unknown; identical to SEQ ID NO: 6010
  misc_feature (1)..( 3000): 2750-1469P.txt file - cDNA_ID_1829657; gDNA_ID_1620836; Annot_ID_50803

SEQ ID NO: 20879 - DNA, 3000 bp, Unknown; identical to SEQ ID NO: 6009
  misc_feature (1)..( 3000): 2750-1469P.txt file - cDNA_ID_1829661; gDNA_ID_1620836; Annot_ID_50802

SEQ ID NO: 20880 - DNA, 3003 bp, Unknown
  misc_feature (1)..( 3003): 2750-1469P.txt file - cDNA_ID_1829665; gDNA_ID_1620837; Annot_ID_50829
cactctcaaatggtatcctagagttagtatgcaagccaaaaagtctaatggatagaagagtcaataacccaaaccatctacgcttttcagtaggccaagctctgcacgttactaagccctgcctaagttcatctagattaggaccttcaccggttggcacatgcaattcactgaagaacgctttgtagtcagctgcaggcacaaacttttctgtaggcagttcatctatatttaaacccgtgatatgatgaaattcgttcaatccaaaccggatgggtttaccagccacgatacaccaaagctccttcttcagtattctcagttgtctgcatagtagataatgtacggtcttaccagaccatagaaaataactatcaacaagcttagcaattaatctaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtcataacataaaacaaactcatccacagataccataactcaggcaaaacataaatctaactcagccatagataatataactccgtcataacataaacctatctcagccacacataacataactcagccataagataaatctaactcagccatattttaacagaaactcagacatcgatgtaaggttaaaccataactcagtcacagcataaaacaaactcagacacggatgaattgataaatcataaatcagtcggcaaacaaatagtaactcagccgtcaaatcaaatagatctaagaaatcggccaccatatgtcaatcaacgacgacgttaaaacccagctttaaaaaccatcgttacgcatcggaaaacgatttcagtgacgggaatcacttgagattgaacttagatgtcagagtcttacttaatggaaacatactcactggaacttagatgtcagatgtgacttcgcgcttacagaaatgcgactccggcgtctgaatttcggccggaacagacgagaaaagagcaaaacggcgaaagaaatcgattttgttccgtcgagagagaaagaggaagaaagcgacagtttttttttttttgggagatgatgaacagtaaagccaagaaataaaaaacccaaacgttatgcggtttggagatgattaatgacgtggattatcgtaatgacatggaatgatgacatgtataatcactgttttttaatttaatttttagttaaaaacgaattaaataataataattaattaaaactagttagggttgttaattgtaattacacaagaactgaaaacatctgagtaataaaaaaaaaatgtgttctattctaggaataaacatacaaatgtgttctatcttaggaattatttctatataatatgtatatgttcaattgtgatccaaaaataaatgtttcactacatattatggaaacaaattcgaataagtgttgatgcaaaatcacttaataatcagataactgaataaattttagaacaaaaaaaatggatcttataatgtcattgttttctagcaaaataatatgatctaccggggatcccatcctcggtggtgaactctactgaagtgtggttaactctgttgaagtgtgatgaatagtgggggagtagttaggtgacgactctgcttcaaatgtgatgaagtctggtgacgagtaacatgagctatttcacttatccctacaaacccatctacattaataacatcttgagagaaggtcaatctctactcccccactattcttttcggttaacttagatgccaacgcttaaaataaggtggatagttgagtccaatataactctaatatttttgaaagtgctgttacgagtttttttgaatgcttgtttccgagttcatagattgcatggtataggttattaatagcatacatgttcatcctacagtagtaagaaaataatgacagataaaggaaattacgtcacatattattggttcttatttgacttttcagcattttcccgttgttgttttattttagggtaaattgcaggccacacctgttgaccatgttttatttccatggattgtcaaaatcaaatgtggttttcaccatttatcttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattatttccattattccgaagtgacatcaacatttaatgcccccaaaaagtttagacgtgactattgtcacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaacaagcattgttcgtgtaagtaatgaagttcttttaagaagttttttgttatgtcatattaggatcttgattgtgttcgaactccatttttttatcagaaaatttgcaaaatctatatttgtttgtttaaaatagtcaaatgataattggtatttaggtttataaatgtgtagtatcgacattccatttgtttttttatatgtatagtatttttcagttgcatttaatgtgtgtctcctgaatttatgatgcaggtgggttatggatattcccgtatttactatggtcggtgagtggaaatgcaaagaaggagaatggaaatttgaacctgaggaaggcatctttggtcgttgtgtacgagttcaggaaaccatg

SEQ ID NO: 20881 - DNA, 3003 bp, Unknown
  misc_feature (1)..( 3003): 2750-1469P.txt file - cDNA_ID_1829692; gDNA_ID_1620837; Annot_ID_50819
tagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaagatgagaatcacgcagatcttgttatgtctggtaatagtggcattgtcttcaagctcccatgtctggtccgatcagatcttcccagctcatctaggtctatatcatttcctctcttctcataattttccgatcaatttcgagttttgtcttgattcaatgttttatgtatagttggaacattcagcagaaacaatcgtgaaccaaagtacaagattgagttccttcctgaagattcaccttttcacccggtaataacgcaatcttaagatagatttcaaaaagcttaatttttgcactaattgaatattaatagtagagattctctgtgattttggtgtttgatctctaatattgttattagtcacactttagatagatttgaagcttacgttttctctatgacatgatttactatgagtagagatagttgtaacatagagattgtcactaacagggttagaatctggaatctatggttatggtggattagattagcttttttaaatcacaatttagattgatttgaagcttatttttgccatgtgacctgagttacaatgattagtgatagttgtaacatagagatcctccgttgttttggtgttttttattctctaatattgttgtttatatggtggtaatctggaatctgtggttacgatggataagagtatagtagttttgaaacttattttgcactttgatcttaagttacaatgagtagagatagttttaagttagagatcctctgtggttttggtgtttagattctctagtattgttttgtatagggtgagaatctggaatctattgttatggtcgataagtgttggcttttttttttatcacaagctattgatttaaagcttatttttcactttgacatgagttacattgagtagagatagttgtaacatagagatccctctatgattttggcgttttggttcgctaatattggcttttatagggtgataatctggaatcaatg

SEQ ID NO: 20882 - DNA, 3000 bp, Unknown; identical to SEQ ID NO: 2576
  misc_feature (1)..( 3000): 2750-1469P.txt file - cDNA_ID_1829711; gDNA_ID_1620838; Annot_ID_50837

SEQ ID NO: 20883 - DNA, 3003 bp, Unknown
  misc_feature (1)..( 3003): 2750-1469P.txt file - cDNA_ID_1829731; gDNA_ID_1620839; Annot_ID_50853
ccaatacagcctgtgaacttcaaaccctaaattatttcataatttattttattttatttttttggaataatctattttgtttaacattattatttattcacaagtcttacccaattcaatgattacaattgttaattagtttgttaaaattgtcggcaaaggatacataaggttttctggtttgcaatagcaaataaagaaagaaatatcgttgaattttagtattttgttatatatcaaaggagaaaagaatattgaaaaacagtttggtataagattagtgattgtattttaagaatatttaatttaatgttggtgtagatgtataatgttaaaggaaaagttttaaaataatagattgcaagtttgtaagataaatctatgtgacaaatgagatgtaaaaggtgaaacatatattttatgtcataaagttcaaaaaggattataaaagaaaaatacttgggttaactgtttaccctcttaattttagccaatcaggatttatcatctaataataaaaataataatttatttaattaaaaattttaattttttattaaaacgaaattatgtatcggtttgggtttattagaaagggttagactttaaattttatgataaaacaatgttaaatatcggtttgggtttataaacggatttaaattttataattacacaaagttaaatgttggtctgggtttagaaaatacgattaaggtttagattttttacgattaaacgagtttaaatggtagtttgggtttacaaaagagaattatggtttagattttgtaattaaacgggattatatatcggtttgggtttataaaaaaatggttagagattagatttaataattaaataagtttagtgggttttaataaatttatttatttatttaatattaattgttttaatttatttaattagatgacatgataaattttaattggttaattaagagaaggtgaatgaaagaggttcacccctagggctgaaataaagagtcataaaatgtttcaacctattctgctatgaaaaaattcaccctttttaaagatttatgttttattccatagaaaatagaatgaagatcctatacttggtttgagagacttgtattccataagaatgagaatgaggatggttttggagttattgatcatttttggtaaagatttgccaaaaacaagatgggtaatttgtttggttgtagatcccaattggggattatcacatgtgtaattgaggaaaggagaggcagatccatattccatagggatgtcattgcttcatatggtgttttggtgaccaaatcgttggctatgtctcaatgaaggtcaaatactatattgttcgttgtattactaagacaaaggtatattatataaaaaaattatgtgatttttttaatcaaccaaagagactcaaatttcttatgagattttctaattagaagtagtcattttttatatctttgcaggataatgtctttggattattcattctctcagttctactcggttgtgactagttgagctttcagtttaagttttctatggttatggtatattggaaattgtctgtttgtttgttcttttaagcttatatttttttgttcaggttcgacgccaactgtttctctgagattgtttgcgggttttgatggttttgaatttaagatttacttattagattcttttgtcatttacttcatttttctcttactttgcttctttttaagacttagttttcaccagcttagttttaaaaaagtttcaacttttatcggtttcgtgtattagaatcgtattctatcttgtattctacttttcttttaatatagtggaaatgttttttgtcggcaacagctatataaatctacttttgcttttaaggtcgactgtattagcaataaattaacgaaaaaagaatattgaaaacatttttggtacaatattatttaaagtattttaagaacattttatttaatattaacttaatgtctataacaacaatttaaatgttaaagataagttttaaagtaacagattacttgcatgaaaaaataatctatgtgaccaattagatgtaaaaaatgacacatattaaataatttttcataaagtttgaaaaatattataacatgtttcaacctaatttggtatgacaaaattcatctactattttatagtttcataaagttttttaaaatacacccattttacttttgtaaataatgtttttcttaatctactatttacatttaaaaaaatatttctcattcattataatcgtttttttttttttttgaagatgtatcatctttgacatgatattgttttatatgtagctacatgaaggcatcaatatgttgtagtatggtatctctaaccaatggttgtggacttgtggtgcaactgcctttcacaatttcaacaacagaagttaaaatgatttttttttgaaagaaaaagttaaaatgatcttctacttttcattttacctggtggataatttaacactaaagattgaaaaaataaaaatctatttaaattttcggtgatggatttatcgatagatttctaaataacaatgattaacgagatttagttcaataattatcaacaaggtggaagaaaaatagtgtttaaggagggtgagaatgagattgagactagtacatccaaaatatgaaaataaatatctctataactatatccatacctccaatgatccaaacatggccagaagcccagaatcagaataataaaagccatacaatggacctaaataaacatagcccaataacggcccactaaaatctgatattttacatcaacttgagtggtagaaataaataaagatagggcagaagcagagaagcaaaatcgtggaaggttacaaagcctttcaaaaacctcactctctcaactctcaaaccttatctccttccttctcttctcctctcctctccgtcgagcttactatctccacaaaatg

SEQ ID NO: 20884 - DNA, 3000 bp, Unknown; identical to SEQ ID NO: 6048
  misc_feature (1)..( 3000): 2750-1469P.txt file - cDNA_ID_1829733; gDNA_ID_1620839; Annot_ID_50852

SEQ ID NO: 20885 - DNA, 3000 bp, Unknown; identical to SEQ ID NO: 6047
  misc_feature (1)..( 3000): 2750-1469P.txt file - cDNA_ID_1829737; gDNA_ID_1620839; Annot_ID_50851

SEQ ID NO: 20886 - DNA, 3003 bp, Unknown
  misc_feature (1)..( 3003): 2750-1469P.txt file - cDNA_ID_1829741; gDNA_ID_1620839; Annot_ID_50850
ctgattagtaaattaattggtaactctacggctttccaaatggattgtaagacaactcccgattagtggtacttaaaacattttcatgctttccacctacatcttgttattatcaatttattgtccatagcctgccacaaactcttaacacatgtccacaaatgaatagaaatatatgtacactttagggaaaccttatatgcctagttgcctccgaagtgattcccaatatactggatcacagggtaccaaatgcttgctcaggcagtataaaccagccatcagcaataaagtctcctctctgcatgcttttggatggtactcctccgataacattgttagcgttaggctgttctctctatcccgggcttccaacctttcggttcacatggctggaggtgtcataggcacaagaatctgaatatccggtgaacatacagctgtgagcaggagactatcttacgtacatagaaccaagttcctccatttttaagattcctgggatcaatataacactctactttgtgtttcacatgtttctagatatgcatcgatcatttggtgtttatgaactgtttcttacttgctataggaaatcccagagagtaccactaaaggagcagcaaataagaaaaccaaaggagctggtggaaggaagaagaagtaaatcacagtcctagtttataagctagtacgctttctgcagaaaagatctcaagagaagatcaataaactgtgatggtatttcctaggtctaagtagtctgtttgctttttgtttttaccatgtttctgtaatggtagtttagtcttttactttctcgatggtagaatattaagtcaggtctgaacttcatttgcatcattatgatttctgtgaaagttcatgagttgtcttttgacaagggaaatgcttgtgcttgtgttttcatgtgctaattgtagaattcaatatgatggaaaagctagacaccaggctaaattatgtattttctattgatattacttggttcaagaggagccaataacaaagctttcatcacatagtaagataaatgaaacataatcacataagaaattttgtatggactaaaagattgcagtattttacatgaagattaagagatggagacaggattcaaacaatggtgcagccacttccgctttcataggtattaactgataccatgtcacggggggtgtagtagcagtaaggaatgaaacaagggtccttcttagggtctggttttgggtctggttttttcggtggtccgacgctgattactactggtttcttattgatcttcttaagctgttctgctacgcagaccggatccatagtacccaccacggttagtatactcttctcttgatccagtgaaactatattcacacctgcatttcaaacctctcatcttttagtcgcatctctcatatatacacaatatgtaacatcgtttttataaaaaaaatcataccttctagctctgtgacagcttccatgattgcatgtttgcatttctcacaatcgatatccactttgatctcgattttctgcacacaatcgaatgattcaagaaacgaaaaactcgaattcttttccgtataagtagtagcatgagcatgtttttaccttagtcgtcatgatggagagattaacaaggattatgggatttagatatgaatagaggagaagaaattagaaacatataaataggagagatttgatgaaagaagcacttgagttgtttcttattgtcttcatttctcaacatcttcattaaataaaagcgacttgacttcgtttaagtctttctcccaaactgttgcgtcaacgagcttactctagttatattttatgtagtctatacattttgtctacacttatattaatatagttacatattatatttgggtttttacatagttgataatatatatctaaatatcgattcaagctgaacttgggacttttgtgagtttatccatgagggtatttgttagtcataagtcttaaaccatttgttcacttgttcatctatttaacatattatatgttgtgtacttgttaatgacagtgacattttagcggacaatctctgtcgacccagaaaccaaatctcaagtcaccaaatctccccggtttggttacaaatgtaaaattcaataggaatgcgacttcggttctccgggtcggttagttcggttatcgccaacaaaattatacagatgtcgatattaacctaaaataaattcggttcgatccggtttccggttaatttgttaattcagttatgttttgactaaattctgggttttgggttaaattcagtttggtttggttcggctattgctgaaaacggtctaaattttgtgaaaaccggtttaattttggtataatccattttcttaagtatctgagaaatagataggttcgacctgaccctaaccaaaattaaagtcctgtcgatcggttcagccgaaagaaccgaaaccgatccaaaacacgaaatctcggttcggtcttgtttggttttctcagttcggttatttatccaagcctcaagtaaaatgagagtttgtattagatttgagtcgtttggccaaaaacaaaacaaagctagctgagttataacgaaattacaagccaacatctagtttctattttattaatccatacaacgatttttttgtggccacgtttaatttaggagagtttcctcgtacggtactaaagccaaatagattagatgagatgtctcaattcaccaataaacaactcttgttaatcaccaacaattaaaatttaaaaacctaattttggctaaattaagaattaaactccacctctcacaattggcctaataataaacattgtaaagcatcctcggtgtttataagaataccaaattcaaggcatttttattgtgaatttattagtaatttataaattcatcaaaaacaaactcttttcagaaaaaaaataacaacaacaacaataatg

SEQ ID NO: 20887 - DNA, 3003 bp, Unknown
  misc_feature (1)..( 3003): 2750-1469P.txt file - cDNA_ID_1829745; gDNA_ID_1620839; Annot_ID_50849
cattgctcttgactctttctaagaactgggaatggagaaagaatggttaaaagttttagaaaaggatataatacaaatgcagaaactggtaatgtgttagtgaaagaatagatctttgtgttcagcttttaatgagaagaagaagaagaagaagaaagagacagaggcaagagcagagcagagaagtgaagtgaagaagactgttttaaaaaagagattttatggctggattcacgtttggaatctcattacctcgattgtcttaattaattatacttaaaagttacaattacactaatctttaattaaagaaaatagtagtagtactactaaactactaattataactaatttagcattcgtcgtaaaacaaggagaccatctttttgtttggtttcatacttgaaacacacatcaacatacacaagaggtaactatataaattgtgatatctacctatgatttttcattattgatgtttatgatattttctaaatcacgcattggaaaaaatcattatcaaaaacaatattaatatatattatttatctgtgatttttttatccccgacacctaccaatctatctaatggtttccaggatgcaataaaatcatgagcgataattacggaagtggtaatcatgtaatttggatttaaaacattcttttaagatatttcaacacatactatcattgtttggattgagtctaaagtaatcaaggatgtcaaattaatacacaaccatatagtttgtcaaagagtggcaaataaaatttaaaatatttaaggaattctgtaccaatagatcctgcacaaggaatatagatctcttacttaatttgaatcattcttttcaaaattagtaattgttgtaagaaaaaatataggattattctcgtttccttgtccaggataagtttaggccaataaatccaaaactctttgactaaccaaaataattgtcataatttatcggtttgaaactaatggctgagagaggaagaagaaagagagtggtggggctgtttgtaaatccgatgcacatgttacgctcttacaaaataaacactcccaaaccggtacggtgctatctatcgtccactaaactatgtacttttaatcactggatttattaataatttaatatttacatcttcattcaatttgatgcatccaagtttttatttaaacttctaagtaaactattaaaattcaaaaaaaaaaaactagtaaactactattttaccattgaacaggtgatttccaaaaacaattcgcattttatctaaaatgtaaagttttgtttgattgttttttgtttttttttttaatattaagaggttttggagcgaaacctataatctttctagaaccgaaactcgtaatcttcccaagcccaaaatcacagtatgtaatattaattttgtctcaaacgttattcgaaccgatgacctttaagcttcgcgtaggatctttaccaattgagctaactaccttcgatagttttgtttgtttattatatacaatctattttctatatatatatacatataatccttgcaatgtttggaacattaataggatgctacataaagttgaaagttttggggaattaattgtaaacttgggatgaaggtgttaactaaggacatatcgttgtatttttccgtggtgcgtaatgaatatatgtacgtttctccacaaaatcctgtcggtgaacgtctttttttagcgtaactatatttaaatgatcacgtaccaccaccgtttcttatacttacacaatgattatatttgttgtagatatcaataatgttgacgtttaaaaataaaataaaacccacgtatcacaccattcaccaccattacgttctttgttttttactccttgacccattcgattcccatgcacgaataatgaaacctcccatatttataaaatcaaaatgattttttggcaactcaagtacagtttcgtttgctagatctacatgatttataatcaagtacacactttctctttagatttcaatatctaccttcttcttttttaactaatgaaccatcccacaccgtggtaggatgagaaaaccaagaacaaattacgatgccaactatatgttttcttttttttgttatgaatgttaatatcattgaaataataaaatgaaagtgaaagatattacggagaacattacctaaaatattataattttggtaaaaataataaaaacaagatcacgatacgatagttagttttttttttttttttaatataatatcaaattagatttaaaagaaaaaatacgtttttacaacttgtgctaagtttgtttgaaaagtaaactctaaaaacttctgaaaattttaaagctttctaagaatcagtgataactagtctcgagagtaaatctagtgttggtaagcatcgttataacgcatgtcgcctaagagagtcggattgctgaaatctgatttcgaatttctttatcaacccatagtcaggtttgatgagaactatatgttttttgaaggcttcagatccaaatcggatcttagaatggatttgtctccagcaaaaaagacatcactgtattggtagggaaataaaatgccaaaagaatagcatacccttacatataacgaaactcagaacatttatatgggctacattgaacattctctctctcaacttataactttatagctccaaaaagtatatagtcatataagatgcatcttaaaagagagtttcgattccactaacatttctttggactatgactcatgggccttaactatatgatgggccttaacaacctgatgggctcattaggtttaaaggcctcataaagttaatcagactctagcgcccacacgtgttgaggaggcgggaaaacaattatcatcgccggcgtgaggagaccaaattggcaaagttccctgagagagagagagagacaacaccttcgcattcgctaactttctctgtaaccgccatg

SEQ ID NO: 20888 - DNA, 3000 bp, Unknown; identical to SEQ ID NO: 6045
  misc_feature (1)..( 3000): 2750-1469P.txt file - cDNA_ID_1829749; gDNA_ID_1620839; Annot_ID_50848

SEQ ID NO: 20889 - DNA, 3003 bp, Unknown
  misc_feature (1)..( 3003): 2750-1469P.txt file - cDNA_ID_1829753; gDNA_ID_1620839; Annot_ID_50847
acaaaatgatgctctcttactttagtttcgccctcttttattcgtcctcatttttccctttcattgacgtcgtttgtttgttttttactaactatttttatgagttttcgaaaacaagtaactaattcattgacatgcatgttatttttgaatgttatttactttaatagtagtacattattaacaattaaattaagaaataaggtacaagtcaacatgcattgttaagtaaattattttctccctctctcacttttaaccttaaaactgcaacaatgatttaaacaaagaacataaactttaggacaaacaatcataggtttaaaatacatgaaatatcattgatcgatgaactttcttaaaatctttaaggacgctctaaccctcggaaagaaagggagtttaccaccctttcccaacctccacgtccacttatccaatctggttgatcagcgtgtatccaaacattagatcatacggaacaactcaacactatctagtaatatattttttctaaagtttatgatcaattataacccaaagagttacggatacaaatcctagtattttgatacattattgtcaatgataatttgcatataaatgcattgcattgagtctacaacgtaactactttttcctcctaacaaaatgcatgattaatttacagctcatttctagtaatggcaccaatttgaacgatattagccaaaccattggaccaaattgatggccaagcatttgatctacttttgtctttttcttggtttttatagctattgatctttcaccacttcgttcatttcgaaaaatagtcctctcaacaggaccttggaagaggcaagtcctactctcatgaacatggcttctcgaagataaaaccaaagtcaatgtcaacctctctccaacttgaaaattttaaatgctcaatcatttgaaaggcggcgaattcttttgtatttcccattacaaactatacaaaaacatcaccgtgactatataattttctatgcacataaaaacatttaacttatgccaatatatactttttagtttttacaaccaattttagtccactttcgactacgcaaagatgattttataaaacttgaaaatgacagaattaagaggttggcatcggctaattgattgcatgttataaaaatataactggatgactttctcattacagttttttttatcgacggctaattcgattttatccactgcatttagtttcttataagttctttactgcatatatatatacgtaatatatgtatattataatttttctttcttcctctactcgtcctaataattttgatgaaatggttttgtatttaaaaaatatactaattatattttcaggatacaacgacatttgggtagtgtaaatgcaaaataccaaaacaaatatatactatatgttatacaaaaattgtttaaacatgtaaaaaatgatatgcataagacaaaatcccattttaattgaaaatataatatatcattcgtgacgcagctgacgctattattaaaattgaggtgatgatctatgagattttttcctcttacaacaaatatgtcaaaggagacaagccagttgtatatacaagggattgagtgttttttccgttgtaatgatattcttcaattatgctattgtttgtatgatttcttaagactcgacttaagctagtagctttatataaataaaatagctttgttgtaaactaatcatcatgaaatttcaaataacaaaaaaaaactaatcatcatgattgtatttttaaaaaggaaactctctttcctataatacgataataatgagaacgcatctcctatcataatatacgtttctaaacacttattgttgttctcgtgtagaagcatgctcgaaattaatcaaaattatctttgtttttgttttgtttcacgttagactagcctcatcgatgtaagattaatgaaagattacccgttacaagtcggtaactagtaacattagtgtgtatataaataagaatattagtggttacgcgaccaaattattgcatagtggaaacatttaaggctatttttccaccattactttgcgtacttgaattgaagaactctttacattctcagcacatcaaggtgtctcctttgagatcaaaaaagtaggaaaaataaaacgaaaaagtactataaatattaatttcgtttacgaacaaaaaagtattaaaattccgtagacatttttggggggacaataattttagactcgtacaatgctttcatggaaatgagtttgttgttgaccgatggcttccctttatttttctttccacttttttattactaattaggaaactagtaatatttatactcgatgtataattcactaatcatatactttccaaaacgtagcaaataattcgactagaatatattgtccgtgaattaagtttcctcttttctttttttatgttaaccatcatgtttctgttatttgttgattttaataaccatactattttatacttttttaaaaataattgaaaataaattcagattacaagtctacgataatgattcttcttctttttcattgtagataaatttcttaaaagttgactacttttctgtcagtatatgtcacatttttctatctatcgttcgagaaaaaaaaaagaaaaaaaaaagtttacaagtgttacctctaaagtcttaaccaccatttctttctattttgtaaaggaatcaaatagttatttactatgtttgagttcatctcttgagttttctgaataaggtggtcccataaaaggtatcaattaattcacccaacgattataaaacaaaagtgtttacaccagaatatcgccaatcatagtttctctcattttataataattttctccatcttcttccttcctcttcaagcttatagaacctccaagaaccataaaactctctctgcaacaatctatactttcttcattacttttataaaaaatg

SEQ ID NO: 20890 - DNA, 3000 bp, Unknown; identical to SEQ ID NO: 9527
  misc_feature (1)..( 3000): 2750-1469P.txt file - cDNA_ID_1829785; gDNA_ID_2926139; Annot_ID_197355

SEQ ID NO: 20891 - DNA, 3000 bp, Unknown; identical to SEQ ID NO: 9527
  misc_feature (1)..( 3000): 2750-1469P.txt file - cDNA_ID_1829785; gDNA_ID_2926139; Annot_ID_138958

SEQ ID NO: 20892 - DNA, 3000 bp, Unknown; identical to SEQ ID NO: 9527
  misc_feature (1)..( 3000): 2750-1469P.txt file - cDNA_ID_1829785; gDNA_ID_1972140; Annot_ID_179274

SEQ ID NO: 20893 - DNA, 3000 bp, Unknown; identical to SEQ ID NO: 9529
  misc_feature (1)..( 3000): 2750-1469P.txt file - cDNA_ID_1829842; gDNA_ID_2926139; Annot_ID_138941

SEQ ID NO: 20894 - DNA, 3003 bp, Unknown
  misc_feature (1)..( 3003): 2750-1469P.txt file - cDNA_ID_1829882; gDNA_ID_2926131; Annot_ID_138746
ctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatgagcaagaaaaatctagcgattctgttgcgtgctagaatgagatccaacaatccctccaaattttccctctctcaatttcctgtaagcttttctttttctctgtttgaattttttggataattttgcgattctgtccaaattcacacaatttgtaatcatg

SEQ ID NO: 20895 - DNA, 3000 bp, Unknown; identical to SEQ ID NO: 6065
  misc_feature (1)..( 3000): 2750-1469P.txt file - cDNA_ID_1829882; gDNA_ID_1620841; Annot_ID_50889

SEQ ID NO: 20896 - DNA, 3003 bp, Unknown
  misc_feature (1)..( 3003): 2750-1469P.txt file - cDNA_ID_1829886; gDNA_ID_2926131; Annot_ID_196920
atttacaagaaatgttattgacatttattattatcaaataattaatattcttaattattagcatttacttatctaatatatatccatcaattctaattacttttaaaaaggaaaaatgttaggattttattaacattataatttattaaagataaataatatagttatttaaaatttataaaatatttaggatatttaccgaaaaatgtttagaatatatataatatatgaaatgtattaaattaaataaccatttcaaaagaaaactttaaattgaattgaattataaatcttttaataaaaatattattagaacaaaaaaaaaaaaataatgtttaatttaccgaactagattagatggagagacggatgtagaatattataatgtatgacttttacaacaattaaataaccatttgaaagaagatttttaaattaatttgaattatatatcttttaaattaaagtattattaaaataaaataacaaaaacaaaatgtttaatttcagtgaacgagtttagatggtaggacagatttgggtcgattgtaatacgagatgatataccaagagtgaaatctattagatatgtttagtttcagtgaacgagattacatggtaggacgagtttgagttgatagtaatacgagacgttataccatgggtgaaatcctagatataacaatcaaaatataattatattatcttaaaaacttaacaaaataaatattattaataaaataaacataattaaaatttaaattatttaataataatctagattttaacttaatgaactgtacattattgttcctatatttttaaacagtaaaaatcaaacatagtaagagttatacattcagaaaatacaaaacattaaaggcaaaaatgcttaaaaaatcccaaacaaattttaatttggaagtttaatactcaatacttttggattgaaataaaaatacatcacttaataaattgttgccaaataaaacactgtattttaattattggtcgaatcggacatataagttaacagccgttaacaggcttaacaaattaaatttttatttgtaaaaaaccaaaatagtcccgcgatattcagcggattaaaatctagtttcttgtaaatattcaattcaaacccccaaaaaatacttaatttctttcaaaaatgatttttcaacatcttaaatgtgtttccactctcaaaaactatcgctgatccactaaatttcatatccatccaaatccaagttttacttttacttaaaagcgtaatttactaaaattggtgactcccactcccacatttgatcttaaacagctttatattctcaactttcccctttccataatttaaaaatagatcttcttttacattgagaatcagcatgattggagatggctagtgggcataaaatgttaggaatagaccacataaataaagcataaatcatataattataacaataccttttattggtaattggcatacactttcaagtttatatttggattatttcattagcttttttaaaattaaaatgtagaaaaccacttcctacaattagaagaattttattttaaaatctacgacaaaagaaaatatgttccttttcaatcattctacttaaatctttaggaccaggtttaaacaaacttcatgtcggtatgtctctcattgtcaagatctgaagatttgttttttttttttttgaaagaaagaaagaaagagacaaaacttcaataatttacattttttattctagatgaataaggagtgaaaattcgggtaagcgggtcgggttcagataaaatttgatcggatacggattcttcggttaaaaatgtttaggacccaataggataaatctaaaatattggttcgattttggttcaggtccaattggatttgggttggttcgatatagattttcaggtctttttttaaaccgatactcgaattttcgggtaaataccagaactttcggataaaatttcggatttttgattaaatttaaattttcgaataaaaattcgggtatatttggattcggatcggattcgaattcgattttttggataaagaaatttagaagtcaataaaataaaccttccggttgatttaagttcagataattagattttttggataaagaaatttagaagtcaataaaataaaccttccggttgatttaggttcagataatcagttccggttttttttggccaggcctactgatgaactgttattttggtaacttctaaatatcaaaacggtcctgaatcaggactgataaaacgttaaaaaagaaaaaaaaaagatctactcgtcttctttgtttgttcgttacagtttttacaaaaaccgacagacactttatctcaagagactgggtcaggcctctgttcaatctctatcaaaatccctttcgacatcattcataaacactgacgaatcagtgaaacaatatctcaaacccagaaaccaacaataattcatagattactactatacaaaattctatataactataatctgttctcttgtgtgtttctcgcgtggcttgcgtgttacttcattcatcactgctttagcttctcctcatatgaatctcgaggcaatccagtcactgacttttctcactccccatctctagggtttctctctttcccttattttataatttatttcattgaatctctgaatttcattctcttttgtggagtacatttgtgtaaagcttagatttttatttgggtttcaagcaaaccgagaaaagaaacgattagatctcctttttctgggtttgttctcaaagatttgttctgtttcagttcttccaatttggggggattttatgttggatccagtctctaaaggttcgattttgatgtgtttccttgatatgtaatcagatttgaatcttaaagtttctatctttatgactcctttcaggttaaaactgtgagcatttggagtagcaaaagtaacaaagcatg

SEQ ID NO: 20897 - DNA, 3003 bp, Unknown; identical to SEQ ID NO: 20896
  misc_feature (1)..( 3003): 2750-1469P.txt file - cDNA_ID_1829886; gDNA_ID_2926131; Annot_ID_138748

SEQ ID NO: 20898 - DNA, 3000 bp, Unknown; identical to SEQ ID NO: 6058
  misc_feature (1)..( 3000): 2750-1469P.txt file - cDNA_ID_1829886; gDNA_ID_1620841; Annot_ID_50887

SEQ ID NO: 20899 - DNA, 3000 bp, Unknown; identical to SEQ ID NO: 6058
  misc_feature (1)..( 3000): 2750-1469P.txt file - cDNA_ID_1829886; gDNA_ID_1620841; Annot_ID_170053

SEQ ID NO: 20900 - DNA, 3003 bp, Unknown
  misc_feature (1)..( 3003): 2750-1469P.txt file - cDNA_ID_1829890; gDNA_ID_2926131; Annot_ID_138749
accattgaaggaattgagaaagttgcaccgttcttgaaagtcattatcgaaaagtgagttctcttgttctctaaaattgttccattcttcatgacattaaatatgaggaacattttgactaacagtggacctttttgttcacagagatttcataaaatcgctgatacaaggtttgctagccggtattgcgttgaagcttttcctcatctttctgccagccatactgatgaccatgtccaaatttgaaggctttacttcagtttcattcttagaaagacgatccgcgtctagatattacatctttaacttagtgaacgtctttcttggaagtgttatcgctggagctgcgtttgagcagcttaactctttcctcaatcaatcgcctaatcagtacgtgactctctatctctgttaatctttcgttctttttgggttacaggcttttctaaggactcttctttttaaaaatctgtgcagaatccctaagactattggcatggcgataccgatgaaagcaaccttctttatcacatatataatggttgatggttgggcaggagttgcaggagagattcttatgttgaaacctctcattatataccacctcaaaaacgcattcttggtgaaaacagagaaagacagagaggaagcaatgaacccgggaagcatcggtttcaacactggagagcctcagatacagctttacttccttcttggtcttgtctatgctcctgtgacaccaatgcttcttccttttatcttagtctttttcgctcttgcttatgtcgtataccgccatcaggtaaatgtagtttctttctctcctaaatttgatgaaactggctagtttgataacttgaaccttctgtttatttgttttcttattctcagatcataaatgtgtataatcaagagtatgagagcgctgctgcgttttggccggatgttcatggacgggttataacggcattgatcatatctcagttgcttctgatgggtttgttaggtacaaaacatgccgcttcagctgctccgtttctcattgctcttcctgtgattactatcggtttccaccgcttctgtaaaggccgtttcgaacctgcctttgtccgttaccccttacaggtcagtttcttctacgttatctagatttattatttctgtttagttcgatttttgtcactgtttggatcggttttacgagccccagaaatggcaaaatgttgattattttacaggaagctatgatgaaagatacattggaaagagcaagagagccaaatctgaacctgaaaggttacttgcaagacgcttatattcatccggtttttaaaggcggtgataatgatgacgacggtgacatgatcggaaaattggagaatgaagtcatcatagtgccaacaaaacgccaatcgcggaggaacactcctgcaccgagcagaatcagcggtgaatcgtctccatctttggccgttattaacggtaaagaagtctagtttaacggtttcaattcagtaaaagcatctgcatacgatttaagtatgaatatagttcgtgtatgtatgtacttttatgtgtacatagagaggtttgtgtttttgcttagacgttgttgatgggttttaattgttgaagtattgaagtttcagggtatttttagaataatatcattttaattgggtgtttttcaaacaatgaatttgtggcaatcttgccaaacaaaaatatacgaaatggtcgaatagttgaggcggttagggcggacaaattcatttgcgatttaaaccatttttgtgtacctttcataaactatataagccatgctagtgtaggttgaaaaagatagaacaagttgaactacagaccggttttacttaaagttagtccgtggtggtttattgtccgattcaaaaatagagtggtttagtcgattaacggattagtctgttttctcatgtcatccattgaaagccgaagagtttgtagaagtaaacaaaaagatataaacaataataaaacaagaattgcataattttgtattcaacagaaattataaaaaaacttatagaaagccacattacagtacaagaaatcattcttatatctaataataggagaagtacatgatttttcatcccaaaaaaaaaaaagaggtacatgatttacacctcgtcgatatcctaacgattaaaaaactgtaactactgattttactacagtatatatgtatcgacaacataacaatgtcgtgacttatatactgttgagctcctaagaaaaaaataacgctattattgatttcacaatagtagcaatctcaactccatagcgaatgacgtagagaaatgtaaccaagacattttttcagaaactatgatcgatatatttcaagaaaggtagacaaaaagtgagaggctattatgtgaatgaagtaaaaaagtagaactattgaggctaatttatagagaatgaattgtaaataagcaatgcgatgggctgcaaactcttctcgtaaatctgcaaatttattaagacagtgcacctaaatattaatgaagagagttaatgaatcaataaatttgaacatcgtgacttgttaagtttggtgagaggggaataaggaacgttctatatgtaaagcaatgataattaagagttaaggagttcatagttcatgtttttctctagtttggacttgagtccaaaatccaaattaatccaaaacaatgttgagcctaaactgtcccaagactcccaacaactcaggaagctcttgctgttttccttttaatcattgtgatattacattcttgatcgtcccacagggaaaatattttagccgttagaccaaatgataaaaaactgtaactgttgatgggaacggcgtcgtttcgctaaccttcgttttaactgatctcaattctcaaggttcaaaagagtacacacacacttatctcaattatccactgaaacattcgtctccggcgaaacaaaaccagaatg

SEQ ID NO: 20901 - DNA, 3000 bp, Unknown; identical to SEQ ID NO: 6055
  misc_feature (1)..( 3000): 2750-1469P.txt file - cDNA_ID_1829890; gDNA_ID_1620841; Annot_ID_50886

SEQ ID NO: 20902 - DNA, 3000 bp, Unknown
  misc_feature (1)..( 3000): 2750-1469P.txt file - cDNA_ID_1829917; gDNA_ID_1620842; Annot_ID_50911
agatcttacgaaaaaataaactagaaagatcttacaaacaaactagaaagaaaaaaaaatctctacatctaagaagatgaaaaaatgtgagatgacatagggaaccgtgacactctcttttccttttattattagtgtggtgttagaaccctttttcttcttttattaaaaaaaaacactagagcaaccttcaaaacactctcttttccttttattattagtgtggtgttagaaccctttttcttcttttattattagtgtctcgtgtttttcatttcacacagatattagtaccctcccacatttatctttaatcgtcatacactgtgattaaatttctagatgaacagcacaataaatgagttgtggggttatgggcaaaaaaaataaacgttggctggtgaaataaacttattttataaaaccacttgtttcctatttattttgaacatgttttttttttttttgcctctctctctctctacatatataacttcgttaccttaaacatccatcttcgaccatcaatgtcaatttctatcttatgccccctaggattcctgtcatacgtagctcttgggtcattatcattcgcaaacttcgttaccaatgatgatttacaaaccctaacaaaatttagcaaacaattcaattaagatgatatatatgaaaaaattacaatgtctaagaaaagagaatagaaaaaacctacgatgtcaaagaaaaattaatagaaagaggggataaattacccttcatcgccgatgacgaaaaccaatatattcattgtactatattcaggcgtttgaactaggatgagaggatgaagatttatcttgataagatgtttaaggactagaaagatcttaagaaaaactataaactaggaagatcttacaaataaactagaaagaaataaaatctctagatttaaaaagatgaaaaatgtgaggtgacatggggaaccgtgatagagcaaccttcaagacactctattttccttttattattggtgtggtattgtaacactttttcttcttttataattggtgtctcgtgattttcatttcacacagttaataatactttcccacatttatctttaatgtcacacattgtgattaattctctagatgaacaacacaataaatgagctgtagagttatgggcaaaaaaataaataaattttggttggtgagataaacttattttgtaaaaatcacttgtttcctatttattttgaacgtgtgtttgtatatttttctctctctctcttcaacatccatcttcgaccatcaatgtcaatttctctcttatgctccctagaatttctgtcatacgcagcccttgggccattaccatctcgacaaacttcgttatcaatgataatttaccaaccttaacaaaatcaaacaaataattcaattaaggtgacatatattaaaaaactacaatgtctaaaaaaaggagaaaagaaaaaactacgatgtcaaagaaaaaataatagaaagaatggataaattacacttcatcaccgatgacaaaaaccagtaaattgattgtactagaaagatcttacgaaacactataaattaaaaagatcttacaaacaaactagagagaaaaaaaaatctctagatctaaaagcatctccaacagaccctcaaaccctcaaatttgaggggtttttaactctaactccaacaacccttcaaaccctcatggcactattcacaccctcaaaatatttctcttatttcattttagtctttgtactttatattccttacaaataattctattaaagtcaactatttcaaatatattcatataaatttaaataaatgaaaattatttaaatataaaaaacaaatacaacaataatagtacactgagcatttcaacacaaattaaaattaacattacaatgataaataaatacataaacacacaaaataaattaacacttgaaaaaattacattaaaacataactaataaaaaattaaattcgtaatgcaatattaatattcaggtaaatttgatcctgaacctccaagatcaccaaaatattgtccataaacatttgatggaatcggaggttgttgttgttcttgatttcttttttgtatgattcttgcttgttcagatcgtataaattcacatgtattactatcatcaatatcgcttaaacgtgttagcaatattttattttccttccctatttcttttagagctaatttttttgcttgattttgcatacgcaattgagccatctcataatccttgcttctagttgatgcactttctttcaaaaaatcaagagagacatctcataacaagaagcatgccgaaaagatgttgaacgtgcgtttggagtcttacaatcgaagtttgctatcatagcatgatcgtcatgttactggaacaaagaagtattgcatgatataatgacagcttgcattataatgcataacataataattgaggatgaacatgatatcaatgcactgattagagattcaagattgatgccaccgccaacagttgaaacggggttaaatgaacagacaagatttcaacaatttttatcttataatctacagataaaaaataaagagactaatttatcactttgaaatgcattgagtgatcatatatgggagcattttggaaatatttatatagagtaattttgtaattttataaatcattttatgtttttttttatgttttttttttaatttatatataatattatattattatatggagttttttttttaaatcttgtttggcataattgtttctataatatatgtgttatatttatttgtgaaagttttatcactataactgattattgttaaaaattgaggattataatgtaaatacttcaaaaaattaaaataaatttgtgggtataccattggagtaagtgaccctcaaatcttcattttgagggtgtgccccctttaaaatgagggccattgttggagatg

SEQ ID NO: 20903 - DNA, 3003 bp, Unknown
  misc_feature (1)..( 3003): 2750-1469P.txt file - cDNA_ID_1829917; gDNA_ID_1620763; Annot_ID_50072
gagagatcttacgaaaaaataaactagaaagatcttacaaacaaactagaaagaaaaaaaaatctctacatctaagaagatgaaaaaatgtgagatgacatagggaaccgtgacactctcttttccttttattattagtgtggtgttagaaccctttttcttcttttattaaaaaaaaacactagagcaaccttcaaaacactctcttttccttttattattagtgtggtgttagaaccctttttcttcttttattattagtgtctcgtgtttttcatttcacacagatattagtaccctcccacatttatctttaatcgtcatacactgtgattaaatttctagatgaacagcacaataaatgagttgtggggttatgggcaaaaaaaataaacgttggctggtgaaataaacttattttataaaaccacttgtttcctatttattttgaacatgttttttttttttttgcctctctctctctctacatatataacttcgttaccttaaacatccatcttcgaccatcaatgtcaatttctatcttatgccccctaggattcctgtcatacgtagctcttgggtcattatcattcgcaaacttcgttaccaatgatgatttacaaaccctaacaaaatttagcaaacaattcaattaagatgatatatatgaaaaaattacaatgtctaagaaaagagaatagaaaaaacctacgatgtcaaagaaaaattaatagaaagaggggataaattacccttcatcgccgatgacgaaaaccaatatattcattgtactatattcaggcgtttgaactaggatgagaggatgaagatttatcttgataagatgtttaaggactagaaagatcttaagaaaaactataaactaggaagatcttacaaataaactagaaagaaataaaatctctagatttaaaaagatgaaaaatgtgaggtgacatggggaaccgtgatagagcaaccttcaagacactctattttccttttattattggtgtggtattgtaacactttttcttcttttataattggtgtctcgtgattttcatttcacacagttaataatactttcccacatttatctttaatgtcacacattgtgattaattctctagatgaacaacacaataaatgagctgtagagttatgggcaaaaaaataaataaattttggttggtgagataaacttattttgtaaaaatcacttgtttcctatttattttgaacgtgtgtttgtatatttttctctctctctcttcaacatccatcttcgaccatcaatgtcaatttctctcttatgctccctagaatttctgtcatacgcagcccttgggccattaccatctcgacaaacttcgttatcaatgataatttaccaaccttaacaaaatcaaacaaataattcaattaaggtgacatatattaaaaaactacaatgtctaaaaaaaggagaaaagaaaaaactacgatgtcaaagaaaaaataatagaaagaatggataaattacacttcatcaccgatgacaaaaaccagtaaattgattgtactagaaagatcttacgaaacactataaattaaaaagatcttacaaacaaactagagagaaaaaaaaatctctagatctaaaagcatctccaacagaccctcaaaccctcaaatttgaggggtttttaactctaactccaacaacccttcaaaccctcatggcactattcacaccctcaaaatatttctcttatttcattttagtctttgtactttatattccttacaaataattctattaaagtcaactatttcaaatatattcatataaatttaaataaatgaaaattatttaaatataaaaaacaaatacaacaataatagtacactgagcatttcaacacaaattaaaattaacattacaatgataaataaatacataaacacacaaaataaattaacacttgaaaaaattacattaaaacataactaataaaaaattaaattcgtaatgcaatattaatattcaggtaaatttgatcctgaacctccaagatcaccaaaatattgtccataaacatttgatggaatcggaggttgttgttgttcttgatttcttttttgtatgattcttgcttgttcagatcgtataaattcacatgtattactatcatcaatatcgcttaaacgtgttagcaatattttattttccttccctatttcttttagagctaatttttttgcttgattttgcatacgcaattgagccatctcataatccttgcttctagttgatgcactttctttcaaaaaatcaagagagacatctcataacaagaagcatgccgaaaagatgttgaacgtgcgtttggagtcttacaatcgaagtttgctatcatagcatgatcgtcatgttactggaacaaagaagtattgcatgatataatgacagcttgcattataatgcataacataataattgaggatgaacatgatatcaatgcactgattagagattcaagattgatgccaccgccaacagttgaaacggggttaaatgaacagacaagatttcaacaatttttatcttataatctacagataaaaaataaagagactaatttatcactttgaaatgcattgagtgatcatatatgggagcattttggaaatatttatatagagtaattttgtaattttataaatcattttatgtttttttttatgttttttttttaatttatatataatattatattattatatggagttttttttttaaatcttgtttggcataattgtttctataatatatgtgttatatttatttgtgaaagttttatcactataactgattattgttaaaaattgaggattataatgtaaatacttcaaaaaattaaaataaatttgtgggtataccattggagtaagtgaccctcaaatcttcattttgagggtgtgccccctttaaaatgagggccattgttggagatg

SEQ ID NO: 20904 - DNA, 3003 bp, Unknown; identical to SEQ ID NO: 20903
  misc_feature (1)..( 3003): 2750-1469P.txt file - cDNA_ID_1829917; gDNA_ID_2926194; Annot_ID_141196

SEQ ID NO: 20905 - DNA, 3000 bp, Unknown; identical to SEQ ID NO: 6077
  misc_feature (1)..( 3000): 2750-1469P.txt file - cDNA_ID_1829921; gDNA_ID_1620842; Annot_ID_50909

SEQ ID NO: 20906 - DNA, 3003 bp, Unknown
  misc_feature (1)..( 3003): 2750-1469P.txt file - cDNA_ID_1829921; gDNA_ID_2926194; Annot_ID_141198
gaatggagtagcatgctagtttagacaaatataaaatggtggaagagtaaatattcaattttgagagggtaataatgtaatcaataacatgctagtttagacaaatactcccaaaagaatgtctcaaactcaaagagttggttagaatttaaagtgtccaaatacacaaataccccaaattttatactatttatgtggctagtggctacatacaaatttatccagtgaacttgtgtgataatttactgtcttaaaagtttatctgtatctagaaatagaagatccgatcaacaaaatacgagtgagcatttcttcatggatcatgatcagaaactttcttatgaaaaacaatgagcaccacttttatgggtcactaagggttcgtgagttaaccccatacctcttttgtgtgtgtgccataggtagtggaaaagggaatctactgatgttagagggtggtgctgtttcggcgacccacaaatctggacgatgtaggcccaaattttacctcaccccaccattttcgtagacttttcattccggtcccataattttacatttcgttggtctaacccatcattcattgattctttacctttttgccaagaggctacttaacctttttgctctttatggattggtgataataatttagtctcaccataaaattcaatgtttttctagtcaacaccatctaaattctaattcaacatttttttcaacgctaattaaaacgaaattcacatatttttagatttatgactactagataaacaagttttatcgaaacttttttcaacaaaaatttcatgcgaaacaacaaaccacggatcaatacttactaatcacggatcggaatcttctatttttttttttttctattttgtaactatcatatttaatgttttcaactaatcacgtagaagggagctttttcaactattagtgaattgacttgtaaacaaaaggagaagtcaaataagaacaacgataatagtagaagaagctcttagactaattaattaatatcttagaggtacaaaaacaatttgattattattactttatgcgtcatctcttagatcatcttccacgggcctcatggacatggacattgacatcatgactcatgagtttggttggtgtaaagttcaaaaatattaacacataacaccaaacgatcaatgtcttatacatatttctatgtttaaaattcactaaaatatgttgcaaacagaataaaaaatattagctgcttataccaattgtagaagaataatatatagcaacaaaaataatatagaatgagtacaaaatggaaaataatctggtgtgtatataagttgattttcataaaattctgatagtaatatttgacacaaatcattcataaattaaaattttctatttaatagcattttgaaaaaaaattatttaaattataaattaacattttctatttaatagcattttgaaaaaattatattattcataaatgatgcattgaaatgttagatttatggtaaacatcaatctttatacattattaaaactcgttgaaaagtttaagtatcaactaaatttataggcgtttattgttttaaaagtttagaaccataaagttcaaatcattccaccacaattttgatcaaagttaaccacaacaaatgacaaggattagatgttacttggaatcgtttgattatagataaagaaaacgatattagtacttttatagttcagaataaatacataattggaagtcattttatgtgatacggcaagataactcttttgttcagcgccgttcttttgttgtcccaaggaactattgtgcgtaaacatcaaccccaaaaatgcataccatgtcacaactttttgaaagaacttaaattaacttaccaattttacaagaagtgaatacaactaatacagctttttaacctaggcttaattgcacgctaatgcttacaacatattccatcagattctgtcttttctttataaaaagttttagagatttctttctatttcaaattatttggtgttttacatctaaagtgtaagaaaccaattttcttttttttcaaaacgcaactaaaaaaaatcctttacatattatacattttattcttatttcattaataataaaatataatttattttataattttctctatcatgtattcttcaataatataacatcatattttgaccccacaaaaaaacttatataaagagtacaagaaaaacaaaactaatgtttgatagcttttacatttttaaaatctgagaaaattgaagttttaactccatcaaataacattgcaaaatcacataaaaattatgatttgtgatttcacgtttaaattttgttttgttagaaatctatttgataaagtagacgtttatataccaacataatcgtctaggtaattaaattagacatccacataacaaaatagcatgttatatatatttttaaaaatcacatattcgataataattaaataaaagttattaaaaaattaaaaatcaatatactatttaatggcgatcaaaaacatcattatttgtttttaaatttcatcgtcaaatcttgccatctacctaatttaaccacacaaaaacatcatcaaattattcctgtataataccaaattaaactcttttgtccaaaacaatttcaaaaaagaaaactctgtggaataagaaacgggcaaagaggggccagaagtttagccacgtcagctacaagagagtgccacatcatcaccataagcctctcccacctgtacggatccctcccaatataaattggaaccaaactctctcctcagaaaaaaccttctcattacacttgcatgtgcaacgacccgaccctatacccgacccggcccacattttaaacccattttagccttttctgtttccgccgccgactgatcggaataatcgatcaaagagagaacaactgaatcttcgccggatactacgccgatg

SEQ ID NO: 20907 - DNA, 3003 bp, Unknown
  misc_feature (1)..( 3003): 2750-1469P.txt file - cDNA_ID_1829948; gDNA_ID_1620842; Annot_ID_50901
atttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagcaatg

SEQ ID NO: 20908 - DNA, 3003 bp, Unknown
  misc_feature (1)..( 3003): 2750-1469P.txt file - cDNA_ID_1829948; gDNA_ID_1620842; Annot_ID_170081
taaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagcaatgacttggagtgatgaccagagttacttactcattgtagaaagtcaaacgtggcaacacagctttgcacgcttcattgacatacacgtcgacgaaaaaaccatatccgctcatcgagaaagtcggaatttttccgagaaaattcaaaagggcgaaaaaaagagcttttgcgtacagttttcgaattggtctccttcgtacgggtaaaatcagctcaaaaacctgacctttatttttctggttcttcacatttcccgatctgattttagagtcatagcttttctaaagttctcaatttgaactcatactgtttctgggttcttctttcgatgtctctggtgattttaacttttgtgctatttttaattcgatgctgaactgattagggttgatactgtttctggtcattattcactacgcagataaagacgacggctttgattttttttgtttggatttagggttttgtgatttctaatctctccttgtttattaaatctctcagtagattgattgtcaaattgaagattgatgaaactctgatatgatcgtaatcgtcgactgttttctttgattttagctcttcataattgggtttaaatggcaagagggttttaatagttttgacttacattgattgttaaacttaaattgatgattgatgaaactgaggtttggtcgtaatcgtcgattgttttctttgattttagctcttcatagtttggtttaagtgacaataaaggttttagcttcagagtgtggaatgtgttattgatgaaagttggaacatttttactggcttttacaggcaagctatggttcaagagaactatgaatgaaactgtggtgtaagagaatatcaatggttgttatctgctataatgttttttggaccaagtgagtttgatgctgatgaaatg

SEQ ID NO: 20909 - DNA, 3000 bp, Unknown
  misc_feature (1)..( 3000): 2750-1469P.txt file - cDNA_ID_1829948; gDNA_ID_2926194; Annot_ID_141206
tttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagcaatg

SEQ ID NO: 20910 - DNA, 3000 bp, Unknown
  misc_feature (1)..( 3000): 2750-1469P.txt file - cDNA_ID_1829948; gDNA_ID_2926194; Annot_ID_201317
attaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagcaatgacttggagtgatgaccagagttacttactcattgtagaaagtcaaacgtggcaacacagctttgcacgcttcattgacatacacgtcgacgaaaaaaccatatccgctcatcgagaaagtcggaatttttccgagaaaattcaaaagggcgaaaaaaagagcttttgcgtacagttttcgaattggtctccttcgtacgggtaaaatcagctcaaaaacctgacctttatttttctggttcttcacatttcccgatctgattttagagtcatagcttttctaaagttctcaatttgaactcatactgtttctgggttcttctttcgatgtctctggtgattttaacttttgtgctatttttaattcgatgctgaactgattagggttgatactgtttctggtcattattcactacgcagataaagacgacggctttgattttttttgtttggatttagggttttgtgatttctaatctctccttgtttattaaatctctcagtagattgattgtcaaattgaagattgatgaaactctgatatgatcgtaatcgtcgactgttttctttgattttagctcttcataattgggtttaaatggcaagagggttttaatagttttgacttacattgattgttaaacttaaattgatgattgatgaaactgaggtttggtcgtaatcgtcgattgttttctttgattttagctcttcatagtttggtttaagtgacaataaaggttttagcttcagagtgtggaatgtgttattgatgaaagttggaacatttttactggcttttacaggcaagctatggttcaagagaactatgaatgaaactgtggtgtaagagaatatcaatggttgttatctgctataatgttttttggaccaagtgagtttgatgctgatgaaatg

SEQ ID NO: 20911 - DNA, 3003 bp, Unknown
  misc_feature (1)..( 3003): 2750-1469P.txt file - cDNA_ID_1829952; gDNA_ID_1620842; Annot_ID_50900
tctatgtgtaagctttcatttcctttttactttggcacaaatatattaaccattattcgttcttcgaggttcatgctaatctagtccggtcatgtcatatggcaaacggactcgaaaagtcgagctatgggtatttggcctttataaataacatatgtggatctataacttaattttgattaatagaggcataatataactcaaatattaaataaataatatagacaatccaactcaaatattaaataaataatatagacaatccaatttctctagcaatcactttgtaatgctttttatgattttatttgctcgcatcactttcaatataataatggctttttttattcttctttaaaaaaaaaaaaaatgttggtacactactgtttttattattctctttcagaatcttcttgttgaaaataaagagtaatcaatcatttacttggtgatattgcagacacttaggaaacggtagaactcgtgctccgtatcgccgagtaagagtagcaggaaaaagatgataagatacacagcagcaatatgagataatctggttttggacacgtgaaaattaacttttcacagcagcaatatgatatgattttcacgtatccaaaaccggactatatcatagaggcaccaaagaacttgtggacgagaagcatccacgtctcttcagacgacccgtagattaccgcgacttgtttaccttctatcactcagaagctggtcgtaaagttcaatctactcttcaagcttacatgtgtgcgcttgattccaagttttaacagagttaggtgattttaagtttgtcaaaaaccatgtagtaagaaaaaagggtttttgattagttgagtcatgtctgtttctgtgtgattcgtctttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatg

SEQ ID NO: 20912 - DNA, 3000 bp, Unknown
  misc_feature (1)..( 3000): 2750-1469P.txt file - cDNA_ID_1829952; gDNA_ID_2926194; Annot_ID_141207
atgtgtaagctttcatttcctttttactttggcacaaatatattaaccattattcgttcttcgaggttcatgctaatctagtccggtcatgtcatatggcaaacggactcgaaaagtcgagctatgggtatttggcctttataaataacatatgtggatctataacttaattttgattaatagaggcataatataactcaaatattaaataaataatatagacaatccaactcaaatattaaataaataatatagacaatccaatttctctagcaatcactttgtaatgctttttatgattttatttgctcgcatcactttcaatataataatggctttttttattcttctttaaaaaaaaaaaaaatgttggtacactactgtttttattattctctttcagaatcttcttgttgaaaataaagagtaatcaatcatttacttggtgatattgcagacacttaggaaacggtagaactcgtgctccgtatcgccgagtaagagtagcaggaaaaagatgataagatacacagcagcaatatgagataatctggttttggacacgtgaaaattaacttttcacagcagcaatatgatatgattttcacgtatccaaaaccggactatatcatagaggcaccaaagaacttgtggacgagaagcatccacgtctcttcagacgacccgtagattaccgcgacttgtttaccttctatcactcagaagctggtcgtaaagttcaatctactcttcaagcttacatgtgtgcgcttgattccaagttttaacagagttaggtgattttaagtttgtcaaaaaccatgtagtaagaaaaaagggtttttgattagttgagtcatgtctgtttctgtgtgattcgtctttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatg

SEQ ID NO: 20913 - DNA, 3003 bp, Unknown
  misc_feature (1)..( 3003): 2750-1469P.txt file - cDNA_ID_1829971; gDNA_ID_1620842; Annot_ID_50895
tatcccgagacacatatattatttcttatatacacatgttttgctgatttggttttaatggatatttgtatatgtaggttctctgttgcgccatgcagaatccttgatccctagttccctcaacgaggaagattttctgcttttgaggtaacataaagcctcttcagtcattctacttttcacctatgactacattaaagttttgtagttctcgagctgtactattttatgtagccgttgatattatttttttccggtatattgtcttctgcagggtgttttgtgaccagttacagccgttaatccattccgagtttgaggaaagtcaagtacaggtgaaggtgaaaaagctttttgctctcttatacattggttttacaattctctggcttatctgtttagttacactgatacaagtaggtgtaacaaggttttactcatgtccatcgtatgttaaatttctacgtaagacagatcttttgctaaccttcaaatgttatgttgtactaggatattgaaggtaggggcgggaatttatctggtaagctaaaagagcttctgaatcttaacaatgaggaagcttcagaggattgtgatgtccgagttgaaggtgtgatgacaaagcaaggcgtgaacgaggagatagacacagttgaaaggttgaaagagagcgatgcagatgctagcaatcttgaaaccagtggttcagatacaagctctaacagagggaagggtctggttgaagagggagagttggttcagaatatgagcaagcgatttaaaggcagtgcatcaggagaggtgaaggaggatgagaaatctgaaaccttccttgtctttgagaagcagaagaagaaacggaagcgtagtattatgaatgctgatcaaatggggatgattgagaaggcgcttgctgaagaacctgatttgcagcggaattcagcttcgagacagttatgggctgataaaataagtcaaaaggtgagttcaagaattctactctttttaatttccaaccacgtattacgaacgatgcgctcgttgattacatgattttgcagggttcggaggttattacatcttcgcagctgaaaaactggtacttgcttttatttgttcctcttcgtcagctgcaaagagaatctcgtaatcactattcattatctgacattgaaagtttattatcaggctgaataaccgaaaagcgaaactagctcgagcaaacaagcaaacggggccagctcatgataataacagctcaggggatctaccggagagtcctggagatgaaaacacttggcagcagaaaccatcaacaccaattaaagatcaaactgtaacagaaaccccgaaaacaggagagaatctgatgagaacatcgtcatcatcagaagaagggataaagcaagggcaacaagtgaggcttatggatgagagaggagacgagatcgggaagggaacagtgttgagaacagacggtgaatggaacggtttaagcttggagacaagacagatatgtgtagttgatgtaatggagcttagtgagtcatatgatgggagcaaaaagatgatcccttatggatcagatgatgttgggaggactttcacagaggcgaattcaaggtttggagttatgagagtggcttgggatgtgaataagcttcagtattagactcagttgcattgaatttgaccagtaggtttttgatttttgtttatttttaactgtttagagattctcctctgttttgtgagctttgtctctctctctctgtggttatttacaggcaaaggttgagactttgagaggaaggtaataacagaaggaatagtttgacttttttaatctcagttagttgactttacagctatttaaagaaacaaattttaattgtttcgtgatttaaggagattaactatagtaaatttaagaagaaatcaattccataaagtagctaatgattatatttgaatatttaggtggtgttattcaattatggagttaaagtcaattctttaaactttagatttgttttctatattgtttttaaaaatatgtttgtatgaatttcaaaatctctgcaatatgtcatggatttcgattctaatgatttactcatgaaactccaaagaggtttcatttcaaatgaattaatatacaaggattttacaagatttttagttttgaataacactggattttaatgaaatatttaaaatcttaattgaataacactaaactttaaaatctattaagcatgatttacaaagatgagttccaataacactagattttaaaactggatttagaatcattagttgaataacagtggattagtgttggatttcaattctattaaaatccattaactaataacacccccttagataaattaccaataaggctacagcttatgcattattattaaatttgttgaaaatgtgtatagaattagaatgttcctctaaacgaaaattcaaatttcaaagtttcgataataaagtgttgaaatagaaatgcttttcttagaattgtctacacacagtatttaccagatataaaaaaaaataacaaagggtaatctagacaattcacatacatataaagccgttgactaaagaagaagactaaaagtccagctcagcgaaaacgccttttctatccgaagaaaactgtgtcctccaaaactcggcgaagcaaagatttttattttattttttcttctcttttaattcaaaaacaaaaaatagtctctgaaaaaaaaagaaaggtttttactttgtggagaagacagagtccgtccgtcgtaactcgccaccgttctccgccgtgaattcttcttactccttcgatctgaactttctacctagttctttcgtccagtgccgtagtctttccttctttgattcgctttctaggtttcgtcttctcatttctctgcttctggttcagtattttggctgttgcgggatcgatttatacccgtaaagtggtttccaatg

SEQ ID NO: 20914 - DNA, 3000 bp, Unknown
  misc_feature (1)..( 3000): 2750-1469P.txt file - cDNA_ID_1829971; gDNA_ID_2926205; Annot_ID_141677
cccgagacacatatattatttcttatatacacatgttttgctgatttggttttaatggatatttgtatatgtaggttctctgttgcgccatgcagaatccttgatccctagttccctcaacgaggaagattttctgcttttgaggtaacataaagcctcttcagtcattctacttttcacctatgactacattaaagttttgtagttctcgagctgtactattttatgtagccgttgatattatttttttccggtatattgtcttctgcagggtgttttgtgaccagttacagccgttaatccattccgagtttgaggaaagtcaagtacaggtgaaggtgaaaaagctttttgctctcttatacattggttttacaattctctggcttatctgtttagttacactgatacaagtaggtgtaacaaggttttactcatgtccatcgtatgttaaatttctacgtaagacagatcttttgctaaccttcaaatgttatgttgtactaggatattgaaggtaggggcgggaatttatctggtaagctaaaagagcttctgaatcttaacaatgaggaagcttcagaggattgtgatgtccgagttgaaggtgtgatgacaaagcaaggcgtgaacgaggagatagacacagttgaaaggttgaaagagagcgatgcagatgctagcaatcttgaaaccagtggttcagatacaagctctaacagagggaagggtctggttgaagagggagagttggttcagaatatgagcaagcgatttaaaggcagtgcatcaggagaggtgaaggaggatgagaaatctgaaaccttccttgtctttgagaagcagaagaagaaacggaagcgtagtattatgaatgctgatcaaatggggatgattgagaaggcgcttgctgaagaacctgatttgcagcggaattcagcttcgagacagttatgggctgataaaataagtcaaaaggtgagttcaagaattctactctttttaatttccaaccacgtattacgaacgatgcgctcgttgattacatgattttgcagggttcggaggttattacatcttcgcagctgaaaaactggtacttgcttttatttgttcctcttcgtcagctgcaaagagaatctcgtaatcactattcattatctgacattgaaagtttattatcaggctgaataaccgaaaagcgaaactagctcgagcaaacaagcaaacggggccagctcatgataataacagctcaggggatctaccggagagtcctggagatgaaaacacttggcagcagaaaccatcaacaccaattaaagatcaaactgtaacagaaaccccgaaaacaggagagaatctgatgagaacatcgtcatcatcagaagaagggataaagcaagggcaacaagtgaggcttatggatgagagaggagacgagatcgggaagggaacagtgttgagaacagacggtgaatggaacggtttaagcttggagacaagacagatatgtgtagttgatgtaatggagcttagtgagtcatatgatgggagcaaaaagatgatcccttatggatcagatgatgttgggaggactttcacagaggcgaattcaaggtttggagttatgagagtggcttgggatgtgaataagcttcagtattagactcagttgcattgaatttgaccagtaggtttttgatttttgtttatttttaactgtttagagattctcctctgttttgtgagctttgtctctctctctctgtggttatttacaggcaaaggttgagactttgagaggaaggtaataacagaaggaatagtttgacttttttaatctcagttagttgactttacagctatttaaagaaacaaattttaattgtttcgtgatttaaggagattaactatagtaaatttaagaagaaatcaattccataaagtagctaatgattatatttgaatatttaggtggtgttattcaattatggagttaaagtcaattctttaaactttagatttgttttctatattgtttttaaaaatatgtttgtatgaatttcaaaatctctgcaatatgtcatggatttcgattctaatgatttactcatgaaactccaaagaggtttcatttcaaatgaattaatatacaaggattttacaagatttttagttttgaataacactggattttaatgaaatatttaaaatcttaattgaataacactaaactttaaaatctattaagcatgatttacaaagatgagttccaataacactagattttaaaactggatttagaatcattagttgaataacagtggattagtgttggatttcaattctattaaaatccattaactaataacacccccttagataaattaccaataaggctacagcttatgcattattattaaatttgttgaaaatgtgtatagaattagaatgttcctctaaacgaaaattcaaatttcaaagtttcgataataaagtgttgaaatagaaatgcttttcttagaattgtctacacacagtatttaccagatataaaaaaaaataacaaagggtaatctagacaattcacatacatataaagccgttgactaaagaagaagactaaaagtccagctcagcgaaaacgccttttctatccgaagaaaactgtgtcctccaaaactcggcgaagcaaagatttttattttattttttcttctcttttaattcaaaaacaaaaaatagtctctgaaaaaaaaagaaaggtttttactttgtggagaagacagagtccgtccgtcgtaactcgccaccgttctccgccgtgaattcttcttactccttcgatctgaactttctacctagttctttcgtccagtgccgtagtctttccttctttgattcgctttctaggtttcgtcttctcatttctctgcttctggttcagtattttggctgttgcgggatcgatttatacccgtaaagtggtttccaatg

SEQ ID NO: 20915 - DNA, 3003 bp, Unknown
  misc_feature (1)..( 3003): 2750-1469P.txt file - cDNA_ID_1829979; gDNA_ID_1620842; Annot_ID_50892
ggtatatttgcaagaccattataactacttaactgacagtgtttgaaattggaaataacttttttttttcttttaaaaaacaaaattggaaataacaaaattggagaaggaaatattaaaccatataatatttgctatgtacaaatattatttataaaatattttatgtttttattatctcaatgatggtgaacatatgtcagatttttacattctgtcatatataattgtttttacaaaaccataggttaaaaaaaaccaatttttttcaacttcatgcttcttaggttaggctattaggttcttccttcaaaaatatttgcgggaagttgctctcaaatataggattgaagcatttttcatattcatgagtggatgaatccaaaaggtttcgagcctctagaggttttctgcatgttttcgttgggttgtcccatccgatgttcccattggtttattatactgtttttcttaaagttttgttaaattttattatgttctctccttgatttcttatattattagtgtaagtatcttccatatttagtatcgaggaatatattatctattttttttttggaaaaatttaaactgttttgtagatgaatatatcaaactatgttaaattttatgtattttccatatatgctaaaaaaaaattctcgtgcaaactgaattttatttaagaatttaagtctttacaaaaaaaggttttttagccacattagctgattttctgaatttgcttgaaactacgtgaacattgaagaagctacgtgatgtgctacactattacaattacggtttgtgaatataaagataattgattcaaattttgaaacccaaaaatctatatttagaagtaaactggcaatgttcgaacagaatagtcatgccgttgaccgctataaaaaaattttaaacagaatataattacatgtatattaagaagttcaaaaagaagctatttgattcatcttttttttaatatatttttaaaccaaaatattgatagaacaatagggaaaagctcgagtttaaatatgacctcgtgaatttgttttttgttgtgtttttgaattattgttaaattatattcaaaaaaagaaaaaaatgttttacagcttaatgaatacgatttcaaaaacaaattctaacaacacaattggaacttaagctcgtcttgtagcaaaccaaacttgaagatcctcttcatacttatggattcccctataccccgaattgtacttaaacgatttctcacatttttgtcgatcatcttgatctggtggttatggttgttcaccgtgtcttcttgcattcctctctctccaaattgagtgtaccgtattttgaaagatatataggagaatgtaaacttttgttttctcatgtacattatgttaaacttaaatatatattccatttatttttagtataaagtttttcaacaaaatcttgatgtaacaacatgagtactttagaatagatgaaaataaaactagcttataaaatacaaaatgtaaaaataatctaaaaatgatgtaaaacacaaaatataaaatacaaaacgtaaaaatgagacatcaatatattgttctgtgaactttatatatagattagttacaaataatctattgtaaatattttaagatagacaataaattaatactttttagtaaaacatacaactagttaataatctaacgaccaatataaatcaactgccaaaacaaaatatatgaaattatattttctcaaaagttaattggttgtcttaaaatgaagatgttgactctgagtctatgatattagtcaaaatgcattttaacttttatgtacattccttgtatactaaaatgtctaaaaacacggtattgaatttcatttattccgtattataaaaaattacaaaaaagcccttcaaaatatatggaaacaaaattgtaaaataactgtaaaaagtaaaattatggttttgagataccaatatatttttgtatgaaattttatccaaacaataaataaatattgtatttatttgttttaaaattatatatgatggaaaatgaatcaatatttgttgaaagttggcaaatggtagaaacctaacggctaagagaatacgacgacgcaaatgaactgttttgactaattttaggaaaaagataaaacggttctctttaacaaatttgtcgcgtttgaatacgacatcgttaaaaactatgttaaacattatatatatatactaaaaagttcaaaaaactataaaattttagttttctcatcctttttatctttaaattatcaatgatttgttgttgatagaccaataatagctcacactaaagtaatttaaattttgaacacacttaacctattatctgcacctaaactattttattctataagtagaatgctcgttccaacacctcatattgttcaaaatgctcgttcatttttagatcgtaattgtctaattattaatttataaaaattgacagctttccttttaaaaacaaaacaatacaggtttgactacaaatacacattttcgaacagatagatagagagagaaaaagaaacacaataaaacgcgcgtaaaaaggaaggctaatttagtctttttcgtcgtaactcccataacgagacaaaacaatcttaagtgttccctctcatcgtaaaagcttttctccttccttctatgtacagctgtaatggcaatatcgtaaataactcgtaacagaaagggcaattattgtcaacatttataatttaatttctcccaacttctcaaattccaccatttttcttcatcctctcctccataattgattttccttttttttgtttttccttcttgcaactaaaataaataaatttttagaaaccaaaaaaaaaattgtagagagagaaaaaaaaaactcagaggagagaaagagaagacgacgaagacgaccattttttttttttttgtcaagagagaagacggagacaacaatg

SEQ ID NO: 20916 - DNA, 3000 bp, Unknown; identical to SEQ ID NO: 5240
  misc_feature (1)..( 3000): 2750-1469P.txt file - cDNA_ID_1829979; gDNA_ID_1620775; Annot_ID_50254

SEQ ID NO: 20917 - DNA, 3000 bp, Unknown
  misc_feature (1)..( 3000): 2750-1469P.txt file - cDNA_ID_1829979; gDNA_ID_2926205; Annot_ID_141680
tatttgcaagaccattataactacttaactgacagtgtttgaaattggaaataacttttttttttcttttaaaaaacaaaattggaaataacaaaattggagaaggaaatattaaaccatataatatttgctatgtacaaatattatttataaaatattttatgtttttattatctcaatgatggtgaacatatgtcagatttttacattctgtcatatataattgtttttacaaaaccataggttaaaaaaaaccaatttttttcaacttcatgcttcttaggttaggctattaggttcttccttcaaaaatatttgcgggaagttgctctcaaatataggattgaagcatttttcatattcatgagtggatgaatccaaaaggtttcgagcctctagaggttttctgcatgttttcgttgggttgtcccatccgatgttcccattggtttattatactgtttttcttaaagttttgttaaattttattatgttctctccttgatttcttatattattagtgtaagtatcttccatatttagtatcgaggaatatattatctattttttttttggaaaaatttaaactgttttgtagatgaatatatcaaactatgttaaattttatgtattttccatatatgctaaaaaaaaattctcgtgcaaactgaattttatttaagaatttaagtctttacaaaaaaaggttttttagccacattagctgattttctgaatttgcttgaaactacgtgaacattgaagaagctacgtgatgtgctacactattacaattacggtttgtgaatataaagataattgattcaaattttgaaacccaaaaatctatatttagaagtaaactggcaatgttcgaacagaatagtcatgccgttgaccgctataaaaaaattttaaacagaatataattacatgtatattaagaagttcaaaaagaagctatttgattcatcttttttttaatatatttttaaaccaaaatattgatagaacaatagggaaaagctcgagtttaaatatgacctcgtgaatttgttttttgttgtgtttttgaattattgttaaattatattcaaaaaaagaaaaaaatgttttacagcttaatgaatacgatttcaaaaacaaattctaacaacacaattggaacttaagctcgtcttgtagcaaaccaaacttgaagatcctcttcatacttatggattcccctataccccgaattgtacttaaacgatttctcacatttttgtcgatcatcttgatctggtggttatggttgttcaccgtgtcttcttgcattcctctctctccaaattgagtgtaccgtattttgaaagatatataggagaatgtaaacttttgttttctcatgtacattatgttaaacttaaatatatattccatttatttttagtataaagtttttcaacaaaatcttgatgtaacaacatgagtactttagaatagatgaaaataaaactagcttataaaatacaaaatgtaaaaataatctaaaaatgatgtaaaacacaaaatataaaatacaaaacgtaaaaatgagacatcaatatattgttctgtgaactttatatatagattagttacaaataatctattgtaaatattttaagatagacaataaattaatactttttagtaaaacatacaactagttaataatctaacgaccaatataaatcaactgccaaaacaaaatatatgaaattatattttctcaaaagttaattggttgtcttaaaatgaagatgttgactctgagtctatgatattagtcaaaatgcattttaacttttatgtacattccttgtatactaaaatgtctaaaaacacggtattgaatttcatttattccgtattataaaaaattacaaaaaagcccttcaaaatatatggaaacaaaattgtaaaataactgtaaaaagtaaaattatggttttgagataccaatatatttttgtatgaaattttatccaaacaataaataaatattgtatttatttgttttaaaattatatatgatggaaaatgaatcaatatttgttgaaagttggcaaatggtagaaacctaacggctaagagaatacgacgacgcaaatgaactgttttgactaattttaggaaaaagataaaacggttctctttaacaaatttgtcgcgtttgaatacgacatcgttaaaaactatgttaaacattatatatatatactaaaaagttcaaaaaactataaaattttagttttctcatcctttttatctttaaattatcaatgatttgttgttgatagaccaataatagctcacactaaagtaatttaaattttgaacacacttaacctattatctgcacctaaactattttattctataagtagaatgctcgttccaacacctcatattgttcaaaatgctcgttcatttttagatcgtaattgtctaattattaatttataaaaattgacagctttccttttaaaaacaaaacaatacaggtttgactacaaatacacattttcgaacagatagatagagagagaaaaagaaacacaataaaacgcgcgtaaaaaggaaggctaatttagtctttttcgtcgtaactcccataacgagacaaaacaatcttaagtgttccctctcatcgtaaaagcttttctccttccttctatgtacagctgtaatggcaatatcgtaaataactcgtaacagaaagggcaattattgtcaacatttataatttaatttctcccaacttctcaaattccaccatttttcttcatcctctcctccataattgattttccttttttttgtttttccttcttgcaactaaaataaataaatttttagaaaccaaaaaaaaaattgtagagagagaaaaaaaaaactcagaggagagaaagagaagacgacgaagacgaccattttttttttttttgtcaagagagaagacggagacaacaaatg

SEQ ID NO: 20918 - DNA, 3000 bp, Unknown
  misc_feature (1)..( 3000): 2750-1469P.txt file - cDNA_ID_1829987; gDNA_ID_1620844; Annot_ID_50929
gtaatggagaccaagtaggagatgacaatacgtgcactgaccgaaatcacctcctgagatgacctcttgtgggctacaagtgaaggattttgttgtctcttgcttagttttaaactcttcgctcgcatagtaatgtgttgtggccgttcctactgtcaatcctcctagcgtcttaaattccttcccggcgtatataaactcaagaatcctccctccttcccttattggataaaacctttaaaagaaagcatagtaggaatttatgagataatgaagaactttttaatggaaaagaatagacaagaaatgaaaacagaccttgatctgtaagccgctgataatcggaaaatctgaagagtagtttgcgcgctatggcgagtaaacggaacatacttttgtctcccttctgttgttccagagctgcgtcataaagggagtgaaaagggatcaatacagaacatatatcacatacacataaacacagatatccatagatgcatgtagaaatatacctgagggacagaacagtgatgggttcttgtgtaagtaatggagaagtctctccatctgcaattctttgaatataaggatctaaatcagcatgtgaaacaataggcaccaaggaagtaaagagagtttccaaagtataatcgtccatcttttctacatcaacagtcccaagccatttcctcagatactccactccggagttgagctcaagaatccttcgtagcgtctcgctttggaccttgcaggcattttccgacacatgctcgaaccaaccaataacatcatcatgccccgcttctacagtttccatccaataccaagtctttcaaggcagtatagtatctcaacgatgcaaaatgagtagaagtcctaacccaacatataggggagtactggtcattgaccactccctttgtcttcagacaaaagaaatttctttgtgtgtatagttgttctcaccttttttgggtctccttatttgtctttttaataggaaaaacatcacagatacctccataaatgtcacgggaattaccgtccacaaattctatcaacacttaatacagctattaatgcgttctcacagaagagtatcccagtctcaacatgtgctcaagagacaaaccttaaccacaatgtattttgcaactatcatccagtgtggtcccatgaaagcctctttgcctcctaaaaaccaaaacccctacatcatgttagctatctttcaactgctttccctgttaataattcagtgaacatagccacaaatatggacattattaaatgaacagagctctcaaacacctatttgagcaaaatagcattagaaaattttagttcttcctataatgtggctaaccttttgatgtttctttctctgcaaatatctggataagcatgtaggaccaaagctaccaagcatcacaagttgcacaagatattttttcttttgggcaggctggctcttccctcaacctcaaccttcacaggcccaccactagtttcaacgggtctaacatttaaagtcccttcactttctatctctctcctcaatcactatgtgcacaaaattccaaccatggttttgcaagtcgaatgaatctctttagcctttttctccctcattatcttcttgatgggtaattaaatcctaaaacatcttatcaaagctccgtaaagcaaaggactagctccacgttaatcttagtataagccaaaaacagaattgtcaccagctcatcttacctccaagataaccaaacaaaaaacgtgggtagtacatgaccattctttgagaaacattcaaactgctttcaagaagtgattatctcctaaccagacgaaaactgttagggtacacagtacatctttggaatttaggtacacagtatcattcatccctggttggtgaactcggaatttgggtacacagtacatctttggatgcaacacacagaaaaatctaagctgtccccatacggatgaatcattaacgtggtgtatttgactacatttggcttggcctccttaacgaatcatattgcagaaaaaccacataaccttcatgtaattttcccttcttgcagaatctccaatcactaaactacaagcctgaaagtcacttctcatccaaatcttgatacaaagctaggcaatactcaaaacctgcatcattgtcatatcatttctctaccctaccttacaatactccttgatcatgcctgttgtaagtaacatgtagtctgatcctgcaactgcccacaatctcaaatacatgctttgtcaaatcaatgaaacatcaagctcaccagagaatttgaagtatgcaaattgggttcaatcccattttctcttaccttacgcctaaaccctcctctaccattccaaccattccaaaactcataatcagagaattggccaaaaaaaatcagaaaagacccaatttttttctaatttgatcacaacctaatcctatcaacatcgttaaccaaacaaagccaatacatttaccaaggatatacgtatgcatattgcaaagatcacccgattttatgaatttcagaaaaaaccttccgcctgattctcttgaatcgttttgatcagactgccgtatcggcggagaccacgatggtgtagtccttgaacatgtctagatcttaaaccaaaacggtaggactcgaagcaactggtcctatggtctagtggtcaggacattggactctgaatccagtaacccgagttcaaatctcggtaggacctttgttttcggcttcggttttgagattgtgcaaaccggtttttaaccaaattaaaacccaccggttattggttttaatttaaccgaaactcggttcggctcagttcctaccgtttggtcaccaaagtctgctgcttcttttttgttctctaagtctaaaaacctctcctttggctgtgagagagccaacgagaagagaaaaagtatcttcctttgagaagtgcaagtccatg

SEQ ID NO: 20919 - DNA, 3003 bp, Unknown
  misc_feature (1)..( 3003): 2750-1469P.txt file - cDNA_ID_1829987; gDNA_ID_1620775; Annot_ID_50284
ggagtaatggagaccaagtaggagatgacaatacgtgcactgaccgaaatcacctcctgagatgacctcttgtgggctacaagtgaaggattttgttgtctcttgcttagttttaaactcttcgctcgcatagtaatgtgttgtggccgttcctactgtcaatcctcctagcgtcttaaattccttcccggcgtatataaactcaagaatcctccctccttcccttattggataaaacctttaaaagaaagcatagtaggaatttatgagataatgaagaactttttaatggaaaagaatagacaagaaatgaaaacagaccttgatctgtaagccgctgataatcggaaaatctgaagagtagtttgcgcgctatggcgagtaaacggaacatacttttgtctcccttctgttgttccagagctgcgtcataaagggagtgaaaagggatcaatacagaacatatatcacatacacataaacacagatatccatagatgcatgtagaaatatacctgagggacagaacagtgatgggttcttgtgtaagtaatggagaagtctctccatctgcaattctttgaatataaggatctaaatcagcatgtgaaacaataggcaccaaggaagtaaagagagtttccaaagtataatcgtccatcttttctacatcaacagtcccaagccatttcctcagatactccactccggagttgagctcaagaatccttcgtagcgtctcgctttggaccttgcaggcattttccgacacatgctcgaaccaaccaataacatcatcatgccccgcttctacagtttccatccaataccaagtctttcaaggcagtatagtatctcaacgatgcaaaatgagtagaagtcctaacccaacatataggggagtactggtcattgaccactccctttgtcttcagacaaaagaaatttctttgtgtgtatagttgttctcaccttttttgggtctccttatttgtctttttaataggaaaaacatcacagatacctccataaatgtcacgggaattaccgtccacaaattctatcaacacttaatacagctattaatgcgttctcacagaagagtatcccagtctcaacatgtgctcaagagacaaaccttaaccacaatgtattttgcaactatcatccagtgtggtcccatgaaagcctctttgcctcctaaaaaccaaaacccctacatcatgttagctatctttcaactgctttccctgttaataattcagtgaacatagccacaaatatggacattattaaatgaacagagctctcaaacacctatttgagcaaaatagcattagaaaattttagttcttcctataatgtggctaaccttttgatgtttctttctctgcaaatatctggataagcatgtaggaccaaagctaccaagcatcacaagttgcacaagatattttttcttttgggcaggctggctcttccctcaacctcaaccttcacaggcccaccactagtttcaacgggtctaacatttaaagtcccttcactttctatctctctcctcaatcactatgtgcacaaaattccaaccatggttttgcaagtcgaatgaatctctttagcctttttctccctcattatcttcttgatgggtaattaaatcctaaaacatcttatcaaagctccgtaaagcaaaggactagctccacgttaatcttagtataagccaaaaacagaattgtcaccagctcatcttacctccaagataaccaaacaaaaaacgtgggtagtacatgaccattctttgagaaacattcaaactgctttcaagaagtgattatctcctaaccagacgaaaactgttagggtacacagtacatctttggaatttaggtacacagtatcattcatccctggttggtgaactcggaatttgggtacacagtacatctttggatgcaacacacagaaaaatctaagctgtccccatacggatgaatcattaacgtggtgtatttgactacatttggcttggcctccttaacgaatcatattgcagaaaaaccacataaccttcatgtaattttcccttcttgcagaatctccaatcactaaactacaagcctgaaagtcacttctcatccaaatcttgatacaaagctaggcaatactcaaaacctgcatcattgtcatatcatttctctaccctaccttacaatactccttgatcatgcctgttgtaagtaacatgtagtctgatcctgcaactgcccacaatctcaaatacatgctttgtcaaatcaatgaaacatcaagctcaccagagaatttgaagtatgcaaattgggttcaatcccattttctcttaccttacgcctaaaccctcctctaccattccaaccattccaaaactcataatcagagaattggccaaaaaaaatcagaaaagacccaatttttttctaatttgatcacaacctaatcctatcaacatcgttaaccaaacaaagccaatacatttaccaaggatatacgtatgcatattgcaaagatcacccgattttatgaatttcagaaaaaaccttccgcctgattctcttgaatcgttttgatcagactgccgtatcggcggagaccacgatggtgtagtccttgaacatgtctagatcttaaaccaaaacggtaggactcgaagcaactggtcctatggtctagtggtcaggacattggactctgaatccagtaacccgagttcaaatctcggtaggacctttgttttcggcttcggttttgagattgtgcaaaccggtttttaaccaaattaaaacccaccggttattggttttaatttaaccgaaactcggttcggctcagttcctaccgtttggtcaccaaagtctgctgcttcttttttgttctctaagtctaaaaacctctcctttggctgtgagagagccaacgagaagagaaaaagtatcttcctttgagaagtgcaagtccatg

SEQ ID NO: 20920 - DNA, 3003 bp, Unknown
  misc_feature (1)..( 3003): 2750-1469P.txt file - cDNA_ID_1829987; gDNA_ID_2926205; Annot_ID_141710
gagtaatggagaccaagtaggagatgacaatacgtgcactgaccgaaatcacctcctgagatgacctcttgtgggctacaagtgaaggattttgttgtctcttgcttagttttaaactcttcgctcgcatagtaatgtgttgtggccgttcctactgtcaatcctcctagcgtcttaaattccttcccggcgtatataaactcaagaatcctccctccttcccttattggataaaacctttaaaagaaagcatagtaggaatttatgagataatgaagaactttttaatggaaaagaatagacaagaaatgaaaacagaccttgatctgtaagccgctgataatcggaaaatctgaagagtagtttgcgcgctatggcgagtaaacggaacatacttttgtctcccttctgttgttccagagctgcgtcataaagggagtgaaaagggatcaatacagaacatatatcacatacacataaacacagatatccatagatgcatgtagaaatatacctgagggacagaacagtgatgggttcttgtgtaagtaatggagaagtctctccatctgcaattctttgaatataaggatctaaatcagcatgtgaaacaataggcaccaaggaagtaaagagagtttccaaagtataatcgtccatcttttctacatcaacagtcccaagccatttcctcagatactccactccggagttgagctcaagaatccttcgtagcgtctcgctttggaccttgcaggcattttccgacacatgctcgaaccaaccaataacatcatcatgccccgcttctacagtttccatccaataccaagtctttcaaggcagtatagtatctcaacgatgcaaaatgagtagaagtcctaacccaacatataggggagtactggtcattgaccactccctttgtcttcagacaaaagaaatttctttgtgtgtatagttgttctcaccttttttgggtctccttatttgtctttttaataggaaaaacatcacagatacctccataaatgtcacgggaattaccgtccacaaattctatcaacacttaatacagctattaatgcgttctcacagaagagtatcccagtctcaacatgtgctcaagagacaaaccttaaccacaatgtattttgcaactatcatccagtgtggtcccatgaaagcctctttgcctcctaaaaaccaaaacccctacatcatgttagctatctttcaactgctttccctgttaataattcagtgaacatagccacaaatatggacattattaaatgaacagagctctcaaacacctatttgagcaaaatagcattagaaaattttagttcttcctataatgtggctaaccttttgatgtttctttctctgcaaatatctggataagcatgtaggaccaaagctaccaagcatcacaagttgcacaagatattttttcttttgggcaggctggctcttccctcaacctcaaccttcacaggcccaccactagtttcaacgggtctaacatttaaagtcccttcactttctatctctctcctcaatcactatgtgcacaaaattccaaccatggttttgcaagtcgaatgaatctctttagcctttttctccctcattatcttcttgatgggtaattaaatcctaaaacatcttatcaaagctccgtaaagcaaaggactagctccacgttaatcttagtataagccaaaaacagaattgtcaccagctcatcttacctccaagataaccaaacaaaaaacgtgggtagtacatgaccattctttgagaaacattcaaactgctttcaagaagtgattatctcctaaccagacgaaaactgttagggtacacagtacatctttggaatttaggtacacagtatcattcatccctggttggtgaactcggaatttgggtacacagtacatctttggatgcaacacacagaaaaatctaagctgtccccatacggatgaatcattaacgtggtgtatttgactacatttggcttggcctccttaacgaatcatattgcagaaaaaccacataaccttcatgtaattttcccttcttgcagaatctccaatcactaaactacaagcctgaaagtcacttctcatccaaatcttgatacaaagctaggcaatactcaaaacctgcatcattgtcatatcatttctctaccctaccttacaatactccttgatcatgcctgttgtaagtaacatgtagtctgatcctgcaactgcccacaatctcaaatacatgctttgtcaaatcaatgaaacatcaagctcaccagagaatttgaagtatgcaaattgggttcaatcccattttctcttaccttacgcctaaaccctcctctaccattccaaccattccaaaactcataatcagagaattggccaaaaaaaatcagaaaagacccaatttttttctaatttgatcacaacctaatcctatcaacatcgttaaccaaacaaagccaatacatttaccaaggatatacgtatgcatattgcaaagatcacccgattttatgaatttcagaaaaaaccttccgcctgattctcttgaatcgttttgatcagactgccgtatcggcggagaccacgatggtgtagtccttgaacatgtctagatcttaaaccaaaacggtaggactcgaagcaactggtcctatggtctagtggtcaggacattggactctgaatccagtaacccgagttcaaatctcggtaggaccttttgttttcggcttcggttttgagattgtgcaaaccggtttttaaccaaattaaaacccaccggttattggttttaatttaaccgaaactcggttcggctcagttcctaccgtttggtcaccaaagtctgctgcttcttttttgttctctaagtctaaaaacctctcctttggctgtgagagagccaacgagaagagaaaaagtatcttcctttgagaagtgcaagtccatg

SEQ ID NO: 20921 - DNA, 3000 bp, Unknown; identical to SEQ ID NO: 6100
  misc_feature (1)..( 3000): 2750-1469P.txt file - cDNA_ID_1829990; gDNA_ID_1620844; Annot_ID_50928

SEQ ID NO: 20922 - DNA, 3003 bp, Unknown
  misc_feature (1)..( 3003): 2750-1469P.txt file - cDNA_ID_1829990; gDNA_ID_2926205; Annot_ID_141711
aatatttatacataaatatataaaaatttatatgaaaatttataatttttcattctgactactttcatttgatttagatacaagataaaaaaccatttttagacccaaaaaaaaaaataggttaaaatataaaataaaaatggtggagtaagatattgtaattttattaaacaaaactgttgtaatgttaaaaattatgtaggtgttgaataatgatgtggtagaaagaaaagatgatgtggagtgttaaaagtgaaaaagtgggtgttgtaaatgagtaaccattgtagataaatagtctaatgattaattttgccaacaatgattatctcaacttcagggataaaccggcctaaattttagatttgagtttgatcacttatgtgtgttatgtctgcatgcctaataagaagtattatgaccaacaaatattcaatgtcagtgtaatccaaatttagcaaagcaatgtaaatgagctgcatattatatgttaaatattgtgtgtactcgtgttcttgtttttacatcatcagttactaattctaaatccgaaattccatctacatacgtagatcaatcaaagttgtcctaagaggaggccttgtgagtctcattgggttttacagaaatcgtcggacctatttgggctcaaacatataaaagatccaagatactggatttaggcccaaactcttttctcaatacgataggatccaaatctttttgtagctgtggaatgtggtggataacaaataacgtcacttggtaaaaatccaacattttagattcagccatcggtcgtacaacgtcactctcatcaacttctttttcagttccccaaatcacgatgatcgcttagtcatcacacccatctagcatcccgccgtcagataaaccggtcatttacccttaccaacataccggttttctcaatttacaaattcggtttgataaatatcaatagattaggtaaatagaaattaagttaattcggcacgtgtcacgaaaactaccacatggcgcaaaggccaaaaccacaaaattcagaaaagttggtatgcttccacgtaattgacatttttcacgtgatttgcttgtgactactgatgttacaattagtagacgtaccgttcaataacgtgatatttattagagattattgatttgcataattagttacaaaatcacacgtcacaaccatttttccccaatattacgtccaaaactgttgattcgtttgatttttattgtccgtccaatgactatttcgatttattataacttcttgtgttagtaaatagtaattcaagtctatatatactcttatatcataaattaggaaaagtaagtactgtatacgatcattgtatctaataaaatatgaaatatgcgagcaataacggccaaatagagcgtaacttcagttttttttgtgatacctagttttaaataccctaaacatcaagttacctcaaattggcaaaacctaattttgctgaaattgaaagaaaaataatatatttttatttctatatttgacttcatttaaatattattttcgaaataaatatttacctacgattgattttatcaaccagttgaacgaataatcttcttttttgtatgttaaggtgcacttataatatatatttctatatatatcacatgaaagaaaaataaaataatttaaataataacaactttcagaactaagtttttttcatattaattataaaaaatttgtatagtatactatagactcaataatagtaagtactaagcagtaaccatcaataacaatattttctaggactaacattttatttctcttcctacgaacgtaccacattgtatcatgatagccaatcaaaatacacagtactgaaactagtaatgataataagttaggcagcctaattatatacaacttttcaaatacgtcatatgaacaaataacattttccgtaatatgtactgaaaatttccacgataaaaaacaataaaaatgctcgattaatgttcttatacactggcattaacaattctcacagcaaaactaccacactaatcacaatcttatgctcatgtagtatttttagacaacattgtacatgtagaaagttctttaactcttaagtattatcgactagttttttttctagaatgaatttttctaatcgaatactttaaaaatagagtcgacgaaagagattaaatataacaaaaccaaaccacgtgaggatcataagctatggacgaggaaaatcgtcaaactttgagataaatttttgattgattaggtgtttgttgtactttttcttattaatatccagaattcagaaccttctcttcctcaaatctgtctttatcctttttaattcaattttaatctcaacttttctatattttatcgtctaaatttaaagaaaagaaaaaacccaaaaacagaggattttgatcaagtaaaagaaagaatattttctagagaaagcaaatcgattctctcacctttatatatataacctctccacctctgtttcgtctctcaatatatatccactggtctttcctttttccggcaaaattgtaacagaaccaaaaattactctgtttttttttattttcttgacaagtctgcatttttctcctctgttttggaattttctcgtttctggttttccgatcataaaaaacaaacaaaactaccgtaaaataggctctctccacagaaaaaaaagaagacttttctttcattcttctgcaagtaactgagcagatttcggttttttcttcttcaaattgatatttttaaagttataaaaatttcttgtccataatttccgttttccttaaattcagctgtcctaacgtcaaatctcagacactcgcttgcgtgtctccctctcttaaactctctctttctctttctcttttggtttctgggttatttcaaagaaaagaatcaagaaacccctctttctctcttacaagaatcccatcatg

SEQ ID NO: 20923 - DNA, 3000 bp, Unknown; identical to SEQ ID NO: 6090
  misc_feature (1)..( 3000): 2750-1469P.txt file - cDNA_ID_1830033; gDNA_ID_1620844; Annot_ID_50915

SEQ ID NO: 20924 - DNA, 3003 bp, Unknown
  misc_feature (1)..( 3003): 2750-1469P.txt file - cDNA_ID_1830033; gDNA_ID_1620773; Annot_ID_50213
acaactgatcctaaatattatttaaaaagattttttgtttttcatcgcatattaacaacattatttattggcaacaaaaatgcaatgaaattagtattttgtagcaacattttcacaactattttgcagcatgtagattgtgattttctcgttatactaagttttaagtggtgtaatataagaattgaaaattatgatgttactaatttgtgttattcttataatgatcattagctcaatttgtgttaaatatccacctgactttttattcgagtgtactgttttttttttttttctgttacaatttgagtgtagtgacgattttatatatatttttgttaaagactatctctctagattaattaaaaacttatctatactcgaagttgatatattggttctaaaacgaaaacgctcgatgtattttaagaaagtgttatgaaaaaatgatagcaacttgaacacaaaacgactgcatacatagtagatgattgattgtctaaattaatttatttccattcgaatataatttgatggtgatttgtgtgtaagaaggataggtgaatcgttgggtggaaagttaaaacgtttgaatgcatatctaattactaactagtattcgtgtcttaatacaaagatttcttatcgtttcgtttgttaggtgaagattagctaaaataattaatatgtttaatttgaattggtgtatcatttttttgtcattaaccgtgatgaaggtgatgacaatgctgcttacgtcaagcttatcggcggctctagcggtggcacaagtgggaaagaagggaaacgcaaacgcaggttggcttccgatttgcgggcaagttccaaagttttgcgatcagatcactggagctttaattgccggtttcgttgcactcgtcctctatgtactcttactcttatattctctccacgccgtcgtcgacccttttctccttcaaaaatcttgaatctacctttttttttttgagtatcgatctaattttatgtctctcatacatatatagatagtagacacataaacataaatttgctcgatgtcgatttgagacgtagttcgtgtgttgtgcttgtataatttccactgaaaagaacgttttctaaaagttcatgaccataacacgtaaagaggcgaatgaaggtaatattaatgtgggacatagtgttttgcgtgatccaaattattttagtatcgcaaaccggcctgtcttaaatggacatttgtagtaacaaaaccgaccatcagcaaattaacgttaacgttgctctaatcgtgtgtatttttctaatgcttggtgaagcacatgcgaccatttgttgtgtcagaacaaaaggaagattccacatttagaatttagattataatcccacatgcctattatttaaacatatgtatactgtaataaattagtcccagaagagcatttcatcatactgtataattaatcaaatttaaaaaacatttgtgttgaagagaagatgactagattcacttgattttttttaatactgattggtcgtttgaccagtcaggatccagactgaaatattctcaaaaggtatgaactattttaatgaaatatttgagctgagaatttgcttatgggacattctatccttctaaagaaatcattagaaaatggagaaaaagttactagaaaaagagagggaaatggggcgagagtatgaagaaagggtcccatgtgaatctaataattgaaaagcaaatatgagatttattttagggttcttgttttagcgtccaaagcggtcgcagttgccgttcagcgacttttctctgtttatgaaataaaaacgctccacttgttcttttcttctttcaacccactttgttataactattaacaaatattgcttggtccaaattttattatactgaattattttagtttttttgtatcatcatcctcaatgttagttttgaaatcctaggtcagtaagtcaataacgaaaatgacaagtttaattttgtaattggaacttacatgtcacggtctttgtttacgatcattgccacgaattgtttagatacgggctttttttttctttccgtgttgatgattatcgtttcttcttacatatcttgatcaatcactaacatttacataacctacaattttgtaatataattgcaatactcgagatcttcaaatggtgatactgttaataaaattacgaacttttaatcatcatcaaaatctatagaaaaagatacataggaccaaaacaagcctaaaacaaagagttataatttacaaataaatgcatgtattttgttacttttgttaaggattttcatatcaatgcatgcataatgcattctctttttattttatttataatgcattcttttataatattcggatccaaaattatgaattaattccagattgccataaatgtctttctttgtttatgctgacttttttcttttcttaacttatatagtaagtaaaccagaaaggtggaagatacaaagcaatttcattgcattaataaacttcaaatgtattatccaataatcaaaatttatctagtaattcacaaaaaaaaaaaaatctgtctatcattcaaaatttcaccaatttggataaatatctagaaaattttaaaatacaattcaataacactattaacatatcaatcaatatataacattgcaaaagtttacttgatcattagtatattcattttaaggttaaaagatctttaagaaaaggaaattcaaattatattgttggaaaaaaatacaaatcaaagacagcaaaaaaagtaacaaaaaaaaaaggtagaagaaactgaaacgcggaaaggaggcaaaatcttctcgtcgtcgttgtcgccgtcttcagagctacaaacgaaaaaactcgcttccgtttcgatttctccattgttattgtttcttcagtgaagcttttttcttcgagaaatttctaagatctaccacatgctactatg

SEQ ID NO: 20925 - DNA, 3003 bp, Unknown; identical to SEQ ID NO: 20924
  misc_feature (1)..( 3003): 2750-1469P.txt file - cDNA_ID_1830033; gDNA_ID_2926216; Annot_ID_142221

SEQ ID NO: 20926 - DNA, 3000 bp, Unknown; identical to SEQ ID NO: 6089
  misc_feature (1)..( 3000): 2750-1469P.txt file - cDNA_ID_1830037; gDNA_ID_1620844; Annot_ID_50914

SEQ ID NO: 20927 - DNA, 3003 bp, Unknown
  misc_feature (1)..( 3003): 2750-1469P.txt file - cDNA_ID_1830037; gDNA_ID_1620773; Annot_ID_50214
accattatcatggtatcagaaaaccaactattcttggtgtcagggagcatatcttcacgggatcagtctcgtcactggcgtggttcatgtctgctcaggagacaagttttgtcactcttggtcagcgtgttcttgcaaacccactgaaggtcagaatgcattatggccaccctgatgtatttgacagattctggttcttgagtcgaggcggcatcagtaaggcttccagagttataaatatcagtgaggacatctttgccgggtttaactgcacgttaagggggggaaacgtcacccaccacgagtacattcaggttgggaagggtccacaatttggattatttctaactaactatactgctacaacgtttttttaacgtttttaacgtttattaattatgcaatctacttttgttataattatgtaatttaacgttttttaatcttctaaattcaaaaaatttgagtaacctttgtctttatgcatttttcaggtcgggaagggacgggatgttggattgaatcagatatcaatgtttgaggctaaggtagccagtgggaacggagagcaggttctcagccgagatgtgtaccggctcgggcacaggcttgatttcttcagaatgttatcatttttctacacaactgtagggtttttcttcaacacaatgatggtcattcttactgtttacgctttcctctggggacgggtttatctggctctcagcggggttgagaagtccgctctagcagacagtacggacaccaacgccgcgcttggggtgatcctgaaccagcagttcatcattcagctcggtctgttcactgccctgccaatgattgttgaatggtctctcgaggagggtttccttctagcgatatggaatttcattcgaatgcagattcagctttcagctgtcttctacacattctcaatggggaccagagctcactatttcggtcgaactattctccatggtggggccaagtatagagccactggacgtggatttgttgtcgagcacaagggattcactgagaactaccgactgtatgcacgcagtcactttgtgaaggccatcgagcttgggctgatcctcatagtctacgcttcgcacagtccgattgccaaagactcgttgatttacatagccatgactatcaccagctggtttcttgtgatttcatggataatggccccatttgtgtttaacccatcaggattcgactggcttaagacagtctatgactttgaagacttcatgaactggatctggtaccaaggcagaatctcaacgaaatctgaacaaagctgggaaaaatggtggtacgaggaacaggaccacctgagaaacaccgggaaggcaggattatttgtggagatcatcttggtcctccggtttttcttcttccagtatgggattgtataccagcttaaaattgcaaacggatccaccagcctttttgtctacttgttctcatggatatacatctttgctatatttgtgctcttcctagtcatccaatacgcccgtgacaagtactcggcaaaagctcacatacggtacaggcttgtccaattcctcctgatcgtgcttgctatactggtgattgttgctttgctcgagttcacgcatttcagcttcatcgatatcttcacaagccttcttgcattcatcccaactggctggggaattctgctgatcgcacagactcaaaggaagtggctgaagaattacactattttctggaatgctgttgtctctgttgctcgcatgtatgacatattgtttgggatactcataatggttccagtagcgttcttgtcatggatgcctggattccagtcaatgcaaacgaggatattattcaatgaagcttttagcagaggacttcgcatcatgcagattgtcactgggaagaaatcaaaaggcgatgtctaagtttaaaaaacggtaaagctccttgttctcaacaccttatgttatgatcgtttaaatcctggatttcacaccaatgcgggctttaaatttgtgtaggtcttaagaagtaaatggtagttcaaatcctattggtatgtggcgaaggaatcagttggaggttagttttcccgaaacaaccgaattcgaagttttgtttcgtctaaagaaaaactcagatgctgatgatttatctttgtattttaaacaggtttttggagagtttggttggatgaggaatcgggaagttggtttgattcggttagatgggtttagggagatatttgattgtcagtgtgtgtggagggaactctgattcttgtatggtttttgttctaaaggtacagcaatttgtgtagtgaggctttgtgtatttgttctccttctctcattatagagctttagagcatttttagtttatattcagattgttatctaatgtcatctcgcagagcttttgttcacatttcacatcttttcttctccttcttagtagagatcagtttcagattagatacttgtccatattccactactctcgtctattatcggtttctgcttgtcaatttctgggtccaaaattgaaataaatttatataattggaccacaacaccactttgtcggttttgacttttctacttggatgctcctgaacttcttgctcccttttctattacaaattgggaaacaatcagtgtgaattggggaataaaaaaaaacagaattgagcaattaaagccacgtggcaagaaatcgacgagggaccaacgtgtttgtctgcaagatctaatccttttattaacaaaacggcgactgatctaacgggaaacttttaaaatcgagaaattgttaataataaattcaactacttctgggccatcatcatcaatcttgttcgtcttccttttgatcttatcaaactacagtcaaatcactcagagaaagctactaggtctctcctcgacatttgctttcaattcgatccagtaattttcttctcatcggagagagaaaaaaaaaatg

SEQ ID NO: 20928 - DNA, 3003 bp, Unknown; identical to SEQ ID NO: 20927
  misc_feature (1)..( 3003): 2750-1469P.txt file - cDNA_ID_1830037; gDNA_ID_2926216; Annot_ID_142222

SEQ ID NO: 20929 - DNA, 3003 bp, Unknown
  misc_feature (1)..( 3003): 2750-1469P.txt file - cDNA_ID_1830057; gDNA_ID_2926132; Annot_ID_196966
tcgaaccttgccttgtttactccttcttcacttgctagtaaagcacttgtgttcgcctttatccatctcaatggaaaactcttctgcatcatcttcatatccagtatccttcttccttgaggatcgttgatgagacatctgttgtcttcaaataagactctgtatcccttggataccatttgagaaacagtcaacagatttcttgctaaacccggcactagaaacacctctttgatgatcttctctcattggcttgtcatcacttggatatttccttttcctgccgtcattacatgttgaccattccccactttgatcggtacctttacactttgatcaagagtgatgaagtatttaacttccttggtcatatggttagtgcatccgctgtcaactagccatgtctcatcattcacgtttgatgatgtttcttcttcgactgcactgaacagcatgtgatcctcatcatcatttgtttcttctagacttagatccactcgctcggtccttctaagtctgcagttctttgctagatgtcccggtttgttacacacgaaacatcttctctcattgttccccacttgttgcgaaagaacacctttgttcttcttcatccagcaatcactctcattgtgatttttacgttcgcaaacgtcacaccatttcccagcctgcgtttgacgcttgtcttcacgtttgttttctccatagaacgctccttccgttgatcattcgtctcgcatctctacccgcttctcgtgtgctttcaatgtgcctatcaactatgttacggacaacgaagtcagatccttcgtttgcttcatcatagccactatgatgtcaaatcttttcggaagagaaattaggattttttgcactatttgatagtctgatttctcttctccatgaactctcagttgatttcccatctcaatcaacttggtcatgaaagtgttgatattgtcactttctttcatcttcaaattctcatactcccttctaagagattgaagctttatcatcctgacttgtggtgatccttgaaattccaataccaaggctttccaagtgcgcttgatgcaggggcgattctcggaaatatggaatctgagacggcagtttgaagaatttgcaaagcggttagatcctttaaggatgctgcttcacatcgtgtcttttgttgcactgcttcagggctatgatctccttctgcgggtggttttggaactccttcgtcaacaatttcccacagtttctttgtctggaaaattgttttcatcttgatgcgccaaaaaccataattctctttgttgaagattggagtcacaatgtgtgacaccatctccataactctctcgtgtttattaaactctttacttgaaatgtttggcccttgaatcagtagggctctgataccatgttggaaattgaagcctcttgttacaaagaaaaaacaagtgtttacttgttgttctgtttcttatgagatacacaaagcaaaagagaaactgacttttattgaatggagaacttgttcgtttcatcacgatacaaaaagtttaaatagaaaacaaatagacacaataagtaaagagttgtgtctctttctctctaagataaacgacacaacctaatctaaaagtcacgactctaacaaacaccttttaatacaacataattataacttatagaccaaactcaattataaactaacagatttgatgcagcttcctaatttccaacagctccatgatgtttatcagctcgttgttgtcagaatctgcatcttcataaatttataataaatataaatatataatgtataactgtatgtagaaccgtatattgtggatccgtgaattggtggaagagttgctattgcggaatcgtccaagaagctattcataaaatcaatcacgaaagaaaaagaatttgttttgctattatctctatattgtgggtagccatttttggaatctttgaaaaatcaaccaatacgcattttctctcagtttggaagttaacaaagacgcgttttttcaaggttttgtggggactggggaccaaaagttcttaatatgggttaacgtctcacaggtaataccaaacatttcatttatttgtgtttttctatcactatcttttccacattttagtattttactattacatataatttttgactaagaagttgattgtgaatgagtctgtacatcttcctagaaatgattataagtatattatttaatttgttactccctctattgtcatttatttgtagtttaagtttcaaggttttggcacaaatgaaattatttcgttttttattattatcttttaatatagttaattatctatttaaaaacaattcaacaaattgaaaaaaaagttttgtagaatttctaagagtcaaaaataataaaatttccattaaaaattgaaaacaacaaataaaatgaaactatttgtttttgcttaaacaacacttcttaaaaaacagaggaaccattgtaaaatagatttttcccaacacaaatcgaaaacgtaacttatataatctctatatttttagtaattcagcgacttatcatttcattgttaactatttttcactgacatgtttctcgttatataaaagtctctgtttatgtcaatggtcgtatgtgaatggttcatgtattatgcaaaactgtttatgataatattgccggggaaaaaaaactgccatgtttcatttttttactagttattacatttgattattatcaaccaacttaccattgaaagataacttgtgattattatttacagtaacgaagaaaattaggccatattttgttttctttttggaacctttcaaatgtcaaagctggtaggctatataaatataaacaaagctcaaaaatttattactatacttaacagtaacgaagtagactacttcaagtagtacatcaaaaaaaaaaaaaccaaagaagttgttatctttaacaaacaaaaatg

SEQ ID NO: 20930 - DNA, 3003 bp, Unknown; identical to SEQ ID NO: 20929
  misc_feature (1)..( 3003): 2750-1469P.txt file - cDNA_ID_1830057; gDNA_ID_2926132; Annot_ID_138771

SEQ ID NO: 20931 - DNA, 3003 bp, Unknown; identical to SEQ ID NO: 20929
  misc_feature (1)..( 3003): 2750-1469P.txt file - cDNA_ID_1830057; gDNA_ID_1620846; Annot_ID_50933

SEQ ID NO: 20932 - DNA, 3003 bp, Unknown; identical to SEQ ID NO: 20929
  misc_feature (1)..( 3003): 2750-1469P.txt file - cDNA_ID_1830057; gDNA_ID_1620846; Annot_ID_170211

SEQ ID NO: 20933 - DNA, 3003 bp, Unknown
  misc_feature (1)..( 3003): 2750-1469P.txt file - cDNA_ID_1830072; gDNA_ID_2926131; Annot_ID_196953
aaggaaagggaaagtatgagagagatagacgaaagagagagagttaactgttgttgtttttccgcacggtttacaatgaaaaagagataaaaggtattgtaaaaagacgcagttgttgagcgcgaaaactgctcagtaaaccgtgggaacaaaatggacatttcacaaccaaatgtggtatgagttgtaatgcccgaagaaatatggcagattacataacgattgggaaaaatatggcagattttataattttcctacatttaattcatatcaaacaacatttgaacatttaaaaccatatacatttgaacatttaaaaccattcaacgagaaatcataataaagccatcatctgaacagtgccaccgaattagtgtttctactttatccccatcaactcaatccaatcattcactatgacaaattttggattccgattcttaaaagaagaaaaaaaatctaggttaagtttcgacgtgccgcgcgttaatgaacagacaagaaacaatttaacatgtcaatcttcactaaaatttactttcggattcgagacaaacctgagagaagcgaaacagatcaaagcttgctcgggaggaatggacgagaggttgaagaagcggtagcggcagcgcaaataaacgaagaattacaacaatcaacgtagaacaaacaaggactttcagaaaaggctcataaataaactttttaatggaccatattgtgtggtaagaagataaatatatcttatcaaataaaatataaatttactaaaacattataacacaactatacttatttattttatagaaaagaaattaaaagtaaagaaaataattataaaaaaaatgtatatatcttattaaataaaaataggaataaaggtagagaaatttggatctataaccaaaaaaatttaataattaagaaactaacctaaaaaaaaaagctgttgtgatattttttgtattttgtatattaagaccactttacccttctcacctctcacctctcacctctcacctcttatctctggcatctcatctctttttttctatatcgccttcattaaaacagaacaaaactatagttttctattttactttcaattttgttacattctatttgctagaactaaggaaaacaaatacgaagactcaccagatctaattgaatattttctggtttgatcaatatctccttaacacaaatttaaacccaaaatcgaatcgatttcaattcgatttaagaaaggagaaaagagattaagagtatataaacatgattttttcagacttctaaaaactgaaacttgagatgatttcatttagtttaattatttttgtttgggttcatataaagtatcatccttagggtttaatttttttaaatcaatagatgtttgtaattagaatggattgagataaaaaaaagttaatttttctggaaattttttattgaattggggagaagagaagaagcaacgaagaagatgatgaaggaaaaaggtctgttaaataagaataaagtggatatttcccagttctcatatgttagtttcttaatttctagaattatagtgctattttcttaatttagtgttgaaaactagttagttttccaattcacccataaaagtattttcagaaaaaaaatatagaaaaaaagaaaaaaagtattagtgtacttggaacctaatattattcattatcaatcatggaatttttactttacaccgaagtcgaaactctactctggacgataaagtgtatgattggtgccgacaaccaagatgtagccttttttatatactgttcagacctggtgaagatagttttttcctcaaccgaatagtcggcgttttcagcatatttggaggattttcagagcgacaaggaagaattcacaagcttctctttatctttaattttttgtaatgcaaatgttaaaacggacaatttggcacgaaaatttgtactaaatcgttttatgtcacttatgtaaacaatattccgcaagattgattcttttgagctcaaaacaaaaccgatgacaaaaaaaaaaaaaatcatggaatttctaagaaccgtagacacttacttggtcaccgttgccaactacgacgaaatatttataacatttctaatatgctacttgacaaaacaaaaaaggctacttgaaaatcgctaatttttgtttttcttcctcactagtcaatatcacttatgaaaagttatttgtaaatttgcaattactttccaaagtaaggttttgtgagtaaaatgtatgttttgataggaataaacattctcaatttactaagcagttatgtatactatagttgttttaaacgcacaaatgaaaacttgtcaaatgggattgataacaaacatatcatactactttctttctatcttttgtcaatatcgtattactttatgttaaatatatagtaaaacttctcgataaattaataactatataaattaataaattcttccgttccgagttgagatcaatgtaaaaattgatacaaatcaatatattaataagataataatttttttgaaaatcttatataaatatatggtctcatttaccttttagattaaatttttgtaaaaagttacaaaatttgtaaaatctctctataatttaaatttattaattaatcgataaattaatacctttttaaattaataaattttctcggtttcagtattattaatttatagaggttttaccgtatttcaattatatcctaactatacaacgaaaacacataaaataataaaatttgaacatgaacatctctgtatacatatatggacatgagaacctacgcgtatgtccgagtactttcctagtagtaacaaaatctgaccaatacaccattttgtcaagtcaagtagtgtgtactcgttgtctcaagtcaccttataatatacaaaagctctatagtaattgattatcctcgtaacaataacgtatgatcaaaaagatatg

SEQ ID NO: 20934 - DNA, 3003 bp, Unknown; identical to SEQ ID NO: 20933
  misc_feature (1)..( 3003): 2750-1469P.txt file - cDNA_ID_1830072; gDNA_ID_2926131; Annot_ID_138768

SEQ ID NO: 20935 - DNA, 3003 bp, Unknown; identical to SEQ ID NO: 20933
  misc_feature (1)..( 3003): 2750-1469P.txt file - cDNA_ID_1830072; gDNA_ID_1620847; Annot_ID_50953

SEQ ID NO: 20936 - DNA, 3003 bp, Unknown; identical to SEQ ID NO: 20933
  misc_feature (1)..( 3003): 2750-1469P.txt file - cDNA_ID_1830072; gDNA_ID_1620846; Annot_ID_170199

SEQ ID NO: 20937 - DNA, 3003 bp, Unknown; identical to SEQ ID NO: 20933
  misc_feature (1)..( 3003): 2750-1469P.txt file - cDNA_ID_1830072; gDNA_ID_1620847; Annot_ID_170250

SEQ ID NO: 20938 - DNA, 3003 bp, Unknown
  misc_feature (1)..( 3003): 2750-1469P.txt file - cDNA_ID_1830084; gDNA_ID_2926131; Annot_ID_138765
gttagtcggcctagctgttatttccggtgggatctttatccgtactacagagcttttgacaatgttgtaagagttcctgctcctcctcctcaagcttcttctactattatcgattacgggagagacgagaaaagttttcaaggaagcaacatagcaattattgtggtcccttcagtcatcaatctcatcatatttgtggttctaatattctcttggaagagaaagcagtcacacaccataatcaatggtaaagtcttttaaaataagcaacatatatattccttatcttactaagagtttggttttaaacttgacatgttttatttgatgacgtgcagatgtttttgattcaaataatggtcaatctatgttacgttttgatcttcgaatgattgtaactgcaaccaataacttctctcttgaaaataagcttggccaaggtggatttggatctgtctacaaggtaaagaaactagtaagaagagtcctaacaaaatcttaagatgggtcagtgatctttaattatagcatgagaattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaatgaaccgtcaatcatgtatgttttatacctatttgtctctctctgtacaatgaatgacaaatgttgagaaaagagatgccgtgtaatgtaagcaaacttatgtttgatttgtgctaaacttatttatattaaatgaatatttgatatagccagcgttttggataatgttggaaattggactgaaacggaggaacgcatagatgaaattaaagtccaatttctatgaaagttcacacgagcagaaacaaaaactttgatctaatgtaagaggaaatgcgtgcggtaggggttgcgtagtcataaagaaaggacattgaacaaaggcacatttttaaacttatatgtaagagcatcatgggctcttaaccatatttagaatttaaatattgcacaatcaaaatacccctcatgagtttttatttttgacaactccaatggtagaagttctaatgaggctcttaaaatttaaatttttgaaatttatatgtgtttgtgtaacaccccgatttcaggaatatggtggtgcatacggtgaaatttaaaataattgatttgaccatttatattaccaaaatgcatttatcttttcgatcaaagatgttgaaaatgctcaagtaaataacatttgacattatattttacttttttcatgtttacaataaagcttcgttttgtatgatctgaaatataaaattttctctatatttataaccaatttactatagactaaatatttttaaattacaaataccgaatgactaatccataaaactgtgatggacaccatatataaagctatattggacgattgtgggtgttgttcattaaattgatgatttccactatgtcaaacctttcctccaaatttaagaatgacaaactatccaaaattattttcaaagatttttgaaagactcactacgagtttctcagaaattaacaattgttacaattttcacttcttttttcttcctgaattgtcacattctttatacagtatatgagtatgactcgtagaccaagcaaaggaagacttttttggtcatgcatgcgaccaaaaacaagtacttacataaccatattgaaaggacaatattttcaatacttctagagaagaaaaaaacccttagttcatacgaagtgattaagaaatgtttaccctttctctacggctatttgaatttgaatggccatctttgaagtcaaccattactcaaattttttcatgtgtactcaaccaaaacccattctctctcatgtcacctaattatacacatatataaacatttattacctcattaacaaaaaaaaaaacaatgaacaaaaccctaaactccattgcttaacaatgataatg

SEQ ID NO: 20939 - DNA, 3003 bp, Unknown; identical to SEQ ID NO: 20938
  misc_feature (1)..( 3003): 2750-1469P.txt file - cDNA_ID_1830084; gDNA_ID_1620847; Annot_ID_50950

SEQ ID NO: 20940 - DNA, 3000 bp, Unknown; identical to SEQ ID NO: 6127
  misc_feature (1)..( 3000): 2750-1469P.txt file - cDNA_ID_1830092; gDNA_ID_2926131; Annot_ID_196947

SEQ ID NO: 20941 - DNA, 3000 bp, Unknown; identical to SEQ ID NO: 6127
  misc_feature (1)..( 3000): 2750-1469P.txt file - cDNA_ID_1830092; gDNA_ID_2926131; Annot_ID_138763

SEQ ID NO: 20942 - DNA, 3000 bp, Unknown; identical to SEQ ID NO: 6127
  misc_feature (1)..( 3000): 2750-1469P.txt file - cDNA_ID_1830092; gDNA_ID_1620847; Annot_ID_50948

SEQ ID NO: 20943 - DNA, 3000 bp, Unknown; identical to SEQ ID NO: 6127
  misc_feature (1)..( 3000): 2750-1469P.txt file - cDNA_ID_1830092; gDNA_ID_1620847; Annot_ID_170242

SEQ ID NO: 20944 - DNA, 3003 bp, Unknown
  misc_feature (1)..( 3003): 2750-1469P.txt file - cDNA_ID_1830100; gDNA_ID_2926131; Annot_ID_196944
gtaacggagatggacatattctgctataagaaataacggttttactctctatcatcttcttctttccttcttttttgtttttgatgagtgaaatcgaaaagatagtatagggattccaaatggatcccaattaaatttgtattgatgagtaaaatcttaaccctaatgagagtatagggaactcaaatgcttcaatcatagacacatatcgaatcaattatgaattttaattaaaaatctaaattatttgagaactttggatagggagttacttggataaacttgatccatggagttctttgaatcccttatagatgacaacatcttatcaatagagacggccttttcattctcacacagactcttatctctcgtaacaaataatttgggattattttaaaaattacacttaaaagctgatcctaatttcataagaaccataattgcaaaatcaaattagaatctaaatacaaaccaccgacgaattaccttattgatttctttgagggaaaatgaagatcatgacttgctatagagacaaaggagagaaaaaatggtaaaatggtcactcaaatgagagagaagtacctaattctataagaatattgaaaaatgatatgagagacaatgacacaaagttttgaaaaatgatatgagagacaatgacacaaagttttttgtgctttatctataattgatccaaattaagcgtgaactaattcgactttagtatggtctgcatcttactacacaacattcaaaggctatacatgttttcaatcaaatcaatatacattcaaagcctatatgttttttaatcagataaacagccagtagtcacatcttttacgtgctttcactagtacttatacactctaaactatatgcatgccttgaatggggaatagtatttagacactaatttaggggttagaatgaaagaaagaaaacttgaaggggttagatgagcaaatatgaaaagttaaaacttcaaggaaacgtatgcttatgggtcccacacagcgtcaacaacgtgaaggcgtttgcttgtgccacaaatcaaagcaaccttatattttccatttgcagcaaacaccaatcaaccaaagtaacaaaccatctattattaattattgtgcaaaaaaaaaaaaaatccttcgcacgttttaacattttattgtgaacatttcagacatttagtgtttttctatgtgagtggagataaaatttttttttttttttttgaagaaatggtataattggggtggcaaagttaatttaaagacgttactgtaacactgtttaagaaaggggttcaatcatattgctctttgctaagctggacctaagcatgggttcaacgtgaagcgtacctaatgctaaacaaacccatatctacggatattttgctaagtataattctcatccattaaaaacagttagacaaataaaatatattgtcttaataaataaataaatgaatgagacaattcttctggattttaaaacaattctttttttgaatcagacaaatatttaaaaattaagatgatagatttaaaaatttcgttgtttatatatatcttggttttaaacctatattgcttaagatcctacttttacactttcagttattatatacctttttaaaaatatttttttattaaacttactatgatttcacttatcttgtagatttttatttagtactaagaaaagttatttatattatataaaatgaataaaaatttagttgagtaaaagaaattaatacataaggttctcttttgaaaatagacatataaggctcttccttgcacacttcaaatagaatgaatttgatgtggaaaacagactaaaccaagatatcatcctagaagatatcttaactatgtacttaatagaaaattgaaaagaaaactttatacttatgcaaaaaaattattaacttttacttaagagaacaattgggatcaatatgaaaataagatataacccaagggtcgataaattaaagtgaattaatatgaaaatgaactttatccttaataaacacaaaacgaattttgctgatctgtctaggtccacgcatagcaagcaaggtttcataaacgtgacgcttgcttatgaaactaactcacacttataactttaatttaattccttcatattcttcaaaagtttccatttacaagcaacaactaaactaattgacatttgacaataaaaagctgaactttattatgtatctctaggttttttccttgagagtttctctctttgaagtcatttacgtatatatatataaacccttgcaccattcttcttcgtcttgttaagcttttaagaatctctactcacattttctctgtgagtgttcttttatacttctttgttatttccaatttttctttctttcctctaaaaattttaggaactattgaatcatttaatttctgtttgttgataaaatttcgatcaactgttctcggcttaccgatgcattttttgtaaaaccgtctttttttggtgaataaaattttaaattcatacaaaaaaaaaacatatttgatactattttagctccattgtatctgaatcttcatttgttaatttttttgtttcctctgttctcacttgaattttggaatattttctctaggttttaccttatattcttcactttaagaactatatgaagatttgattggaagtaataatattcggtgatagaatctgagtttgtttgattctggtgtggggcttatatctaacttttttctttgtaccaatacattttcaattttacatttttgattagcttaaaatgtgaaggataccttgtaaataactattacactattgcttgtcttagtctaatagtcttcactaatattttgtgcagtagaagtaaatattataaagagttgttgtttgattatagagagttgttgtctattctttaacttgatgtgatgttgtttttgatgacaggtaaaaatg

SEQ ID NO: 20945 - DNA, 3003 bp, Unknown; identical to SEQ ID NO: 20944
  misc_feature (1)..( 3003): 2750-1469P.txt file - cDNA_ID_1830100; gDNA_ID_2926131; Annot_ID_138760

SEQ ID NO: 20946 - DNA, 3003 bp, Unknown; identical to SEQ ID NO: 20944
  misc_feature (1)..( 3003): 2750-1469P.txt file - cDNA_ID_1830100; gDNA_ID_1620847; Annot_ID_50945

SEQ ID NO: 20947 - DNA, 3003 bp, Unknown; identical to SEQ ID NO: 20944
  misc_feature (1)..( 3003): 2750-1469P.txt file - cDNA_ID_1830100; gDNA_ID_1620847; Annot_ID_170239

SEQ ID NO: 20948 - DNA, 3003 bp, Unknown
  misc_feature (1)..( 3003): 2750-1469P.txt file - cDNA_ID_1830150; gDNA_ID_1620849; Annot_ID_50984
tgtcagaaaatgtaagaggtattaaaatcacactctgacagcatgttatcttaatgtatattatgtagctcagtagagaatgataaggttgcagattgcacaatgcttttgtgctaatgaagagttaaaccatcttaaaaatctaatcatttgcagggtatgatgtatgcacttctctagggcatgcctcaagcacaaaagttgatattattggtaaggtttaagatatgtgaaaattgagactattttcaccctgtgttctaagttgtgaaaaagctaaattgttaatgctgttttctcccaacttcgtttgcaataataatgtaataaatgtgcctcaggatttttgttttgaatatggtagataaagaggatcctggcaaaggcgtcattgttcagatgtcaactggaaataggaaccaaaattgctcgctttcagtttctgttatttgccagaaaactaaagttgatgtaaggatttgtatatcagacatcctacttaagcgtatgaattgaagttgattttaggagtttttaagacgtaaaacctcgttcaccattttcttttctcagggaccactcactttggcgaaatctggtacctgtcagtatgtgagtgttcagtaactcatctatttgctcttttcctgtagctttcaaattaccaagtgtgattgtttcttttgtgaattttatgggttttaagtttgaaaactgagtttttatttgcatctcaatatcttgattcttaagaagtatggactctgggtagttatggtcttgtttcactgacaggctactcagctgcgacatcctgccggttgtgcagcagctatatccggccatagtagtggatggggctggtttagtaccttactaatcatgtgagcaaaccaatctttttaatgtgaggcctattggaatatgtttagatatcgtgggaatcaaaaatgaaatgttcttatctttctcagtatcttgtgcctgtttggagcttatctggtgggtggtgcagtatatcggtatttctcccttggaattcgtggcatagatgtatgtttcactaccttcctttatatatgcaagtttttctcatgtactgattctatcacaattgaaatgtaaacaccctgttttataggtaatcccgaatatggattactgggccactgtacctcacagtatacaggtattgttctgtgtttctatattctcttctggtagattggtgtctaagaattaaatttaatgagcttacgtttcctcttcatcttgcagagctgttttggctcactattttcaagattcggggggtctattcgtggtcagcaaacctcatattctcaggtcaacttctgagcagtctcagcatcttctctgatccatggtctggagacacatccccaaactttccttgactggttcaaccaattgcaaacgccgctagattgttataccctgagtactcttttggccattatatgactgcaagttataaggtgcctctccttttcagcttgttatgtcatggatccctgtagaaacaaaagaatcttgttcattggatagaaacaatgtcaagccattgcaatctgcagcctttcccatttcgtgtgtttgctctttggagattgtttcagtttcttgatgctgattttgagtaatggtaaccgatgtgttgatgttttagcacattttgcatccgcttggcgttggataagtggatatctcttttctttcagtgagttttctgataggcgagtgatcaatgtttaggatagagatgttgcaattgaccaaaaatccacgaaccagattgttcttttagtgatctcggttaaatttgagccgatttagaaactggtctagctgagccaaaccggtcaaactggccggtccagtcgtcataatatacagtagttgccaatgaagcttcttgaaagcatctctttgtacaattttgagtattgtagcatctaaagaaacattggcttagtgttttgttttgttggacgaagagtgtgtacaaagaggaaaagtgagagccaacaacttgagcttgaaagcccaacaatttctcaactaattccactattcatttcatcttgaactctctcctgatagttactatataaaaaaaaaaaattatagaccgataattaagattttgtttgatctcacattgttcagtattaattttaataaatgtcagttttgttctatattgttttctaagtaacatcaaaaatccattggacaaaggtaaagacaacgatgtctcatctttacaaattgatcaactgtacgaaaacacctcaaggacacttagcttagaagccaagtgaatttatattcctcacctccatcaatcatcatctcaaagtttccaatagcctaagaaactaataatttttgttcctttttgacagatattagaagagtattcatagtaaaaaggacaaaggaagccaatgatttaatcataaccatctaggttggatttaatcaaatacaaaacggactagatgtagtccacagtgaactcagtgattgtttttgtcttaaaatcaaggtaaatcacatgattacttaaaaacaaacagagatatacatttttgctgaaaacacgaatgtgtatataaatggattaaatcttacgaaaaagcattagttagtagacaaccactctgttgcgtcaacatttacctactcatcactcttaagtatacttcctttgctaattcacaaaaatttcatcacctaatataatcataaccatattataaatagtttaatcattgtacaattcacatctttagtatttcttgaagcaattccaaaataaagttcttttggcttcctcctcccacattcttatttggttgaggagaatgagatcatcaagaacacaaagtgttcatttcttaattttatctcctcttttcctaataatataaaatttgaaatcacatttgtaacactaattctcaaatcctaaacatg

SEQ ID NO: 20949 - DNA, 3003 bp, Unknown
  misc_feature (1)..( 3003): 2750-1469P.txt file - cDNA_ID_1830154; gDNA_ID_1620849; Annot_ID_50983
gtcctaaactagctatggtaacatatcttaaactttttcacttatttacatttaaagcgtattacaaaacgtacatgtgatatttatacacaactttattagaatttttggtctttttcatttgagaaattaacaagtcttataataaacttgaatttttttatagactatgggatttgcattcgtgaacaactcaaatatcaaagacataacatcactcaacagcaaaatgggacatttcaacttcttctccgtccatcactttaatattaccggcgtcactataacagcttccggtgatagtcctaacaccgacggtatcaagatgggttcatgtagcaacatgcacatctccaacacaaacatcggtaccggagacgattgtattgccattctctctggaaccactaacctcgatatctctaatgttaaatgtggtcccggacatgggatcagtgttggaagtttagggaagaacaaagacgagaaagacgtgaaaaacttaacagtaagagacgtcattttcaacggtacaagtgatggtattcggatcaagacttgggaatcttcagcttcaaaaatcctcgtttcgaactttgtgtacgagaatattcagatgattgacgttggaaaaccaatcaacatcgatcagaagtattgtcctcatcctccttgtgaacatgagcaaaaggttaacattctattcaaaaaacaagcttcatcattctcttatttcatcaaaagaataagaacaaaaatataaaagacaacttgtgtttatttttcttcagggagagtctcacgttcaaatccaagatcttaagttaaaaaacatatatggaacgtcaaagaacaaagtggcaatgaatcttcaatgtagcaaaagctttccgtgcaagaatattgagctaattgacattaacataaaaagtaatggacttgaaaatagttcttccattgcagtttgcgaaaatgttgatggttctatgagcggtaaaatggttcctcaacattgtctgaattgatttgacgagccatcaaaataataacgatgtgttgtgtatatgatactttcatttatgaataaaccaaattatttgatgtataggataatgtttttttttataaccgaaattccaaattaaaacataaatatgtatataagctttcagataaaataaaaaattaacatccataatctacaagaaattgtattttctgaaaatcgaatagaaacacatgattaaacaattggacgaaagaatttctacataaatctctgaataaattcaataaatccggttcatctgaagaaactaaattgaaccatactctggttcggtttttaaatgggccgtttgagatttgagaaggcccatagttgataacattcaggcttcaaattgcaaatgatatacaaaaataatttatgcggcttattcgtaagaattactaagattaagggtacaattgaaatttcgattgaaccaacggcggatgtgaaatcaacaacagcgacgactgcagccgtgccgagcactcatctcttcttctctctcagtctcgctcgccatctccgtggagatcctcggacatggtcatgagatcgtaagagagaatcttcaaaaaattgaaattggaaatcgataagctaggagctaaggagaaatgtcggggaaactttggatcccgagatttattctcatcactctactgtttattagctcacgagttaactctcaatgtgaattcagtttcactggacgcaacaaggtctttcatttcaacctagcatcttcgattcggaattatcctcacggtgtgctcagcgaagatgggtactttcgcttttccttttgtcccagattccatttcttatatgcttgaagttcgctttcaatttcaaattctgtacatcttatgaaattattatgtagaatgttgcatttggtattgtgatttgtactggatggtgttaagttaaaatgttcgtctatgttacttcatttgtgttgtgcttatactaaatgcaataattggataagcaggttttataaagtggaagcgaacagttccgtgttatggtttcaggttgtcttctacatcaggttacactttgtttctgtatttttctctgttacactgatcataacatctatgatcctgtatcttggatttctcgcgtgcctgtgtaattcatcttgttgtatgtaatttctgataactggtaacaaggaaaaaggaatagataggttaatggaacagtagaggaagaacgatacgttgcttagattaggaaagcatttagagttaaggtggttctgatttgaagatgtataactgcttggtagtcatactgccgtttatgttttacactacgccattgtgatttatgtttgttattttttttgtaaaccgtcttgtggaacagctttgtgacgtgctgattttcaatcatgatccccctcgatgtgttggttgcgaagtaagatatttggctacttttcttgtcttgatctatccttctacagaaaaagtttctattttaactttgagaatctcaatcagtctctgtgactttgcttttcttcacttaggattgtggaggtccatctcactgcggaacgtcatgtagtgcacttgtgtcagaaaatgtaagaggtattaaaatcacactctgacagcatgttatcttaatgtatattatgtagctcagtagagaatgataaggttgcagattgcacaatgcttttgtgctaatgaagagttaaaccatcttaaaaatctaatcatttgcagggtatgatgtatgcacttctctagggcatgcctcaagcacaaaagttgatattattggtaaggtttaagatatgtgaaaattgagactattttcaccctgtgttctaagttgtgaaaaagctaaattgttaatgctgttttctcccaacttcgtttgcaataataatgtaataaatgtgcctcaggatttttgttttgaatatg

SEQ ID NO: 20950 - DNA, 3000 bp, Unknown; identical to SEQ ID NO: 6143
  misc_feature (1)..( 3000): 2750-1469P.txt file - cDNA_ID_1830159; gDNA_ID_1620849; Annot_ID_50979

SEQ ID NO: 20951 - DNA, 3000 bp, Unknown; identical to SEQ ID NO: 6142
  misc_feature (1)..( 3000): 2750-1469P.txt file - cDNA_ID_1830163; gDNA_ID_1620849; Annot_ID_50978

SEQ ID NO: 20952 - DNA, 3000 bp, Unknown; identical to SEQ ID NO: 6142
  misc_feature (1)..( 3000): 2750-1469P.txt file - cDNA_ID_1830163; gDNA_ID_1620849; Annot_ID_170291

SEQ ID NO: 20953 - DNA, 3000 bp, Unknown; identical to SEQ ID NO: 6141
  misc_feature (1)..( 3000): 2750-1469P.txt file - cDNA_ID_1830167; gDNA_ID_1620849; Annot_ID_50976

SEQ ID NO: 20954 - DNA, 3000 bp, Unknown; identical to SEQ ID NO: 6141
  misc_feature (1)..( 3000): 2750-1469P.txt file - cDNA_ID_1830167; gDNA_ID_1620849; Annot_ID_170288

SEQ ID NO: 20955 - DNA, 3003 bp, Unknown
  misc_feature (1)..( 3003): 2750-1469P.txt file - cDNA_ID_1830180; gDNA_ID_1620849; Annot_ID_50969
aaattatagagaaaggtaatttgggcaccgacgtgaatttgactaaattacgagagagaaagaaagagagacttggtcacgaaggtgttaattagcatgaaagagagagaaataatcgtcgttgaccattgaccataacttagtcagtcatatatataaaaatccaaccgcccactattgttcccctattcacaaggtccttgctttctcagacgtaaacaacaagaaattatattaacacaacaacaacaacaaaaagaccaaccctatttattcatattttctcttatatgcaactctcaaagaatccgatcaaacaaacgagaaatcgagagaagaattacaccgacgatttcaccatgaagagatctgtaatcatggctcctgaatctccggtttttttcccacctccgcttgttttctctccgacgtcggtcaaaacgccgttgtcttctcctcgttcgtcgccaccgaagctgacgatggttgcttgtcctccaagaaagccaaaggagacgaagactacgggttctgattctgaaacggtgttgaaaaggaaacgaccaccgatgcttgacttaacggcggctccgacggttgcatcgtggtgcagtacgacgagagagacggcggagaaaggagcggaagttgttgaagcagaagaagatggatactactctgtttattgcaagagaggaagacgcggaccaatggaagataggtatttcgcggccgttgatcgtaacgacgacggaggttacaaaaatgctttctttggggtatttgatggtcacggcggatccaaggcggcggaattcgctgcgatgaatctagggaacaatatcgaggcggcaatggcatcggcgagatcaggagaagatggttgttcgatggagagtgcgataagagaaggttatatcaaaacggatgaggatttcttgaaagaaggttcgagaggtggcgcgtgttgtgtaaccgctttgatatcgaaaggcgagcttgcggtttcgaatgcaggcgactgccgggctgttatgagtcgtggtggaaccgcggaagctctcacttccgatcataatccttctcaagcaaatgagctcaaaaggattgaagcattggtgagttttatccttgtgcattggattttgattagtaacatcacataattgtggaattgcatttcaaaaaaaaaaaatcattgaattcgtggaaaaagcgactctagtaaaaatgcggttgataaaatttttgcaaattggagaatcattctaccattttgcgttcaaaataatgttttagtgcggtttggtttaatttgtgtttggtttacttatttttgaatgtgtgtagggtggttatgttgactgctgcaacggcgtttggagaattcaagggacattagcagtctcacgaggaattggagaccggtacctcaaggagtgggtgatagctgaaccggaaaccagaacattacggattaaaccggagttcgaattcttgatcttagcatctgatggcctgtgggacaaggtaagcataacaagaaatgcatgatttcaaaaatttgattttcatttttggtctttggatttaatgttgaagctggtttgtcctataggtaacgaaccaagaggccgtcgatgtcgttcgaccgtactgcgtaggcgtagagaatccaatgacactttctgcttgcaagaaactggctgagctatcggttaagagaggctctttggatgatataagtctaattataattcagctacaaaactttcttccatgatatattaacacatagtacattagctaaacttaattaatttcattaggtcgtagttattaataaattttgttcggtattttacatgtaaatacataaaggtttggaaaataattaatttattgttattgttcttagagataagctccaaaatatttttggtttacgatataaacactacataatacatgaaattgcactatctaaccatttatcatcctttttatcctcaacttttttattctcatgcattttgaaaaccacattctaatcatatttctgcttttatgtgtaaaaccaacaaagatgtacatggttgatatacacacgtagacataaccttgacaagcaacatcttcgtcgttactcattttacagatttctacccatctgccttcaataaaacaaacatcaaccatattagtaactgcatggtaaccaagcatacgtgagtttttgttgtaaggaccggtaaacactttgaacctataaacacctccgcctcttccaacaactcagaataatgaacaagatcacatgctaaggttttgtaatgcttcttacaaacaaaagtttatttaaaaagggaagggagagtttataaaatataaattagcattgacattggtgtgaggttcttcacataatcatatcattctgaccaaaatattagtcggaaaatggttagaaacacaccaatatgagttgttttcttgtagttctgagaaaacatagatgaaccaatatatcaacgtaagtaactaagataaattgtgaatcatgagaatgcaagaaatattttctcatgattacatgagatgaaatactaccttacaattcatcaaactttttgtagaaaaaggtattgaagaaatgaaaattggatgtagacaaaaaaataaaaaattcttgctgcaagatcctggacaaagacaataatcacattaagaacaatgtaaattttttaaaattagtaaaaactctctataaattaataattcacaccatttaaattttagaggaggtgatgaaaggacattatcatcaattttggtagttaacccccaattatttaactaatcaagatacaaggggtacaactgtaatatattcatagtttggtgtgttttctacaatattcagaaacacgatttaagacgattgaaactaaaaataaaaagtgtcggacttgtaaattttcgctcagcgatctgcttccaatg

SEQ ID NO: 20956 - DNA, 3003 bp, Unknown
  misc_feature (1)..( 3003): 2750-1469P.txt file - cDNA_ID_1830199; gDNA_ID_1620849; Annot_ID_50964
gaattattttttacttttagataacaatgtatactctatggtaacattgcatcaattatgaatggattggccaagtataaaatttaattatgattatacctcaaattcacactacttaaccatctattttcaggctattccattaattagtttttattaacacagtaatttatttgagaacagatttgaaaatattttgctaaactacttaaccttagactaactggaaaacaatatttaactaagtgtctgctaattaagaaaattaaagtatcgttcaccttctagacacactatgtcgattactgttttgagtgcaactagtgtattcgaaataatacttgggtgaattaagtttaagctttgagtaactaaaaattatatataaggatccataagttttgttgaaatagaataatcggaacttttacattcaaaaactttttcatatatatacagaaattcaacccccaataaacaaatgactaatgagtgatagtctgataggtgttaatgactgtcttaatatgagatacataagaaattttgaatggaattatttaataaatgtgaattatgtgggtgacttgactattcagtgttcactgaacacaaaaaggtaccaaaaaaattattccaatcagtgagagatcttcaaaggaaagattctcattcgcgccaatatttttgctgggaaaaggtaaaactttttagattattctataaattattttgctgatgttcccttacgaaaaaaacagtattcagtaccaaaatgtctggcacatataatcgtatagacgataagtagttgtcgaaattttatagggcaatggctcaagcaagtgaaacattgacacctagcccattcacatctatgtcactatatatgtgggttcacaaaggtgacgttttccttatgtgaatcatgtaaatgctataaagttttgtagtacatgagcgattatatattattacgaaactcctgaaatatatgatatataatcagatgggttgaggtagtgacaatagtttgtaagtgcaccaaaatacgttttgagctattaagtccgaagtttaggtccttttaagttatcgaaggtatgcttaaaaaaatttactaccttttagtttttttttgcatgatcgttattcgagaaacatgctgacgcacagattgatcagacgctgtggtaatccaagtgatagcaacaacacaaaatcatgtggagaatgatgatgatgatgcacatatggatttgcataaattttgtaatctccgaaatattgtggagaatgaaggaggagaaacataacattttaaaaatggataaagaaaaagaaagtgatggaaaaataagtatgtggtagaaaaatagggttccttcttctcatttgtctctttcaagctttatgatgcaaagcgacccttctttttcttccctttattttcttttattgttatcgttagtgtcactttctttttattaatttcataaagtcgtatgatcgtatccattgtttttattttgctccgacaggaccgacactgatctttctatatctttcggtaattaatgttataggattcctttttcagatcacatcatttgtattttatgttattttcgtttaacataatacactaataaaatgacttcataaaagatatggtttaggttggggaataaaagatatggtcgagccatacttctaatccttaatttaggttgatagaacatctaccgtcactaacaagtaatgaagtcagattaaaacttgatcgtgacaaaaattgtcccatatattttaaatgaacatgataacatattaattgaaaaatgttttagtgacttagttgtattgaatagcaaaggcaagtaagtagttatatacaatgactttcctatactcgagaagaccgtatccaagtaaatcaagaagatcgatatatatctagccggatctttggattgtcaagtgtcaacaatcttaattagatcaaaacagtctgttttaaaacatatgccaagttgtcaaacagaaaccaagcttttcatcactcaaaggagaatcacaaattctgcatggcgtgggggatagatatatatcatcgggagccactgagtccaagaaattgaatctattgacttcctattgctaatctatttcaaaataaccacgtcagagagatacgagtacatgtaatatcaatgagatattttcttaggagtaatttgaagatatttaatttgcggttgtaataatcccttttgaaaataatttgacttgtacacacggcaacaaaagaatgatctaaaggcaagtaacaagaatctgagtatccaccacctcttcctgttcctgttcttgttcctgttcgattccaaactctcactttctctgcccccctcgtgtctggctcccaccttttgtgtccactcaaccaacaacaacagtgtatctcttctcctccgttaaataactttatatttccccgttacatttccttattgtaacaaccaaaaaataattcacctgagactcacattctttaaggttttcgcatttaatatttcactttcttgaaatctcctatatttttgttatatatggtcgtcggcgatgccaacggcggtgaatgtagcgaaacaatgcttaacggcagaagcatcctacgcattagaagaagctgtgaacgttgcacgtcgaagaggacactcacaaacgacgtcgcttcacgctatctcagctttactctctctaccaacctcagtcttacgtgacgcatgtgctcgtgttcgtaactctgcttactctcctcgtcttcaattcaaagctttagatctttgcttaagcgtttctttagaccggatccagtcgggtcatcaacttggatctgatgattcaccacctgtttctaactctctaatggctgcaattaaacgatctcaagcgcatcaacgtcgtttacctgagaacttcaggatctatcaagaaatg

SEQ ID NO: 20957 - DNA, 601 bp, Unknown; identical to SEQ ID NO: 6183
  misc_feature (1)..( 601): 2750-1469P.txt file - cDNA_ID_1830214; gDNA_ID_1620852; Annot_ID_51017

SEQ ID NO: 20958 - DNA, 3003 bp, Unknown
  misc_feature (1)..( 3003): 2750-1469P.txt file - cDNA_ID_1830222; gDNA_ID_1620852; Annot_ID_51015
ttgaatttataactatggaaattcatctataatgtatcttaaacgcaattgcttgttgtaaaatcgttgggtaacaaacgcgacaattttttcaatattcccataacgatcttttatgtgaccgttaaataacaaacgcgataattttttcacaccctaaacgactttttgtataaccgttagataaaaaaacgcggcaattttctcttaaacctttcaaaacgatcttttgtattaaaacgatgacgtattctaacttgagtatttcttcttattttagaaaagtatttgtgaaaacatactcaaaatctctttaaattaagttaaggataagatgagagatattgcattaatgctaatagaattctcacattttaaggatactaattggtaagtatatgctagatatttatgtattgttgaccaaaaaaataataacacaaattagcttacaagttacaaccatttaattttacaccatgttggattgagaattttgatggttattcctttatatgttgaagaaaccttctgggccaacaactttccaaataggcccaattcaaacccattgtacaaatgcaaggctactttcgtcatttttcgtaaggcgcttgaattttgcgttttcagaatcttggtttctagggtttcacttaccttccctccgcgcccttgagctctctacctgagcttctccgggattcctaaagctgaaattcaaacacctccattttcatcctcaaggtttgctctctctctctccctctccatcgatccattagatagtgtgattactcctatttgtgtactgtcttcgatgattggcgtcaatcttactaccttctcgtttaaaacccagtaacttgcgattttgttgaactttttcctcaattttctttcgattaatcctctagaaacccgtagctaagcttagattagtgatttcaatcgcaagattcaatattgatcttgcccaagtgaattaaagtcgcaaaattgatttgtttttgtttttttagctttcttatgtaattttgctcaaagctatatgattttttgtctttgcagggagataaataaaactctattgagtagaaaatgagtgctgcagcacacaggactcctaaatcagggaggcaatctctgctatttcaagatttagcttctcctgtttcagcacgtagagggaaattctcgagtccgggacaggcagctgcggtatctgcactatggcgtgagaatttcggaggatctgatcttccaccacctccaatgtatactttggatgaccggtccgatttctctcctgagtctggtattgcagactactctgcgtctccagatgctaagtctgacagaagaacaccattccagagttctggaaagaatattgtaactcctggtaaaggaaagttggaagcaagcccttctttttctctactgaatgcacaacagagtcagcaagtttcagggagtccgagttggtggtcgcagtcaaaggcaggtagtagtaccgagcaggatgataaagggaagggatctcctgtagaaggggtggttcagccaggtgcattggtcactcttccgccgccaagagaagttgctaggccagaggttcagaggcagattatacctacaggaaaccttgatgaggaagagtgggtcactgtctatgggtaaggccatttaagctttattgctctcgtttttctcactttactgttgcaaatgttcttgatttgtcaacattctcgtgtctctgaaattctaggtacatggatgataacagttatattggtactgggtagtgttattaagtgccttaacttgtgtctgtctcccatgtttcaatcttagagaactgttcataataaatgctgttctttaccatcatgatgctcaaatatcagcctttgattgtgattttatgttttgatcattgtgaattctgactctttacatggataataactggtagtgttattaagtgccttatcttgtgtttatctcccatcttttcaatcttaagaactgatcataataactgccttcagattttctccaggtgatacaaatttagtactacgggagtttgaaaaatgtggtatggtcttgaaacatgttcctggtccaagaaatgccaactggatgcacatcctctaccaggttactgttcttcccttcaaacctgtttgatgcatgttgataagcattcatagttcttctagacgagtcatcatacatgatagtctaatcaaatcttttatataaaggaaacaacgaactgacaatggtctgtgtatttgatacagaaccggtctgatgcacataaggcgctgaacaaagcagggatgatgataaacggagttgtaatagtaggagtgaagccagtagacccaatacagaagcaagcgttaaacgagagactcaacaaccaaggattcatgcctttacctccaccatcatccactagaaacactgctcgacccctgtctcgtcctcagtacttgcaaaacggcagcgctttctctcctcaaccaagtggtggcgctatggcctctccgtcaaagtcaatggtctcaaagttctttgacttgatgttcggtgtttaaaagctacttcaatggcatttcccgaatgattcttctttacacatagtttgaagtttttgagagcagagtggctaagtaaatcttagagcgtggtcaaaattaaaaattgtaagaggtgtttcaaattgtcttttgtattgacgacggctaaaaatttggtataaatctgattattaaaatctcctcttttagccgtttcattgttgtttgtatttgagcagactagtcatgcctcgtgaatgattgaaagaaagacactgattccatggaagcctcacgggcagtgttttagaaactccattaggaactagccacgtatctagcctgttgtgtttatatatcccctctcgcatgtaaattacattacaaaactcagtaactcacaatg

SEQ ID NO: 20959 - DNA, 3000 bp, Unknown; identical to SEQ ID NO: 6168
  misc_feature (1)..( 3000): 2750-1469P.txt file - cDNA_ID_1830234; gDNA_ID_1620852; Annot_ID_51011

SEQ ID NO: 20960 - DNA, 3000 bp, Unknown; identical to SEQ ID NO: 6168
  misc_feature (1)..( 3000): 2750-1469P.txt file - cDNA_ID_1830234; gDNA_ID_1620852; Annot_ID_170356

SEQ ID NO: 20961 - DNA, 3003 bp, Unknown
  misc_feature (1)..( 3003): 2750-1469P.txt file - cDNA_ID_1830234; gDNA_ID_1620520; Annot_ID_159439
tctagtgattgttaaaaatcgttatttacttacttatttaaatgtcacatagagagaaaagagatttgcatacttgtaataatataatcgtgcttgtataagaaaaaaaaaactttatgagacaagaaaaaaaaactcgggtgtacgtacgtcgtaagtaaaagggccaatgcaagcaagctgtttggctctttccttaaagcaaaataaaagaaaaagttatctttttctccttttatttcaacttttttctttaattttcttttccattttttatgcttaatttttcaactccgagatatgaaactctctactttgtgtttagtttgaactcttttagtcataaaacaacaaactctgccgcaatcaacaaaaagcgaaggagtcaaataaaaacttctttttacgagtgaaagtgactattttacttcaatctcttttgattttcaaaactaagaaaaaaaagaatggaaatcaaagttgtgcatgttcttcccttagtcgatatgtaaaagtgatttgatagacattattgtatgtaaaagtaatacaactctgaaaaattttaagaaaaattgctagtatcagctaatccaacaattagttatatgttttggagaatgtgtaacatgaccgattataaagctaacatcactttatttattgaatttataagtaatgcaattatttaaataggtcttctcgaagaacatctagatggtatacgcttttgtgaggtgagctcccttttatgtttgatttaatagaagaaatgtaatgtgtaatgacttgcttcaaatgatttgtatgttcctattggataagggcatcttgattttatttttattttttgtatctataatgtgcagtaaactttttacttttcattttagtatgatagctggagtttggttgtttcaaagataggcaagtattgtgtttaacaactaaaaataaaacaacacatatttttcaatagaattatttacaaattataaatctaaacacagggaaaatgttagatacaaaaacaaaaaaagtatcaaagacaagcagtgtatcagacatatataatatcatattttcaattcattagaaatacaacttgccatatcgcaaattagtccataatcaccaaggtagggaacgattgtctatcgataagttatgattgaaagaaaaggatttcatgaagaaaaaaaaacttaatttttcttccagaatcgtgacttagaatttttgttaacaccgacgaatttagataacaaaagctactccctcattgactaagccaagaaagttgagtagttgactaacaatgggactaatattttagcaaaatcaatacaattttggtaattattttggttcatgaaaatgttcaatttttttggtctgaattgtggaattcacgatttatttagcctttttgcggtatatataaaattaagatatttttatgtaacactttgttttataaaggataagcttgtatagtttatatataacggctagtcatgctcaaagcctttatcatctgtgggcttcacaatcttatttcttcgacccatttgcttcaagcctcaaaccaaaacttggctgagttcttcgaaagctcattatttcttatatagtaattcttttacatagtgttggaaaatgaagtaaaagaatatcgaaacttgaacgcttagatgacgaatctgtgacattatgatttcaagtatcgacgtgttttatcaaagtgaaaagttgttaatgttggtgttgggtccgtgaaagctcgaagccatggagattaatttcaaacacttttgacctttgagccttgcaagtttggtttatttgttcaacgccagacacgtttgcacagatatgagttggtgagtgcaaatcccatcataccaactaatataaagttataccatcaatgatattctatcgtgaaaaaatatgtaaagtctaatatcattaagtatcatttattaaaagaatgaattgaagggaaaaaaaaaaaaaaagataggcaatccactagtgttcataatgaaagatgatggtcgatgtaatatgtatactaatattatatctctagctttgatcctcaatagtcaatatctatagtgtttatagtgttttaacagcttttgtataatgttaactgtgcaaaatacatgacataaaataaatgattttttttggcttttatgttataagtactattagttggttatctgttttaaaggtttttccttgaattagaggatcagatttacatgcccataacagaaccaagctggtcaccaaatccatcttatgtagtggcataacagaaccaatcttggtcaccgaatacagtagtttcacctttctctttctccaaatataataaaaaacttttttattttgtgcaaaataaactttagtgagatatattgagcaaatatgtatatatatataaagatttcttgagacgatatctctttgcctctttgggtcattgttaattccatgtatcgatttttagggttgaagagacttgtttgtaactttgaccaattgtctactctttttagaccacaatgttagtaagtatgtaggtaggacttgtttcgaatgtgatgatttatttaggcccagacaaattatttactagacccattgttgttctattatttactgtttgaaagaagttgtttttgtcgttgattgtttactagtatttcaaagaaaagggtatgcatagtttaaacttcaaggaaatcccttatatatagtaaaattaaaagaaattccacaattagatttcgtaatacaattttctataacaaaacctagttaattagtccacatgtcctagctcttacccactcagcccgcatattcctcacgctttctttttattttccgaaattttttaaacggctaccaaatcaaaatgcataaataaacaaacccttctcttctttaccaattcccaaatccaccaaaaaaaaaaaaatg

SEQ ID NO: 20962 - DNA, 3000 bp, Unknown
  misc_feature (1)..( 3000): 2750-1469P.txt file - cDNA_ID_1830238; gDNA_ID_1620852; Annot_ID_51010
gagaaactgcaggcgattcatggagttccgaagattaaagagaagtataatccggcgacatggatgctagaagtgagctcaatggctgcagaagctaagcttgagatagattttgctgagcattataaaacatcatccttatatcagtaagttcaacctaatattcaaagctaagatcattccagatattttaactcaattagaattgttcgtggtgtagacaaaacaagaatcttgtaaaggaactaagcacaccaccacaaggagcaagcgatctctacttctcaacgcggttctcacaatcattgttaggacaattcaaatcttgtttgtggaagcagtggataacttactggagaactcctgactacaatctagcaagatttttctttacattggctgcagctgtcatgctcggatcaattttctggaaagttggcacaaaaaggtttgtttaattacttgaatcgaatacagaggcctcaaatctagtatcagagtccttacttatatctaaactctatacaactgttttcaaaaacagggaaaacgctaatgatcttacaaaggttattggagcaatgtatgctgctgttttattcgtgggcgtaaacaactcttcatctgtccaaccgctaatagccgtggaaagatctgtattctatagagaaagagctgctgaaatgtactctgctttaccttatgccctagcacaggtgagattaaactagaaacgttttagttacttgacaaacaagaaaccttaatgggtcgtaaagcagtctttaactaaaactttcccatggtttcaggtggtatgcgaaataccgtatgtgctgatccaaactacatattatacactaattatatacgccatgatgtgtttcgaatggacattggccaaattcttttggttttacttcgtatcatttatgtccttcctctacttcacatactatgggatgatgacagttgccctcaccccaaatcagcaagttgcagctgtttttgccggagctttctacggacttttcaacctcttttctggttttgtcattcctagaccggttagtgttggttacttttctggcaagaaagctgaaaccctaaatgattctctattgattctatcataagctggttttactttcctcttgcagagaattccgaaatggtggatatggtattactggatctgtccagtggcttggactgtgtatggattgattgtttcgcagtacggtgacgtggaggatacgattaaagttccgggtatggcaaatgatccgacgataaagtggtacattgaaaaccactatggatacgacgcagattttatgataccgattgctactgtgttagtgggctttactctcttttttgcgtttatgtttgcttttggcataagaacgctcaacttccaacaacgatagggtgtagttgcctgccggatatgtttggcgtgaagtagaaaaaaatgaaaaatgagggtttatgccatatagtttgtgattgatgctttattgattgtaagtaaagtgtacaatatatacaacacaatagattgtggggagaatttacaaggacaaatctaattataattaacttaagatctaaatttatgtatatcctaacagttatatccgttttgtacactattttaaaactttttacagatctaagataaacatagatttattttaagaatcaaattgtgaaaactctgcgtggaaaaaattaatcatgagtcatgacaatgatgagctagttaaggttccaagtgattgcaatcacattttgtgagcactaaagaacacatacacacactatatatatattcttgatcacctaacgagtgaatcaaaagagatgagtagtttattgtattttgggacaaacttcgattaaataatatttacactatttcatgaaaacatttgatcactcatcaaatacatcttatgaaggcgcatatatatctactgtttatgaaatctaatctactttactatatgaaaaaaacatacaaatttgccggagctttctaaagacttctcagcttcttctccggtattatcatccctagaccggtcaattttggttacttaagttgcaagaaatctccgtgtaacccaaatttcataaatgcgtagtgggatttactcttcttcttttttggtttcatatttggtgtttgcctttcgcgtaaaataccaacatatagcaaagagcgtttagacgtcaaatgtgtttgttttatttgtgtagagtatacatacttttttaagaaaagaaaaaagaagttatgaaagcttgttcttttttgttaaagattatgaaagcttgtttaaatcctaatcacatctcgtactaaataaagaactatatgtgtgtgggtaatattatccaatctctttaaatttaaaccacttgtctcatctcatatgcaaaacgtgtatcttgtaagaacacacgctcttctaatatagaaatagatcgcgtaacaagtggacttggaaaagctatagtttatggcgttttcggacagatttacacttaaataatattatcctcacatcttttaaattcaattatttcattatcttggttatcagaactgagttttgtcggtaacattgtatctttaaaaaaaattatcctaaacaaagaacgaaacgatacaatagtataaatttgttcttgtcataaacgataatttccaggtaagattaaggataaaacaaaaaagcttataatagcaatttaaaacacgaattcaacgtacgatccaccacaatcctcgtcgtctttcaaacttaaaataccgaaactacccttaccttcttctttccataagaaatcaaaaccaagtcctatggtcgcaattgtatctctatctaaaaatcttctttgaatttgtgtatacacaaatcttattcaacgaatcatttatcaccaaaaggttctctcttttttgtttgtttctgtcttgtgtgaatg

SEQ ID NO: 20963 - DNA, 3000 bp, Unknown; identical to SEQ ID NO: 6179
  misc_feature (1)..( 3000): 2750-1469P.txt file - cDNA_ID_1830242; gDNA_ID_1620852; Annot_ID_51009

SEQ ID NO: 20964 - DNA, 3003 bp, Unknown
  misc_feature (1)..( 3003): 2750-1469P.txt file - cDNA_ID_1830246; gDNA_ID_1620852; Annot_ID_51007
gaaatgaacatcatctacttcacatccgttaaatccatacacaatccatactttcccttgcaccacttcgagccctgctcctcctcttatgctaaaggaatctcctggattcgaacaatgaaaccacgtcttgtcaacgatattgtaagagtctagtgtcttgattcgatccatagcacccactccaccgaaaacgtaaacgttttcctcatccgctgccatcgaatggaaactacgaggagtgggtccttcttccaccggagttagcagtttccactcgtttgttgtcgtgtcaaacgagtagaaaccgttgtattggcgtgaaaagtctcggcctccaaaggtatagagggtcgatcctactgacaccatacggacacctaagcaagagaggtgtggaacgtctccggtggctggagcaatggaccaagtccgggtctcgaggtcaaagacgtaaaggtgtttatcgatgggctgatttggtatgagctcaccaccaaaagagtaaatcttgttgcctacttgagctatgccatgtgagcatcttagccctgggccttctccattttgctccaccttataattaattagtaatatttgttagctatttttaaaaggatttatattctgattagtaaatttccataattgtaaaataaaattaatcaaattataaattgcaaaactgtcattaattatctaaattccaatttttccctctctttttttttctttcgcgtccgtggtttagtatttttggtgctaacaaacaaaaccttcaatatacatagttgtgggagatctttgtatgttggtctaagtgattactaccttaatccagtttccaagcaatttgggagtggacggcaaagaaacataggcccctagggaatgtagaacgtcggtcgaacgtccatgaaacccaacgatttttccaccatgtagcacaaacttaaccccaggttttttaacgataggctgagaggttttgcctttagaagtcttgaatgaaagaaacgtgatcatttctgaggtcatatcgctaactttctcacggtaaccttccacgtagacgatgtagtcatccgaatcaatctcaaactacaaagaaaccatataattttcaatgcggaaagctaagcaacaaagaaaagagacactcttgaccaatcacaacatagcaatcttttttagtacctcttcaactcctagctcagtcttctctccatgttcatctccaacaaccacttcagaaccattggcatactcaaacttgacgaaggctataccatactggccttgccctacatatacctttgtaacattgtcgtaaacaccatcatcccatacatctcccgtctcaccaccctgtgcaactagcttttgggccatctcttttgcttgcgtttgataaatcttacgatttattacctgcgattagaaacgtaaccaaatagtttcaaaaagattatcatatataatgtaaccaaatactatactaactataatcatatgagaaaaggtagagagattacctgagaagtaagtaatggttaattggtgcagtgatctatgttagggaaatttcatggtatttattgacctggggaagatatggatgatggtcgatagggaagacttttagtttacatgatatggcaactcgtttttttcttctctttcttatttcttttatgagaagaaagattctcactatacgtaataaagatctgtatcttggccacgttcttcaaataagtataatctccccttgcatttttggcttaatggattggtagtgttgccctcaattctcaaaagggaaaccactttaagaattaatagttgtatcatgtgtggttgattaattgattgaagtaagatcatgtatatttaactatactaactaattctaaagctgatggaacgtgttcacgcacattctatttcatatagaaacaacgtttattcggtttaattcatttgaacctatccagtaacataagctgtcgaccaaaaacaaattaaataaatgaatatagtgggacgtaaacaaaggaaacgtaaacaaggggaattcttaccctttagaattttttttacagaatacaatttataaatatttggttgacagttaagttttccggacaagaatacaataattttgagcaggaaaataaaatataacttttcttttttaactcgtcgaaaagattattattatagaaaaattgtaaaataagttgtcaaatcttcgattgtttcaaattaaagacatgaaaatttcgttagggtgaattagtaggtaaggtaatctgattttgaacataatttaaataaatgactataatggcaagtaaacaagagaaattcatttaaaatatactactttgttatttgtcaaaagaatatgctactttaagattctcatacatcatatgaacaaattagattaaaatataatttctagaatacacaatgggaaaatatattaaacaaatcaatagtgtgtgagttggcattgacatggtaaatgcaaaatcaaaatacagcataacctatgcaattacatgatgggccttataaaaactacatactaaacaaacccaaaaatagaatactagccttattaatctaaaactcaaataagcccaaaattatttggaatgggctcacttccatatttggataaatttaaaatttcgggtatgagcaaattaacgcgagtttaaccactaagccatactcgcggcgcgtggagttccgtacgaaatatcgtaccgccgtctctgtgcgcgctatgattacggttataacagaacgatacatacatctatatatacacactccaagacaaaataagacctctctgctttctctcgtcttctccatttactcttttttctctgcagagtttttcggaaaaagaaattgttctttctcattgattctacatttctacagaacgagagagagataaggatttgtgagagaacaacaatg

SEQ ID NO: 20965 - DNA, 3003 bp, Unknown; identical to SEQ ID NO: 20964
  misc_feature (1)..( 3003): 2750-1469P.txt file - cDNA_ID_1830246; gDNA_ID_1620852; Annot_ID_170352

SEQ ID NO: 20966 - DNA, 1433 bp, Unknown; identical to SEQ ID NO: 2331
  misc_feature (1)..( 1433): 2750-1469P.txt file - cDNA_ID_1830246; gDNA_ID_1620520; Annot_ID_159443

SEQ ID NO: 20967 - DNA, 3000 bp, Unknown; identical to SEQ ID NO: 6164
  misc_feature (1)..( 3000): 2750-1469P.txt file - cDNA_ID_1830250; gDNA_ID_1620852; Annot_ID_51006

SEQ ID NO: 20968 - DNA, 3000 bp, Unknown; identical to SEQ ID NO: 6164
  misc_feature (1)..( 3000): 2750-1469P.txt file - cDNA_ID_1830250; gDNA_ID_1620852; Annot_ID_170351

SEQ ID NO: 20969 - DNA, 178 bp, Unknown; identical to SEQ ID NO: 2836
  misc_feature (1)..( 178): 2750-1469P.txt file - cDNA_ID_1830250; gDNA_ID_1620607; Annot_ID_161804

SEQ ID NO: 20970 - DNA, 3000 bp, Unknown; identical to SEQ ID NO: 6162
  misc_feature (1)..( 3000): 2750-1469P.txt file - cDNA_ID_1830254; gDNA_ID_1620852; Annot_ID_51004

SEQ ID NO: 20971 - DNA, 3000 bp, Unknown; identical to SEQ ID NO: 6162
  misc_feature (1)..( 3000): 2750-1469P.txt file - cDNA_ID_1830254; gDNA_ID_1620852; Annot_ID_170348

SEQ ID NO: 20972 - DNA, 3003 bp, Unknown
  misc_feature (1)..( 3003): 2750-1469P.txt file - cDNA_ID_1830254; gDNA_ID_1620607; Annot_ID_161808
ctatcaactataatcatatacagaaagaaaaaaaacaagtgttacatcacgcttagcttaaaagtttcgactttttgcaccgtcatatttcacgtgtaagcaagaaatacaaatgtaaatagattataattaatgaattctctcgactctctcaacatagtatataaaaggaaatctacacatgaaccgtatctttctcacttttgaaatattttgatgttttaaagaaattttttcaaaattttatataaattataaattaatttaatattttttgattatttatatttttcatcagtcttgttcataattggttgaattgttttaaagtaaatatttctttagctaaaacatcttatacaattaaaagaaaaaagtgtaatcaaataaccaaatataaattagtatttcaaattatacttattgcagggtgataaaccttttgtcccaagtgaagttaaacctataaatatataccccatttagagggtcctatataactaaagtaccacatatttggtggtttatatcattcaatttttttgtaactaacttaatatttgatatgtaaaatcatgttaaaataggatcagcagatagaatatataaaaaataagtcatgtacaaacgtaacgttcttcatatcttaggtaacgtatctaacaattttgttaaatattattattttaaaaaattgaacatattatttggaaacttttcttttgataattttgaaatggcactttgtaattaagagtttaataaagaacacgtcacacacaaaaacgaagaaagagattatagaaattaagttgtgttttcaatcttcgtgtatacaaaacaaaaataaaaattagaaatgatatttcatacgatgttgttaaataatataattatgaaaattagttgtgctttatattattatttttgttggaagctctagaaacgatcgacctaatagtatatttttgtcactaaaaagtgtgattaaaatatatatatatatatatatatatatatatatatataatattgtaattttcaaccaattctcggtttaggtggtttattattatattgttttttgaaaaaattaaaaaatatatccttattagttcattcttttctggtcattcgttcacactttacaacttggttaatggccacttctcaagttatcgttctttcatttgttctacagtcgcaagaaattatcgttctttcatttgtcattatgcataatgatttctcttttctttttagtgcataatgatctcactacataaaaaaatctatcttacgattcaactatatttagtcccatgcactcgctgcataacacattactttcttcgatttagagtgattttcacaaccttgtttctgtattgtatatttagttagtgtttgtgattaccaaaaaaaaaaattgtttcttcttggcttagtctttttatcttttttttttttttgcttcatctatttttcctcccatgacagatgaagacggcaagagatgcagcaaatctcatttatgatctatctgaagaatcagcgtcatcgatttggagactcgaaccataacaaaaagagcatcacagtttcaatttaattgctcctggcgcttcctatttcagcaacaaacattaaataattaatccaatagagatgatatatatggaaatttcaaaaccaaaaaaagaaactttcaaaaccaaaattgcgaagccatagaaatcgtggatcatggaattgcgaagaccaatgttgacatatgggaatttggtgtcccaatgagcagagatcactaagattggttttcgggaggaactttttgagttcatgatttgaagaattgtctcgcctataagctatcgtccatagtttgagattcatgcgacaagaagaaggtttgattcactttctccatttaattgaatcatcttcatagatatattttcatacttaatcaatgtttttaccaaaaaaataatgttattttattattttggttttatgtggtttgggattggtgtagattataaaccgattaaaccaatgtttttgtgttctgagatttcaaacttttgaactaaataaatatacgttttggggaatatccaatatcaatatgtatcatagtttggactctatctattccagtatgataattcccgtggaaaaatatatcatcgtctctattttatacatgcacttgcaacacaaaccagccataaagtgggtctattcttataatttatgacaacatggaacactatcattgggccacgatgcaaggagcgaaggacgatgcgagaaggtgctttactgatttgatgaacgtggaggtgattctgaatgatacgagatctctaagctgaatatataatagtatagtttttcgtaatttttttttgttaaattttttatcgctgctaaagattaaatggcgagtaaaactatactattatactttcaaagatcacccgagaaaatgatgactgcacatactttcaatatcccatagatgacatatctgttttatttccatcaagctattcatcgaaacaaaagcacatgacgattatgggagagaaacactactctaaaatcccgtaataagctgcaccacctaattttttgtgccttgaccaaaaaaaattcaatgttgcagttcaacgaaccttcttacggaggatctttaaacaaaatttatttggtacatagagaaaaatattttaatatatactaatttaatgcctcgcgatcaacgagtagagaaaaaatatgtcgcgtgtatcttcttccattggtcaataaataccaatgcaatgtttactacacaaatcattacttcagtctcactctcaggtcagctctctccacatctctctcatatgattgtactatgtataagatttggtaatatttgtaattacaagtaaaattcgtaaatacagataatattcgtaagaggttgatcaaacgaaagcaaaagagatg

SEQ ID NO: 20973 - DNA, 3000 bp, Unknown; identical to SEQ ID NO: 6157
  misc_feature (1)..( 3000): 2750-1469P.txt file - cDNA_ID_1830264; gDNA_ID_1620852; Annot_ID_50998

SEQ ID NO: 20974 - DNA, 3000 bp, Unknown; identical to SEQ ID NO: 6155
  misc_feature (1)..( 3000): 2750-1469P.txt file - cDNA_ID_1830267; gDNA_ID_1620852; Annot_ID_50996

SEQ ID NO: 20975 - DNA, 3000 bp, Unknown; identical to SEQ ID NO: 6155
  misc_feature (1)..( 3000): 2750-1469P.txt file - cDNA_ID_1830267; gDNA_ID_1620852; Annot_ID_170342

SEQ ID NO: 20976 - DNA, 3003 bp, Unknown
  misc_feature (1)..( 3003): 2750-1469P.txt file - cDNA_ID_1830267; gDNA_ID_1620607; Annot_ID_161814
aatactagaaagaaagaaaaaaaaaacttttgggcaatttcaagaaatacaaagatttgtgtacctcctctgttccaagtagtgtttgcttcccatgttcaagtgatacaatcttaccatctttctcgtaatcaaacttgacataaacaacaccagagtcaccttgtccaacataaactttctttacattgtcataagcaccaccgtcgtcccaaacatctccaccacgaccaccttgagcttccaatttggtcagaccacctgataccggcggagtcagcggtgtagtcgacggaattatataaactccaacagaatggatcaaatcacttgaacttccatgaaatccaacgattttgccacctcctagctcagcttcttctccagaggttagtccaaaaggctgagaagttttccccttgaatgtcttaaagattagagccgttacgatctctatcggtgatccaaagagcttctcgtagtaaattttcactgatgttatgtaatcttctggatcaaccacaaactagcaaaaaaaaaaaaagacaaccaaaaatgatcagttaatgttgatgacaagagaactctcattgaaaacaaaatatttacctcctctgttccaagtagtgtctgcttcccatgttcgtgtgatacgatttttccatctttctcgtaatcaaacttgacgtaaacaacaccagaatcaccttgaccaacatacactttcttgacgttttcgtaagcaccaccatcgtcccattcttctcctccacgaccaccttgagcttccaactttttcgccatcttttcttcttaacctaaagttatagtacccatttcttagaaactgtaaacgcacaagagccatgaacagacactactcaagcactttcatgatgatgaaactaatctaatctgaggactataatacttccactaggacattactttaaacaatggtatcatattctcatagattcattatcatataaagaaattcaataattcaaataaaactagtaaaaatcaatataacgattttgtgaaagaaagaaaaaaggagtacattaaagggaaggaagaaacacctttgagtgtgagaaatggagatgaagatggaatatgaatgagttaatcttgggattttgtatatatactatatagtatatataaaacatttttgaatacgaacattaaattctcttttcatccaatactaaccactttttttttctgccaatactaaccactttttcttttctttttgagagactttatattcaaccaactcgtgcttcacgagggatggaagctttgattagttaggacttaggaacttgtattaatctaaatatctttttttttttaaaattgaatctaccttacaacataaaatttgtaaagagaattccaaaattccaaaaaaaatcacctaaaattttaaaatcgtgaaagcagcatcgtaaagatgttctcttctgttttttttttttttttttaactctcttttgaatattggattagagattttcacagtgtcgtagattcttcgtagagtctgttatgagttgacatttaccataggaattgcattatcgtgagaaggttaaatgataaattgacatttataaattctcaaaatgtaggttatgagttgtcaaagaaatgtaggctatgaaaaaaaaaacttacgtctaaaaaaatgcaaagttaagaaagaaatactcaaagttcgtggcatttgaccatctctcagctacacctcaaattatagctcatgagaatggcccatgaatatgattgtggctccgttaatcacgtggtattaaaactcacacacgaccatttctcatctgcctccaattatagcgaaaccgttacaactcgttgttcacgtgagcatcaaaatgtgcattactcctttcaagttcggcaaatcctaattatccattttaatggactgcagagactttaattagagcttatagaactttaaacattttggtttaaatcttaaaatagaaatttaaccaatctcaaatgatttttttttcttttcttttggcataagtttcataactcgatgatgaatgctacgataatatagacatacagtatgatgattagatgaaaacagataaagaagaaaaagtgtatcgtacgccccactcggtgataatgattaatgagactatatatgagagtacccaaatatgattttttccactcatgaatcgtattgcactatttctgcattattaagatagacccacatttaacattagaccaaaaaaaaaaaaagatagacccacaccacctgttatagtatttagtatttttacacatccactaaacgacgacaattgacaaaatcacacaaacctttctcctttattcatttttgtttaattcgggtcccttgctttttagcattcggctctcattcttatcttcccatggatggatagtcatagttatataatacagttcaattgaagttatgcagtatatatatgcaccacacacgagtcttctatatatgtggatactacgtttcaaaataattctattaacttagagaagataaactttcttagtacttttttcgtttcactttacacacacctcaaaaaaattcttgtttcatttgtgactgcatgtaaatgtcgttaccttacttgaatttttacacaatggtacgtgaaaaagaaaagaaaaaaaatataattgagagaaaatataataggatcacaccactacaatacatgggctttaaattcatcttttctatatgttataatttgggccaagactattatatcatatgggcctatcaatgtaattagaagcaattgcccgatccaataaccttaattaggaaaaaaaatcgttcccttctctcgtttcttttcagctctgactcggcctctatctctctcccgtcgtcagccacattcaccggtactcatctgaccaagctagggtttcgcagtcatcatcatg

SEQ ID NO: 20977 - DNA, 3003 bp, Unknown
  misc_feature (1)..( 3003): 2750-1469P.txt file - cDNA_ID_1830584; gDNA_ID_2214482; Annot_ID_133282
tactaagatgtttattggttgatctggcaaaaagaggaggttacatctagtggcgggcctatagtaaataaaattcctgtttctcacccttaaaaagatagaagagtggtccacaagcaaagtttcgtgattggctctgtttcactgggccattaatacacacatatccacagtctttgtgtatacaaaagatgattatggttgtaaatagacatatggaaggacaaaacacgtcataatagaaagcttaggaacctatgaatggtggaaacagcaaggtcttgtcgcatcgagtaatctgtaggaaacattatctttaacagttaacagtacaatgcaccactttggcactgcctttgttatagtcaagagaaatgtacgaagtgagaaagaatctttttctattagtggttatacgtttaacccttaatgtctctcaatgtccttctcatagatatctaatagctaaaacctaagttacctcatgctcatgtttcaattctttgcaagttgcaatgtgaggccaacaaagcaagcctgtcaaatcgttttcagtcgtatccttaaccctcgtgcaaatcttttgtcatcatttaatcttcttttgtactctttgctccattatcacggctcttgaccatatgctaacaaattaaccgtcaggctttttgggtgtacctggacttgcttcttgggactgttcacagtctcggcgaaccgcgactgcataagattcccgcagaaccagaatatatcatgaaaagattcagtattattgttgaatatccggaattatgaactttagagtttgtgttatggttaacaattaacaaactttatttatgtaacgtaatctcacacattgttttgctacatttgggttagaaataagtttgacaatcctttgtaacacaatgataccattgagttattgcatctaaaaaaacacgtggtttcattatttggattttggacccaatgtcattttattgggcagtcttttacggtaaagtcaaatctcagaaatggttggaaatatttattttccattccttctttggttatgtttgttacgtgttgttctcagcatctcacgctccataatatctgagctcatcacataacaaaaccatttttgtcattttttcaaacaattttgggatttcgaaatggacccaatgtaaaagaaaaaatttccattaattctgtgtcctagaaaaatagttttgacatattttaaaattatttgaaattattaatatacctcgttttaatactatttactaaactataacaacttaatctgagttatgccaaaagtaaaaaataaacatcctattaagtgtcatgttaaaaagaatatatataataactatatcatgatatgtttgtgatatgaaagaagtaaatgtaaaaatgtttctagtttagtgatgagtttacgaaattacagaaaggtaagatattgcttcaatattaaagtggatgcattaagttccatgcatgtttccctttctctaattgtaatgacaagggacatcaaggcttaaatcttggggcaagatatcgcaagctttttggaccactatattttttttctccatcttccaattttattggatgcatcaaacgcgtctttggaccacagtcgcttttgattttcactgcaagcttcatttgttcatgcttgaaacagaatggaatgtctcagaaattttactattgatccaagatacttgatttgtcataaatttctaggtcggcaactactgcaagtgaaaaaggtcatcctcatacatacagttgttctatgacgagaatatccggatattttgtcttgattcataggactcaattttgaagatcatagtatcaaaaagaacttgaaacccgaatgaaatagtattcaactttccgttcttattagtttcactataaaaaaataacgaaaactttatttgtatttcgtacaaatccaattcaatagtgcatttattttttccatgtgctccttagatatactgcacgtgtagtattaaaatggttggatgtatttctggtgatgaggcttaagtagctcatagaattaggagacctaattaagtaactcggaaaatgtagactctaactcgcagtaatgtgaaatcttactgtattacactttattctgaaaatctagtagaaaacaccatgagttttttaatatgacgaaagacgaaactatatatacttgtaaacgtagagaactaaaatttatatacaatttagacattttttgttggaaatatttatgatatttttttatacaacttttatacgcctcttcctatgagtatttttagtattgtcggtcaatttcatacgaatacgcttaccatcattaacagaaaaaaacaaaacaaaaaaacgcttatttcatcaagcatagtacggcataaagtaatacaaaagaatatgataaattcaaaacggcttattaagtttttgttgttgttgttgagaggatggcataggtttattgagtgattcttatcattggatacctgttgctgaccagaattttcggccaaatatacataggacttttgttgtattttcttccatatttaaactataataaacaatgaaccaattaaaaaattgtatatgccatccaaggatttatactgatgatgatgatggtggtggttacatgaccaatgtgatgatgatgacattaatgaaaaggaaacaaaaaatctagcggtggctttatatatatcacatacttgaggagagtaaggcaatagctaaactaagcaaatctctaagacttgttctcattttgtttgttcaaaatcccattaaaaaaaaacacaatgcaaccttaaattatttccgtttagtctctctcttcacagtcctgacctctctcaactctcacaacattaccaaatacatcccataaaaaaacaattctttaaaaaaaaaatattttgatataaacagaaaaaacaattaatg

SEQ ID NO: 20978 - DNA, 3000 bp, Unknown; identical to SEQ ID NO: 11236
  misc_feature (1)..( 3000): 2750-1469P.txt file - cDNA_ID_1830751; gDNA_ID_2214485; Annot_ID_133350

SEQ ID NO: 20979 - DNA, 3003 bp, Unknown
  misc_feature (1)..( 3003): 2750-1469P.txt file - cDNA_ID_1830895; gDNA_ID_1620863; Annot_ID_51288
aaggacacttttaaaggcttttcaggttttggatgcgatatacctaatacctaatttctttgacatgattatactataacattaatttacatttgacttaatactattattgtatgtttttgtaaattaaactcaatttttagatatgaaagatgcacacgagattataaaggcaatttgaattgaataatattagtttggtaggtggttcatgtaccaaacaaagcttttgatgcgtgttttgtaatttttggcgtataaaaaatctcttgttaattcttaaaagaaaaaaagaaaaaaaaagaaaaaagaagaaagaattattttgttagtagattactttttcttatttcattatcctacgaaaacgtacaaaaactatatatgtgaggtttgctttcagaaaaaaggaaaagtgtacaaaacgaaatatgacaatcttatataattattttaaaaagattgcataattgatgtctttggttactcaatttctaatgttattttttttttcgtttttttttttatttttttttatttttaaatgtactacacaatttgtgattactccattgggaagctatatgtactacatatattttaccgtcactcttttgaaagctatatgtactatacaaattatgttttaaggaaccatgaattgtttttaagattacttgaagtctacgttttaggtcttgacaacaaacaaagaaaaaaagaaaggaaaaagactaatagtctaatacatttaggtcaaagcttatctcttgatctttcttaagtggaaggttcatattgttatctttgcctttgtttttcttgttttttatttgttcgtagaaagcataatgaatgattcagacagagagaaagtatatttggtgtattagcttttgataagtggagtggaagtcacattccaacgaaagaaaaagtaaactaactattccaatgtttcagaatttggttctctgtaatagttccgagtttatatcataccaaaaaaagaagaagaagagttatagataaactcattagatatgcgattttggaaatacaatagatataaaatgaagaaaaccaaaaccaaaaccatagctatatttttttaagaatatccaatggcaatagctagtatcagaattcttagattaacgcacatattattagcttcacattgcatgatatcattcgttacaattactatttgattaatctaagaatataattaatatctaatggcaagagctaagaattagaattcttagattaacgcctatattatttagcttcacattgcttgttatcacatggtacattagattaattgacgccatggtatactcgtttccagtactattagactaacttctatcatagtttttattttgacttttgtctttgttagttttttttttgtaattgttttatgcaattattttaccaatcaatgtttttttttaccaactctagtctactactatgtttagtagtctatattagtcagtaaagaaataaactatacatattaatttttcaatgttttttgtatgcatttttattgggtaaaaaaatagttcaattggtaaattttgtatgcatttttttcaacaaactaaaaatagtatcattggattttcttaaagatatctaaatgatactattttgatacaatatttttttaacatcatcttgaatttgaataatactaatctgctactaaaaaattagtaaaatattggcaaatcatatatttgttctaaaagtcatttataattgaaaagattcttataatttgatttaaaattactgacaagttacaacatgctatcaaaaactagaaaatttatcgaaattagatttcaaacatatattattgcatttttttcctcattttcaacgtttaagtataaattaattataaacaatgggtgcatttatttgactactactactatttaaaaatataaataggtctcacgagtctaccactcctcgggatcagactaggctacatccattgaaccatagtaaaattaccgtggaaaaaacagtacagctgtaacttcctatataaacacaaagatccatgtgcccataaacatttactactagtctactactatcgtattttttttccttcgtctatgactacactaggttgtttaattttggaatcaaattaattagtagacgacgacttcaaacaataattatttaacatacacgttttgaacaactgtatgcaataattaaaaaatcaacaagaccaatcaaaatcattaacaaatgctgtaaaaaaaaccattaacaaatgtcatttaacatgtttctaagaatatttaatgaaaaaagtatagatcaaagctctagtgctctagatttttcattaaaaatctattaatattttcagttttttttttaaatgttttcagatattttaaaactctattaatatttccagattttttgttaactcttgaacaagtactattaatatttcctttaattacatacgtacatagtaataatagatttctcctataaaatgcttttctttttttacttcagctcctatataaaatactcggataaatagatcctaatcaataaataaatagattcagtttttcttttgatttagtcgtgtacaatgacgatcacaacaaaaaagcccataaatataatttactcaaagtgattaagggtaaaattgtcattatctgatacgtgttttagttgaaaaattgctatcttccaccttcttctatctctctacgaaaataatatttttgagttttgtttttactttttgtttttttttttaaaatttttttttcttcaaaaattcctccattgttattacataaaggaaaaaagaaaggtctctgagattttcaaatcaccatcatcatcatcgttgaagaagacgaagaagataccttcctctttatcttctccgatttctcaaccttcccgtctgcttgtcgtaaagaaatg

SEQ ID NO: 20980 - DNA, 3003 bp, Unknown
  misc_feature (1)..( 3003): 2750-1469P.txt file - cDNA_ID_1830899; gDNA_ID_1620863; Annot_ID_51287
taaaagtaggcaagatttaaacaaagtgattcatcaataatgatatgatatgtgtcattcatttacaaattatgtaacacataatagatattttgtaccctaaaattttgaaatttattgtacataaattttagaaaatctgttggactgtgactagttcttcaacttatagagagttgagtgtgtttataatcacatactgcctctttaaaaaacgttaaccaagtcgaaactcgaatatggtactaccacacatgacaaaatagaaaaaacacttgaatgtttaccaagtagtacttggtccattggcccaaaaaaaatgagaatttgtgctcctttgaaaggagttttcaactgctagacccaacccaaaagaatgtacgattaggcacattttccataattgatgtaatgtaaagaaacacttgaattttaagttttacatataatatttacatttaattcatcttcctcatgaatatgttgttcaattatcaaagaacctacaaagatacagtattataactataagatcaccaaagaagaaaacaatcatttgaataacaaaaacagtaaaacaccatataataaaaccgtgttctagatacaaatgtaaaccatagtatctcaccttgcttatcgattcatctttgtaaaaaaaacaaaaacaaatgtgttcaacttggtttgcaaaaaacaaataacacaagtacacaaccatccatccaataacacaatcacaatatttgtttcccaacatttatgcaaccttatttttagtggacactaaccatagaagaacaaatttcagttgtagtgttacaaagtccattaaaattacgcgttatcaattacaaaaccacatctgttttttttttttttaaacactttaaattttgtgtcagataaaatgaatatatgttatgacagcaatcactttcaaaaggcctatcaaatgggtcccaaatgtataatcctaatgtcaatcacaagtaacctaagttcggcccaaatacctgatggtccactttacaatttttcattaaataaatattaagtaaataaaataacagtaaaaaaaaagagttattcagtctgaagaacattaaattaaggttattaacgtcaaagaaaagataatcattttctctggtggcggcgttttaaaaacatagatttgaaatttttaactttattctataaaactaaaaagctctctgtctagtagtatctaaacgaatttaactaaaaccagctaaaaacaagaagcataaaaataatatcaaagtagaaactaaaggatctaataagtaagacaaaattcgaaattaagatccatggcggatttttgtctcttctctcattggatcgcacttgacacaaatgatggttcgagacataacagcagagaagggtccggtccgaaccgaaacggaggaagaaagcaaaaaggcaagacctttgttgttgggttgttgataaagagagagagagggggacacgtgtagtgaaaagagaggaagagaggtcactctccgttcccggttctgtctcgtgcggtgcgattgttgggtgccatgtcagagtccgttcccctatgagcccggcgaatccgaatcatatgcctttcttttcgctatctctctctctctctctctccctttaacccaaacccatctctcaaagacttgacctttctctctctctatctctaatttatttatcgtttcgcgtgtcgccttctctctttctctcattctctctctctctttcccttcgtatctctctctcgtgaggccgtgccctagaagaagaagaagaagaagcccctttctccgggacttcaatccctaacttccgtcgccggatttctcgtccttgattatcggaggactctttaacaactttattccgatttcagattcccagatttgtaagctgctttctcctttctgggtatttcctctttttgtatttgcttatgtaatttcgatgatttatcttacttggtgaggggttttgatgcttgtgtaatgttaatgctgtttaattaaggactgatttagtgtgattcggtttaattgagtttctttgggggggaattgggtttatctccaatgaagctttatgtttagtgccaatgtgtgttgtttagctcttttctctattgatttgtgtgtgaaattatgtttgtttgagtttcattaccaatggctgtctttacttgaatctcagtgattcatgaattctaccatctgtcgttgattatttcagttatataggatcattgatctatgttttagaactagtgtattattgccttagagaacacctgattttgaagtagaggaatgtagtttgcagtagaggaatgtaattaagtatgaatttaatggaagtattcgtaaggagtgagggaacgaatcgtttattataaaagctgtgttaagattagattacttactaggtttgtgtctcatctttaattaagacttttgattacggatggtgaggcttctaacgttataccaccatttttaggggtgacatcatttagtttcttagcttctatagcttatatgcttggatgacgctgtttgatttcatatcggtttaaaagtgaatgaaattgtggttatggccttatggtttggtacactgtgctttgtccgatgctgcatcattgatttgagttatacttcatttaatcttatcaatttttctgttcagtatttctgagcatgtgtacaatttaagtatttaactacctcactgttgtttcagtgtctcttgatcttagattatggtttacattactcgttttttgtttacaattttagtgtagagacagagttttttgaaggccagtattctttagttacttcggtagctgtgatttacacatgaaggtctatccggttctctatcaagcatatggtatggaaacagaagtagaaaatgaaagattcaggcagtgaaatgattaaaagagattgggtcatg

SEQ ID NO: 20981 - DNA, 3003 bp, Unknown; identical to SEQ ID NO: 20980
  misc_feature (1)..( 3003): 2750-1469P.txt file - cDNA_ID_1830899; gDNA_ID_1620863; Annot_ID_170389

SEQ ID NO: 20982 - DNA, 3003 bp, Unknown
  misc_feature (1)..( 3003): 2750-1469P.txt file - cDNA_ID_1830914; gDNA_ID_1620370; Annot_ID_154967
ggtttgtagagagattggagaagaatgttaaagggggtgactttttttgaagatcggatggattttttttttctcagagatctcaacagggagagaaaaaagacaaggaagacggtcacttcatggttaaaaaagtttgttggaaaatgaactaaaaattctaaatttagcatcaaagacacgacgagaaagaaaagagacagggtcaaagattttgtttttttttttaaaaagaaatatagttcactaattaaatcatggttaattaccttcttatttgctaagaaaatttgagacagttaactaaaactcacttttcttcgtaagcattgtaggaattcggtactattcaaaaagagggaaaattccaaaacaaaaacacaattatttattaattagacgtttaatatgtaatactttatggttagaagaaaaatatgcatattaataaaaattgtgcaattttatcttcaaaaaactaattgatgttattttcatatcaataattttacaacaaaattttaattttaattttactcttactagttcaattaatcattaatatttaagtgatgcaacattaattttattttatttttaaatttactgtttattaatattttgtttctgtattcatcccaaaagattttgtttttctaaaatagattattttatttttaaaattcaagagaaaacaaattaaccatttttatgaatagataaattttgagaaatacaatgactttgggattgagattttgtcgaaaatacttttattggtgaagaatttaaattcaaatagagagtttctcacgacgaagaagaagttcatatcgatgttcgttgatatcatatccatcacaacgaaaaaaaatcgtgaacggctatcgaattcgatgttggaaaaagagggcaaaaggagattgtttaacggcgattcacatagcgattaatcgagaaaatctagaatcaaaaattgaatcctaagagaaaacgtctctttcattttctcctaattttttatgttgaattttaaaataaatgaatatataatagtaaatgaaattttaaaattaatgtacataaaattaatttctttatccaaaagtgtaaaattaatgccacgtcatcttaaaaactaataattaattgagatagtacgtgcataattatcatatttttttatgatatcgttattatgaaaataaccacatttaaatgtttaaatattaaactacacagtttattaatctttttcatccaaccaaaaactattagatattaaacgtccaaataaaaaatgagattttttcctttcaaaatatgtttacaaaattgggctttttttcttttgaattttgattttatacttctcaacctagcaaaaattcgatgtcggttataaaaataaatctctatcaaaaatttgttacgtagaggaatacgactaaaggaagagaagaaaatagggctatattaatttatatacccagaaaacataaaaataaaaaataaacttataattttttttataattagttctctttccacaacttctataagttggactaaaataccctttcgctcataataaactaattaacaacataagaaaattgttaccgacatcttttatatgattcagatgatattgtttatcaaatatataagtaagaatatattatgaattaactgataactgttatgttaacaagataacaaaatatatagcaataagtttataactatattgtgttaaaccatattgtatcgcgataagtttataaatatattatgttaaattatcttgtaccaataattttttgttgttcattatgttttgttatttgttaattattttaatatgatgtaattatattgatttgatatgatatacatattattttgatataaaatttaatacttatccattaaaataacgtgtgcataatcaaaatccggattattatgattaaatcctcttattattaaaagagaagtacaaattgaatttttgtctaatttgacctcaattttgatttcaattttggattttcttctttgctattcaaaatcattaagggtaatttggtcttaacaatctattaaactttatatgatccgattcaatctaaaccgttcaataaaattaattcccttcaatctaaaccgttcaacaaaaataagtaaataacaaaaaaaaatcccaattattatttagttatgtttgttttaaaaatttttatttataagtttaagatatcaaatttattcaaatatttagtataaaaaccaaataaaccgattgtccgcggtaaaccgcgggttaaatcctagtagatagttaaaatgtatagcaaaatagaatgcgtaagattaaaattttagtttttagaaatttactaaacaaaatacagaaaaggtgtgttgacaactatttaaaatttaaatataatcaataagatatagttaaagttattaagtgtatagcaaaataaaaattgtaagaataaaattggatttaaaatttttttagtaaattaaatattttaaaaatagggattatcatttactgtttagaattcaaatatcatcgataaaaatttatactattgttttataaatccgcttatctagacgggcctaacctagtaaatatataatacacatcttatcattcggtcaaaatattatgaaaacatcattaaaatttgatgattacattccataagtaatttgttaaagcattatgcattttcctgttctatggacattaatttgaaccatacgactccatctaattcacttgttctcggcagctagcattcgaatcctgacttttcaaatacaaattatcggtcaagatgggtgtgcgttacgttcatttacaaatcactaaaaatgagtggtgaataatcatttggacaatacggatacattcatcgaagttgactccattatcctaccgtcgtctcctaacaatcgaagcacaactttgcaatg

SEQ ID NO: 20983 - DNA, 3000 bp, Unknown; identical to SEQ ID NO: 6184
  misc_feature (1)..( 3000): 2750-1469P.txt file - cDNA_ID_1830914; gDNA_ID_1620863; Annot_ID_51281

SEQ ID NO: 20984 - DNA, 3000 bp, Unknown; identical to SEQ ID NO: 6184
  misc_feature (1)..( 3000): 2750-1469P.txt file - cDNA_ID_1830914; gDNA_ID_1620863; Annot_ID_170381

SEQ ID NO: 20985 - DNA, 3003 bp, Unknown
  misc_feature (1)..( 3003): 2750-1469P.txt file - cDNA_ID_1830918; gDNA_ID_1620863; Annot_ID_51289
atagcagcaggagtgtttttcccggttctgcgggtgcaattaccgccttgggcagccggagcatgtatggcactctcttcggttagtgttgtttgctcttctttgcttcttagaagatacaagaagccaagacttaccactgttttgaaaatcaccacggagtaaaaagtcctttgttttcttacattggagtgactcgactacttttgttctgaaaataatttgtatttacttttcttttgtgctgttgttgttgtaatcatgtaacaacgatattggtcttggagaggtttctttttttctgtaagaaatgtgtcctctcggcctttgttgtaaaaaaatggtttcgatgctttgtgctcgattattaatgtaaaatggtgaaagtagtgaattcctctaatgtgactataaaatgatatttttatctgataatcgaatacagatttaacacgacatattgaatttagaattgttctgaattttgcgacatcaattattattattatgtaagaagtaagcaactatagcttttgccaatctttagcgagatttccggtttaatatacctaaggtttttgcttcacgagtccattgaagtccaagattaattatccattcaccatcttagtgactgtttattgggagttgattttcgtatcagaccgcactgaacagcagttgtagatcatttttgatctttcgtttcttgttcctcacattccatttgtttcttctttttcatcttgtgtaggagtggttagcttacgtgaagtgggataccttctgtcttaattttcaagtcaaagatcttaccaactttttcttcctttgtacttgacgactcatacatattcttcttcgttctttcaatttgagacttcttctccttctttggtcttcttgtcaattggatgattgagtagagaatcaacttccaacagtaatcaaatgcctcaaagtttacaaagttgcattgtgcttccgatgattgttggactgtcaagatagtgtctccttcgaccatgttcatagtagagcacatgcatagatcaaattcgtgaaagctgatttggcatctgcaaagatcaaagtgatacctatacctataagtattaaccaccagtcaccagatttaacattgttagagaaaaacttgtatatattcatgatgtatatctaaatctaatcatcaagaaagtattttgatcaagtcaaaattacagaattgttttgttatttgaatacaccaaaatttataatatactagattaggacttgcatatctattaacatgttgaatattgataagtacctcatttaaaacaaaatttcagttatacgtggttaatttcgcaatacaacattaagaaaaaaaatcacatttcaatatcataaacttaatatcaatcaataaaagccaaaacatttcatatcagaatagtataagtatcatatcaaatttacgtacatacatagttagtattacacaaataataataataataataataataataataataataataaataataataataataataataataaaaataccatgagtacagaaaatacaatttgacatatcgacacgaaaattagaaaacaaacatcatcttaaattaatttttgtcggcacctcataatctcatgactaataagtaataatgataccacgtgtcacatcagtaagaggcttataaatatattaatcttttcatgaaccagtagaaaatttattcccatgatctcattttgtttattttttagtttcctttttgtacaaatcaaaaacactatggtacaatgctaaacattctaattttagatatatataacttaaattgttattttatattgttacactcattgtttttattgcatattcatgtgtaagtgcatggaaatattaaaaatttgaaaaccttattacataaaattgagtactcaatctagtctctcttataagtagacaatgagttcaaaataattaaatcaaatatagtaaaaaataaattcaattccaagatttattaatatagttttcattcgcatgacaatttgtttcgctgtttagcctacgaaaataatcaaactttaaaattagtaatgtaaagtttgcaaatttgcatgcctagtcttatcaactcttcgaaaacatgtttgaatttgtcatctctagtgagaagtgtcaagtatggtgttttgaggcttgcgacattcacatcctttcatatagatttttctagtatttttcgaaattcgaccatacatcgatgagaaacttttctctgacactcatgtcacacttcagaaaaacatattattgtattatttgattgatatttttggttcaaaattttaaaaaattatgaatgtaaaaactaaaactaaataatcatatttgaccaactgaatgtggaaattatatttgaccaactgaatgtgaaaattaaattttatgaatgtaaaaagtgaaacaaaaaatttattaaagtcaaaatctcgtccgagctcagctgaatgtggaaattgaatttaataattagagttgcatcaattgcagttataggtatttcacatttcataaaaagcatattataatatcaattggcttatctttttagttcaaaattacatgtttatgagggtaaaaaataaaatacaagtctcggctaagtttgatatactacaaaatcaactaaaatttcgtcataaaaaaaaaatcattgtggtcgtatctttaggttaactgtgtataagtgaataattaaggataaacgtcagattctaggccttttggaataacggcccaataattattatttgggcctgttaatcacttgtttccccttaaacctttggcgcccaaacaaattagggctttatcttatcttcgcgattctctcatttcctccctctaaaattccccggcgacacagttcaccggaaatcgtagaataaatcagattctttctctttagtatgaaacaatg

SEQ ID NO: 20986 - DNA, 3000 bp, Unknown; identical to SEQ ID NO: 6189
  misc_feature (1)..( 3000): 2750-1469P.txt file - cDNA_ID_1830925; gDNA_ID_1620863; Annot_ID_51293

SEQ ID NO: 20987 - DNA, 38 bp, Unknown; identical to SEQ ID NO: 6202
  misc_feature (1)..( 38): 2750-1469P.txt file - cDNA_ID_1830941; gDNA_ID_1620864; Annot_ID_51318

SEQ ID NO: 20988 - DNA, 3003 bp, Unknown
  misc_feature (1)..( 3003): 2750-1469P.txt file - cDNA_ID_1830941; gDNA_ID_1620724; Annot_ID_49254
aagaacaaagaaatcaaatttcaatactgaaaaatcaaaattaggtaaatttaatgtaagtgaactaacaatttaaaagaacagaagacttacaaacatgatacgatcaaccggcagtaaagagatgacggtccaaacggttgcgtttgcaaacattgcaaaccctaccaagaacgacatatgttcgacgctcttagttcttacaactttcacttgcgtttatcattatttcgttgttaattttttttcgtattagtaatgcgaggatatttattaatctttgatattcataaactaaacttaccaatacagacaccggagaaaacgcaacagacgtccacaataacaaatcaccgaagacccaaagattcgatgaaacctaaagccaacgtggcaaatgtagttacagataccacctcgagtaccaaaatgataatcactaatcgctgcgtagagtgcttgcaaaatctaatatatgcggccaaatagatccccatgatcaagactccaatcccattagtgatgagggtaggagtcccaataaaaaaaaagacttacaaacataattggatccacatgtagtagatagacgatggtccaaacgattgcgtttgcaatgtttacatatttagcttgtttttgttccacatcataaaagtaattaaagaaatttttattaattaaagaacaagttctctcgaagatcacgaaggagagaagaaagtgcaatctttatagaaatatgaaaagattagatgatagtaaattataaagatatagatacatgcataacataagcaaaatatatacataacataagcaaaacataagcatattttgtttatgcgcatatcacattatatagactttgtttagcaatgtaaacatcataaaattgattcattatgtagagtaaataagaagaagacggagaaagcggtaaaaaaagatagataagaaaacataagtatatgtcttaaataagaaataataaatataggttatggtaggccttggcaaaaaaaccgtacctgaaaactcgaaccgaaaccgattcgaaaaaccggtttggggcgggtacgtatattagctatttaccctattgggttttagattgttgtacccgtggatataggataatagccgacccaaacccgatacccgaaagggtatcaacttatccgaaattacatatacttattcatagatttatacatataaaaatttattttatatttaatatttgaaccaaatacatttatatccaaatatccaataataattactaaaaactaaatgtacctatatttaaatacttaatactaaatattttatatatgcaaaatattcgtaaatgttttggatatttggacaaaatttcggttattcgggtaaaattcagatatttgggtaaaattttcgactatttgggtataatttcgggtatttgggtaaaattatcgactatttgggtacaaatttcgggtatttggtacaatttcgggtatttgggtaaatttttgggtatttggatataaaatacatgaatccgaaggatacccgtttttttcgagtatttaacggttctaaaattctatacccgaaccaacccaaacccgattagaaccgaaccaccgaagttttctatttactctattggattctagaacagtatacccgtacccgatcgggtattacccgaaccgacccgcatacccgaatacccggccctacgttatggctataagtgtatttactatacagaaaacgttaatccaaacaaagaatatggaaagcatgcatatctatgtagactaatgttaaggctattacaattggcaaccgaaaatttcgtgttaagttgtaatttagtatacgtacaaaatctaaaagtacaatagctttgtattaatatttgcaattttctaacttgatggattcagaaaagaacccaagaggtttcacttcacatacatgtatttttgaaaaataaccatgtcacttttacaattgttttttaatattaacaacggacggctacgatggaaccatcactcgaggaaatcgcgatcctacaattacatttagccgcgattcggtgagtaaacaaaccgagaacccgaacccgacccgccatctccagcttcgactctatttccactgttgacccggaccgatccgaattttgaaattgggcggcggagatttgagaactagaggccgccgcgagaggaaacgactgaacggagaaagtagctaacatacgcttggttcgacccgattcgatctcaccagcaggtacgaaggtataaccgatccggtttccatagtaaaagagctggattacattgttgtagtgtgagaaagctgcgcggttagggtttctaacggcggagaattgagaaaaggtgaaactaacggagctattagcgacggagaatgaaggaaccttgacgctagtgacggagatctcaggatctctcggtctaaagactgtgagataaacagtaagtgcggcgatgattaagaagactatgaagagcgtggcgacggcgcatgaagcgaggtttgaacaagacttcgacatttctcggtggagatgtttggtagcgatgatttaagtgttcactagttgggataaagagtttatttttggttaaagggaaagcaaaacgacgtgtaaaagcaaaaggatgttttgtttggacatagtgataacgttacaacggagtttggacttaagtgtgtgtgatgcagcgaaggtggccgactagagctaaataaattattttagtgaacaaacaatgtacccggaacagaaaccgggtttcgaagtcgggtcgaattgttgtaatttagagctaacagaacaaaaacctcctgagattgaataaacctccgattgctctattttcttatccagaacgaagagagattcaaatttcgcaatgcgattctagtgaagcttctttttcttctgtacatggttatcgtcgtaaaatg

SEQ ID NO: 20989 - DNA, 38 bp, Unknown; identical to SEQ ID NO: 6202
  misc_feature (1)..( 38): 2750-1469P.txt file - cDNA_ID_1830941; gDNA_ID_1620864; Annot_ID_170439

SEQ ID NO: 20990 - DNA, 3003 bp, Unknown; identical to SEQ ID NO: 20988
  misc_feature (1)..( 3003): 2750-1469P.txt file - cDNA_ID_1830941; gDNA_ID_1620724; Annot_ID_165902

SEQ ID NO: 20991 - DNA, 3003 bp, Unknown; identical to SEQ ID NO: 20988
  misc_feature (1)..( 3003): 2750-1469P.txt file - cDNA_ID_1830941; gDNA_ID_2926184; Annot_ID_140705

SEQ ID NO: 20992 - DNA, 3003 bp, Unknown; identical to SEQ ID NO: 20988
  misc_feature (1)..( 3003): 2750-1469P.txt file - cDNA_ID_1830941; gDNA_ID_2926184; Annot_ID_200488

SEQ ID NO: 20993 - DNA, 3000 bp, Unknown; identical to SEQ ID NO: 6204
  misc_feature (1)..( 3000): 2750-1469P.txt file - cDNA_ID_1830949; gDNA_ID_1620864; Annot_ID_51315

SEQ ID NO: 20994 - DNA, 3000 bp, Unknown; identical to SEQ ID NO: 6204
  misc_feature (1)..( 3000): 2750-1469P.txt file - cDNA_ID_1830949; gDNA_ID_1620864; Annot_ID_170433

SEQ ID NO: 20995 - DNA, 3000 bp, Unknown
  misc_feature (1)..( 3000): 2750-1469P.txt file - cDNA_ID_1830953; gDNA_ID_1620864; Annot_ID_51313
aaaagatatttaattgtgtggtggaacagatgatgtacgaagacatgaagagtagagtcgaacatgtggtcgagagcggaaaagttgagactgcgtttatcgcatgcgatcaatttagttgtgtgttcgatctgtggacagataaattcactcgtcatgaccatcctaccattattatggtatgtaactattttgtaatgcatggtaaaagtttcgtcacaaattaatgtttctaaaaactcgtttttatctattaatttgtggtgaaggtgctacaacataacgaaacagagatgatgccaaaccttatatatgtttcaagagaaaagagtaaagtttcaccacatcatttcaaagccggtgctcttaatactttggtatcaactaatccatatctcggttaaactgtcatttctatatttgtaatatttcgttaaccacaacatgtattttctttgtagttacgtgtatctgccgtgatgacaaactcaccaatcattctaacactagattgtgacatgtactcaaacaatcctacaacaccacttcatgctctgtgctatttgtcagaccctaaaatcaattttgatttaggatttgtgcaatttcctcaaaaatttcaaggagtaaacaaaaatgatatttatgcatccgagctcaaacgcccatttgacatcaacacggttgggtttgatggacttatgggaccagttcatatgggaactgggtgtttcttcaatcgacgggcgttttatgggcctccgactactttgattttgcctgagatagaaacatttgggccaaatcggattgccgataagcccattaaagcccaagatattttggcgttggcacacgatgtagcaggatgtaactacgagtgcaacaccaattggggatccaaggtaagattaaaatgaactttagctttcttttatgtatgttgattttttggttatgtttacagattttgtttcttttacatcaactagtcttctcaaaatccatatttataaacatattaacaaaatttttgtgtaattaacataaacacaaaacacacataaaaatgaaaaaaatgaaaaaaaagtatgtttgcattcacatgtaaaacaatcgactctccaatcttgatttctgtgacattgttttgttattacttactagccatttgtcaaactttacagataggtttcagatatgggtcattagtagaagactacttcacaggatttatgctccattgtgaaggatggagatcaattttttgcagcccgacaaaagctgcattttatggagactccccaaaatgcctaacggatgtaataggccaacaaatccgatggtccgttggacttcttgaagtagctttttcaagatacaatccacttacctatggaatcaagccattgagcctattaatgagcttaggttattgccactatgcattttggccattttggtgtattcctctcgttgtctatggaattttaccccaagttgccctcatacatggagttagcgtctttcccaaggcatcggatccatggttttggctttacattatcttgtttctcggtgggtacgcgcaagatctatcagactttttattagaaggaggaacttatcggaaatggtggaacgatcaaagaatgtggatggtgagaggactctcttctttcttctttggttttacagagttcactctcaaaaccctaaacctctccactcaaggatataatgtcacgagtaaatccaacgacgataatgaacaaatgaagcggtatgagcaagagatcttcgattttgggccctcttcgtccatgttcttgcccattactacggtcgccatcatgaatctgctagcttttatgcgtggcctatatggtattttcacttggggagaaggacccgtccttgaactgatgctagcgagtttcgcggtggtgaattgcttaccgatctatgaagccatggtgttgaggatcgatgacggaaaattaccaaaaaggatttgtttcttagctgggctcctcagttttgttcttaccgggtcaggctacttcttcctcaagtaacttcaccattaggccattgtaaaaaaaaaaaaaacacttcaccatgagggttaattttcaacaagaatgatatgaattaatgcatcttgctcaagctgaagcaagagagaataatgtaatgaatccttcttaatatttacttttttatctacaattagcgcgcgcacacactatataacctatttgaatcttggttatgattggtcacttcttggattcatatatttttgctataaaagtatacacaaacgtagtatacattatacattttatccatatatacgaatgtcttaatcatacaatcgtgtggaagtaatggtggttcatattactatatcgctttaagtaaataaatctcgttttcaatgtaattggaacatattgctatgtgttagattacgacattatgaggtaactatttgggtactattttaatattttttcatctcctctctcgccgacgccaagatatgtgaagactgaagacagttgctctcacaacccctatcatcagccacgtgtttttttctcctttttattcaacattttctccttttaatttctcaacaaataccatcttttagaaagaaaaaaacaagtcaatatatatttttattatttatatgtatgtgtttaaattaatttgctttcacacaattttactaatataactgacttttaatacaaaaatggtttaggtatttaaaacaaatttcagtaatagtctagtgaaagaactaaaccgtaagcttaaattaaccattcattttgtgaaactgttgaaaattgaaatcctaaaattgtctgggagaacatatcgactctttttgacaactaaactataaatatcatcaatctagtagaggtaagtttaccagtcttctccaaaacaatttgtaaaaatagagtaactaaaacgatg

SEQ ID NO: 20996 - DNA, 3000 bp, Unknown; identical to SEQ ID NO: 6211
  misc_feature (1)..( 3000): 2750-1469P.txt file - cDNA_ID_1830961; gDNA_ID_1620864; Annot_ID_51306

SEQ ID NO: 20997 - DNA, 3000 bp, Unknown; identical to SEQ ID NO: 6210
  misc_feature (1)..( 3000): 2750-1469P.txt file - cDNA_ID_1830965; gDNA_ID_1620864; Annot_ID_51304

SEQ ID NO: 20998 - DNA, 3000 bp, Unknown; identical to SEQ ID NO: 6207
  misc_feature (1)..( 3000): 2750-1469P.txt file - cDNA_ID_1830969; gDNA_ID_1620864; Annot_ID_51301
  misc_feature (2520)..(2520): n is a, c, g, or t
  misc_feature (2538)..(2557): n is a, c, g, or t

SEQ ID NO: 20999 - DNA, 3003 bp, Unknown
  misc_feature (1)..( 3003): 2750-1469P.txt file - cDNA_ID_1830973; gDNA_ID_1621104; Annot_ID_55953
tccaagcaccctcctttaaaacgccgttacacttaacggagctttatcctcatcttcatggtacgatgtagtttgagaatgagacaaaaagagaagacgttacctaaggtcgaagtaaaagcttttgaagaggcggtgtaatggagagagtgttaacggcgttagtgtaggaaacgacaacgtgggatgctgctgtctgtgtcagggagaagagagagagagagttaatgaagatttttgtctgtattctgaaacaaggtcgaatgttggagactaaggaaacaaaaataaagctttttgatggcttatgagtctttgaaatagctacaccgctcctctcaccttagtctttaacctaataacccccccccccccccccccccccccccaattttctctccctatcctctcatttttgtagtgcgcactgagagagacaaaaaaacaaaaaaagatggagcctttgtttttaaggttttctttatgttgaggacattaggctaagacaaaaagctctgttttctttctttgttggatttttgggtgttgcttgtttgaagaaataaagctttgagtatctccaaggtttccattacagagacaaaaggggtatttgagcttagtttctctgtttatgtgtttgttgtgcttttaaatcggggtttaaggtttatagaagtggtgtttctggtaacagttgagactttttgaggggatattacagagttcaggaaataaaaaatatagaaatttgtgttttgtgtttaatgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggtttcaagttctcacctttttgttgacttctgagctatgaaaaaattgaattttgttgttatgtgttggttttgatgtgattttggtggataaaatccaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatggtaagatctccctagcctctcacttaaacgtttcccatttttgtcaatttgtcttggtttcatgtgttcttgatctcttgttatcatgtttgatgcaactaaaagccattatgatggtattagaatgtcaagttttttaccagtgttacctcttagtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacaggtgcttttacttacattcttgtagtcaaagtattcaaatccttcccctttgaaatcatttgaaagactgaaacttagtggttgatatgtgaagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaaacaaatggcgctcgagttccggtttagtgattagaaaccatcgttgttagtgttttgtttgaaaaactgagaccttttagctttctgttggtgttttacggttggattttgcagtagactgctcttatgaatggaaaattgtttgagacaacgctttactttcactgctggattagtgaaaagtcagaataatcacttttgctaaacatttgactaattatttcaagagttgaccagaccgacaggtccaagtattgccaacgggaagcttctgtgattttgcaggatacgtgacgtcggcaatgacgcgtgcgaagaacaaattaaaaagcatatatccccttaaagcgacttcgcagcaaaacctcttgtctcgtttatctatataaagaaaatttagtagcaaacttctcgattccttgattcgtgggaaaaagaaagtctagatttttgtggattttgattttgtgattccgtgattgtatgaacttgagccgttttgcttcgagattaagaatg

SEQ ID NO: 21000 - DNA, 3000 bp, Unknown; identical to SEQ ID NO: 6201
  misc_feature (1)..( 3000): 2750-1469P.txt file - cDNA_ID_1830973; gDNA_ID_1620864; Annot_ID_51300
  misc_feature (320)..(320): n is a, c, g, or t
  misc_feature (338)..(357): n is a, c, g, or t

SEQ ID NO: 21001 - DNA, 3003 bp, Unknown; identical to SEQ ID NO: 20999
  misc_feature (1)..( 3003): 2750-1469P.txt file - cDNA_ID_1830973; gDNA_ID_2926185; Annot_ID_140726

SEQ ID NO: 21002 - DNA, 3003 bp, Unknown
  misc_feature (1)..( 3003): 2750-1469P.txt file - cDNA_ID_1830995; gDNA_ID_2214489; Annot_ID_133418
cctcactatgcaagtatcctttgttactttagaatttcgtgagatggtatgttgttgtcttgttagtctattccagtgtaaacgtccttaacctcaaaatcaggaaacaaagcagttggagtgatgaaagcaggtcagactttcacaatcgagccaatgatcaacgcaggtgagttcaatgttaaatgtccttaacctgcattcgttaaatgttttaaatttgttactccatacttgagttatctatttacaaccataagggcattgtcatgataggggggtggagggatcgaacatggcctgatggatggactgcagttaccgcagatggaaaacgcagcgctcagtttgagcataccctattggtaacggagactggtgttgaggttttaacagcgaggcttccttcatcgcctgacgtatatccttggcttaccaagtgattaagtgtttggttcctttttggttgtgattcgtaaacttgggaataatagtgtcatctttttgccattatagaccatttgatgttgttaccttgttgtctttgtttatgtaattttattattactatctgaaactgaatcttaaagacagagtcatactgtttcaaacctatttttatcaccatgagaacttttttgctaaaaacgtctgaaactgaaatactgacaacaaacgaaataaaaaaagttttgaggtcgcttggctaggatatatcacaagagacttgctagttgctactgtcatcgaataacgatcgacctaaagatgttgagacgaagaagatattaattccatttttttttaacaatagatgatacatataggcttgcttataacaaagagaaaataaaagttgcacaacaaagtgggaagaagcattaagagagttcctgagatccttcactcaaggaccttcacaccagaaacataaactcggctttgaatgacactgccaccaatccaaaacccaggcataaccataagaccaactcttgggttctcttctttttcatccacaactatgttcttcacaacactttccatgtatgaatcagagaactcactaccctttttcacttggaagatctttgcagctggatcaaaagagtaagcaagcctatgcaagatccatatcgactttatggaatgttaacaatccacagaacaaacatatcaaacaaagcgactgtgacattttctttggaatgcaaagccttaagtggtacctttcctgtataatgtaactgcggcttgctatggctatccacagatgtctttggataaagttttggaagacgaggttgttgaagatacaggggaatcacaagtctttaacttgcttaatccagaatttgtagactttgatacttgtttagatcctatcacaaacgaacttccaacttccggtgactgaaaaaaagatgcaagtacaaaactttatcaaataataacatagctagcaacatgtatactatttgagtttttttagagtttctaagccaatcagaaggctctatttcgtacccactcgcagaaagagcgcgttgagcgagtgagagcgattctgtgggtaaacccctttccaattcatgactttttttatcgacgcacatctctccaaattctctatcgcgtgactcttttagtttttttccacaaaaccaaatgaaaccgaaccgaaatcagttttaatttcaaaaccaatgcaaaccaaaccgaatcagcaaatagtgtgaagcaacaattctggacagaaattttctcaacatcccaacaacgggaaaaagagaaaacaccacaactcaaaatcacaaaaaaaatatccaagaaaatcacaaaagcctttgacccttaaattgcactacaactcaaaaatcacagtaaactttcaaattgcaaaaatctcagaatcaaagccaaagaagattcctgaagatttctacttccatggcatccaatagatgaagaagaacatgaaaaacgaccgaaagagcttagctttactagttttagtaaaatttctcggcaacaaagtgacacataaaaaaagataccaaaaagaattgtagattccataagaacaaggacgatttgcaataattaaggtttatacagattagacttaccagttgaaatctgaaagcatgaatctcgttgtgagctcttcgtgtttgcctcgtccttttattatctttcttattttctcttctttgtgtgatttcaactcaccaacttttatattttactctgctgcttcgagatcaacgcattaaaagtaatggggtacatttagaatatttagattttaaggggttgaagttgtaattttgaagaagtggaagatcaataaaaaataatagaagaacagagacgacgaaacctgccggagaactgaggagagaaaaaaatccgtcgaaaatgggaatttgaattcgtcttctgttgatcatcgcttcacttctgcttccaggtcttcatcggaaccaatctcactttcactctctaatttctaatttgaaaatcgatcttatcaattgtgtgtgtgtgttttgttgcagagcttttactcagaagaagcttgatgatctcaaatctctctttgtttccctcgcttccaagtctcacagcaatgaccaatacgtctcgtaccctgttttccaggttttgacaaaaaaaaaaattgtgttctgttctcatctggtttttgtggttgatagttttgaattaagccttacacgatgtgtgtcggaatagtgtccaaatctcttgtttttctcaaactcgcaaaaactcaccaaaggaaactcaacaatttcactcgggagtgttgttcttcacttgtgttttttttgttggtatcaacgtgactgaaaagcatgggccatagaatgcgatgctatacagtatgtagagggagtaagactggcccgtgaatgcacataatgggccttaaactggcccatcaatgctttactctcctctctagctagcgaggagatg

SEQ ID NO: 21003 - DNA, 3000 bp, Unknown; identical to SEQ ID NO: 11351
  misc_feature (1)..( 3000): 2750-1469P.txt file - cDNA_ID_1831091; gDNA_ID_2214491; Annot_ID_133459

SEQ ID NO: 21004 - DNA, 3000 bp, Unknown; identical to SEQ ID NO: 11351
  misc_feature (1)..( 3000): 2750-1469P.txt file - cDNA_ID_1831091; gDNA_ID_2214491; Annot_ID_183653

SEQ ID NO: 21005 - DNA, 3003 bp, Unknown
  misc_feature (1)..( 3003): 2750-1469P.txt file - cDNA_ID_1831425; gDNA_ID_2214497; Annot_ID_133585
agcagctcaaaatgctcgatccttgctttctaaaatttctggaagctcttcggatgaagttgatgatgataatgattcatccaacagtgaatctgatagaagcatacccactttgcgacagttggacaaaccatctcagatgctggaatctctttcaaatgacaaacagaagaaaagattgattgtaaagatctctgttaagaagccagcagagtctatgggaagcaagggagatgtgataaatcaggctgatttagagcaactatcttccaaacctttggaggagaatcacagagtgattggtatatattccagagaacccgggtcaagttctgtagatgcaaaaggtgattcagggtgtcagagtattccctactctatgaatacgccacagagagaaaaggccgataatcagttgataagatcttcagatcaagaccagaatatgtgcaagtggagggaagagattcctgtttgtgaacctaccgaattaactgcgcctgagaacatagaagaagcccaaccattttatgggtagggaaatcagactataatgggaacgttatgtttgtattatatttccgcaatatctaattcatcgtattctcttgcagggatgaagctgatgagattcttccaaagaaagttcgacgactgaggttaaagcttcggcatcccaacagtcctcgaaaactagaacctgatgaggtggcagatgatttggcagatggtggagatgggtttgcatccatagctccctctttcatgaatccgattatggattctgaacctgtgatagatagcgttagagattcttctgcacataactttgagtttggagaagctacagctgatgtgatacgtaggaaaagatccataagaagtgaatctagtacaagaaatagcgcattacgcataaggttgggctctggatctgtagacaaaataaagaaacaagggattccttccacaagcgtgtatgatgatgcatcacttgaagaatggccttctacctcaaaagctgggtccaggtctagatctgcaagcgtcagcaaaccaagtcttcatactgggataaggttgaatagtgtctcaggaaaaatctcatggttattgttgtctgaacacgaggaaggctgccgttatatacctcagctaggggatgaagttatttacttcaagcaggtacgtcctcttggctgctaattcgttgttcacttccttgtattaatttgccagctgtgatattaataaactttccttgactgtcgttttcagggtcatcaagagttccttaaaactaaagaattaaatgacagggaccgatcaaggtaccttccccgaaacctaggagcagtagagatttgcaaagtcgagaaacttaactatgatacatatcctggttctggagatagctgctgcaaaatgaccctcagggttctggattcttcttcatcacatgcctcccgcaaagagtttcaactgacacttcctgagctcattaatttccctgattttattgtggagaagactcgatacgacgctgcaattcaaacaaactggaaaattggtaatgagtgccgtgtgtggtggagagacgcaaccggtgaaggcggggcttggtgggaaggtaggattgagtcttcacaagtaaaatccactgacttcccagagagtccatgggaaagatacagagttgtctatgaaacaggggaaacgagtcttcacagcccgtgggagtttgacaatcccgagtttccctgggaaaaatctaccatcgaagatgagagaagagagaaactgctttcattatttgctggactagtaaaatcaatcagcaagcatcaggtttgtcttctctcccgaaactatcatttctcatcttgctgttatccttgcttgcctcgtaactgttatttgcttttgttatatattttcttcaggatagttacgggatccaaaagctaaacgaagcagctcaaaagatggatttctgcaataggtacgatacttcacaacacttagctctctgcaattgattctttcaaaacctccctagtcctataaactcgaacatgaaaacccatgtggtatacttgagaagcagaaacgatagttgagtcggtgcttatttaaataactcatatgatcaaacttgtggattttcttatctggcagtaatgattcatgcattgtgtaactctggtttaaaatcgcaggttcccggttccattataccctgagctgattcacgaaagactagagaatcagtactacagaagtattgaatcgtttaaacacgacgtggatgcaatgctctcaaatgcggagttgtatttcgttagaagtgcacatatgctttcgaagataaagcgactgcgagataaattgacaaaaacgttaagaaagctgatctgaggataaggcaacaccggtatgcttcttttggtcctttcttgatcttgtaaacacgttaggctgcggcagttttttcattatatagcgaagagagtgttaaaaagaaaatttaaaagttttcactctaaacaaaagaagtcggttttgtttgtagtaacccgacacaggtttcatgtatagttttagtaccacatgtctgtaaccgaaatttactctgttgtcacaaaaatgacatcataagtctaattttattacaagaagattattatcatttcatttgcaaactaaattgtttttcgttttaactactaatattaacattttattttcgttttaactactaatattaacattttattttcgtttaaaaggtttgtgaaatcgaaaacaaacattacttgagatgaaatgtaataaaattaaattaaatgaaaaccgaccagagaaaagaataaaataaaaacagagtaggttgaatagaaaacacggctgagagaaagtaaagagaaaaaccctaatcttcatcttcatcttctcccgccgtcggccgtaagaggtttcgaagaagcaaagtgagcaacaatg

SEQ ID NO: 21006 - DNA, 3003 bp, Unknown; identical to SEQ ID NO: 21005
  misc_feature (1)..( 3003): 2750-1469P.txt file - cDNA_ID_1831425; gDNA_ID_2214497; Annot_ID_183854

SEQ ID NO: 21007 - DNA, 3003 bp, Unknown
  misc_feature (1)..( 3003): 2750-1469P.txt file - cDNA_ID_1831917; gDNA_ID_2214490; Annot_ID_133442
ttagattattaagcttatattgaagggttttatatttctttcttgcgtacatttctctttcgttttctctaatgatttaagttagattagagaggtcaataacgtatgcagttaaccttttccatttcccgttattgtggaaacctcagtttgactacatactccgaccactttttagtgatatttaacacaaaaagaacttttgaaaaactaatttatcggtgtgactttttttgttcgcttgtgcatttttttccaacactggtccataagtttaccatgtaacatatattagtatttagagttagtatatttctacaaatatgtgcacagctagctagcattacttggacccttaaaggtgacatgtattggatataggaaatcaggacccctttagcaaaaaaaaaaaaaagaaaaaaaaaagaaaatcaggaccatcttaaaactatttgttcctctctatataatggtttataatcataattaagatttaaagtacaaattatagttattaaaaaggttagttctcacagataataacagaaaatattttaagttaccaattttagcacataatatctaaagtttttaaaatactatgaatttaatatcaaaaatcttatataagtatttgatggacgctttacgcgataataatagaatcatgatttcaaattgtgattaattttttacgtaattcggtgaagataagtaattcttgtataaatttcactaatgttaattttaaaagtttatggaagatatgatataattgttcataaaacttgttataatgctattataagatatttttcttaaaaagacaagtaaattactttgttcgtcgaacacaaactaacttacgcttgatcaagctgtattctacaaaagttatacattattaatttatcattacaaaaattggaaaaaggttactttaacaattcaaaaatatatcgaaatccaaaaagatttatcaactccttttaaatttcacgttttacgtgaatcatgtgatataatcatatgcatacaaatgtcatctgagagatttcagccgacttttgaacaaggaccaaaacagcctacgccatgcggagaccacgaaaatagatattttattataaataaatggatttttttggacgtaatgaaacgagaagtggatcagaagattaattacataatcttttctatttataaatttaaactatttctttctaattcattaacaattttgatacatcaggacaatggtaacttatgttactataagacaatggtaatatctcaatagaagtttttttttgtaaaatcgcaatatatacatgaattaataatgacatatgatggtcatttggacataatataaaaatataaatatttggcaaaataaataagtaaatgaaggggagaggaatgtgtgagtgtgtgtgggtgtggatgcctttatgcctcctacatctcaacattgagcaaaattgcggctgcccaacaaccacccaaaagagaattagtcaaaattattaaaatcaatgcatgtcctaatctctctcacccaactctcaccttcatttcaactcccatgcatctttttggtcaattaatttattaatattataaatatattttttcaatgaattttgaaaagactgtgttgcatattaaaataatgcgttgtactattaagagtcaaattagaaaatgtacttttaactccaaattaatttacaacatcttagattatgttattttttttttttcaagtcttcacgtacgtggtgtggtttggagtaacgcgaagttggtccaaaagcagagagactctttatattaaaactagaaaactattaagaagacgcaatagtattatgcacgttcacatttcttggtattcttttacattttgttgtttctctggtcataaactaaattgactaattagccatcaatcattttttcttcagtgtttttttcaacaatggacttttgttataaaactatctgtttagtggttgttgctcgattttatccaattctgtcacagaactgagaaataacattaaagtaaataatcttctatactgaaccggtaagatataaaaatttatcaattttatccaattaacatcgaagtcccacgacgtatggtgtgaacagtataagataaaattaaatacttttagaggtagtcgtacgtgagtacgtgtataagacaacacagctgataactccccaatttccgaccaatgcattgtacagtattatgtattcattcgtgtgtgtacttttccccataaaataaacgatttagatttaactatataagaatagaaagactagagaaaaaataagagaagaataagaccaatgcaatgtatcatgagttgtccatttatttccccatccaaaattcacgtatattctttacacacaaaaaaaaataaaaaaaattcagttacattagtttatgtaatttttttaataaatactgtatattattaagaaaaagcttttaaaacgagagagctaaatcattgtaaaacgttttagttttggataccaatgtgttagtaaaaagcccaccaagcccaatagattttatttttgccaaaaaaaaaatcaaagaagaacgaagccttccttctccgccgtaacctccgccagtgaaaccctaaactcctctttccgatatttcactgttcatcaatcgctctgcgtcactcttcctagcaagctcctttaattttcctctcaatccaatcgtgattttgcatacccatcaggtttcaggttagtacgtagtcttaggagaaattaggtaatcagatcgatatcgctatttgttcatacctagattagtcagaatctgtaatcgaaattcgattaggatggtgtagttcaacgaattcatagatacagaatcacttcttcgtagttatggaaagctctttgtttaaaacctcttccgatttttgtatcagaaaaactgaaataatg

SEQ ID NO: 21008 - DNA, 3003 bp, Unknown; identical to SEQ ID NO: 21007
  misc_feature (1)..( 3003): 2750-1469P.txt file - cDNA_ID_1831917; gDNA_ID_2214490; Annot_ID_183630

SEQ ID NO: 21009 - DNA, 3003 bp, Unknown
  misc_feature (1)..( 3003): 2750-1469P.txt file - cDNA_ID_1832112; gDNA_ID_2214511; Annot_ID_133836
cgtagtactgctccatcatttctcttgcactctcgctgtgacccacgtcctcaaaatcatccgttgcatccttacctgaaaagagaataagaatcaaaaaccgatggattgatctccactaagccgggagcatggtgatagttgtgtttatacagacctgttgaagacaagagaacatcgtccccacctggatggtcttcaagaaacttggtcacattgtacacctgcatttttttgcaaatgtgtgaagttaggagaggcaaatgaaacccaattacagaacttctgaactttgaagatttcttgtcaaatcaagaagtttaaaacatgggaagatccacttctgaggcttatgattaaaatgtaagaaacaatggagcaacaaaaagaaaagttcttaggttatcgctttctttggactaaacaagatatggtgcatataactctaaaaatcaaacaataggaatagaaagatgaatacttgaaacaaattactgtaccaacaaccaagtccagagatacatttgggatcttctgaacttgataaaaaggattgttctgtgtacatagcaaacttgttgcacagaggtaaactcccaaaaaaaatgaacttaagtgacaatattaataagaaacataaactactgatggaacaacagaccaaaacatttaatgtttcctactttcttgtgataatctactgatttcacaaaccaatcaatgaagaaaacaaaaatcaagttcactatgaagggaggctcaaggatgtatctacagattccttcacaagttaataatcacaatacaaaaacgatcgatcttcagggcaaacaactaatcgacaagtgtcagtagtccatcccaagaaaggttgatgtcgatcaaacaaactctaaagacaataagaactatttctacatttctccatcttcaatcaaaattagaaaattttcagctgataaatagatcaaaagagctaaatcttcagcataagcttaataactacaccattttctactctctctacccatctaaagatttgatctgataattttagacttagaaatctgagacttcaaaagcttaatctcatgcaaacaccaaaaggggaaactttgaagcacgagatctctaatttcagaggtgagaataaggagaaagaagaatgaaacctttccattgatgacaatccaacagtcatgagcttgattatgctctgaaacttctgaaagagtgaagatctttgcttcgtctcccattgtttgtttgattcttgtctaccagaattaacccaccaaaacctgactctgagacttaaagctcaaaactttatacaagagtgtgagagagagttgttgagttaaagaccatttgacgaatcagttaaattccggtttaatttggttcgttctcaaagtaatcggttggtgagttttggaagctttgaaaaccggtttaatgaaaattgattttgagtttgttctcacatagtctgtacctaattgctgctctactgttttggccttatggtattcatctgtacgattttgaaaacatatgtgccaatgttgaaccgatgggttaagtggtttggtagtagttgttatttccggttgagtggatggggtaggtaggtaggcagtgcaaatgttgcggttgtgcgctctaattctgcctttttcattcaagatcggtaggtgaatgatgtgcaataaattttattatggtacatatgaattcttttctcataagtaatatttatgtagttttatattagtagatacaactacataagaaaaataaattgccgctgcttcataccaactgaccttatttattagggacacaaatctttttctttctaaagcttatataaaatgtacatattattcaaaatcaatagattgaccggtgaatttctgaccttgtaaacgaaaagaggtctgagaagtttcaaatttgaaccatcgacaatgaaaaaaatacattagccatgttctctagagaaaaacaagcaggttaaccaaaagattagaaccatcattttctttatgttttttagtaccaaataatgttattaaaagaaaaagttatacttttaggaccaccaaatctttttcaatactaaaaattgttgctttgaaaatattaaatacaatttacacattaaaaaaaactaatatatatataattttaaaatgaacaataaatataaataactaaaatcgtgtttgtttgttcatacactattttcattgaacttctgatacgataaacagataactaaaaaaaaaattgaatgcatatgtttttgaattacatcttgaaatgatttataagctaaataactagatgactttgttacataatcgagctaatggtcgaccacaccatcatcatagtttacgcttaccatttcgtgtaatgagctgaatcgatttatgataattttgtttataaaatttgattaaccgactgtaagtttattaatttctctatgatgccttgcatatctctataaagctttgtattatgttctgaattgcaacacattttattgatatgatatgatgataatttagcaattagggtatcctaaaagctcctaaaacttaaaattgtatgaccaaccaattttgtaaaagcaataaggagtttttgtaaatcttcaaaatatattggatccataactcaataacacaaaacttgagactaaaatcataataaagctatacattcggggcagtttttaatatcctgacttgttgggtaagtctctaaatattcgtagtttgcatccaagtccctgacttactatcttctcccaaatctccttttatttttactttcgtcctataaactaaaataaataaggaaaacactcttcttcaaatccagtagagagattcaagacgagtctcatcgaaagttcgaatctttcgtcatctgattagctttctcttagggtttatttcgatttcgatttagtgttctccatcaatg

SEQ ID NO: 21010 - DNA, 3003 bp, Unknown; identical to SEQ ID NO: 21009
  misc_feature (1)..( 3003): 2750-1469P.txt file - cDNA_ID_1832112; gDNA_ID_2214511; Annot_ID_184248

SEQ ID NO: 21011 - DNA, 3000 bp, Unknown; identical to SEQ ID NO: 11732
  misc_feature (1)..( 3000): 2750-1469P.txt file - cDNA_ID_1832288; gDNA_ID_2214513; Annot_ID_133904

SEQ ID NO: 21012 - DNA, 3000 bp, Unknown; identical to SEQ ID NO: 11733
  misc_feature (1)..( 3000): 2750-1469P.txt file - cDNA_ID_1832291; gDNA_ID_2214513; Annot_ID_133905

SEQ ID NO: 21013 - DNA, 3000 bp, Unknown; identical to SEQ ID NO: 11733
  misc_feature (1)..( 3000): 2750-1469P.txt file - cDNA_ID_1832291; gDNA_ID_2214513; Annot_ID_184355

SEQ ID NO: 21014 - DNA, 3003 bp, Unknown
  misc_feature (1)..( 3003): 2750-1469P.txt file - cDNA_ID_1832424; gDNA_ID_2214516; Annot_ID_133954
gataaacgttatttatatcaatcccaacagtagttcacttaataagccgtattactatatatacatatataaattaacacatttcaaagttaacaaacctagcgtctttcggcttatagaatcataaatgtttgtatagccaaaaacaacaactatatacagtatcttacataataaagtagtttatcacctatatttttaatagatgatgttttacattttatagagattaataaagatgtatgacatgttaatacatctcacttttttttccatatctctatttaatatagctcatctagtaaaactatacaattaataggaaatttaaaagcacattcaagcaaaaatgtgatttcataacactctttaaaaacacgaaggaaaatatatatattacgcgtgaatatatatatatatatatttgtgtcgatcaaaatgtaaatatattttctttaatcaaatttttgtacttttgaaagaagagaaccatctcatatttggatataattttttaaaaaaattaaggtataatcctgaagagaatagaaagaaaaagagagtgagaaattaaccagcataatgaagaaaggactatttcggattctgcagatgggatcacctaaagtgtcagtgaagagaagagtttggtggtcgtgaccaatctcacaactcttctccatacgacccatttgaattctgtccctacgatcatcgtagcatctgatcaccacctcttcatcaacttcttcttcccattgccccaccattctctatctctatctctctctttctctttctctttctctttatttataggggaaatgaaatgagaagagggataacaattcatacaaggaggagacccatcctatgttataatgtggaaaccttataaatagacacacaatatggaagttattaaagtgtcaggacgactaatatatatggatatgtcattatgtttttgtatattagttgtaaaattcataaaaagtttactataacttcattgattctaggataacaatttatgtgcaatctctcagatttgtagactaaaaataagattttagtaacagaataaatttaattaatattaattccaaatgacatatactactattacttttggcaaactagccttcatactttgactcaatcttttaataagatagtaattgttccaagtttataaatttaccatctaaaagaattttatatttgactaatgttgttagacatgcataattttgttttagtaattaatttcacattttgaaaataaaatttcaaatctttgttagggtgtgataatcacgtgttcgcattaaacttttcctaaccagttcaaagatacatattttccattttgactattttgattaattagtatttctaagttagcttgatataatcatcagaatatataattatgtagattatgaatgtaattttcgtagttaagtatcccccatgttgataatttcttgctattttgattgtatattgaaccacgtacccttgtttgtcaaagttccatattgattgtgtttctatgaattgttagatccgttgattgtggacacggtacgttgtcaagtgtaatttcagagaaatgtgttgaatatattgaatgacaatgcaacttaaactaacttttgtcataccttgtaactataatttgtaagtttcttgctttttaaagagtactttaatatgtgatttaaacaaatagaaataaacttttcatccgaaaaaaaatacaagtagggaaattatgaactaaccatttctgttaccatactaaaataaaagttggcagaccaaaagcaaaattatacaataatatgattgggagatgttttgggagtggagagaagaagtacagaacgaatcatatcttcactaacttaactaaccaaagccaaaacgaatacgtaactcaatatagattagcaattttctttttaatttgagcatttgaaaaatgtttttaaatataagatttattaccatttatgatctatgcaatgtattttcttaacattgttgagttttaggagtgatggtccacaacagactttacatggagcacaagtttagagtggagaacaatattctcggatatgaaatatacacatataggagatttgattaacatatctaattgtctggattttgagtaattgtcacataattttcagtgcgactgcagatttttttttttttatcacaactgcagatttagtcttttaacaggttttctttataaattacaaattaatatagtatgttatttcttaattaattaataaattacaaattaataaatatataaataagttcaattgtagtctagtttgggtcacaggatacttaagctttctcacctgagagtccatgaaaggccttgaaagacattaataaagcccaacgtagcccagatagacccataaataaatctgtcacgtttaccacgctttaacggtcaacagccactagttattaaatttatttattttttaaaaaaactcatcaaaacaaagtccactagttatattcgaggttataaacgtaattcaaggttattgtgctgttgggagctttgaagcggcacgatgataaataagttgacgccatgacacgtaagccgcttagtagcctctttcttcaaaccaaagactattcaccgttggattaagaaagctcactcaatcttaacccttcattttattaaataaatcctacgaccagaaaataaaataaataatttggttctgttatcctttcattgtcttcttcattcctggtaaaggcttttaatttcatggattatcttagcttctactctcatggtggctatcgagaaatcactcacaccaaaatctttgaagttctgagtttcaaagtttttcgaatttgaaactttcccgaagcaattttaaaccttttctcttcctttcgattttttctcttctggaattagaaaacttagttatg

SEQ ID NO: 21015 - DNA, 921 bp, Unknown; identical to SEQ ID NO: 11394
  misc_feature (1)..( 921): 2750-1469P.txt file - cDNA_ID_1833057; gDNA_ID_2214494; Annot_ID_133517

SEQ ID NO: 21016 - DNA, 990 bp, Unknown; identical to SEQ ID NO: 11399
  misc_feature (1)..( 990): 2750-1469P.txt file - cDNA_ID_1833057; gDNA_ID_2214494; Annot_ID_183750

SEQ ID NO: 21017 - DNA, 3000 bp, Unknown; identical to SEQ ID NO: 12032
  misc_feature (1)..( 3000): 2750-1469P.txt file - cDNA_ID_1833226; gDNA_ID_2214528; Annot_ID_134224

SEQ ID NO: 21018 - DNA, 3000 bp, Unknown; identical to SEQ ID NO: 12032
  misc_feature (1)..( 3000): 2750-1469P.txt file - cDNA_ID_1833226; gDNA_ID_2214528; Annot_ID_184840

SEQ ID NO: 21019 - DNA, 1369 bp, Unknown; identical to SEQ ID NO: 12535
  misc_feature (1)..( 1369): 2750-1469P.txt file - cDNA_ID_1833587; gDNA_ID_2214558; Annot_ID_134817

SEQ ID NO: 21020 - DNA, 1369 bp, Unknown; identical to SEQ ID NO: 12535
  misc_feature (1)..( 1369): 2750-1469P.txt file - cDNA_ID_1833587; gDNA_ID_2214558; Annot_ID_185786

SEQ ID NO: 21021 - DNA, 3003 bp, Unknown
  misc_feature (1)..( 3003): 2750-1469P.txt file - cDNA_ID_1833613; gDNA_ID_2214536; Annot_ID_134388
ttatcttacaaagataatagtttataaattttatatcattatttaaagaaaataatatgatgtagaactgtctttttaaatttctattaaaaacttaattttagaagaatttggattttttttacaaaaatttttagaaaaacttctcaactatttggtaattatttttttggacaatttgttctttttccagataaactattagcttggtaccataatgacaaaatagtatttttagttctttacttggtctggtctactagctaagcaaaaaaatatcttactaataatttataataattgacacgtcataatgtactggatcacgtgcatcgcatgtttagacgagagtatcatatggcgctgtctgatgattttggtagcattcatcattgcaactcgtaagaagaaaagctgaaaccagatcttccttcgttaactgttttcagctccagcttctgaaacggactgtccagaaacaaaatatcatcaggttttatctcaaacaacaacagattatatagtttgtatcttggactaacctgctgtttggatcataatagaaaccgctgatggaaccatcgctgcaggagaagcatacgtagtaaaatccagctattgttagtccacaatctgtgccaacgtttacaaagtattgctctttccatctctgcaccaccacaaaaataaacccgagttgcaggaattatggaatacttgagagaaaatgatgattggattcgataggaaaaactgagagttataccataaatatataaggataattgttaagatccaattgcctgccaccatcagattcaacttgtccctgcagtattaagtccagaacgttgcttaggagatgttactgactatacaaacaatgttactcgagtgttacctgaagaggcgaaaaagacgggaactttgaccaatgtctcatatcatcttccctcctgtgacaaacaaactttcaaaaatttattcacgataagaaatcatcagtttcaaatctacaagaatataggaattgggacatacgttgcttcccattttccggtgtaaaaggtataattctttccatcaacgatttccccttcccagaatgttatgacctgacactcacagaatcaagaatcgtgtcccctattagaaattcaaggggaagcaatatgaagaaaaaatgagtaagagtgtaagggcttacaggagtgtctgccatgggaacgtttagagcttccatggtgccacaaagataaccatgttcaaggtcaataccctgtatctggacgttgactctccaagcttcctccttctgttgattagagacattttgcgtaccagaaaatgcctgcagcacagcataaaaacatgtgtgttcctcatctttaggttcattatgaataaacaatctctttgagccaatgaatgttatacaatcccaactagatacaaatgcacttgaattaagcatacatgtcaacatgaaaaagatatgaagccaatcaaagcagacaaggccaacttctaattggtataacaaaaatcagcattactagagaatcgttatgcaaccagaacacttgaacaagttgcagatctaatgggaagaaagtaactagacccatgatgtttgttgcctgcctatgaatgatgctttgtgcctgaacaacgagacacgagatctttaagttcttttatgctaacctaagtagctaaacatcatggaaacttataactttccttctcatcttaccatagcctctctctcacaaatttcacataaagtatactagcaaacccttgtgaagcaaagtttcttctataactaccacagccaatcgacagaatcaacaataaaaaaattagctattcttgtgatttcaagtattcataagtaagaacttgtcaagtttgagagaaaattcacctttacacataaaaacccctaagataatgtctttataggtatactcagattctgcttacacataaggttatgttcataaaaagagtgtgcatacataaccacagatgcacaagcataactaataaagttctttctagtcctaaccaatattcccaagacctctatggtcagacacttgagagaaaaacttgtaaaaatccaagtatcatacgaatcctagaaataaatttctgcaaaataacatgttttgttaattcattaatcgttgtacctggccagcgccgagaagtgaactagggggaagtggtgatcgattcccaggatcagttcctaaatggcaacaaatctcaacaaatgagcgagagagccacaaagagggaacataaacaaacaaacctaaattcaaaacttgaagaagcgatcaaaaacctgaaacttgagcaggcgtgttgctctcaacaactctcaccggcattttcttccgtctcctcctttccgtctgataaaaatccgatctttggtgcgaccaaatcaaatcgtggagcctaatcaaaaaccacatctcatcatacccggttcggttttcttaaccgaatcaaattatacataaaacggattaggcttctccggttttcgactgcgttttgtataaaacctctcaaaaaccttttcttctctccccgtcagaccgatcttctctctcctcgccgccgcctccaaatccggaagaagcttttttccacctctattatcgaacttgctttataaaaatctaacctttggacctgactttccgacttctctctctgtctagctgcttctctcacccaggtttgccttcctctcaagttgaagctgcggctttattagtttagctattgactctaagaatgttacttgaatccattcacatgagcttcttacgtcgttttcattggtttagctattgacgttgacttgggttttgcttgagttcattctctattgtggtctaccatactttttcatgttacttgattgcatatttataaaacggtgctaaaagtattccgttttgtatagcattctagatg

SEQ ID NO: 21022 - DNA, 3003 bp, Unknown
  misc_feature (1)..( 3003): 2750-1469P.txt file - cDNA_ID_1834169; gDNA_ID_2214546; Annot_ID_134577
atacctcttgatagctccatatccatggcttcccacaacaagaatagaagcatgatgcttatctacaacttcacataggatattccttgcatcaccttcgaaaacttcgatcaccgcgccatgaacctacacaacaaacctaggaatgatgattgaaaagaagaagatagttgctaaccaaagatagatagttactataagaaaaaccagtgctacttagcttgaagctcttaaatgtgctagagattcacattcacattaccaaactcatctaatagagtccaatacaacacatgatgacgattataaaatccaagaaacacataaaacgaatttgaatgtttgataatagcaagatcgtaccgatctgctctgacaaattgctttggctttctcgacaaccttagcagcggtatgcttcagatcagcatcaacataaggtacaacctccgcagttcctaaaacacacagattaacaaaacctaaatgatctctccccatcgctgcccaaaacagaacccctagaagagtagattcgagagtgaaagcaaagagcgtaccgggaccagcgagaccaacggcggagacggcgttaggtttggcgtggacgatgaagagcttaaaaggataattgggagcgtaaggagcgaagaaacgatcgagcgtccactccaaggcgtaagtgctctgctcgctgtcgtcaactccgacgaccatcaccgatttcccatctccggtggccatgactctgacgttgttcgccggcgtgaagaaaacgcgctcttgtgtttgtggtagaaagaagcctagaagaatcctccaaagtgtttgcacagaaaaagagagttttggtatcttcttcttctattatttaatttctttaaataaaaagaaaagaggaatgtgatactttgatttgatgacgtggctggtcctcatttctttatgcctttccattagtaaatttcccaatatttaaagttacccacagattttaaataagaagaacccacagattttacacaaaatttattctaatttgaatattacccataaaacaaagtacataaaaggattttgcaggttaacagttattagctttttagtaacaaactgatatgaattggtttgataactttcgattttacttggaaattaactattacaagaaaaatctaatttcaaatagtggaatgatttgagttgggtaaaatccggctcagatgataacaattacaaaataaaaatgagacggccggctgtagaataatatgacgacgtgaagcaaaagcaggagtgcgacagaaacctctctaaccaaattgcttttagttatattcttcttcgtcttgacgctactctttacctttttttatctgatttcagatttctccagaatcttcagattcccatggccactgttcatgttgtcggtctgaaaatcaattctggatctccagggaaggacacatcccgaaaggcacctgatgcaattcatgctgctttatcaccgtcatcatctctatcattactcagaggtacatataccttaaaccccaaaccagtttctccgtagcattttgagacgtcatcattcttatctatcatcaaaccttgctctttgtccatataggagtgttaccaaagtatttcagctcagagttgtcagtggctcagttccggttggtcgaaggatcttaatacatagtggcatttggacatgagaagaacacagattcttgggatggatgggaggtaagagaaccataccctaaccttaataatgtcctacaagtcggatcagcagctttgtttgatttttgggtgttttgcagcttctacaaaggccagttttgatccagtacacggaggagagatgtctcagctcgagtatcataactgtctgaagccgccttctgtgttttgaaacaacaagtcagcattctcttacttcctttatatatattaatcttgttgagattctggattttaggcttgtgtctttggtaacatatgtggtttccggttagttatggaattgtcggtcaatctcgaggcaagaagagagagtatgtatatatgtaaatgttgaaccactaatcacttaatgattatttagttaattacgttggatctcatattgagaatactattttgcatatatatttttctgaaaaaaacaacaaaaagaaaggtcaacattacaagagtaaaattgcatatgaagagagtgataatgaaagttcaagtgtttgtttctgaattcttgacatgtatataatcaccatataactgtttccaaattgtagatggtaatgcaaaaatctgatgaggagggagatggttctgtttccagcaactagatttagttataacataaggggattgattattgttattgttattgatccttcttctcctgttgaattggattgagagttagttggtcaaaaggtgttatgggttttagaaaattaataaaaacaggtgggctttgtctgtacatgtccttaaattatttgttttgggagtagtttaatatcgaatgatacgtttacacgtaaaaagtcttttcttttgagtcgtcgtctcaggaaagatgagattcgtttctaggagaggttgactttttcaatccacacttataactctagaatcttatgtcattgatgacgacctcctctacacttttggatttgtatgtttacaaaggaaggaaggattaccttagaacagtttatgtgatgtttgtgtctttctatttttattcaatgaaatttctttacatgtacatagattagctatattgacatgaatctaactgatttttttgtttgcaaaataacaaattagtgaggggaattttgtttcagtcaataaatccgtgatttctatatgttagatggataacaatgcaataaataaaggggacccaataaaaaaaaaggaaagagagacgtgcctgtgggtagtgggtggtggtgagaagattctggaaaaatg

SEQ ID NO: 21023 - DNA, 3003 bp, Unknown; identical to SEQ ID NO: 21022
  misc_feature (1)..( 3003): 2750-1469P.txt file - cDNA_ID_1834169; gDNA_ID_2214546; Annot_ID_185412

SEQ ID NO: 21024 - DNA, 3000 bp, Unknown; identical to SEQ ID NO: 12429
  misc_feature (1)..( 3000): 2750-1469P.txt file - cDNA_ID_1834360; gDNA_ID_2214550; Annot_ID_134663

SEQ ID NO: 21025 - DNA, 3000 bp, Unknown; identical to SEQ ID NO: 12460
  misc_feature (1)..( 3000): 2750-1469P.txt file - cDNA_ID_1834466; gDNA_ID_2214552; Annot_ID_134706

SEQ ID NO: 21026 - DNA, 3000 bp, Unknown; identical to SEQ ID NO: 12841
  misc_feature (1)..( 3000): 2750-1469P.txt file - cDNA_ID_1835663; gDNA_ID_2214575; Annot_ID_135169

SEQ ID NO: 21027 - DNA, 3000 bp, Unknown; identical to SEQ ID NO: 12841
  misc_feature (1)..( 3000): 2750-1469P.txt file - cDNA_ID_1835663; gDNA_ID_2214575; Annot_ID_186328

SEQ ID NO: 21028 - DNA, 3000 bp, Unknown; identical to SEQ ID NO: 12865
  misc_feature (1)..( 3000): 2750-1469P.txt file - cDNA_ID_1835727; gDNA_ID_2214576; Annot_ID_135184

SEQ ID NO: 21029 - DNA, 3003 bp, Unknown
  misc_feature (1)..( 3003): 2750-1469P.txt file - cDNA_ID_1836205; gDNA_ID_2214705; Annot_ID_136955
tttcgcaggccctaattaagacattcaagaaaacaagaagaagcataagaagaggcctaaatgcccagagaattaaacaaatgggcctttaacaatattttaaacaacactgaacaatagatgagatctcaacttcgaaaagctaaagccttaatataaaaccaaacatcaatctctcgccgttaaggttacatctgtcgccgccgctgagaccgccacttaaggccgtctcctccgctctatccatatccaaaacagctataaagataaacttccagagcttggtgaaggagcagcaaccctagttttcaatccctaaaggtgaagtttttgttcttctttttctttgattctactcttttttcgtcacaatagcgcagtagcgatctgggttggcgtttttattgacggattttggtgggtttgggttcgtgttagattttactttcacagattcaggtatgtatttgatcttatttagctttggtaatactcaaaccaactagtatttgatcttaattaggtgacgttgatattttgtgtgttgtgggtcaatcatccactctaggttgatctgcgtctatgtttagtcctaattttgaagaatcattctaattgctgatgtttatttatgacaattttatgtcttacttcgaatttagctaagataataaatctagacgagtgcctttataaacagtttatgtatgaacaatgcttcgcttgtgggattgttgatttcactacatttgattaagaatgtacatactattacaaatgttatcgattaaaaacgtcattttcagatattagttctccagcgagttgacacaaaacccgattacgtttcatccggcgactcgctttgatattccatggattctcagttgaatccttccaagagacgcaagataaggttcgcgtctctcatcttttccccagttttttttcttattcgaatcacttaaggcttgagaaattagtggttagggtgtgtaaattgcgtttgatatagtgtcaggcacagatgcgttgcgtgctataagatgttcaatagacgagaacacctcgttgagcacatgaagatttcctaccactcacttcaccagcctcgctgtggggtttgcctcaagcactgtaaatccttcgaatccgtgagggaacaccttaacggtatgtttgtatttgtattcgttttccaccacacatcgtatgaatatggtggttgttgatgtttgtttgattccgtctttccaactatttcagttccagaccatctttccaaaggaaactgcaaagccattttcactaaacgaggctgtactctctgtcttcaaatctttgaggaggcctttgctctcgccgagcataaaaacaagtgtcacctctccccacctcgtcctcttgtaagttttgttgggaattatttagataatgtggactatatatgctctgccgcctccaatattcccgagtctattctttctgattattgaaatatcagcagttttccccttaaatgatctgattagtgctttattcatatcagggaacatctacccaaaggaatccttctagttcacttgctggttcacgtctcaaggctatggcacttgactgtgaaatggttggtggtggtgctgatgggactattgatcagtgcgcatcggtttgcctggttgacgatgacgagaatgtgatcttctccactcacgttcaaccactgctccctgtcaccgattacaggttctgcttgtggaccatttgtgcttgttttgttttataattcttccttttaaatctcaccccgcctcatgttcaggcacgagataactggattgactaaggaagatttgaaggatggtatgccacttgagcatgtacgagagagagttttttcgttcttgtgcggtggacagaatgatggggctggaaggcttcttcttgttggtcatgaccttaggcatgatatgagttgcttgaagcttgaataccctagccatttgttgaggtaactaactgacccgtttttgttgactctttgcttgaaatctaatgtaattgctatgcttcacctcagagacacagcaaaatacgtgccgttgatgaagacaaatcttgtaagccaatcgctcaagtacctcacaaagtcatatctcgggtaagttatgcttgggctttgatttgttgacattggattatgaaaacttggaacatgagatagaaactggttttgtttgtatgtgtagatacaagatccagtgcgggaagcacgaggtttacgaggactgtgtatctgcgatgagactgtacaagagaatgcgggatcaagagcatgtttgtagtggaaaggcagaagggaatggtctgaactcgcggaaacagagcgatctagagaagatgaatgcggaagagctgtaccaaaaatcaacgtcagagtaccggtgctggtgccttgaccgactcagcaatccatgaaatgaaatcccaatttctcttttaaaagaaagctccttctcttcctcccttaagtctctttttgttcgatgggaggattaagaagacttgttaagagcttttccggctagtttttggataatcaaatatgatatggcttcattcaacaacaactctccctttgggaactcgtataaaaagttactacttaagcttcaaatctgtgtaactaaaatggataaagtctgatgcatctgaggtcttggaatctgttgctcatagttgtggataccagcaacatcaaacattattacttgtttaccaaacccactctcagcttccatttcatcagtttgaagtcaagtggataaaaagactgtctacataactcaaatactgtagtattatattcacatataaatgagaaattgacatttcctctagaaaaagaaaagcaatcgtgtgagaagaaacaagtaaaaggctgaggaagaagacgactattagtccccgtcgaacttgtttctcccggtcgtccaacaaatg

SEQ ID NO: 21030 - DNA, 185 bp, Unknown; identical to SEQ ID NO: 155
  misc_feature (1)..( 185): 2750-1469P.txt file - cDNA_ID_1836205; gDNA_ID_3404; Annot_ID_146278

SEQ ID NO: 21031 - DNA, 3003 bp, Unknown
  misc_feature (1)..( 3003): 2750-1469P.txt file - cDNA_ID_1836253; gDNA_ID_2214546; Annot_ID_134589
ggggcaatgcaaatttggtataacctgtaaatttcatcatcctcagcctgctggtactactgtcccaccaccaccagcatctgcacctcagttttatccatcggtgcagtcacttatgcctgaccagtatggaggtccatcttctagcttgagagttgcaagaactcttcttcctggttcttatatgcaaggcgcctatggtccaatgctattaacccccggggtcgttcctattccaggctggagtccttactcggtgacctttttttttattgatgtatcatcaatacatttgttattcaccacagtctcttactgtctcacttttgcttttgcttcaggcacctgtgagccctgctctatctcctggtgcgcagcacgctgttggggcaacttctttatatggagttacacagctcacttccaccactccttcgcttcccggggtttatccatctctgtcctctcctacaggtgttatacagaaagaacaggcctttccagagagacctggtgaaccagagtgccaatactatttgaaaacaggagattgtaagtttggaacatcttgtaagtttcatcatcctcgagatcgggttccaccaagagcgaattgcgtcctcagccccattggtcttcctctacgcccggtatgctctgtgttaatatgtcataaaggttgttgatcatagttataacatttctgtctctaaatccgttgtttatcttgggttgaaaacagggtgtgcaacggtgcactttctacgtacaaaacggcttctgtaagtttggatcaacatgtaagtttgatcatccaatgggaacgatcagatacaatccttctgcgtcctctctagctgatgcaccggtggctccttacccagtgagctctctcttgggtgctctggcagctgccccttcttcttcatcgacagagctcatagcaggcggtgcaaaagatgcttacatgaccggtgtgcctacatcaagaagcacatcaaacatctcggcaggtttgattttctcccagagcggtgggtcaattccattctcagagctgcaactctcgagccagagctctcttcctctaacaggtagcagaatcacaagacaagggcgtgaaattcgtcgatccttttgaatagatcacctcagaaaagggtacgcatacgcaggtcctctggatcaccttttagcaattcttaatctatatgactattattatatagaagcatgtgatgtgaatttatatatataatcttcgtaccttgagaagaagaaaaagcctatttgagtagaagacctgagtgagaatcacatatatctgagaggaaatctatatgtgcatataccaaaaaagataacaagaaaaggcttcttctttttttttttggaatttgtgtataatgtttgtatagagacagacaaggtttctttgtcttgtccgtacttctacttcagacccattccggctgagacacaaaaacaaaaaaaaaaaaactgagacaaagaactcaattctcctcttcttttagtctgccaattggtgtacttctcgtgtgttaaggtttgttcttattgtagatgaatgatgtgtgttgttaattttgttatgttactgcttcacacattacatgtgttatggtgatgaaacaacctacatttcaagactagttttgaaggttggcaccattatcttgaatatatttatttccttaaaaaaaatggttttgaaatgaagttgagcggaagcacactaatcctagaatcgatcaatagcatcgggaaagtggtacaaaaaaagagacgagagaaatgatggcctagaaacaagttttaaaacaatatggagaaggaagtaatctttagagaaaaccctacctgagaaaagaaactatcatgctcaatttaatatgcttcgccatcatttgctcttatttgccttccccacttgtctctctctctctacactcttacttttctttttgtcaaaagcccaaggaagaagatgaaatcaactaaacttggacatccggctttggatttggattttgtagagtgggaaattgtagtttgttgtgaaatctaacaacaaaatatttaccaaaatatagatttgcttaagtgagatatgtagtattttaatgaattgcgtattaataggttaggagtagtaaactttttgtttttcttgttaactcgtttgagctacttccggaattgaaaagaaaaagaagagagacatagaggtatgattacaacccccaaaagtaatgcaaccattcacatttcctgcagtatagttttcttttaaaaaaaatataaataacctggtgtaaaataaacaaagagaagacacgataagagacctttttaacttttcaccgaaaagcataagtaataaacagcacacttaattgactttttacgcatatatgcatacatatattgcttttcaattacaaaaatagaaaagtacagaacatttagcaaactacctctgtatatatattgatatcctgtaagaaaaatctaaatattattaatatcacctttgaaacaaaccaaaaaaagaaagaaagaaagaaagacatttgtatcacctgacgtgtgtgtggactgtgggctgagatcatgtactcatacaagcattctcagactacctatagcaagcgagattagtgtcctaattcccggagaataaagttatatatatatattcacctaattttttattagtatatgatatgcacataaagaactgtttatttttatgaagaaagtcataattccactttaatcctgcatgaattcatgtgtgtttttaactctcactccatggcacaatctttcatatttgaaaagcagacagagagagagagcatttgcagccgacagtaaggaacatttttgggagaaacacaaaaacatatttgcagtaacacaaaaagaggtttacaactttatttggggagaagagatagataataataagatccaatg

SEQ ID NO: 21032 - DNA, 3003 bp, Unknown; identical to SEQ ID NO: 21031
  misc_feature (1)..( 3003): 2750-1469P.txt file - cDNA_ID_1836253; gDNA_ID_2214546; Annot_ID_185427

SEQ ID NO: 21033 - DNA, 3003 bp, Unknown; identical to SEQ ID NO: 21031
  misc_feature (1)..( 3003): 2750-1469P.txt file - cDNA_ID_1836253; gDNA_ID_1971751; Annot_ID_175303

SEQ ID NO: 21034 - DNA, 3003 bp, Unknown
  misc_feature (1)..( 3003): 2750-1469P.txt file - cDNA_ID_1836462; gDNA_ID_2214587; Annot_ID_135358
agagtaggaacagatggcttaatacaggaggccgaaacacaagatacttttactccactactaaaacatgatgagtacgaaatagaatcttatcaatccaagatgaagcatgtgtgatacatagaggagatcaaaacatagcaagggttgggactaataactttgagaatatgtacacttcaatgcctgtaagagaggctaactacaatgacgcttttcaaggatacactagcaagataacatcacatattaacaatgatctcacaagactaatgactgagcaggaaatcgaagaatccatatttgcagtggaaccattgaaagcaccaggctcggatggtttcactggcgagttctatcagcatttttggtcgaaaataaaaggctccattattcaagaggtaaacaacgtttttagagaaaacaagctatacgagaatcgtaaccacactaatctctgtctcatccccaaagtggaagccttgtcaccaatgggtgatttcagaccaatagctttgtgtaatgtaagctataagataatctctaagattctgggtaatcaactaaagaaacatcttagaggagtgataatagataatcaagcggcttttgttctggggcgaatgataaccgataacatcattatggctcatgaagtttattatgctctgaaagcaagaaagggtcgagcgtcctcaaacatggcaataaagaccgatattactaaagcctatgatcggttggattgggattttttggaggaaactatgaggcgaatgggatttgatgacaaatggatatcttggatcatgacctgcgtgacattagtgagacactcggttttgattaatggagcctcacaagggcactataaaccggaacgaggtatacgttaaggagacatactctcaccatacctttcattctgtgtgcaaaagtcttatcgcatctgaagaaacaagcagaagctacgaagcaactacaagggataaaaatctgcaacagaagtccttctttatctcaccttttatttgtagatgattcgttattcttcactcttgcaaattatcgatctggcatggcaatacagaatatcctaagtaatatgaggaggtttcaagacaggctgttaatttaagaaaatcagctataacctttggtcgacttgtgaagtcaaatacaaagagacaaatccgtcatttactaggaatcaacaatgaaggaggtggatgtaaatatttggggcttcctgaacagtttgatgaaaagaaatcagaactttttcaatacatcgtggaaaaggtgaaggaaaagactcaggaatggagcaaaatgtttttatcccatggaggaaaggaagttcttctcaacgcagttgctcttgcgattcccgtctactcaatgaatgtttttaagttaacaaaggagatttgtgaaaagataaatggcatataagcgaagttttactggagctcaggcaatgacaaaaaaggtatgcattggttctcctggaatcgtctaagcttgccgaagagagaaggaggtttgggattcaaggatctaaagaattttaacttggccttgttaggaaaacaagcatggaggatcttagaacagcctcattgcctgatgtcaagaatgctaaaaggaagatacttcccagacactaatatcatggatgctaatcaaggtcagaaggattcttttatttggaaatcaattttgcagggcatggacctactaaagaagggatttcgctattgtgttggtaatgggactctagttaatgcgtggttggatccatgctgcccattcacccgccgagaccgccacaaaaaaactagggatgccctagatcagcatatggttagtgagctcttaaactcaacacgcacatattgggatttcatcaaactcgctacttagataatacttgatgatgtggagaatgtcaaaaatattaaagtttgtgcattatacaaagactgacattatacaaagactggcatttagactatgaaatctgcatatgttatacaaacatatgttttgaaggagataatcatgagttggaatcaattatcaacagaagaagtccacacttttgagtttcaattttggatatgagagattcgagcttagaaacaaatatttctaggaagcaaatttttatgaataggaagaaaacacaacaaaccagcggatattctcgtaaagcagcaatgacctcaaggaacaaaatttatctttcataatcatattctttatgtaattcataatgctatgtgtttgtatcatacgttatttcaatattaataagaagctacaattcaaaaaaaaattaaaaccaaaatctacaccaaactttttttttttttttttttttttgtcgtcctacaccaaactttttaaaaccgaaaatacgaacttaaaaaaccaattatagtatactttttttttgttccgttttaatttttgttttatttcgataaatatctctggcgtagattagcgagagaggtttagctgtcgttttacattctctcaaagctctctcttttatagctttccaataacaaatcccaaatctgattctttcagctaaaaatcttacatcaatcaatcgaattgtcaaaaaaagatatcacaacccttcttctgaattctcatttcttaagcttatacacttgaaatctccaaaaaggtaccatttttatgactttgttatctccgttttgtgttcgttgtttgcgattctcaattgggttaaaagggtttagtcgttaaacatttccatcttcgtttttggacttgatgtgaatttaaagttgggaccttttatgttttgatccaaagaaaagaatctgcttaattgttgttttagtgtcagatttgtttcttctttgatgcaggggaaaaagaaaatgagttaggtgaagtttcagaaccatagagacgacgatttgatcgttgcgtaaaccaaatgatataaagcaaaagatg

SEQ ID NO: 21035 - DNA, 1462 bp, Unknown; identical to SEQ ID NO: 13172
  misc_feature (1)..( 1462): 2750-1469P.txt file - cDNA_ID_1837267; gDNA_ID_2214603; Annot_ID_135590

SEQ ID NO: 21036 - DNA, 1462 bp, Unknown; identical to SEQ ID NO: 13172
  misc_feature (1)..( 1462): 2750-1469P.txt file - cDNA_ID_1837267; gDNA_ID_2214603; Annot_ID_187117

SEQ ID NO: 21037 - DNA, 3003 bp, Unknown
  misc_feature (1)..( 3003): 2750-1469P.txt file - cDNA_ID_1837627; gDNA_ID_2214608; Annot_ID_135700
gtcctagatatccgaaatcttgtaatttgatagcatgatcgttttcattcttaatataatcattttgctgaaaacagaaaagaaaaaatccaatatataaacacttccatatagaagtcgcgggatgggagattaatgagaagaaaagacatgcagctattttataaaaatgctcgtcaatgcattatggtgatgaaataacatcattgggttttctataagttaataatcttattctcattaattagtcaaaatatacgattggaggtttatatatagattgactttgacctaaaccatagccgtaaatcggaaaatgacaatggtttatctttgtgcaatactagttcaaaatgcaataatagtaaaaaataggaaacgtagggccttctccattagtgtataaagtactcatttctaactttttaatatatctttgtgccaaaccacattatgacctcaaaactacttcctctcctcctcaatctcatcttcctcttcttctttccccttctaaacgcatccgaacaaaaaccttgctacagtttctcatgtagtcaagagagcgtcgttgctcgtttccctttctccctattctcctatcaacctgagtcatgcggctactcaggattcaacctcatatgcaaagatgatgccaatactaccttaaagcttcctaagtctgaaccctttcttgttaaggagatcgactatgaaacacagcgtattcgcctcaacgaccctgagaattgtttggccagacgacttcttaactttgacccttcaggatctcctttttcttttcttcgctctcgtaactacacgttcttgatctgtcctaaggaagcgaacatcactgcatccttcagagctatcgattgccttggtaataccacttcctccttctttgttgtgcagtttgagaatctcggttcgatgccatcttcttgtcacatctttaagatattacctcttccattttcttggtttgtcgcctacacgacataccctgatggccaaaacagtcgagacatgtggctcaaatgggactcgccggattgtagagattgtgagaggagaactaattcaagatgtggattcaaaaacaatacttcccatcaagtcgaatgcttcagttctgttaaccctggtgcgtacaatctcaattcttctctgttcttttgtacttcacgatattccaacttgaaacgacatcatctacttttgaaaaagttctttcccaaagaatccataaatggttgaaagcttcaaatccaaggagttgttaattaaacaaagaaatgaatctagttggctttaaataatgacattaaaccattgacttgattagtaaatcaatatattttcaaatagcaaacatgagagaatgtcgtaacattagaatatatgaatacttgtacatacaagtttcaccgttgacccgttttgttgttttgaaaacaggacttcacaacacaggcttacaagtactaaagataatgtgcctctccctagtcggaccactcaccgccttgactttttgtgtcggtcttgtcatgtgcagttccgagagagtctcttcacagatacaacaagcagtggttgcacgcctttctggatccgtaacgtcgcagccaagcaacgaagtcgcaaggataggtctcgatgagtctacaattgagtcatacaagaaagttgagctaggggagagtaggagactcccgaccgggtcaaatgatgttgtttgtcccatttgtttgtcggaatatgcaaccaaagaaactgttaggtgtttacctgaatgtgaacattgcttccatactgaatgtattgatgcgtggctcaagttgcatagttcctgcccggtttgtcggagtaatccatctcctttgcgcgattgattgctttgaatagtcttgtagcgtttgtatgtaatttggaatttggatctctccataaatgcattacaaactgtgtcaaaactcaaaactaagcccaaacgccaagtttattagaaaagtaaaaatgcaaatgagaattcgtagattttcctcggcagattctatgaaaccacaaaattgggaaatttcatgggctatgaggaaataagtgattaattctatataatatttatcgataaattaataattaatttataaagagattattttaattttgtaatttttaaaacaattctatatggaaagtagttttttctttgtaattaatatatttctaaaaccaattacaagtagataaataattatttagtttaaaattttttatcgatgtaataaaaataataaaaatgaactcttccaaaaattaatacaaatttatgtaaaaaaaacaatattaaaattctatttcactaagaaaatttatatataatattttaaatatatataataataatttatagatgtcatatatataatattcttcgtccatatttgttagttatttaaaatcgtaatttctaccatcacaatttttactaatcatcatttataatatagtcaaagcccttataccaaattcatataacaaaagtttatattgtttagaggcagaattatcaataattaccaatcggctcctaacttatttaataacggttgaaactgtatctgtgtttgttttgtttcagcaaattcccgcatcctttgcgtttaaaccagtcctcgttaattgaagtttataataataccccgtccgagggtatgataagtaggtgaacttatctctctgactttggtcgctttcactacactacactagactgtccattagcggattaaacgaagacgacgagttaagcttttgctgacttgcaaatttctcattcgtcttctttctccaaatctcgatgccaatttagggattctacttgacgttccgtgcaatttcttcttctgcgctactagaattgatttctctcgaaccctaaatttcctctggacctcaatgcttgtttgtttctaattacttggttcaacgatg

SEQ ID NO: 21038 - DNA, 3003 bp, Unknown
  misc_feature (1)..( 3003): 2750-1469P.txt file - cDNA_ID_1838125; gDNA_ID_2214620; Annot_ID_135856
tttatagatcaattaaaaaattacaagggggagaaaaagaaaatagctcttatagatcgatcaatcggatcactaagaattgtcacaaataatataataaatgaacacaaatcataacatatatggtgttatatacatctacttaaagtagatgaccggactattagatctcaaatcccacattccactttctttaaggtattcatggtatctagagaactccggtttagccgtcgctttcttcttgttatggcggcgataaccatcaaataaactgaagattggatggcttaatttgcttgtcaccactgttttagttggtttttggcgtggaagcttttccaaaatcacaggaaaatctccaccaagccttatcgatggagcatagtatggaacgctcgttgacctccttagctttgctccaagtaggctgaaggtggaatcatcgcttacacgctcatatccgccgcgacgactcctcgtcctcgtgcttaagtttcttagcatttgcatttctggattagttgaaggtttaaattgcttggaagagagaagtgacgaaggtaatggtggtggtgagaaagagataggcgtcaagagaagtgtattgttgtttgtggttattgtaacgagagagtctttgattgtctttatatagtttttttctatagagagtctttatatggttttattgataatataagaattgtaggtttaatgattttgcattatttaagttaggttgccattttggaaaattcaaacttcgtcggtcgtatcctcttttctattagtaataatatattttatcttccgttaataaactaaacatagactaagacttgcattgcatgataaacgttgtgttaacaatagaataaacacatacttattatatatgtgtttataaacacaattaataaacaaaagaaatgacgacaagcacatggttgattggtttatatattagtccatcacgtaaccaaatgattgaaaatatttgtaattcatgaatagctacaactgtaaaaagaaaattctgaattacacaaaaagaatttggttaaatttaaaggatagtatatgcacagagaccaatcttttgcattttcaaatcggtcaaagcatcagttgctttcgaatcgttggaacttggaagctgctaagcgctaactagagaaacttgtctttcgaccgataaaatttaaaggatatgaaattcgtgatacacacaaatttataaatagctgttaacatttactgaccaaaataatataagttatgtgaaaaagtttgaaaaataacacaatatttttttttgttcactaaaatattataaattatgcgaacattgagttttttattttgccatttaaaatgttcacagtggctaacatgattgaaatcttagtagtaagactcaaagttagtcattcaactaccatagtgaatcttttaaccacgaaaccaccataatcagtcttcctgtaaataatcacctaatcggatgttgctacctaataaaaaattattcatttaactataaaatttatctatcacaaaacgaaattatatatccgtttgggtttactagagaggattaatgattatattttatgattaaacaaaattagctatctgtttggatttataaacgagtttatattttacaagtaaatgaggttaaatgtcagttaagatttataaaagaatttagattttataattaaacgagattaaatatcggtttgagtttagaaaaaacggttagatttaaattttataattaaacgagtttaaatatcggtttgaatttaaaaaagagaattagagtttagattttgtaatcaaacgagatcatatatcatgtttgatttatgaaaaacaattagaccattcacattgcataacctctcatgtatgtcttaaagactaaccatagttaaaattaaagacatttccttttggatgtcaaaaatatcttccttaagatattttagacatctaaaaaataaaatgtttttaattttaatcatggttagtctatttttaccatggttggtcttggagacattaataaaagattatgcaatgtagatgcttttagtatttagaatggaagtgaaaaaaagaattcatcgtaaagatgaactcaagaattgttcgataatatatgtgttattttcaaaaatactttaatttataaataatgaatatttgatatcttttaagtaaataaaaaatgtggtaaaatgaaaataactaaacaaaaaaaaacttgaaatatacaagggattgggaaatgtcatgcataagatactttggggtttgatgacatagatgaataaagattttgaagaacacatgccggttaaagcctaaataattcggttaaacactcgcaaattggatttttggttaaaccaattggtagacgtgtcaaacctaaaccttccattgcgctaagacgtttcgaaactcacaaagataaaccctaaaacaataaacttttcctcagacatcagcctcggcgaccacgacaacaacttcattttttctcgtcgagtttttttctgggaattgcaggtaatctctcgttaacgtgcccctctggtttctcaaatttgggaactctgtttttgttctgttctgggaaagtagaacaattcgaattacggttcgaccgaagtcaaaccgggttttgtccggttaaataaattgaaagaaaaaacaaaggaacactgtaataaaaaccctctcctaaaaccctaatttcttcttctctccgtcttccttcttgttgttcccggtgcgatttctttcattttgatttcgatagtttattcttctccttgttttcactgtttgtgtgattgattctctccatgaattgataattcttacactattgtcttttagctcgactcttaaactgatttgttcttgttaccattgatggttttaattgcaggtggatttatcagagtgttgtgctaacaaatg

SEQ ID NO: 21039 - DNA, 3003 bp, Unknown
  misc_feature (1)..( 3003): 2750-1469P.txt file - cDNA_ID_1838273; gDNA_ID_2213646; Annot_ID_132385
tatgcttattgcagaaattgtgtgtcgtttactttttcgtcttatcataatcacttgtatcaagttgtacgttagcccctatggaacgtgaggacgcttacgtattcataatactaaaaagataaacagtgtctagttcttttgtagccatttttttgggtacttaaacactataaattctttaaataatatatcactgttttcttttgataaacgaaataagaaaccaatgttgtacataagttctgtgttatggttgacgtgataggtaaatgttgtcaagctaatcgtaagtaattaaactatatgattaagttattaatgcgtcactgatatggaatatttttgtgatctgttgatggacctgactttaattctcgattcttaggaattaggaaatggccaagttgaccaacaaaaaatgtggcgggtgtagtggaacccactcaaaaaaatcaggcaactttcgtaatttaatgaaacatttgggggcgaaaataaggaaaacgtaaaggatgtgaccgacaaattatttagagccgagacgtaattgaattggacggcactgccacgtgtaagcacgaaactcacttgggtcacagtacatgcggatccagaggatcttttatactaatccaattagactcatccacgtgtcaaattagttaaatttaagttttttttagtccgaaattaaagttagaatattaaattaatttccacacacaatcgtttttcttagttattttacaactagctagtataaacgataaccaaaatggatgacatcaaaataattaattaggccaaaaataataatatcagcagtcaataataaaattgtgtatgcatgtgtcatggtaccattgtttcttaagctcaaaacatttatgatgagcatggaggaatatgtgatttatgttgacttgtcatgcatgtatacaatttatagcttcttcagtcaacaaaaaaaattgaaaatgttaacttctctaaaaggagcttttccacagatttcaatcagttcatgattttctcgatataaagtaggcatgaaattgacgaatgaaaatgtatgaattgaagaaactatataatgaaaaacaagaatcatcaataaaaatcaaatgtttcttacatagtttttttttcttcttcaaggaaatcaactatgttttgtttttttatacaatcagatcattagattaatcgtatgtttttgtaacttaacttatgttgatcagcttcattaaaatgagagtttattcttgtaaacaaaaaagttagttgtgatgactaatatgcgtttccgaaacgaaaccctaaaccctgcaatagaaaagggattgttgaacttaatttgttttgtgcacgagaagatggatgaaacagaattgttaaccaaaaatcttatgaacctaattccaaaaatcttatgaacctcacagactttgagaatcgtttaaatgactaatgtaaagatgtgcaagcaactgatatgaagaattgttaaccatatattgtgatatctcatatttgtatatatatttgatatatacaaatatgtttgttccaaattttgttacaaactacacagccaaatataagaagctatcaaatattatttctttagcaagtttgaattaatcaaacgcaggtcattataaattaaatcataacaggtggtataaaaacaacgtattttgttaaatttaagtgattgtagtcttagaattatatataggtcttttgttagagatgaatagttgatttctgatgtatttcctagtattacatcattaacgcaatgaccatatataatgatatagacaacgatgacagagaggtgactaagttaacatgttatgatcctcgtctgaataaactagaagactagccgcatgaaaattcttagttaacaaaaaatgatgttgtctatatgtatatctactactaatatcatgaacccaaattactcaagaattaaagaaataatattcctaacacaagttggcttttcgtaaactaaacttacggtattgttttatgcatcgatcataatgaatattttaaaacactaaaacatggttaaaaaaaaaagtaatccacatgcgattgttttggattggtccttttaaataaactaaagttttggcagagaggaaccaagtaaaaatgggcattatctaagaatggtcctaattccaagaagatattacactcttttacagattggacccaaacactcatgtgaagatgaaaaaataaactaagaatacaaaaagaagaaaataaaagaaaaaatcagagatcccgtcggagaaagaaaaagagaagatagagagatacaagtaacggcttccactaatctttcgccttctacatttttgctgctccgtccaatttttgtgtctataaaataagacagcttctttctcttgactttccaaattcactcaactttctctcactccttttttctctctctctctctatcctctacagagctcgcagcaactagcgcaggtactctctctttctcactccttaatctagatactaaagctgatcattttcatatctctcagtaatccgtttcgtctgatcgggtaaaacacacttccaattactccggttccgacctcgttgactttttcttcagatagattccaaaaaagttctcatctttacttgttcaatctcatagattccgatttgggtctgattgttacctctccacaactattgggttcctctcaaaacccttcgatttcttgatccatccttccttaattttcgattctcgaaaaccgttttcacaacttttttttataaaaaaaaaaatctgcaaaaagatctctctgataagaatttttaaaaactttccctttatggatgctctgaaacataaaagagcttttaagtttataccttcccttatattctctgttttcaaatctgtcagaatctgatcactcttttctttttatctacttcaggatg

SEQ ID NO: 21040 - DNA, 3003 bp, Unknown; identical to SEQ ID NO: 21039
  misc_feature (1)..( 3003): 2750-1469P.txt file - cDNA_ID_1838273; gDNA_ID_2213646; Annot_ID_181442

SEQ ID NO: 21041 - DNA, 3000 bp, Unknown; identical to SEQ ID NO: 3990
  misc_feature (1)..( 3000): 2750-1469P.txt file - cDNA_ID_1838404; gDNA_ID_1620678; Annot_ID_48291

SEQ ID NO: 21042 - DNA, 3000 bp, Unknown; identical to SEQ ID NO: 3990
  misc_feature (1)..( 3000): 2750-1469P.txt file - cDNA_ID_1838404; gDNA_ID_1620678; Annot_ID_164307

SEQ ID NO: 21043 - DNA, 3000 bp, Unknown; identical to SEQ ID NO: 3990
  misc_feature (1)..( 3000): 2750-1469P.txt file - cDNA_ID_1838404; gDNA_ID_2926213; Annot_ID_142077

SEQ ID NO: 21044 - DNA, 3000 bp, Unknown; identical to SEQ ID NO: 3990
  misc_feature (1)..( 3000): 2750-1469P.txt file - cDNA_ID_1838404; gDNA_ID_2926213; Annot_ID_202759

SEQ ID NO: 21045 - DNA, 3000 bp, Unknown; identical to SEQ ID NO: 3259
  misc_feature (1)..( 3000): 2750-1469P.txt file - cDNA_ID_1838524; gDNA_ID_1620635; Annot_ID_47355

SEQ ID NO: 21046 - DNA, 3000 bp, Unknown; identical to SEQ ID NO: 3259
  misc_feature (1)..( 3000): 2750-1469P.txt file - cDNA_ID_1838524; gDNA_ID_2926178; Annot_ID_140450

SEQ ID NO: 21047 - DNA, 3003 bp, Unknown
  misc_feature (1)..( 3003): 2750-1469P.txt file - cDNA_ID_1838553; gDNA_ID_1620724; Annot_ID_49260
ggacctaactaatatatataagtgacatacacaaatccactaacgatagggtttttttttggtaaaacactaacgataggttatcgatagaaaatccataaaagttaatatggtaccagtgatatagaagtgacatgatctagatccgctcatttttaattgattttgagttgaaagtttatgaacctcaaaaccaaacaagtttcattctaggttaacttattagaattagtttttttttgttcgttccatgtaagtgaactaagaacaattagtttctctaatcttagataattatagctaatttttagaaacaaacttgatttcttgattgatacgaaacatagaaaatatcttctttcataattgatagtctaaagtaagatcattggttgtaaatcataatatatttgtttcctagtttgttataccgtataacttcattttatcattcaaaactatgcagattggattcagatatgggtctttagtagaagactactacacagggtataggctccattgtgaaggatggagatcagttttttgcagacccaaaagagcagcattttgcggagattccccaaaaagtctaattgatgtagtgagccaacaaaagagatgggccattgggcttcttgaagttgccatctcaaggtatagccccattacctatggtgtcaaatcaatgggtctagtaacgggagtaggctattgtcaatacgcatgttgggccttttggtcacttcctcttatcgtctatggattcttgccccaacttgctctcctttatcaatctagcgtctttcccaagtcatcagatccatggttttggctttacatcgttttgttcctcggtgcatatgggcaagatctactcgactttgtattagaaggaggaacttatggcggatggtggaacgatcaaagaatgtggtcgataagaggattctcttcacacctatttggcttcatagagttcactcttaaaaccctaaacctctccacgcatggattcaacgtcacaagcaaagccaacgatgacgaagaacaaagcaagaggtatgagaaagagatttttgagttcggcccctcttcgtccatgttcttgcccttgactacggttgccatcgttaacctccttgcttttgtctgggggctttatggtcttttcgcttggggagaaggactcgtccttgagctgatgctggcgagtttcgcggtggtgaactgcttgccgatctatgaggctatggtgttgaggatagacgatggaaaattaccaaaaagggtttgtttcgtagctggaatcctcacatttgtgctgattgtgtcaggttacgtcttcctcaagtaactggacccattatggttggttctgtcgtttcagttaaactaatattacatctgtattgtggtaattaggagagaataatgtgatgaatccatttctcacctcattttagaacatacatttcggtatattgcgtctgtattgtagtaattaggagagaataatgtgttgaatccatttctcacctcattttagaacatacatttcggtttattgtataagcttaaattagtaattgaaaacgacatacactatctattgatattttcactgattaatacgactgtattttttatatttcttaatggatgttttgagcacaatttagtaaatatgggccgtagagatatgctacttcgtcaaaatgttaaaacgtctttgagatattttgagatataatagacgataagacaacatttatcttgcttacttcgatctattgtatttatttgtatttataattgaagtttcaccgtacaaatactttatatttatcttaggtttataacaaattaattattccctaaagttttaaaataaaatatttccctagcgagctagtgggatattaattatcatactcaaagtagtcgattatagaaactaaatgattaaaattttacgtagtctggctctgtttttatctcaaatttctttgcaaataaaaacacaataaatcatatttacttgggagaaacttctatcacatattaatatttatcaagaaaacttcaatcatatttttcgtaaagtgttacttacctttatacaaatattccgtgtattcctcggtttacgattctttatgtctgattgtgtggaaaagtacaatcgatatttttgcaagaagttaagaagttggcacttggcagatgcgtgacgtgaatgaatcgtcaaggcagtgactctccaagccccagtcttcatccatttgacattttcgcatctttttcaagctagagaattttaacttaagttctccattgaaaatttcaaactatataaataaaactccacatatctcactaaaatctaacacgtgacaaaaatttaattacttaagtgtagtatatgttagtaattttctcaactcgcgagcaaacttcagttaacttgattttgataaaataaataacacatcaattatctgaattctttttaaaagaaacaaatatttcatagaattagtttttttttcattttagaattctaattgaatattacagaataaaaacttttacttactaccacacaataatagactttaaagttagttattgtaagtagaatgtattattttgaagttaaaatcgtgtatttatcgtgatgtaaaaatttaccgttctttcttataaactagtcaggctattctggtgttgaactacttcacttcacacgtgtcttttggagaagtagtttcattaataaacacttatctttaattttggcttcaacttttcaaaggcacataatgatcacactgtactgtatcatcttatctcataaatgagaaactcgaccataagaactgtctatagtgtgtatattcagaaaagttatcaatagttcaatactaagaaaccggcctatatatatatatttgtggtcactaatttctccaaaaaccagttgccttccgtaaaaagatg

SEQ ID NO: 21048 - DNA, 3003 bp, Unknown; identical to SEQ ID NO: 21047
  misc_feature (1)..( 3003): 2750-1469P.txt file - cDNA_ID_1838553; gDNA_ID_2926184; Annot_ID_140711

SEQ ID NO: 21049 - DNA, 3000 bp, Unknown; identical to SEQ ID NO: 6205
  misc_feature (1)..( 3000): 2750-1469P.txt file - cDNA_ID_1838557; gDNA_ID_1620864; Annot_ID_51314

SEQ ID NO: 21050 - DNA, 3000 bp, Unknown; identical to SEQ ID NO: 4463
  misc_feature (1)..( 3000): 2750-1469P.txt file - cDNA_ID_1838565; gDNA_ID_1620707; Annot_ID_48918

SEQ ID NO: 21051 - DNA, 3000 bp, Unknown; identical to SEQ ID NO: 4463
  misc_feature (1)..( 3000): 2750-1469P.txt file - cDNA_ID_1838565; gDNA_ID_2926173; Annot_ID_140201

SEQ ID NO: 21052 - DNA, 3003 bp, Unknown
  misc_feature (1)..( 3003): 2750-1469P.txt file - cDNA_ID_1838672; gDNA_ID_2926147; Annot_ID_139153
tgtgtaatgtacagtacaaaattgtggctaagatcctaactagacgtttgcaaccttggttgtcagagttgatctctttgcaccaatctgcttttgtaccaggccgagcaatagccgataatgtgttgattacacatgagattcttcactttcttcgtgtttcgggtgctaaaaagtattgttctatggccataaagaccgacatgagtaaggcgtatgatcgcattaaatggaattttctccaagaggtccttatgaggctgggttttcatgataaatggataaggtgggtgatgcaatgtgtttgcactgtctcatattcattcctcattaatggatcgcctcagggaagtgtagtgccatctcgaggactgcggcaaggtgatcccctctccccgtatttgttcattctatgtacggaagttctttcgggattatgtcggaaagctcaagaaaaaggagtaatggtgggcattcgcgttgctcgaggaagtcctcaagttaatcaccttctatttgcggatgatacaatgtttttttgtaaaacaaatcccacgtgctgtggtgctcttagcaacatcctaaagaagtatgaattagcttcgggtcagagcataaacctagcaaagtcagctataaccttctcttctaaaacccctcaagatatcaaacgcagagtgaagctttcgctgcgtatagacaatgaagggggaatagggaaatacctcgggttaccagaacactttgggaggcggaagcgagatatcttctcgtcaattgtggatagaattaggcaacgctctcatagttggagtatacgctttctgtcaagtgctggaaaacaaatcctgctcaaggctgttctctcgtcaatgccatcttatgctatgatgtgctttaagctgcctgcctctttgtgtaaacagatccaatcagttctcacccgtttctggtgggattcgaaaccagataaaaggaagatggcgtgggtctcttgggacaaacttactttgcctataaatgaaggaggactaggtttcagagaaattgaggagttcaacgatgctctctaggcgaaacttagttggcggatacttaaagaaccacattcccttctctctcgtgtcttgttggggaagtattgtaatacatcctctttcatggactgctctgcttctccttcctttgcctctcatgggtggagaggaatccttgcagggagggacttactacgaaaaggccttgggtggtctatcggacagggtgatagcatcaatgtttggactgaagcgtggctatcaccgtcctctccgcaaactcccataggacctcccacagagacgaataaagacctttctgtccatgatcttatctgtcatgatgtgaagagttggaatgttgaagctattaggaaacacctacctcagtatgaggatcagattcgaaaaattaccatcaatgccttgcccttgcaggatagtttggtttggttacctgtgaaatcaggggagtataccaccaagacgggttatgctcttgcaaagttaaactcattcccagcgtctcagttggatttcaactggcaaaagaatatctggaaaatccatacttcccctaaagtgaagcacttcctctggaaagcaatgaaaggagccctacccgtgggagaagcgctttcacggagaaacattgaggcagaggtgacctgcaaaagatgtggtcagactgaatcttcgctacatctgatgctcctctgtccatacgctaagaaggtctgggaacttgctcctgttttgttcaatccttctgaggctacccactcttctgtagcactcctcttggtggatgctaagcgaatggttgctctcccaccaacaggattgggttctgctcccctgtatccgtggttgctttggcatctatggaaagcacgtaaccggttgatctttgataatcatagctgttcggaagaaggtcttgttctaaaggccattttggatgctcgtgcttggatggaagcccagttgctgatacatcacccttccccgatttcagattacccttctcccactccaaatctgaaagttacaagttgttttgttgatgcagcttggactacttcaggttattgtggtatgggttggtttttgcaggatccatacaaagtgaagattaaggagaaccaatcttcgagtagctttgtcggctctgcgcttatggctgagactctcgctgtgcatttggctttggtggatgcgttatctaccggtgtgcgacagctgaacgtcttctcggactgtaaagagttaatctctcttctcaactcaggaaaaagtatcgttgaactgcgaggactgcttcatgacattagagaattgagtgtttcctttactcacctttgttttttctttatccctcgtttaagtaatgttgtggctgattctttagctaaatcagccttgtctgttattctctcttcctccgttagtggtgggtaaaactcgtttgcattttttataatgaagtttgataaaaaaaaaaaaaaacatattccaaaaaaatttaaaaaatctatacccaaaccgatccgaattcgattagatctaaatcaaaaccgaaccgatattttagatttactttttgatcctaaacttttctacccaaaagattcgtaccggatcgggtttaatcctaactcttccaacttacccgaatacccactcctaaattctgattctgttttttttttttttttaacacggcaaatcaaaattctgattctgttattgtagtaaaatcagattcatctctttggaaaaaaacgataagggatctctctctaattggcgctcctttactaattgccctttaattccatccatcttcggattcttttcaaatcaacaaaaaaagtacaaatcggatccctacaatatcctctccactcttcacaaatccttctccgagatctacaaacgctgtttcattcttccgattacaatg

SEQ ID NO: 21053 - DNA, 3003 bp, Unknown; identical to SEQ ID NO: 21052
  misc_feature (1)..( 3003): 2750-1469P.txt file - cDNA_ID_1838672; gDNA_ID_1620633; Annot_ID_47295

SEQ ID NO: 21054 - DNA, 3003 bp, Unknown
  misc_feature (1)..( 3003): 2750-1469P.txt file - cDNA_ID_1838680; gDNA_ID_1620742; Annot_ID_49640
gcttttaaaagcaaaagcaatgttgttgaatacgaataaaatgatgtttgttgtctttgagaaactttaaatttgtctgtgttttgtgccaaaacttctgattaattggtttttggtctttgtgcgttactattatcaattttattcttattatttgccatagcttatgattaaattgatcatagaagaaacatagaggctttaggttcttgtgctgaaccaagtttggcgtattcagtattttacattcttgtataaaattgaatgcatatgtcataattctggtaatacttgttaaattttgttgttcctgattaacattaccatacctattttgcaatgttttcatgacaaatattgccatactaaaattgctggaggaaacctcacctttcaatcgatttgactaaagtattgattgtaccaaactattcatgcctcaccttaaatttggaaacttaattgtgaaacatgtcaaatatggaatatatattgaataagattacaacaactcagtaaaacaacaaggtccttaatttgaaacagttaagcagccatgaaattatcgcaaatagctctgatttgcatagttatagcttccctcttcgctatgcatgagtgtacgtacagagcttttctaatatagtatacacacacgtatatgtcaaatgtctttttttaatcatcaaagttttgtgtgtctcaaatcaactttgtaggtgagagattggaggctacagaggaagagaaatcgagcaagatctatgtcccaccatgttacgaaaccatttgctcgttctcacttaaaaaggattgttggtgctgcttcgaacctttagttcacaaaaatctttgttggggagtacatgattttccgaacgccaaagagctttgcttcaacgaatattcaaagaagatttaaatcctttttattagagaataataatgtattctctgtttcgtgtagaaagttttttttcctcttgagtgcacaacaagttatgtgtttgaatctgcaaaaatttactggtcacatgttcatgctcttatcaacgagaaacacgacgtctaattccacttgcctccctcattcactctcttctatataaacaaattccactttcttccctctcactcactctgtcatctataaacaaattccacttccctccctctcactcactcactctgttataaatgaaacctaaaaaaaaacttgagagatcagatcaacaaaaccaagagaaaacatggctcagaacgatacagtgaagctgataggttgttcggatgaccctttttccattaggccacgagtggctctacacttgaaatctatcaagtacgagtacttagaagaacctgatgatgatcttggggaaaagagccaactccttctcaaatctaaccctatccacaagaaaacccctgtcctcattcatggtgaccttgcaatctgtgagtccctcaacatcgttcaatacctcgacgaggcttggccttctgatccatccatccttccttctaatgcctatgatcgtgcgtctgctcggttctgggctcagtacatcgacgacaaggtaaaacagtttagagactcacttctacatgctctgttttgcttcttgtcaaagtttgatactttagtctctgttattaataaatctgtttagattagtcaaatcaagagttatgtgtctgaaacagtgcttcgaggcggcgaatgcgctgaccggagcaaacaacgacgaagagagaatagcggcgacgggaaagctgacggagtgtttggcgatactagaagagacgtttcagaagagcagcaaagggttagggtttttcggaggagaaaccatcggctaccttgacattgcatgtgcggctcttttgggtccgatctctgtgatcgagatgttttccgccgacaagtttgtccgggaagagacaacacctgggttgatccaatgggccgtgaggtttagggcccatgaagctgttaggccttacatgccaaccgtcgaagaggtcactgaattagtaaagcaaaggattgaggagggttttaagcgaaacttcaaaagcaatgtttcgacttcggaatatgaatagttgatgtttgaatattttaatgctttctgtattactattttgtgccaaaacatatgcacttggatttttctttcttctatttgatatctttgtgtttttattgattttgaagcctcatttctcttagttttctttatttcacattcatgttttagcatatagtttcatattattatttggttaattgtttatatatactgaaaaaaataaaataatcttaattggtttatccaaaaggcgagaaaagccaaaaagggacacgtcatactactcactcgtaacaagacacgagttttttttaataacaaaatgaattgagtgattgatgacgacgacaagcaaaatgcaaaatcgctgtctccttcatgcttcgatcaatcaaaccatcatcaaacccataagaaagagaccaacagtgttcctgtaggaagcggcaaacttgcagctctgttctcttgaaatggagaaaacagtgagatgtgttcggtggggttatgaggttaatacctcttctgatgcttgcatcgacgcaattaactcctattttcaacaggttcttcttcaattatccctcttttagtcactgaaacatcatgaaattgattggaacattggttacaacagggcttaagattttcgatgcaaaattgaggtttttctctatggaatctagatggggtttcattaagaaaagtatcaatttttttattcttcaatcaaatttatggctagggtttgatcattttatgaatttgatacgtttttgagtcactatgtagcttaattacgatcttgtgggtagtttctgctctgtttctggagtattattcttaaagtttccatctttgtaatttcatatcagtgaatattgttgatcatgttctgtggttgatg

SEQ ID NO: 21055 - DNA, 3000 bp, Unknown; identical to SEQ ID NO: 8520
  misc_feature (1)..( 3000): 2750-1469P.txt file - cDNA_ID_1838731; gDNA_ID_1971814; Annot_ID_58192

SEQ ID NO: 21056 - DNA, 3000 bp, Unknown; identical to SEQ ID NO: 8520
  misc_feature (1)..( 3000): 2750-1469P.txt file - cDNA_ID_1838731; gDNA_ID_1971814; Annot_ID_175898

SEQ ID NO: 21057 - DNA, 3000 bp, Unknown; identical to SEQ ID NO: 8520
  misc_feature (1)..( 3000): 2750-1469P.txt file - cDNA_ID_1838731; gDNA_ID_2926180; Annot_ID_140525

SEQ ID NO: 21058 - DNA, 3000 bp, Unknown; identical to SEQ ID NO: 8520
  misc_feature (1)..( 3000): 2750-1469P.txt file - cDNA_ID_1838731; gDNA_ID_2926180; Annot_ID_200189

SEQ ID NO: 21059 - DNA, 3003 bp, Unknown
  misc_feature (1)..( 3003): 2750-1469P.txt file - cDNA_ID_1838761; gDNA_ID_1621194; Annot_ID_57530
aatctatacacgtttggtatcttgatggatggattgtataagaaagggagaacgagtgatgcacagaagatgttcgacgatatgaccggtagaggaatttcgcctaacagagttacctataccattctcatttcaggtttgtgtcagaggggaagtgctgacgatgcacgaaagctattctacgagatgcaaacgagcggtaactatcctgattccgtcgcacacaatgctttgcttgatgggttttgtaaattgggtcggatggttgaagcatttgagctgttgcggctttttgagaaagatggttttgtgcttggtcttcgaggttatagcagtttaatcgatggattgttcagagctaggagatacactcaggcatttgagctgtatgcaaatatgctgaagaagaatattaaacctgacatcattttgtacacgatattgattcaagggttatctaaagccggtaagattgaggatgcattgaagctgttaagcagcatgccaagtaagggcattagcccagatacctactgttacaatgctgttataaaggctctatgtgggaggggacttttggaagagggtcggtccctccaactcgaaatgtcagaaacggaatccttccctgatgcgtgcacacacacaattcttatctgtagtatgtgcaggaatgggctggttagggaagctgaagaaatttttacggagattgagaagagtggttgttctccttcggttgctacgttcaatgctttaattgatggactgtgcaagtccggtgagctcaaggaagccaggttattgttgcataaaatggaggtcgggagacctgcttccttgtttcttaggctttcgcacagtggaaaccggagttttgacaccatggttgaatccggttcgattctcaaggcatacagggatcttgcacattttgctgataccgggagttcgccagacattgtttcttacaatgttcttataaatgggttctgcagagcaggagacattgacggtgctctcaagcttctcaatgtgcttcaactaaagggattatcccctgatagcgtcacttacaacactctcatcaatggacttcatagagtcggcagagaagaagaagcttttaaactcttttacgctaaagatgattttagacacagtcccgcggtttacagatcgctcatgacatggtcatgtcggaaaagaaaagtcttggtggcttttaatctatggatgaaataccttaagaagatatcttgtctggatgatgaaacagctaatgagattgaacaatgtttcaaggaaggggaaaccgagagagctttaagacgacttattgaattagataccagaaaagacgagttaactttagggccttacacgatatggcttatcgggttatgccaatcagggagatttcacgaggccttgatggtgttttcggttttaagggagaagaagatccttgtaacacctccgagctgtgtcaaactgattcatggactctgcaaaagagaacaacttgatgctgcaatagaggtgttcttatacactctagataacaacttcaagctgatgcctagagtttgcaactacctcctaagctccctcctggaatcaacagaaaagatggagattgtttcgcaacttacaaacagaatggaacgtgcagggtacaatgttgactcgatgcttcgattcgagattttgaaatatcatagacatagaaagcaggtgctgatagatctttaggtaatgaaatgattattaaaggtttatctacatccggattcataggcattagttttgtggagaagagaaatatgagttttgattcgaatctctttaccttaacactacattagaatagaaaaatctctggaaccggaagctctttgaggaaaaggaaaaggaaaaatatgaggtttatacgtaaatgctttgtatgctttattgttcatgaagtttttccttatctttattgtacactgatttgttttgtattatgatgttaaatttctttgaaataaagactaaacatgtctaaatctttctggtttccttccaagacctgttccaacatttttgaccctcccataaattatgtacacagcttgtttgtaagataagggagcttcctgaatccttttggttagacaaagagacatgaatcaatcataaatacctcttgattcttcgttgtggacttggcttatcagatattgttcgaatcacaagatttggccaaagtttcctgaagttgacatcaacaaaaagcatctgctgatttcaggctggaaagggccttttaaaaaaaatccccgggccatatgaccatatctgtctgacgtggcatcaccaagggctttcctaattcagtatctcagtgccaaaacgacaaaagatcacagtgaggccgactaatcatgggcctgaccgttgatccacgtgtctttgtattccacgtccaaatctcaacccttcctttacatatgccatgtcatcatctttttcaccatttttttgtgagttttatgtgtgagttttttttttgctgtcattaatttagaaacaataatctcgttgtatcagtatctctatttaatatgcaaaaatcagtcattagttttattttaataccgttgaaaaaatgcaataattcataggtgtgccgcagcagattttaacccatcaattttataggaacagagtgtgtcgtctctctacaacagtcgtaggcacattaatactataattgccttaaaaactccgttgagtagacaaaaagagtgcaattccaaagcatttcttattcttatagattttaaaaataggaaaaaggtgtaaatctgcgaacattttggattcttcacgtttgtttatattttgggttggctctacacctactctcagaagtcataagccaagcaaagggggttttagggtttttgaccgcgagccagatctctttcttttgtttctcccacttccgaatcaatg

SEQ ID NO: 21060 - DNA, 3003 bp, Unknown; identical to SEQ ID NO: 21059
  misc_feature (1)..( 3003): 2750-1469P.txt file - cDNA_ID_1838761; gDNA_ID_1621194; Annot_ID_174665

SEQ ID NO: 21061 - DNA, 3000 bp, Unknown; identical to SEQ ID NO: 4576
  misc_feature (1)..( 3000): 2750-1469P.txt file - cDNA_ID_1838776; gDNA_ID_1620715; Annot_ID_49104

SEQ ID NO: 21062 - DNA, 3000 bp, Unknown; identical to SEQ ID NO: 4576
  misc_feature (1)..( 3000): 2750-1469P.txt file - cDNA_ID_1838776; gDNA_ID_1620715; Annot_ID_165620

SEQ ID NO: 21063 - DNA, 3003 bp, Unknown
  misc_feature (1)..( 3003): 2750-1469P.txt file - cDNA_ID_1838830; gDNA_ID_1621162; Annot_ID_57139
ttctcctggaacacaagctgataatgttgaaagacatgagagagtaagtaggctattgtagttaaaaaaatgtcttagtaggatgctaattgtttgtggctatttcttttgttagtttatctcctaaaattactgttattcaaccactatatcatctacaggaacatgaaaagcctataaggtttgaagaaccaacatcagataacacactcaccaagggggatgtggaaagggtttcagaggacaatccacggtgcagtcagccactgcgatctgtggccacagtgctggattccccagctcagtcaaccggtcctaaaatgttttccacattagaatttagtttccaaaacctcaggacaaggaggttagagaggctgtcgagattgcagtccacaggttatgtatctaaatgtatgaatacgccacagcctaaaaagtaagatttctttccttcttcttttgtgtagtgtgtttctatttgcatttagagaaatgggattctttaaaatgacaactacgtctacaggtgctttgccgctgcaacattagagttatctcaaccggatgatgaagagcgaaaagcaagggctttagctgcagctacttctgagctggaaaggctttttcgaaaagaggatttcaggagaatgcaggttgctatctttttgactaagcgagcaccgaaagattgatagattaaaaaaatttcattctactctatcctggctcggtcgagaaatatatttatctgttttttctgtgtgataggtactcgggcaattcaatcttgggttcatcattgcaaaattggagcgagatctgttcattgtggatcaggtgagtcttcatatatgcatgcttccagagcccttttttcctccttcgatttgtttagttattggttgagttgtggaaaatggaagtttctatcatttcagagttcttccctagtctgatttttgaagaaatggtatagactagtgattgaattttatggccagcatgcagctgatgagaaattcaacttcgaacatttagcaaggtcaactgtcctgaaccagcaacccttactccagtgagtttctttgtgagatcaatctagattcttgatttcattacactgctttcactttttcacatcaaattccccggcggcattcttttatgtcccatgttactttagctatacttgaaccagtagtaatacctcttttccactactctatatgttacccatatttatctatttttttcctaaactcaggcctttgaacttggaactctctccagaagaagaagtaactgtgttaatgcacatggatattatcaggtgaaggatcaccattacttcttttgtaacattttcttattcttgctatcggtttggagattcaataatgtaacaactttccagggaaaatggctttcttctagaggagaatccaagtgctcctcccggaaaacactttagactacgagccattccttatagcaagaatatcacctttggagtcgaaggtagtttttctgtacctctgctgcatcaaatgtcttttgcattacatgttaatatttactttattgttttgggcagatcttaaagacctgatctcaactctaggagataaccatggggaatgttcggttgctagtagctacaaaaccagcaaaacagattcgatttgtccatcacgagtccgtgcaatgctagcatcccgagcatgcagatcatctgtgatgatcggagatccactcagaaaaaacgaaatgcagaaggtaaccaatgcttaccctaagataaacaacaatgtcccttgatagctaacgatggaatccatctctattaaattcaacttgaattgtaaaacacattcttctgcatatgttaacgcttttgtcatttgggttttggtcagatagtagaacacttggcagatctcgaatctccttggaattgcccacacggacgaccaacaatgcgtcatcttgtggacttgacaactttactcacattacctgatgacgacaatgtcaatgatgatgatgatgatgatgcaaccatctcattggcatgaacactcaaaagtcttaacgtatttagatgtgagaatccttaagattaacattgaggaacactcggttataactacaatcgtaaatgtaaattgtcttagtctatatgatctttttggtcacaacaggtaatttcattttcctttgattacttctcgtgaaaaaacaaattaacagttgtggttttccattgatttcaaaaattatctcaaattttggctaaaaaaagaaaaagaaaagagagatgcttcagaatcagaagagaacagtccacttaaaagtcttaaaccctaaaatgaaatccttccatctaaaacgcagtaaacgtcaccgtttgattcttcgtgacccacctaactacgatacactagcttgtagaggataaatgctccgagccctataaacacaaactatgtggagctactaaaggagaagtctttctctctcgatcaagccaagtaaaaaaaaaatcctaatctttgcgtcaccgttcgtgtttcctcttctctctagggttctccttcaacagttttccagtaaacatgaggtaacaaataagaaatcctttttctcttctctctagggatctttacctaaactcttcccttcgataaatcgtgcttctcagattcatttcgtgcttttgttgctttgttcacttcaatttttcatttttactcatgggtttctctgggaatcttggtttcttttttcaatcggttgatttagtgctacgctttcattggattcctgatgactgctgaaaaaaattttagggttttaaattggggttagggtttattgtgttgggtaccggaatttctctgtacattatagccagcaattgtttctgaatatatctgcatcaatctcttcttgtttagacctgaatcttagagcagttggatttagggtttagggtttatg

SEQ ID NO: 21064 - DNA, 3000 bp, Unknown
  misc_feature (1)..( 3000): 2750-1469P.txt file - cDNA_ID_1838830; gDNA_ID_2926183; Annot_ID_140661
tcctggaacacaagctgataatgttgaaagacatgagagagtaagtaggctattgtagttaaaaaaatgtcttagtaggatgctaattgtttgtggctatttcttttgttagtttatctcctaaaattactgttattcaaccactatatcatctacaggaacatgaaaagcctataaggtttgaagaaccaacatcagataacacactcaccaagggggatgtggaaagggtttcagaggacaatccacggtgcagtcagccactgcgatctgtggccacagtgctggattccccagctcagtcaaccggtcctaaaatgttttccacattagaatttagtttccaaaacctcaggacaaggaggttagagaggctgtcgagattgcagtccacaggttatgtatctaaatgtatgaatacgccacagcctaaaaagtaagatttctttccttcttcttttgtgtagtgtgtttctatttgcatttagagaaatgggattctttaaaatgacaactacgtctacaggtgctttgccgctgcaacattagagttatctcaaccggatgatgaagagcgaaaagcaagggctttagctgcagctacttctgagctggaaaggctttttcgaaaagaggatttcaggagaatgcaggttgctatctttttgactaagcgagcaccgaaagattgatagattaaaaaaatttcattctactctatcctggctcggtcgagaaatatatttatctgttttttctgtgtgataggtactcgggcaattcaatcttgggttcatcattgcaaaattggagcgagatctgttcattgtggatcaggtgagtcttcatatatgcatgcttccagagcccttttttcctccttcgatttgtttagttattggttgagttgtggaaaatggaagtttctatcatttcagagttcttccctagtctgatttttgaagaaatggtatagactagtgattgaattttatggccagcatgcagctgatgagaaattcaacttcgaacatttagcaaggtcaactgtcctgaaccagcaacccttactccagtgagtttctttgtgagatcaatctagattcttgatttcattacactgctttcactttttcacatcaaattccccggcggcattcttttatgtcccatgttactttagctatacttgaaccagtagtaatacctcttttccactactctatatgttacccatatttatctatttttttcctaaactcaggcctttgaacttggaactctctccagaagaagaagtaactgtgttaatgcacatggatattatcaggtgaaggatcaccattacttcttttgtaacattttcttattcttgctatcggtttggagattcaataatgtaacaactttccagggaaaatggctttcttctagaggagaatccaagtgctcctcccggaaaacactttagactacgagccattccttatagcaagaatatcacctttggagtcgaaggtagtttttctgtacctctgctgcatcaaatgtcttttgcattacatgttaatatttactttattgttttgggcagatcttaaagacctgatctcaactctaggagataaccatggggaatgttcggttgctagtagctacaaaaccagcaaaacagattcgatttgtccatcacgagtccgtgcaatgctagcatcccgagcatgcagatcatctgtgatgatcggagatccactcagaaaaaacgaaatgcagaaggtaaccaatgcttaccctaagataaacaacaatgtcccttgatagctaacgatggaatccatctctattaaattcaacttgaattgtaaaacacattcttctgcatatgttaacgcttttgtcatttgggttttggtcagatagtagaacacttggcagatctcgaatctccttggaattgcccacacggacgaccaacaatgcgtcatcttgtggacttgacaactttactcacattacctgatgacgacaatgtcaatgatgatgatgatgatgatgcaaccatctcattggcatgaacactcaaaagtcttaacgtatttagatgtgagaatccttaagattaacattgaggaacactcggttataactacaatcgtaaatgtaaattgtcttagtctatatgatctttttggtcacaacaggtaatttcattttcctttgattacttctcgtgaaaaaacaaattaacagttgtggttttccattgatttcaaaaattatctcaaattttggctaaaaaaagaaaaagaaaagagagatgcttcagaatcagaagagaacagtccacttaaaagtcttaaaccctaaaatgaaatccttccatctaaaacgcagtaaacgtcaccgtttgattcttcgtgacccacctaactacgatacactagcttgtagaggataaatgctccgagccctataaacacaaactatgtggagctactaaaggagaagtctttctctctcgatcaagccaagtaaaaaaaaaatcctaatctttgcgtcaccgttcgtgtttcctcttctctctagggttctccttcaacagttttccagtaaacatgaggtaacaaataagaaatcctttttctcttctctctagggatctttacctaaactcttcccttcgataaatcgtgcttctcagattcatttcgtgcttttgttgctttgttcacttcaatttttcatttttactcatgggtttctctgggaatcttggtttcttttttcaatcggttgatttagtgctacgctttcattggattcctgatgactgctgaaaaaaattttagggttttaaattggggttagggtttattgtgttgggtaccggaatttctctgtacattatagccagcaattgtttctgaatatatctgcatcaatctcttcttgtttagacctgaatcttagagcagttggatttagggtttagggtttatg

SEQ ID NO: 21065 - DNA, 3000 bp, Unknown; identical to SEQ ID NO: 21064
  misc_feature (1)..( 3000): 2750-1469P.txt file - cDNA_ID_1838830; gDNA_ID_2926183; Annot_ID_200419

SEQ ID NO: 21066 - DNA, 3000 bp, Unknown; identical to SEQ ID NO: 6252
  misc_feature (1)..( 3000): 2750-1469P.txt file - cDNA_ID_1839026; gDNA_ID_1621086; Annot_ID_55378

SEQ ID NO: 21067 - DNA, 3000 bp, Unknown; identical to SEQ ID NO: 6252
  misc_feature (1)..( 3000): 2750-1469P.txt file - cDNA_ID_1839026; gDNA_ID_1621086; Annot_ID_170525

SEQ ID NO: 21068 - DNA, 3000 bp, Unknown; identical to SEQ ID NO: 6313
  misc_feature (1)..( 3000): 2750-1469P.txt file - cDNA_ID_1839029; gDNA_ID_1621088; Annot_ID_55430

SEQ ID NO: 21069 - DNA, 3003 bp, Unknown
  misc_feature (1)..( 3003): 2750-1469P.txt file - cDNA_ID_1839029; gDNA_ID_2926212; Annot_ID_142053
ttagttactttgtacctgaaggttgatgtagtcatgtaacacaaattttgcatacattaaagtgtaaaactaattcaaagaaattgactaatttcatccacaaatttctttctcgattaggctttttggatattgaaaagataaaaccaaataatcttgaggtgtagaaagattgactcgattttcagatcggtttggttttggtttaggcaaattctttaaccgttcaactggaatccattacatcagatcaccaacagcaacaaaacacaaaatttgaaaagccgtcaagttcttacatgatccatgcctactccgatagaaaaatggaaaagaaaaaaaagatcttccatttgtttagccttagagtacgtacatgcagcaaaagcatagtttctcttctgaaacttcttctctcactcaagcttgaatcttacgacgctgtctcagtcttccaccaatactatttgggtttggttcagcagacatctttcgcttgcttcttgtttctcggttctctttgtttgcagagttagccatcctctcagtttcactgcactgagcctcaagatcgatgatcacaggagttgctggatccacctctttcacatctaatggcttgagatcaccatcagtcactgaagtttggttgttcccagacgacaagaagcataatgactttctagctgaatccggattcttgtttgagccatcatcatcatcgagattttcgtcaatttgattgtcctgaatcccatcagttatgagaaggagatgatctccttctgaagcttgactatctgcaggagcatcagtttcatcatcctcacttgtttctgactgttggttggtttgaatcagataatgtgcaacagacttatacccgagtttatgtatctgagaacaaaagaaattcaaagggaaagccattaacttttgaatctatccaaggactcaaaatcagaattttcaccatggatcatactaatcgaaatagctaccttcctgtaagctgcaccagttgggagccaccctttttttgtacgacagaaactgcagttgcagatatcgcgacagactggacaaatccagtccggattttccagagcttcaagaacatgttctccatatctgttcaatcaccaaaacataacctaaaacattcagttccaatcctcattttgctgagcaaagcaagctactcaattcccagttgattctcacaaaaggaattactcaaaaacacagaaacaaagaaggttggaggctaatgtacctcatgtataaacaatctccacagaattgacctcgaacagaatggttacactggctgcattgggtatgataacctagcgtcttctgcctgtaaaatccacagtaaccattaaacacattagcctcaatcctaaccgaatcaaactacatcttcagagataaagccaagtgtacaaacctgcactggtggcaacactttcctctaacagggtcataaatccgtttcccatttttgtcacaaccatcaacaaaaagctcccaagttcgttctgtgttacctaacagtttctcatgctcctcagtgtaaatctctggccttacgccttctcctacccacaaaacaatctcttctttagacactttacccttcttcagttcaggttcctctgcgtaggaaactggtgtagcgttcttcaatctaaagaccacaacagagaaggcaataaaaatcattactttctattaaaaatcctagcttcctgttaaacccttgattttgaacagaatccaaagaacgaaacgagaaccacagagattgaatacgaagagattacctcgaggatctccgagaaactggcggctcctgcttcaatctgattataaaacagcgaaatgatttctctaaaaaccctagatttctctaaaacccctaattttggaagattgaagcaatgtgaacaaaatcgagagaagtcagtgactgaaaacgaagagattaccttgaggatcgtctagaggagacggaaagctgaataggagatgtttctcgacccggattggcattagagttaccgtaacgccttttggcgggtcggatctcggatttgagtttgagagagagatccatgattccgagattcttcatcctctgaagattctccttgatcctgtcttctctgcatttctcgtagatcgagacgtttgagtttcctcctccgactgttggattagggtttgtgacgggaatcgaacatttcgctctcgttctcaccacaggcattgtgagagattgatgaactgattttggattcaaagttccaatctttccctctttctctctttggatctctggataagaagaagaaatgaaagatttttttttaactttttaagtgagtgaagcggaacagcaacggtctggtttttttactctttttaaaattcaaaacatttttcacctttttaggtaaatgtgcttaatttgccaactaatgaaaacgttgattggtttgtcaaatggaaatcatatttattatctatcatacatctgtaaatttatttttcttaaagggcctttaggctttaataacggcccataaaaaatcccaaattgtactacgaagaagaataagccgccattctttatctttccattccttcctggagattacgcattaatatatttagatcttaggtcttattagcttctttattcgcacttttttttttcctctactcgaagcttaacgatcgtaacaatcatggcgacggcttcaggtaccatgattccttcaatttcttcttctaatactttaacctaattctcgatttctctgttaattcccgttgatgattaagaatctcgcttctgatatcttcttctttctttaaatctatatattagtaaattagggtttttactagttttgctattggctagattcattttggctaaattctggcaaaattgattttatttttaatgtttgaatgttgttctgatatatg

SEQ ID NO: 21070 - DNA, 3000 bp, Unknown; identical to SEQ ID NO: 7420
  misc_feature (1)..( 3000): 2750-1469P.txt file - cDNA_ID_1839033; gDNA_ID_1621144; Annot_ID_56717

SEQ ID NO: 21071 - DNA, 3003 bp, Unknown
  misc_feature (1)..( 3003): 2750-1469P.txt file - cDNA_ID_1839096; gDNA_ID_1621103; Annot_ID_55923
tgaaatctcttttgcaaaggcatagaaccttgttggcctgcctcacctcctcccgaacccgtaattcccattttattccctaaccatcattacaccaaattaaaagtcattaccaccgtcaaaagccgaaaacgttgtttaacaggaagaggcgtgtattaccaatggtggagccaagtgactgtgtagagtcttgaacagattctgtagacttttgcgtcacttcttccgtcgtaccagcgatccaagaagtaacagctcctctcagcttctccgcaatccctccttcgcctttctccgcatatgcttcaccctgtttcgtagctgcttccgagctcggatccttaaaccctcctaaccttttctccacctcctccgattgtgtcactatccctctcttcggtggcgcagtttcgccaccgcctcctccaagatgaagcttctcagtgaccacttccgacaaagccttgtcttcctctcccggactcagtttctccgtaaggaattctttcgccgagacgcccctgtcttgtccttgctctgtcccggtcccggtgaatggtaacttcgtcattacactagctcctgtctctttaaccttctcgtaaactggagtcaccatacttgcgaccgtacttccgtatccaccagcggagctaggattttctgctccttccacacgattctcgtggccgccttccccggagtaacctaacttcgaagcgacggcgtttttcgccgccacagctttgtctgctacgaccgaagtcgctaatgagatcttatcggtgtagctgctctgattaggctggtgcatctcctctcctctcctctgacctctggaatcaaaaccctgagggttttgtataccttgagttctcgtcggcaaatcttttcccagatcaaattcatcactccgctccggagattctttccccaatctagatccatagtctcccgccggtatgtgcttgcccatttcaggtcttgacttagtatcaaaaccatgacttttctcccggagatctcttcccagtcccatgtgatcatcttcacctgtttcgttcctcctcccaaaagctgcgacactcggttgttctccagctcctagaataaagaaaggacacaagtcaaaagatataaattcctgaatcagaattccgagaagaaaaaaaacttacctttaccggtgggatcagtaactttggactgataactcgacattccaccatgagatccctgagcagtcggttttgtatcaaggccatggcttttcttctgcagatcagttcccaaccctaaccttccaatagctgagacagtcgatgctgctccaatttctccagtagctagataaagaaacagacaggtgaaaagagttgaaacttcttagcaaaaaacgtagagctgaaactttaaatcaggattaagagactagagaaaagatcttacattttccgatggggtcagtaactttggactgataatttgacaacccaccatgagatcccggagcagctggatcttggtccaatcctttgggtctgtcgatattaactttactttggtttcgagacttgtgttcatcaggaacaaatgttcttgtcacatcttctgttgcagatagtaaagacacgggagtgttatgcggcgtcagtgtaggagcccctcttctctcttctttctccggtacaccggagtgttttataggacgagacattgcttcgtggccaactcctctcactggctcagagggttttgtatgtgaagaggaaacaactggaaaagctttcgatcctggagggactatctcctccttcaccggaatatgagcttttcctcgtgctgctgggaccaatccaaaacattaaatactctgttttggtcaatagagagatcaaagtgaagcgaaggactgacaaacctggtgcaccgccgtggagttggttgtcgttgtagtcatcttcatcgtcttcttggtctagatcgtgatcgtcagggatgtgttctccacgatcgtgctcatgaccatgtccatgtttagtaagaacattcttgatcttctttgctttttccttcactttcttcagaacttttgatggtcctttttcatgatgcccttcttcctctgcattcaaaacagaggaacacgtaaaaaacattcattaggctctctcacttccagattttagaatatcaatagaaaaaaaactttacattgagattagaatctggtttcgcaatacctggatggtgaatccttattggctcctgtgcttggtgatgaccatgagtacgttgcaactgcgcttgtgaatccattttatttgctagatttgattttgttcttttcctttctatgcatccaaattgtttctgagaaaatatgaggagcttcttcaaagttttatacagagtcagagagtatgggaaagaggaggaagacgcatagccgaactacctctggatggctgtgtcctctgtactttatcttacgaaataccacgtgtcatgccacgtatcaggctcttgattgtgtgcgtggcgctctcagcctaatctttatccgagaagaaccgtcgatgttaccttctttcacaagttagcccactagcccattccaacaacatgccgtttcgatcattggaaaaacagcataacacagtcactgaaatccgaaaacgacaagaaatgatatcatatgaatagtttccattgcgcaatgggttggtccaacagaaatgtacataatgggccttaaaaaagatccagtatgctctatcgcggtttaatggtttggttggtggtagaagaaacagacacgaagcgcggaagcggaactagtagatgcagctactacaatatccacgtggcgaaacattagtcgtttatcgagaactgccccacgaaattacacgtctgaatagataaatcgaaaatggatcgtgaggcccacgtgtctgcgaagaagggcccacagtggattattgaaaagaagaaatg

SEQ ID NO: 21072 - DNA, 3003 bp, Unknown
  misc_feature (1)..( 3003): 2750-1469P.txt file - cDNA_ID_1839096; gDNA_ID_1621103; Annot_ID_171488
agccgaaaacgttgtttaacaggaagaggcgtgtattaccaatggtggagccaagtgactgtgtagagtcttgaacagattctgtagacttttgcgtcacttcttccgtcgtaccagcgatccaagaagtaacagctcctctcagcttctccgcaatccctccttcgcctttctccgcatatgcttcaccctgtttcgtagctgcttccgagctcggatccttaaaccctcctaaccttttctccacctcctccgattgtgtcactatccctctcttcggtggcgcagtttcgccaccgcctcctccaagatgaagcttctcagtgaccacttccgacaaagccttgtcttcctctcccggactcagtttctccgtaaggaattctttcgccgagacgcccctgtcttgtccttgctctgtcccggtcccggtgaatggtaacttcgtcattacactagctcctgtctctttaaccttctcgtaaactggagtcaccatacttgcgaccgtacttccgtatccaccagcggagctaggattttctgctccttccacacgattctcgtggccgccttccccggagtaacctaacttcgaagcgacggcgtttttcgccgccacagctttgtctgctacgaccgaagtcgctaatgagatcttatcggtgtagctgctctgattaggctggtgcatctcctctcctctcctctgacctctggaatcaaaaccctgagggttttgtataccttgagttctcgtcggcaaatcttttcccagatcaaattcatcactccgctccggagattctttccccaatctagatccatagtctcccgccggtatgtgcttgcccatttcaggtcttgacttagtatcaaaaccatgacttttctcccggagatctcttcccagtcccatgtgatcatcttcacctgtttcgttcctcctcccaaaagctgcgacactcggttgttctccagctcctagaataaagaaaggacacaagtcaaaagatataaattcctgaatcagaattccgagaagaaaaaaaacttacctttaccggtgggatcagtaactttggactgataactcgacattccaccatgagatccctgagcagtcggttttgtatcaaggccatggcttttcttctgcagatcagttcccaaccctaaccttccaatagctgagacagtcgatgctgctccaatttctccagtagctagataaagaaacagacaggtgaaaagagttgaaacttcttagcaaaaaacgtagagctgaaactttaaatcaggattaagagactagagaaaagatcttacattttccgatggggtcagtaactttggactgataatttgacaacccaccatgagatcccggagcagctggatcttggtccaatcctttgggtctgtcgatattaactttactttggtttcgagacttgtgttcatcaggaacaaatgttcttgtcacatcttctgttgcagatagtaaagacacgggagtgttatgcggcgtcagtgtaggagcccctcttctctcttctttctccggtacaccggagtgttttataggacgagacattgcttcgtggccaactcctctcactggctcagagggttttgtatgtgaagaggaaacaactggaaaagctttcgatcctggagggactatctcctccttcaccggaatatgagcttttcctcgtgctgctgggaccaatccaaaacattaaatactctgttttggtcaatagagagatcaaagtgaagcgaaggactgacaaacctggtgcaccgccgtggagttggttgtcgttgtagtcatcttcatcgtcttcttggtctagatcgtgatcgtcagggatgtgttctccacgatcgtgctcatgaccatgtccatgtttagtaagaacattcttgatcttctttgctttttccttcactttcttcagaacttttgatggtcctttttcatgatgcccttcttcctctgcattcaaaacagaggaacacgtaaaaaacattcattaggctctctcacttccagattttagaatatcaatagaaaaaaaactttacattgagattagaatctggtttcgcaatacctggatggtgaatccttattggctcctgtgcttggtgatgaccatgagtacgttgcaactgcgcttgtgaatccattttatttgctagatttgattttgttcttttcctttctatgcatccaaattgtttctgagaaaatatgaggagcttcttcaaagttttatacagagtcagagagtatgggaaagaggaggaagacgcatagccgaactacctctggatggctgtgtcctctgtactttatcttacgaaataccacgtgtcatgccacgtatcaggctcttgattgtgtgcgtggcgctctcagcctaatctttatccgagaagaaccgtcgatgttaccttctttcacaagttagcccactagcccattccaacaacatgccgtttcgatcattggaaaaacagcataacacagtcactgaaatccgaaaacgacaagaaatgatatcatatgaatagtttccattgcgcaatgggttggtccaacagaaatgtacataatgggccttaaaaaagatccagtatgctctatcgcggtttaatggtttggttggtggtagaagaaacagacacgaagcgcggaagcggaactagtagatgcagctactacaatatccacgtggcgaaacattagtcgtttatcgagaactgccccacgaaattacacgtctgaatagataaatcgaaaatggatcgtgaggcccacgtgtctgcgaagaagggcccacagtggattattgaaaagaagaaatggaaaatctgaggattgattcgtctcagaggccgaggttgaagattaatcggacaaaggagattagaagagtagaaaaaacgacaagaagaaagaaacacagttgcaggagagaaagagatatg

SEQ ID NO: 21073 - DNA, 3000 bp, Unknown
  misc_feature (1)..( 3000): 2750-1469P.txt file - cDNA_ID_1839096; gDNA_ID_2926187; Annot_ID_200735
cgaaaacgttgtttaacaggaagaggcgtgtattaccaatggtggagccaagtgactgtgtagagtcttgaacagattctgtagacttttgcgtcacttcttccgtcgtaccagcgatccaagaagtaacagctcctctcagcttctccgcaatccctccttcgcctttctccgcatatgcttcaccctgtttcgtagctgcttccgagctcggatccttaaaccctcctaaccttttctccacctcctccgattgtgtcactatccctctcttcggtggcgcagtttcgccaccgcctcctccaagatgaagcttctcagtgaccacttccgacaaagccttgtcttcctctcccggactcagtttctccgtaaggaattctttcgccgagacgcccctgtcttgtccttgctctgtcccggtcccggtgaatggtaacttcgtcattacactagctcctgtctctttaaccttctcgtaaactggagtcaccatacttgcgaccgtacttccgtatccaccagcggagctaggattttctgctccttccacacgattctcgtggccgccttccccggagtaacctaacttcgaagcgacggcgtttttcgccgccacagctttgtctgctacgaccgaagtcgctaatgagatcttatcggtgtagctgctctgattaggctggtgcatctcctctcctctcctctgacctctggaatcaaaaccctgagggttttgtataccttgagttctcgtcggcaaatcttttcccagatcaaattcatcactccgctccggagattctttccccaatctagatccatagtctcccgccggtatgtgcttgcccatttcaggtcttgacttagtatcaaaaccatgacttttctcccggagatctcttcccagtcccatgtgatcatcttcacctgtttcgttcctcctcccaaaagctgcgacactcggttgttctccagctcctagaataaagaaaggacacaagtcaaaagatataaattcctgaatcagaattccgagaagaaaaaaaacttacctttaccggtgggatcagtaactttggactgataactcgacattccaccatgagatccctgagcagtcggttttgtatcaaggccatggcttttcttctgcagatcagttcccaaccctaaccttccaatagctgagacagtcgatgctgctccaatttctccagtagctagataaagaaacagacaggtgaaaagagttgaaacttcttagcaaaaaacgtagagctgaaactttaaatcaggattaagagactagagaaaagatcttacattttccgatggggtcagtaactttggactgataatttgacaacccaccatgagatcccggagcagctggatcttggtccaatcctttgggtctgtcgatattaactttactttggtttcgagacttgtgttcatcaggaacaaatgttcttgtcacatcttctgttgcagatagtaaagacacgggagtgttatgcggcgtcagtgtaggagcccctcttctctcttctttctccggtacaccggagtgttttataggacgagacattgcttcgtggccaactcctctcactggctcagagggttttgtatgtgaagaggaaacaactggaaaagctttcgatcctggagggactatctcctccttcaccggaatatgagcttttcctcgtgctgctgggaccaatccaaaacattaaatactctgttttggtcaatagagagatcaaagtgaagcgaaggactgacaaacctggtgcaccgccgtggagttggttgtcgttgtagtcatcttcatcgtcttcttggtctagatcgtgatcgtcagggatgtgttctccacgatcgtgctcatgaccatgtccatgtttagtaagaacattcttgatcttctttgctttttccttcactttcttcagaacttttgatggtcctttttcatgatgcccttcttcctctgcattcaaaacagaggaacacgtaaaaaacattcattaggctctctcacttccagattttagaatatcaatagaaaaaaaactttacattgagattagaatctggtttcgcaatacctggatggtgaatccttattggctcctgtgcttggtgatgaccatgagtacgttgcaactgcgcttgtgaatccattttatttgctagatttgattttgttcttttcctttctatgcatccaaattgtttctgagaaaatatgaggagcttcttcaaagttttatacagagtcagagagtatgggaaagaggaggaagacgcatagccgaactacctctggatggctgtgtcctctgtactttatcttacgaaataccacgtgtcatgccacgtatcaggctcttgattgtgtgcgtggcgctctcagcctaatctttatccgagaagaaccgtcgatgttaccttctttcacaagttagcccactagcccattccaacaacatgccgtttcgatcattggaaaaacagcataacacagtcactgaaatccgaaaacgacaagaaatgatatcatatgaatagtttccattgcgcaatgggttggtccaacagaaatgtacataatgggccttaaaaaagatccagtatgctctatcgcggtttaatggtttggttggtggtagaagaaacagacacgaagcgcggaagcggaactagtagatgcagctactacaatatccacgtggcgaaacattagtcgtttatcgagaactgccccacgaaattacacgtctgaatagataaatcgaaaatggatcgtgaggcccacgtgtctgcgaagaagggcccacagtggattattgaaaagaagaaatggaaaatctgaggattgattcgtctcagaggccgaggttgaagattaatcggacaaaggagattagaagagtagaaaaaacgacaagaagaaagaaacacagttgcaggagagaaagagatatg

SEQ ID NO: 21074 - DNA, 3000 bp, Unknown; identical to SEQ ID NO: 6213
  misc_feature (1)..( 3000): 2750-1469P.txt file - cDNA_ID_1839100; gDNA_ID_1620864; Annot_ID_51311

SEQ ID NO: 21075 - DNA, 3000 bp, Unknown; identical to SEQ ID NO: 6213
  misc_feature (1)..( 3000): 2750-1469P.txt file - cDNA_ID_1839100; gDNA_ID_1620864; Annot_ID_170424

SEQ ID NO: 21076 - DNA, 3003 bp, Unknown
  misc_feature (1)..( 3003): 2750-1469P.txt file - cDNA_ID_1839107; gDNA_ID_1621109; Annot_ID_56068
gtgtttggtatcttgttctgcatctaaagaaactctctttacagcaatctgtgcattagaagagagctttcctttgtagactgtcccgttagcctctgtaccgaataactcgctctctttgaaccctttggttgctttgtagagagctttgtaagaaaacctctgaggactgtaatcttcctcccattcttctcgtacttcttcatacttgctgttcacatacattgatcttaatgctgctcccattcttagaaatatacctgcaaacatgtcagattttttgcagattctcaaggcagcttttagtcctctattgtcatcgttgtttctgtttggtgatttgtgtgttgtgggaaattagtagcagaccactttcttttcaggagaaggtcaactgttgtaccaggaccgtccattcttgttatttaatggtatttcatctctgataatggtattttattatactagtggcatttaaagtctccaatgaagattttcattatgagttatatgtaatttatattgcaacattgaacaggttcatctctttgatcacctggatgaattaaatactcaaatttttatgaagatgcaatattttcttcttattacagaagtcaactacaagaaggaaggaaacaaaaaccaaaaaatgagtaaaagaacaaaagaagatgtattagaatttcttatgtatgtatacaacagacttcagacaaaatgaatcttggttttggtatgataacataactaatagggggaaaaagaggattgaaatagaaagcctctttcttacatagaggctttgtaaacaatgaaaaacactctctgttctttagtttggttgaagtatctttccatgattttctgcttcaacaactgcagcagaatcaaatgcatcagaatacaattgcaggtgtgtcaaattgttaatagttgaggaataaaagaggaactcactttcatttgtgttggctacaagaggagctttgttgtctgctgaatttgaagcaggtgccatgtttgtggctgcaccaaaactagaagtctgagaagaacctttacgaggactgatagctttagatatcactcgagaaagttctctatcgtcttcgctaggctcaaacttctgcgatatgtattccttcattgatacgcctttgtcccatacctggttacaaacacaagatgattgactgatgtatttacctaaatgcacaaacagatagagaactttgtcgtaccttggtattgaagccagtgggctggttagttccggcagtgttgatttctgcaacatcatttacctcttcttctcgctctgttggttctggaaaagccatatcttgaatcttcttagttatagcttgagttgcgtcagagactttagcataaccaggtgctagcttctctgtcacagtttctgttactgtcttgcttggactaataggttcctgctggctcgtgcactctttccttgtcttctcagacgattctgttactattgttgttgtgtcagaatcagcaggcttctcttgcttgacatcagataaaacattcttctcagagatcacaggatgttctgttttggaaccattacaatctttttgttcttgttcagcgtcctgtttggctgggagaacagacaagacatttgtctcagtgatcacaggattctctcggggatgctgccttgctgtctcctttaactcttcaggtgccttctttgattcatacactgaaaataacacaagaagatcgatcagttttaagcaaattcctaaaagggtggttgttacttatgaagctttgttcaatttcatttacttggggctccaagatattcaggatcttcttcttcttcttctcctccttcttctctgactttacggtcttttgacttgtcacgtggtgacaatgacgcataaccaacttctctaacttcatgatcttcggatctgcaaaacggtgacatggttgcatcaccttcttcatcatgtctcttcttggtgctgagactgtgctgcagttttttcgccttatccttcattttagagaacaaagatttcttatggtgagaatgttctccatcattttcttttcttggtgaaccagaaggtgaccgctttgaagcttcaccagctgaaaaaaagtatgacaaacagatttcaaaccaagagtttgcgtccaaaatcatcaaatcactgagagtaaacaaaatggatattatcatttcttggagagacttacattggtgacgctggctaagtgttgagaagctaggatttccagaatgatcaacatgtgtttttaagctttcgagctcagcgacggggtctagttgacgcgacatttcagaaacacaaagttcttgtagatgttctgtttaggaactctgatcctctgagaacaacataagatagatataagacaagaaaaactgtgcatgtcgtcttgtttctccgaggttcttggacaaaccataagaaaaaaaaatgcttaaaatagtcatggtctcttattggagaagcatgaagggaagacaaagtcttggcctgagaaattgacgtttgaagctgaattataggactcacatttgtagagttttctagagaaaaactggaaccataaataacaaatacactgtttaaagaacttaagcaaaacttgtctctgaactttaatgaccaaaatattaagactatgtgagaaaaatgtaagaacacatttgtctggataaaatgcataagttacagaattatcacagactaaacatttttcaagaacctagtcagaagtttactcatttgtctcactgaaactgcgtgctgtttctaactaaagtaaacgtcacgcagttctatgttaaataaacaaaacgtaatgtagtctaaaaggaaagtctctctacctgcttaaaacccaaaagtacattttttcgccgaagccaaaaatcttcacttgcttcttcttctctctgaaaccttatcttctccgcccatg

SEQ ID NO: 21077 - DNA, 3000 bp, Unknown; identical to SEQ ID NO: 7041
  misc_feature (1)..( 3000): 2750-1469P.txt file - cDNA_ID_1839118; gDNA_ID_1621124; Annot_ID_56340

SEQ ID NO: 21078 - DNA, 3000 bp, Unknown; identical to SEQ ID NO: 7393
  misc_feature (1)..( 3000): 2750-1469P.txt file - cDNA_ID_1839138; gDNA_ID_1621143; Annot_ID_56685

SEQ ID NO: 21079 - DNA, 3000 bp, Unknown; identical to SEQ ID NO: 7393
  misc_feature (1)..( 3000): 2750-1469P.txt file - cDNA_ID_1839138; gDNA_ID_1621143; Annot_ID_172920

SEQ ID NO: 21080 - DNA, 136 bp, Unknown; identical to SEQ ID NO: 441
  misc_feature (1)..( 136): 2750-1469P.txt file - cDNA_ID_1839149; gDNA_ID_1591003; Annot_ID_150398
  misc_feature (132)..(132): n is a, c, g, or t

SEQ ID NO: 21081 - DNA, 3003 bp, Unknown
  misc_feature (1)..( 3003): 2750-1469P.txt file - cDNA_ID_1839186; gDNA_ID_1620631; Annot_ID_47261
tttattatccatatatatatatatatttgttttattttaaaatcataatattatttttagatagtttattttcttttttaatttatccaatcatatactttatgcatattaaccggatttttaataaacttgccaccttctttcttctttaaataaatttcattttctcttgctctccaatcccatacgtctccatgatcttccataccgaaaagcttgaatgctgtaaaattctgataatgtctgtaattaggcccttgtttcaaagtacacataaaacgcgttgtacgccaaatgttaacactaaaataagttacaaaatgccctccgattggtattatttttggacctaatacatcatctttggaataacacctcatccagaggagtttttggaatttaagttcgttcccgatcctaattccggctcccgatacatgatcaaacatgcaaagactaaaaacaaatataaaaactaaaagatttttcatttattttttacttttttgtaatgtttggatttttgggtttgttaacttggtttttgtgtttctcgtactttatatacacacacatttgtattggtattggtacacaatttgtttcagtattagtttccaagtttcaacatagaatgacataatcaatcatgtatatcgtgattgatatccttaatatatatggcataagattttatatagttacatgtgaagatatctataataatcatacttggtaatgaagatatccttaatattagtatattataaaaatctatagaaattgaattttgaaagaaaagatgaaatcaagaacccaattttggataatactggaaagattatacggggagatcaaatgataatcaattaaccaattgtgcataatcaattgataatactggaagttcaaacgtattcaattatacatcacctattacaattttacaacataatcaaatgataatatctttttttatctggaaacaaaaaatctttccaaaatttatttatcaaatttcattcctttttaatcagttaattataccgatttttttttttaaacgtgaatatattaattagtattaacatagttttacataataaaagcaaaagtgggaagggaaaatccgttttataccataaaaacaaaagtgcgtaggaaaaatccacaaaggtaataattttttcttcaaaatatccttattaaataaataaaaacaatttaatcgaaaatctattattgtgttttacgaattaatgaaagataacaaaaaaaaaaaaaactatttccgaagattatgaatcataatgataaatcgtctgatgattatgatttattatgatcaaaaatctatttttggacctaatacataatcttttcacattgttgttcactttaagaattgtaaatataaaacacatcaatatgttactgtaatattttggctgttataattgcttaaaatatagttattaagtacaagtgtacaactaaaatcatagtaataatttatatttctattactataaatgtaaaaatattacaaacacactaatatagtattataaatacatacacatctgtatatatatttttctgaatgcaaatttattaataaaataaagtacatatgtacaaatgttaagtggaaataggcaaagctagagaaacagagcaaccaacgaaacatcattagagaagccgtccctatgagaattaacgctattggatatacatcatagtttctcaattctcataacattatttttctacaatttacattatttactgttagaagtttgtgtgtatacgtatgtgtgtgagttttttttaaattataaattcgttggttccaccgcgttggttttgttagatcccttcagattgattaggttaatttagccctattaggtttagtttggtgttctttttgactttaggtttttgataggtagcttggaagggtttagttagagattttgactacgaattctttagcaagagatgaaaagtctcaactaccaataactaatcttttcatttaacatattctcatagaccccatgtgcatgtatatacgtaataagctaagatatttttaaccgttacagaatttgactaacgatactgaacgattagggtaagtatttttttgacatgtataaattaatacttattaacggcatcattatatgttattatgttaagttccgaaatagaggcaaggttcaattaggtgggtgggagtgactcagtaaaccattgtggctctagttgtatataactttttcttcactatataatttcactaaaattttgttgatttatgacatggctatacaattttgttgatttatctaagagttgtatagccatgtgatatatatacatttataaacaaggttacattatttagttttgaaatttatttatgtgatatacactaacaaacattttctttatttgatgacattctcacataatttaatagatgaggataacaaaatcttcaacgcaattgctcaaatgggggaagtctcatcctacaatgctggtttcaaagtcaaagaagttagcggttgcatttccaattttttttgttgctcaatcaattgaaactttacccatagcatttccttgtaaggcattgttgtatttaagtttttctttttataaaagtatataagtttaaaaaaaaaaatcaaatcccttagaaatacaaaaattattgataaagttttttttttcgtttctaaatgattcaaaactattccagtcttcttataagttagaagtattatattacttagactcaaattccgcaatgatcgaataacattctctaaaatatataaaccgtatcctataaaaaacaaacaaaattaatgctattacaattcgaactatttatgttgttcccttatataaagaaactcttcctttcataccaaaaaaaaaaaaaaaatccattttcatttctcctcttaaaaaaccgccatg

SEQ ID NO: 21082 - DNA, 3003 bp, Unknown; identical to SEQ ID NO: 21081
  misc_feature (1)..( 3003): 2750-1469P.txt file - cDNA_ID_1839186; gDNA_ID_2926182; Annot_ID_140617

SEQ ID NO: 21083 - DNA, 3003 bp, Unknown; identical to SEQ ID NO: 19038
  misc_feature (1)..( 3003): 2750-1469P.txt file - cDNA_ID_1839193; gDNA_ID_1620645; Annot_ID_47569

SEQ ID NO: 21084 - DNA, 3003 bp, Unknown
  misc_feature (1)..( 3003): 2750-1469P.txt file - cDNA_ID_1839211; gDNA_ID_1620650; Annot_ID_47714
gactcttaaccgaaggaaacgaaaggtcgcgcatggggaaaacgcgatgtccagctttcttttgcatttttcgaggctccaatatctaggcgttgcatggccgttgtggcataggtgatcattacaacgctattcccataggcgtaatgagcttgtctcgggaattgcttatgcgtcttctataagtactgtcctcctttgatcgtttcacccttcaatcgctttagcagaggtacgagttctttctctcttttgtcttgttttgattcgttatttctttggtttcgatgtcgttgggttcgaattcttctcggctcgtccccggtcggactcatactggcgccctgggcgattcgtcgactcgatcggccaagtgtgaagacgacggctcgtcgttcgtctagaggtcgatctcgtcagaatttaggtacgcacttcatcaaatgagacttcacttctattacgatgctgtggcttatccgccgttgtcttttcctttgcttatagcgactcgttggaagatgggaaggataaacctagacgcgatccccaactactcgaggaaatacaaggagaagagagccgtttcggagactccgcagccgtctctttccgagggacaacagattgcagaagctacaaggagaagcctcttggatcaggtcggtcgtcgtgtgtttgagccgggatgttcgaatcctactggaatggcttctgagaagacgcgagaagaggttgaggttgtcgtcccttccgagatgcgaggcgatggtcaggttgcaaggagggagctcgtacttggtcttcagaattcgtctggcacgtttggtgcaaggagggttgctcctgaagtgggtcgtgcggatgcttctaaacgaccgcgggtaagcgaccatagatggggctttcgttacgacgatatggctgctccctttacttctaattctgtcgcttgtgctgagcttcttcgtgaaattggtcgtggctcgggtattccttcgatgcccttagacttgaaggaggagaaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagacgctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacatgatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatgaaaaaacacacacaccaaaaatatcagatatctcaaacaatgtcttcagtttttggatctgtccatatcttggccatgatagccatacaactcctccttacacacagtgtttcatctctgaaccttaccaatgcgtatctgcaccacaaatgcagcaacactcaaggaaaatataagcaggggagcgcgttcgagaaaaatctcaactaagtcctcagtaccatcacctcgattggaaattttcgtgacggtttccgctacaccgaagaaggtgaggatcccaataacgtctttgtcatg

SEQ ID NO: 21085 - DNA, 3003 bp, Unknown; identical to SEQ ID NO: 21084
  misc_feature (1)..( 3003): 2750-1469P.txt file - cDNA_ID_1839211; gDNA_ID_2926176; Annot_ID_140347

SEQ ID NO: 21086 - DNA, 3003 bp, Unknown
  misc_feature (1)..( 3003): 2750-1469P.txt file - cDNA_ID_1839219; gDNA_ID_1620643; Annot_ID_47541
ctaaaacaaaccttattcctagatgatgaagaaacgctatgtcctgcacatatatcaaatcacttcaccttctactcaaatacgagaactgaaaactcaagcacattgcaaagaaaagatcatataacaaagcaaaataagaatagtaacaactttagttgaggcaagcaaacaatcgaacaccttgcgtgcttttttctcataaatcaaagtatataatacggtgaagaaagacggtaccttcaaaatggcatcacaagaagagccggcgatgatctcgccggagataataacgacgaatgtgcagccacggtgagcccaaagataaggccatgcttcacggaaccaacgcacaaactgtttgtcgtcaactggatgctcagcctccacatcgccggctgcagtcaccgcgtagtcaaacatattgcatttcgccgccgttatagaactaaccggcttaaaccatgaacagttaaaccggaattgagtagggtttagcttattttttggtttgaatgacgaaaaattcgactttgattggcgaaagtggtaaggaacatagtagctagaagtagaagaagaacccactaaagctcctcgctccatcttccttagacttcgatgagagaaagaattcaaataaatactaaattgttattgtaactaaaccggcaggtgacggctgattacggtcggagaaggcggcagtagtaccgtagtgggacccacggtaagtaggtattttatttattgtttatttttccatattttcttcaatagtctttttctattattatttattgtttatttttccatattttcttcaatagtctttttctattattatttattgtttatttttccatattttcttctttagtctttctctattactatttgacggaactctttgaatgtctggtcgttacaagcttaagttgtgtccccacatggaagttattcggttgggtccatcgaaggaaaattgattgaaccggtctggtcattctctcccaaactatagaaccaatttcggtctgcatcggagtttcgaagtcgcggacttatcagagtgggctttttaaggaatgtttttagaatatttaccagcccaatcccattttaagtatgtccagatcttaatttggcgagcctttttatatatggtgaacaactgattctaatgtgtatgtttcacttttattagagaaaaaatgtgaaaagatttaatgtgtatgtttcacttttattagagaaaaaatgtgaaaagattcttaaaagtatttatttatgctaattggcaaaactaaaacatcaatttatgtacatcattttagttcttcctctaagatttgattgatttgtattaatggctctgaatactgatactagtttcgttggcaagtaagataagtgataactttgataaagagtgtcaaattacaagtgccacaatttggagtacgtaaccaaattgacataaaacttgaataggtgaaaaaacgagccagaaaaaaaacgaatatcttctgcttatccgaataaaacgaaagtaatattcttacaagatccttccttatgaagtagtgccagtagatatttttatcattgtgattgcgacctgtttgttgcgattcatttatgccaattcacgttactatttatgttgtgataaaatcttttatttttcttcttctttccaaatacttaagtatgcatgattattgatccgtacaagcataaacgaagagctataaagtctccaacggtaaacgtacgtgaaccaaaataacaattcaatattatggttcgaattattctgtgtattttatgtaagaaaataaccaaaaccgactcgaaacaaaacaaaaaaatcttctgaaatgtgaatctttatttcggaaaattcttaacgatagatagtttttgctttaaaattaaatccaaacataaactagaactgaaattcaattcgttgtcaatattttctatacaaaaaaaaaaaagaaatccgaccaaataaacaaaaccataaatagacatctccatttttagttgaaagatgattaaatgcaataaatgtgccacaatcataaatttttccttttcacctaattgaaaattttaatcattaataagaagaatccatggagcacaattattttattttttattttttgctctcatatggtatgttaaattaattttcccttaatttaaattccccatatcaaataagtttttttttttttgagaaagacttgatttcataggagaaatatttgttaatattttcgacaaaacattttctctgtttgatgtatttccatcctcgtacaataaatactctagctattaaattcttagcccaaacgaaaataaagaaaaataaaagggtcctactaataaacaaaacaaaactagtggtcccaatttgaaatatataaaaatatataaaattcataaagctttgtggcttcagagcttccacttccatcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccaggtaacaaaatctcaccttttctctcctaatttcacgaaatcgaagaaaaattctcataattctcttaattacttatctctcaatttcttaaatcttacagggtttgtctttcgaaattcaggtaattttctcaaatccatttatggattgaagctttaggtaatgaatgagctgaatctgcatataaaaatcgatactttcattatccagaacaaaacaagatttagcataaacgttcaaaattgaaactttgattcctaacttcttggaatgattcagattgagctagatttagatctgtatgattgatattatgggtttggtttgtttatgagtagagagaaaatg

SEQ ID NO: 21087 - DNA, 20 bp, Unknown
  misc_feature (1)..( 20): 2750-1469P.txt file - cDNA_ID_1839219; gDNA_ID_1620720; Annot_ID_165755
aagcttcatctgaaacaatg

SEQ ID NO: 21088 - DNA, 3003 bp, Unknown
  misc_feature (1)..( 3003): 2750-1469P.txt file - cDNA_ID_1839219; gDNA_ID_1620643; Annot_ID_163117
aatcacttcaccttctactcaaatacgagaactgaaaactcaagcacattgcaaagaaaagatcatataacaaagcaaaataagaatagtaacaactttagttgaggcaagcaaacaatcgaacaccttgcgtgcttttttctcataaatcaaagtatataatacggtgaagaaagacggtaccttcaaaatggcatcacaagaagagccggcgatgatctcgccggagataataacgacgaatgtgcagccacggtgagcccaaagataaggccatgcttcacggaaccaacgcacaaactgtttgtcgtcaactggatgctcagcctccacatcgccggctgcagtcaccgcgtagtcaaacatattgcatttcgccgccgttatagaactaaccggcttaaaccatgaacagttaaaccggaattgagtagggtttagcttattttttggtttgaatgacgaaaaattcgactttgattggcgaaagtggtaaggaacatagtagctagaagtagaagaagaacccactaaagctcctcgctccatcttccttagacttcgatgagagaaagaattcaaataaatactaaattgttattgtaactaaaccggcaggtgacggctgattacggtcggagaaggcggcagtagtaccgtagtgggacccacggtaagtaggtattttatttattgtttatttttccatattttcttcaatagtctttttctattattatttattgtttatttttccatattttcttcaatagtctttttctattattatttattgtttatttttccatattttcttctttagtctttctctattactatttgacggaactctttgaatgtctggtcgttacaagcttaagttgtgtccccacatggaagttattcggttgggtccatcgaaggaaaattgattgaaccggtctggtcattctctcccaaactatagaaccaatttcggtctgcatcggagtttcgaagtcgcggacttatcagagtgggctttttaaggaatgtttttagaatatttaccagcccaatcccattttaagtatgtccagatcttaatttggcgagcctttttatatatggtgaacaactgattctaatgtgtatgtttcacttttattagagaaaaaatgtgaaaagatttaatgtgtatgtttcacttttattagagaaaaaatgtgaaaagattcttaaaagtatttatttatgctaattggcaaaactaaaacatcaatttatgtacatcattttagttcttcctctaagatttgattgatttgtattaatggctctgaatactgatactagtttcgttggcaagtaagataagtgataactttgataaagagtgtcaaattacaagtgccacaatttggagtacgtaaccaaattgacataaaacttgaataggtgaaaaaacgagccagaaaaaaaacgaatatcttctgcttatccgaataaaacgaaagtaatattcttacaagatccttccttatgaagtagtgccagtagatatttttatcattgtgattgcgacctgtttgttgcgattcatttatgccaattcacgttactatttatgttgtgataaaatcttttatttttcttcttctttccaaatacttaagtatgcatgattattgatccgtacaagcataaacgaagagctataaagtctccaacggtaaacgtacgtgaaccaaaataacaattcaatattatggttcgaattattctgtgtattttatgtaagaaaataaccaaaaccgactcgaaacaaaacaaaaaaatcttctgaaatgtgaatctttatttcggaaaattcttaacgatagatagtttttgctttaaaattaaatccaaacataaactagaactgaaattcaattcgttgtcaatattttctatacaaaaaaaaaaaagaaatccgaccaaataaacaaaaccataaatagacatctccatttttagttgaaagatgattaaatgcaataaatgtgccacaatcataaatttttccttttcacctaattgaaaattttaatcattaataagaagaatccatggagcacaattattttattttttattttttgctctcatatggtatgttaaattaattttcccttaatttaaattccccatatcaaataagtttttttttttttgagaaagacttgatttcataggagaaatatttgttaatattttcgacaaaacattttctctgtttgatgtatttccatcctcgtacaataaatactctagctattaaattcttagcccaaacgaaaataaagaaaaataaaagggtcctactaataaacaaaacaaaactagtggtcccaatttgaaatatataaaaatatataaaattcataaagctttgtggcttcagagcttccacttccatcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccaggtaacaaaatctcaccttttctctcctaatttcacgaaatcgaagaaaaattctcataattctcttaattacttatctctcaatttcttaaatcttacagggtttgtctttcgaaattcaggtaattttctcaaatccatttatggattgaagctttaggtaatgaatgagctgaatctgcatataaaaatcgatactttcattatccagaacaaaacaagatttagcataaacgttcaaaattgaaactttgattcctaacttcttggaatgattcagattgagctagatttagatctgtatgattgatattatgggtttggtttgtttatgagtagagagaaaatgggtgatgaggcagagatcaaggaacatttaaagccacaagcttcatctgaaacaatg

SEQ ID NO: 21089 - DNA, 3003 bp, Unknown; identical to SEQ ID NO: 21086
  misc_feature (1)..( 3003): 2750-1469P.txt file - cDNA_ID_1839219; gDNA_ID_2926213; Annot_ID_142108

SEQ ID NO: 21090 - DNA, 3003 bp, Unknown; identical to SEQ ID NO: 21086
  misc_feature (1)..( 3003): 2750-1469P.txt file - cDNA_ID_1839219; gDNA_ID_2926213; Annot_ID_202794

SEQ ID NO: 21091 - DNA, 3003 bp, Unknown; identical to SEQ ID NO: 21086
  misc_feature (1)..( 3003): 2750-1469P.txt file - cDNA_ID_1839219; gDNA_ID_2926214; Annot_ID_202820

SEQ ID NO: 21092 - DNA, 3003 bp, Unknown
  misc_feature (1)..( 3003): 2750-1469P.txt file - cDNA_ID_1839226; gDNA_ID_1620652; Annot_ID_47760
tttaccattcataatgagactttgaatgtttggacgtaagtgttgaatcatgtttcttgatgtatccttgtttaaagttcaagaaaccttgagtgtgtttgtgtgtgtgtgttctttgggatttgcaggcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctggtaagaaaagactcaatctttctctctattcctgcagattactgtttcaaaatgtggccaagttcatgtctttgtaattgcattgcagcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctatgagagatattgaaggatgttgaagatgaagattgaagattagatggaatctttgatgttttaaatcttgtttgtagtagcttcatataaaagttggattatgtaaagtcttatctgtaatcaaacgtttaattgtttcttttattcaacaaaggattcatattgttaatctgcatattactggttaaagaagctgaaggattcatatttttagatgattccagtcttgattgcagcattcaaagtatcataatctagtgtcaacctcatataagcctccttgtgaacctgacacaagcctaactggttccatcgcagaggatactttggttctgatcttcttcttgaagatttcccctgactagttggtatacatttcgaatgatccataagtgttgataaactacaagtacacaagtaactactcaagggaaattcacttgcaggttagtcaagtgaacgttttttcaaagtatcagagaatcataaagaagacaaaggctctagtttgagtctggaaattgttaatgatgatggtactaagttctggtggagtttgcatgtaagacaaagcattgcagactgaggttacagcaggaagtgcatctgggttcaatggttgatgtgtaagttgctgtaaggacgtgtctcaaggatatcacaacggtttgttgagatgagacagagttaaagataactagtagtggttaagaatacagtgttaattattgttttcaatatatgagaggaggagcttccctactatttttatttttttagccaatgagagagctccacttcataccccacttttaccaatcgctagatttcacagccactctcacccatgtcgcgttgagcgcgtgtccacaaaaatcattctttttttgatccacgcacctcattctcaaaaacccaccgcgtgtcttatttttttttgttttcttctctaaaccaaagtaaaccgaaccgagatcaatttgaatttcaaaaccaatgtaaacccatcgctgtgaaaacaaaaagctcggccactgtaacaacaaaaatggagacgacacaacttggaaaagaaatcaactcgaaatagccaagagaatgttcgaaaaccctctcaaatccgatgcttcctttgattccaacctccaaaagcccatctgctcaaatcttcatttcgaggacgaggactcgaggagtattacaaggtacctctatagaatcaatggcttccatggtttttgaaactttacttctaataaacaccattgtaatgtcttgttgtgaaattgtgtaaggaacaaaggatagtgaaagctgaagagtgggcagagtttttttttgactaagtggcctctgtttttgattcttcagtggtcaattttgtgatgggatttgattgaaattggagaatgatttcatgaaatctcttcgggctgaggttgattcatgactctttcatttttctagtgtctcattgatgatagacataagaagcactcagatgttggtttttgttttccatacttaaggccatagagagtggtgaattggaggcaatcaagcctttgccttggtaccctaagaatcttcacttttctagtgtctcattgatgatagacataagaagcaccattgctgaatcatatctgtttggcacagttctagttgaccatccataagtggattattcatgctgctgcttaagccattttttccatatctgctgacaactatagaggctttagtcacatgcttttaggtttgtagctaggaaccatctggaatcaagtacttgctagaaataatgttgttgatcctctgctgcagcgagagagatgcagcgcgtagcagctttaaacgtgttaggaaggtctgtgaatagtctaaaatctacatcaaatgagtgaagggaaatg

SEQ ID NO: 21093 - DNA, 3003 bp, Unknown; identical to SEQ ID NO: 21092
  misc_feature (1)..( 3003): 2750-1469P.txt file - cDNA_ID_1839226; gDNA_ID_2926215; Annot_ID_142173

SEQ ID NO: 21094 - DNA, 3000 bp, Unknown; identical to SEQ ID NO: 8624
  misc_feature (1)..( 3000): 2750-1469P.txt file - cDNA_ID_1839234; gDNA_ID_1971821; Annot_ID_58334

SEQ ID NO: 21095 - DNA, 3000 bp, Unknown; identical to SEQ ID NO: 8624
  misc_feature (1)..( 3000): 2750-1469P.txt file - cDNA_ID_1839234; gDNA_ID_2926195; Annot_ID_141213

SEQ ID NO: 21096 - DNA, 945 bp, Unknown; identical to SEQ ID NO: 4149
  misc_feature (1)..( 945): 2750-1469P.txt file - cDNA_ID_1839258; gDNA_ID_1620686; Annot_ID_48466

SEQ ID NO: 21097 - DNA, 3000 bp, Unknown
  misc_feature (1)..( 3000): 2750-1469P.txt file - cDNA_ID_1839258; gDNA_ID_2926202; Annot_ID_141561
gaataacagagaaagagagaaaaagagagagagagagagagagagagagagagagaggatgtctggtgtggttgctcttggtcatgcgagctcgtggggcgcagcgctggtaaggatctcgccgtatactttctccgcaatcggaatcgccatctcgatcggtgtctcagtcctcggtgccgcctggtaaatcgaatcttattcttcttcgtccccgcagattaaagcattgacctttttcatcatctttttttggtttgtcttattcaggggaatttacattacgggaagtagtttgatcggtgcggctatagaagctcctcgtattacttcgaagaatctcatcaggttcgttaaaagtttcaagcttttttaattctagttttgttcctttggttgatcaattagtggctttaaggaactgtgtagattccatgtcttgttctgaatagcaatgagaattcatcgctgagtagcttgattcatttggatatttcaatgccacatctctgcaagagtagattgtcacattatgatacaagttgttgacctgggattcaggaggtagaaatttagaattctcaaggactcatctggttggtagggctagtaactttggatcgtgaaggctctggctttgcggattcaagcactggatgtaatgataatgaagtgtcttttgtctttccacgtatttcagcagaaacatatatctaccatcgagatagctaaatgttaaattaggggatatagatttaaagtttgtgtttacgttatttgtggtgccttcctattccgctccttcattcttgggccggagtcacttaagtaaacactcaacacagtcattgctattatatcccatgggtctacggggtagatttaaggaatgcttaacagggagtagctgtgtatgcaatttgatttgttgttacagagctacaggcttggagttagatgctctgcaacatcagtgtcaacagtgtcattaccacacaccatttcttaaccatattgagtagagcatttggctgtaaaggcactagtacttaggaatgcttaagtaggaaacagttgtgtttgcattctacattttctactttgttaacacttaacagagctttaggctcaagattagatgcaaaaagtatacaatgacgaagcatttcttgttcttttaaactgtcccagtgtcatcttttgcgaagctgttgctatatatggagttattgttgcaatcatactgcaaacaaagttggagagtgtcccatcttcaaagatgtatgatgctgagtctcttagagctggatatgcaatctttgcatctggaattatagttggattcgccaaccttgtatgcgggtctgtatctacccttttctccttccttacagttttggtttttggattccattgtcagatatgcaaccgaggtccacatttctcttgcaggttatgtgtaggaatcattggaagcagttgtgcattgtccgatgctcagaactccacactttttgtaaagattcttgtgatcgagatattcgggagtgctctcgggttgtttggagttattgtgggaattattatgtctgcacaagcgacatggccaacgaaatagatatatatatatccggtctgtatatgttgtggtctacttgcaaatctggaaaaacatggcttcttgattatcttcattgttatatcgttccaatgtctagacgaaaatcttgtgtgaaaactgagaaccacttttggatccccaattttttgtatttgtttaaaacttttgaataagtccttttggagaacatcttcatgtttgtattctcttataatcaaagacaaagagtttgtatatgatttgttaaaactgaactagtcattttatcaagtctgtttcctctatatactgtagttatgttttatcttttttttttctttctcaagttatgatttatctcaagcaattatgttgttgatacaaatggtcttgcctctttggccacaccctgtgtagtgctgtacccaacaaaaccaatgaaagaattcgatctatacaaattgcataccaagcagaaccgttttgtcctaaaccaatcatcacactagacgacgtcgtttcacgtgtgatatttaggtggctgtcccgttcctggaacccggagctttttttgttgtgatatatcccgtaaaaccctaaacatagtcacttcatcgtctcctccactgtatcattcaatctctgtcttccttctttttagcgacctcgtctccaaagctcacaaattttctacctttccggtgagtgttactctgttctcgtttcctcgcttgtctctttctgggtttttagtttccgaaagattttcctttcaaaatccgtttttgaatgcgaattccctctgctgtatctattatatttagtaatttgatgtattgtttggttggtatgagctgataaagttcaacacgtttgttgttcacttttgggaaaatttgcgataaaacaaggatttttttacaattttgacatatatatatatatatatatatatatatatatatatatatatttgagacgagaatatttgttcagatatctactgagtaaaattagtggtctctctgtttattgcgttcatgtgacatttggaatttttgagtctaggagtagagagaaagatgcaagcttgttgtggtggtaattcgatggcttctcttcagcaacctggacgggttcaaggatctgtctttcccccaattatgcctccagtgaccaaattttctcagcagttgaagttcaatatttcaaaacctttccgttcttcatttctgaaaagaaacctggtctctgaaatgagagcatcttcagtctcgctacctaatgtcgagataagcagtaagatagtttaagtttcatttccttgattatgttgatgatgtgaaagatatttttacttgtttcatgcgtggttttgatttctttttactttttgaatg

SEQ ID NO: 21098 - DNA, 3003 bp, Unknown
  misc_feature (1)..( 3003): 2750-1469P.txt file - cDNA_ID_1839266; gDNA_ID_1971819; Annot_ID_58285
aaaggtttattttatttgtcagatgagcaatcgatggtaacacaatttttgagtcaattcgttttttttttcctgctggaatgcatagtatttgcgtatttgatgatctttaagataagcacactctaaaaaacaaactctagtcctctcagaatagatatgaaccgaatgtataatccaatcacttcgttggtatataaagatacttaggagcacattgcttatgggacgaggcagcaaaggaatttgtctagtgagggacaagtatctaaaaaaaggtatacaacgacacatcgtttagtttagcttagtaagcaaatcttcagatttatttattcacgattttatgctacatatctataaatctgacacgtacgcattaaagacaaacatcttatgctactatatatgattaatcatagacatgtgctataattaacccttgtgttctaaatatgtgtctctttataaaaaaaaaatatatatatatatatacttgtatatatcacatatgtgaaattgtctataataagatttatttttttttggtaaaattttaagtaataagtttatatttgcgattttttcttaccgcttttaactattccagtattgtttatcacttttttatacatccttcaaaaatattatatcgtttgtgtcaccgatcgtatatatgtcatgataatagtttttcttgttcattatgtgatgcataaaattcacgtcacacaatttgacaggatatgatgaaacagttttagtgaaaacaatcacaaacattgatatgaaaaaactacgtccaaataataacaagaacgcagccaacttgcctattcaagaaactatagtgctctataaataatacattttgaaattattaaagaacccaatatatatattcctcgatgattgatctagcttttgaagtttcctttagttctaactaatgaggatataaagaaggagcactatcaagtttgaattacaaaggactcaaattaggaaccaagccgcacttcccgtccaagaacgtcacaacaaaattaagcttgacactcttaaacaattattgcatctctatttttactttattctcattttgattcgtcaaatatagcaatgacagattcaaaaaatcagtccatttctacagctaaaatactttcaagataattagaatcatgtaagtataaccacaagcatggataaaacagaaccaaagttaaaccaattcatcaaaatgactaaacaaactggccccttttcatttaaaccggaacaattcttgttattcatttaagaattaactggtagtttttgtaaaaaaatgcaatttattagatgaataatgtcattcgttttaatagaatgttcattgcaatgctgtcataaatgaaataaatatgcccattcattttttctgcgtttggaaagtggaagaatttttcaagaggatcggtcattcatgcatgtaatgatgcaacggaataagaataaccaaacattcgatcgaaagtacttaaatacctaaatgtgcttgtcttaaaatatatctaagatataggattcaagatatctgaatatcatatataaaaaatgaacatacagatacagtgaatatttgaatttatgaaatatgggattgctcgattggaaaagtaccatagtccattagtccgagtaaaggttttaaaagcttatccgaatctaaagaaatgtacgaattttggcttagaatctcttaattacaacaaaaaaaagttattaggtattaaatttttcacctgatattggtgatttgctatatacatctgatttagatagaaaacaaaagttatactttgagataaatccaaaaccctatattctggggctctataaatgttattaattaccgtctctttgtagcgcttactccacacaaaattgtaatatttaaaagatttaaaaacaccaaaaagagataagttagtgtgaattgtggaagtaacagctagaattccaacgtgaaggacgatagtgaatgaaacacccaaaaccaattaaacttagtcatgatgagagggatgcatgaaactaatcggcgatggttaaaggtcagcctcatctcatgtctgtgtcttatctcatatatgataatcacccacaatatctgtatatggtcctcgtcagatttcactcattttgtatcctcgagaaattatgcagtactactagttacttattggcagattttttattgctccatttccatagtatatataatatcatttaatttgtaagatatattagtgtttttgacaaaaaaaaaaaaaaaaaaaaaaaaaaaaaaaaagaagaagaagatatattagtgttgtctatcaacatttatctgtcggattcaccaggtattaggaaagaagcccgactatttgtttcgaaattttattgtatgtcacatgaatacgtttcaacgtgatgcatatgttattaatgtatacatagatacatacatcatgttgatatcctttcaagaatatctagatcataaattcataatagatatgttcatagctagaattagaagaatactttactagaaaatgaaatgaaaatgattagctatctgataaaatgattaaaaaaaaaaagtctactgaaggaggatgataaagtttaagtgttgagattttattcaagttatgtagtatacaaaaaaggggatagttttagacttttagtagtacgaatagctaatcttctaaattaattgctatctattacactacactatcaataactaaaaatgaataaatctagtgcagtttattcaataaaaatgtcacgaattttacataagttgtaaacatccatctattaaaacataatcacacaacatctattttgttggaataccataaacttttacttgacggctacataaacatgatacatgattaacataggccttttaaaaaagcaaatatatatgactagaagaagaaagcaaaagaaatg

SEQ ID NO: 21099 - DNA, 3003 bp, Unknown; identical to SEQ ID NO: 21098
  misc_feature (1)..( 3003): 2750-1469P.txt file - cDNA_ID_1839266; gDNA_ID_2926199; Annot_ID_141444

SEQ ID NO: 21100 - DNA, 3003 bp, Unknown
  misc_feature (1)..( 3003): 2750-1469P.txt file - cDNA_ID_1839312; gDNA_ID_1620712; Annot_ID_49041
cccgagatgggccaacagtgtgggaaatagggatacctgaccggtctgcagctgagttctttgttccagacccaaatcccaaatacatcaacaaactatatattggtcatcctgataggtatgtccatgatcaaagatatcacaacattaaggtttcagattgttaaaacagtagagagctaaagtatggttgtacgtaagcaggtttaggcaatacgggctatgggaaagatacacagaactatatcctaaggaagatttggtgttcaccattggcgtcagtgattacaaaaaagattggttctttgcacacgttaccaggtaacaaatatttcacattttctaagaagagtaaaacaaagaagcctcacatttattttaaatgatgataggaaaatgggagatgatacatatcagaaaacaacatggcaaatcaagttcaagctagagaatgtacagaaaagttgcacatacaaaatccggatcgcgctagcaactgcaaatgtagcagaattacaggtgaggatgaatgatgatgacacagaaaagactactcctatattcacaacgggtgtaatcgggcacgataacgcgattgcaagacatgggatacatggaatctataggctttataatgtggatgtaccaagtgagaagcttgtggaaggagacaacactttgttcttgacacaaaccatgaccaccactggagcctttaatggtctcatgtatgactatatccgcctcgaaggacctcctttagattcatactctcactaggacttttagtcacattattgtatacgcaattttgtattgcgggttactttactaataaaaaaaaagacattatatgggccttgtgttgggccttctttctaatctcagatttgactttattacaaacgaaagggtaagaatgtaatttttcgccgactcgatctatcgctgcctatatatacagttacctgcaaaatctagggtataaaagcccctaattttttctccgcccaagagacaaaaatccttcgcaatcgagcaacggaagctcctgcatccaccgtccaaatctcttctaacgtcgccggagatcggtaaaccggttcttcatcccgtattcatctcttattgaggtcttagattcatctagcaccttttttttggcgtcgaaactttcagattccctatttgtaattagttgcgaattttgattcgacgatttgttgctcgaatttgaatcaacagatcgttggggaagtagagaatggcgacgtttgagctgtacaggagatcgacgatcgggatgtgtctgacggagactttggacgagatggttcagagcggtacgctgagccctgagctagctatccaagtccttgttcaatttgacaaggtttcaatttaacttttatttgactgatcttggcgtcttgattcgtttttgtggttttttttttctttcctctttttgatatctgtatgcttgttgtagtccatgactgaagctctggagagccaagtgaagaccaaggtgtccatcaaggtgattttcagttcttttaatctcttagtcagcgtaattgggtagaagaaaatatccagttcgtgaattgggtggaagacgattaagagtttctaaactatcttgctctattcggttatcgttaagagtttctgtgagtaatgggttgaagctggatatcaaataatttagtgttaaaaagttcaacttgatagtaagatgtggattcagttatctgcctgataaggttattagatttgctagcacaggaaatactaacactgtcatggattcaatcaagttcatagtttctttggatgtcatatatgaataataggttgcagattcccattcctagagttaagtgtcaaccttagattaagctgtatggatttcagttatctggctaggagcttatatctgttttacctcaagaaatacttgcaattttatgaatactctcgagtgttgtagactcgtagtttatttgtctggacgttgtatgttcttttggaagctgactgatcaattgtttttggtgttcatcactaatctggatagtcaaaaattgagcttattctttgctccgaagacacttttttttaaaaaaatcatatctggatctcaaaataagagaaaactttggcagatgaaacaatcagattcttactatcgtttcttatttattatttcagggacacctgcacacttacaggttctgtgacaatgtctggaccttcatattacaggacgcaatgttcaagagtgacgatcgtcaagagaatgtgagccgggtgaagatagtggcatgtgattccaagctgctcacacagtgagatgcaaattgtctgcagggaatttactttcctttgtactagattttgagttttttcactttgtaaactcagcacttgctatatatgttgagcacttgctatatgttgagctccatctgcagccatcaatttagcctatatgtaaattctcggcccaaggacataaggatacattctgttgctatgagaaagttcttgagcttcatcttgagttttttttttttttttttttttgtcaagagtgttacttttatatatataagccagtacaaaccgagtcagtacaaaagtggaggaaacaaccatgaacaaaagcatggactaaagcctaacctatcaactattacagatatgattaacaagaacaaacttgacaaacactagagaaggttaaacttgtatcataaacgaaactagtctaaaacagaatccaaaaggtgacctaatctgttcttatgaccttttatctgtaaaattccgaaccacttgatattgatttggacaaaactttgtctcatggaactgattggtctcaaagccattggttaatcttagactctttctttctcttggctcacttcactctcctttttttaggtgagagtgagttattatatgtatgtgtcatttttgccttttcagatg

SEQ ID NO: 21101 - DNA, 3003 bp, Unknown; identical to SEQ ID NO: 21100
  misc_feature (1)..( 3003): 2750-1469P.txt file - cDNA_ID_1839312; gDNA_ID_2926185; Annot_ID_140755

SEQ ID NO: 21102 - DNA, 3003 bp, Unknown; identical to SEQ ID NO: 18409
  misc_feature (1)..( 3003): 2750-1469P.txt file - cDNA_ID_1839316; gDNA_ID_1620713; Annot_ID_49060

SEQ ID NO: 21103 - DNA, 3003 bp, Unknown; identical to SEQ ID NO: 18409
  misc_feature (1)..( 3003): 2750-1469P.txt file - cDNA_ID_1839316; gDNA_ID_2926152; Annot_ID_139348

SEQ ID NO: 21104 - DNA, 3003 bp, Unknown
  misc_feature (1)..( 3003): 2750-1469P.txt file - cDNA_ID_1839320; gDNA_ID_1620713; Annot_ID_49055
tgatcgggacgaggattattttgccacagctggtgtgtcgaaaaaaattaagatatatgagttcaattcccttttcaacgaatctgttgacattcattatccagccatagaaatgccaaatagatcaaagcttagcggcgtttgctggaacaactacattaggaactacctagcttcctctgattatgatggtattgtcaaggtatttgaacctttgaagttttacgtagattgtttatcacttgattacccctttatttccttcggtctaatgaatacaaacgtatttatgatgaatccagttatgggatgtgacaacaggacaggccatttcacatttcatagagcatgagaagagggcttggtctgttgacttctctgaagcttgtccgacaaaattagccagtggaagcgatgattgttctgtgaagctatggaacatcaatgaggcatgctcttctatactggattttgtcgttttaatagctactcctactgagatatctggcatatatacatatgaatatatcaatagcactttggattattctgtcaatgttgtcatgctcgtattttcagccttgtagctaatagacaatcttcttgtttgactgtgcagaggaactgcttaggaacaatcaggaacattgcaaacgtttgttgtgtgcaattttctccacagtcctctcacttgctagcctttggatcatcagacttcagaacctactgctatgatctaaggaatttaagaactccttggtgcatactgtcaggacacaacaaagcagttagctatgcgaagttcttggataatgaaactcttgtaacagcatcaactgataacacgttaaagctttgggatcttaagaaaaccactcacggtggcctctcaacaaatgcttgcagcttaacttttggcggccatacaaatgagaaggtagctaatgctgaaacgtaattttgagttaatctatataatgatgtttctctttttccttcgtggttgatttgtcttttcctgcctttttcagaactttgttggtttgtctacttctgatggatatatagcttgtggctctgagacaaatgaggtatgcccctacaaacctgggaactctttgatattcctataactttgtgtatggaatctccttttctataatcctttaacaagcattgccacagattgatagtttgattctcaacttaactagaagctccagagtttatttcatgtgatggaaaaaatcacagttccatgtgaattccgtctatttatacgcgatggaggaacttatccattgatactaacaattagtaaaataactggcgtagggtcaaaaaagaactaatctggtagtattgttgtttaagtgatctctctgattgagaaatatgctgtttcttgttttgttcaggtttatgcctatcaccggtctcttcccatgccaattacctcgtacaagtttggttctattgatccaatatcaggtaaggagatagaggaggacaacaacctgttcgtttcaagcgtttgctggagaaaaagatcgaatatggttgtttcagctagctcaaatgggtcaatcaaagttctacagttggtctgaaataaatacatacatacagaagaagctgaggtaattctacacctagagccctcttggtttatggtaaaacaaaaaccccatcaatccaagaatcaggcaaaacaacggagataacgaacaagctttcaacacacagatatgagatagttttatctatctgttgctaaagttttcctcaaatggggtgaaggaatgagagtgagtagaactatagttgttcaatagttgcggtttgatcagcgcggtaagggtttataccgctgatgggtatacatagtaaggtaaaagaccttctcttttgtggtgttctaaggtgtttatttttttattttttattttggctcttacaataagattcctctttgtgatatgtaaatttgctccgatagttctaaggtaaaagagcatactctgatgtatatatagttgaaatgagctttttagttctacggatgaatctcctccaccaagaaaagaaaaatcttcgtttttctttttaaaaactttaaatgcatcgttttttgttgaatgttcacaaaagtaatctttgaaatgctttatcattgtacatagcttaggactgaatcagcgtaataacgttatcaaggtttcttgctcaatcaagctgctccaacttgtttatggtcttcttcacttggtactgaaaacttttttactttctgagacaaacaacaacagaagatgaatcaaggccttgctcaatctaagatcaagctgtcttacatctatgagaaagacttaagaatcacaaagaagaattcatagtgaactagtgaagcatgccatatggaaaaacaattgttcaaaaactccaattgaggaaatgttggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaaatg

SEQ ID NO: 21105 - DNA, 3003 bp, Unknown; identical to SEQ ID NO: 21104
  misc_feature (1)..( 3003): 2750-1469P.txt file - cDNA_ID_1839320; gDNA_ID_2926152; Annot_ID_139343

SEQ ID NO: 21106 - DNA, 3003 bp, Unknown
  misc_feature (1)..( 3003): 2750-1469P.txt file - cDNA_ID_1839324; gDNA_ID_1620724; Annot_ID_49258
tctgaacatatcatattttttttttttaaatgaacatattcattgcttctagatttttgctgtcaaatatgagtaactttctgtgacgtatgtttttatacagaggtgaaaacagggaatacgccatcaagaagcagggaatcagtaacctactattttaatagaagattcattaccttgttaatcacgaaattaccttcttgctcatgaatcaccaagtcaatgtcaatgtttttagagaaaaaaacacacatacataatcatcaagtcaatgttcttgcaatagttatacctttagtttcccccaaaaaaatattagccaattaaatcaaacaagaaagaagatattacttaaaaatctctacaaaacacatgactacatgagcgagtgaattcgataagggcttgaagaagtggtatgccgattgactattgggttaaaaatagatgaacaattgagattcttagaattagtaccactaaattgactaaaaatcagtaaatgattgaactcatttgagaccaaacatgtgggagatatatatgggaatgaatgctttctaagtggacacgaaaattctatattacagttgagattcgtttgaacaagctctggggaatatacgggggacaagataccaatttattactaaaataaatacgattaaaatagtctaaattgagaaagagaagatccggagatggtggtggtgggttttaaggcatcttgcttatttatatccttaaagggaacagaaattgtcaaaaatacgtcatacgtgacgttttctgtcataattagtaatatactaaacataattaattagaactaaacgataaagtaattagttaattggtatataaatatatggactatggagtataggctttttcatctttatattttgcttattatttattaaaaagtttggcattattcattgccaaatgactacagcaaatatacgattttgatgcagaaatttaaatttattgatcatctaaagatcgcacttagtttactatacgaaaatccatgcactacactactagtgatggtacaaatgtttaggaaataaaattattatgttaaattttgtattgaaataaatatttgggagttataatcttatcatataaaaaaactaaaataaataactaacccaacatatatgtatatctacattataaggatttgaatttatatggtaaacataactatactaacaaaaattattatattacatatcttggttaaattagtaaaatagatttatttagtgtttttcgtttgtcgcttgtcatactttttgagttccttcaatttgagtatcataagatttttaggaaacttaatcttgatgttataagtgatattaatcgcttatttataacatctacttatttatccatcatcgatcattttttaacggttcaaaagatttcacgtatattaatgttcaaaattctaaaaaaaaaacatttaatcaaaacatttttttctaagtatttaagtaatttttccggataatatttgtttggcaacgatcaacatatatcatgactcaaataaattttgatgtttctaattagtaaaatgtggagttggaaaaaagttcttgcaaaaggtgaaaagaacaaaaatcagagatggaaacacttcccacatgcttatgttagtcccaccatttagtggtagaaatgtaatttatccaaagaaggaggtcaaagctgcttcgtctctaatccaagtctagccagtattgttgcctgcataagagcaaacggtaaaagtgacggactcttaacgatgacgggtgttactgtttaatgtctcttgatcgacttttgttaccgtaacgacaacggcacgcgccctcacgctccgtaccagccttaaaagccaacacatttatgatttatccagtaactaatactaattccttcatccactaacgcaattgcatttaattgtttagtacgtatagaaaaaaagtaaaaagctatttataattataacttacaaagtctctttcaattagtacagtgtaaaacaaccaattattttctatattatacagtataaaggtgtttatcatagacccattatttatttgtttttgactaaaatatcaaagtgtattaaaacataaaccaaataaatttgaaattaaagttttttttttttttgtaaaattaaaactgatttttggtttaaatagagaagcaaagctacgcttttttttttgctagctctttttttatttaatcaaacaaaaattgaggaaaacaattattgttgtgctaagcatttctatcatatatttttttataaacaatacatttaatttcaaaataactttctactttcttcaaatcaagctatttcctagaaatttggtactgtctggataacaacatgtcttagaaagtatagtaaggaatttacaattggttatacaattaatgtatagcgtattattatatacgaaaaggtgtccaattttagacatacatataaaatcaatttattaaaaataaaagtattgaaaaaagagagagtgaaacggagataaaagcaaacggaggtgttaacttaaagacgggagagaagcgagtgagagattctttcttgtaacggcgttgtttgacgattatagtgacgaagagagacaaaaaaaaagagtttagtcttctttgtttgggagacgaagacgatagaagctggttttacgggagagaaattagagaggttacagttacagagcaggaaggattgcgttgcgttacgattcagatctctctcgatcgttacttacatgcattagagaacaagaaaacgtggagacggaatccaagggaccttcttcttcaatttaattcctcactttattacgcacccttcttttattttcgactgtttcagcttccggttcttcatcggagagagatagagagactgtgtgttttggtgtgactgatagaagatttaatcagctgatg

SEQ ID NO: 21107 - DNA, 3003 bp, Unknown; identical to SEQ ID NO: 21106
  misc_feature (1)..( 3003): 2750-1469P.txt file - cDNA_ID_1839324; gDNA_ID_1620724; Annot_ID_165905

SEQ ID NO: 21108 - DNA, 3003 bp, Unknown; identical to SEQ ID NO: 21106
  misc_feature (1)..( 3003): 2750-1469P.txt file - cDNA_ID_1839324; gDNA_ID_2926184; Annot_ID_140709

SEQ ID NO: 21109 - DNA, 3003 bp, Unknown; identical to SEQ ID NO: 21106
  misc_feature (1)..( 3003): 2750-1469P.txt file - cDNA_ID_1839324; gDNA_ID_2926184; Annot_ID_200491

SEQ ID NO: 21110 - DNA, 3003 bp, Unknown
  misc_feature (1)..( 3003): 2750-1469P.txt file - cDNA_ID_1839328; gDNA_ID_1621141; Annot_ID_56632
tgtttgtttatgggtaagtagaggcctagaacaccatgtttggttcatttgtcttctttgttgtaaattcccgataactcctgttactagtaaatataaaacaaattatcagttcttgtaatgaaaaaaaaaattttattttgtttagtaaaacatagttgtgctacagatttttctgaatattaataacatatttacagtaacaatttttttcaattgtcattagttttgacgaatacataacattcttactaaaaaaattatataaattaaattttaaatgtcatataattttactttaaacaaactataacgtaaatattatgaaagcagaaaaatgtagctagacatattatcaaatagtttatctctaactaaaaaataaattatatagaggtactttcaaaatattctataaatttaccctttttaaaacaaaatattaatatttcttatacaaaacagatctagcttaatacattttctatagggcacaaaaaagaaactattgttaatgaaaatgaagcaaagaaaacatgtcgagaaaatgtatagcaaatataaattttcgtaatataataagaccattaatataagaaattaaccaaaaataggtgaagaaatttaaactatacgttttgggtatcggttttcttggtctagcacaaaatgttttactcaatttttatgttttatataaagttttcatcaaagagctttactcaatagtcaatataatgtagttagatagtgaaatttttaactttgaaacaaattttatataacataattgaacaaacaaaattattatatgatatttgtatttatttgttttaaaaagactatatgttacgtataaaataattacaaaccttgcacaaaaatgacgaagagagttagaacggtaaacgagaatataatgtttttattcatcttagctgatataaatgattatatatatatatatatatatatatatattttaatctgaaaattgattgtgtttaaaaagaaaaaaagaaaaaaagaaaaaaagaaaaaaagaacgaagaaagcatacatatatataagaagttaggtatatcccacattataacttatctatattaagccatctatctccttaaattccgattgagctttttactcatttgatatgttaaaagctttttaccagctagtcctatacaaaatatttttccaaattaagtaaaagtgataaattagtaaaattcatatataatttagagaatagatatactaaaatggaaaaggttataaaaatagcattttggttttcataaaaaggaaaaattaatttagaatgtaactattgaaatagacttttgtttttcagtttttttgtgcaaatacttgatttcattcattcaatcaaaacaaaccaaatcaaagtacaatgataggaatgattccaagatcccaatgtttataacatgaaaagatagagtgttccctaatgcaacataacaatagattaggtagtccgacttgtgattcataagcgcttggagacaaatgttagaaaggaaattggcacaagcaaatccatggtgagtcgatagtgacggttgattgatttcgtgatgttgaaaaaaattccaagactttgattcttgcttgcatgagacgttttacacagtttatcataaaggtaaggaagatcggtagcttacacagtttagaagccaaaagctgaggatgaaaacttgtaaatagagttctcttcgtataagagaaggagatggttagtttctccataaagaaaccaattgaattcatggtttctcattgagcgagggataaggattcggaagactctcatagtcggatagccttagctttgtagctctaagaaataggtcgggatctctcatggaagatgcaataattttttgtgggagcttgatctgatccgtaaagatgttggtgattgtgagatacttgagatcattttaaaatattgtcgacctaaagtgaacgtacatagaggatccattatcaaagtcgcaccaccgatcaaggatcatcaagtttatgctttcataaaacgtggccagagttgagtttagcgataaggttcctagatgataagcgcaagaccaattcatcaaaatcgattcacatctcatgtcatgtcctcggccacataggtaagagaatcgatgcatctatgtaatggacttgacaaaagaaaaaaaacaaaatttggcaaatcattctaaagaaccaaaattacttcgtaactagtgaaagtccttttaagaattcataacttagaaatttgtaagttatatgcgagcaacggaaacattcggatatttttctagtaaaattaaataattagagttttttttaaagaattaacggctagaggagaaattaaattactatgggtatttttttcagcaaaaaaatagttggatttttttttgttgagaaatttcccttttaacaagttccaaaataaaaactgattatagtagaaaaaaagattggaaattgataatactacttgaattttttatatgccttaaatagtatataattgttttcaaactttagaaacattaaatattaattagattttagacattatatagagtttaaatattatgaaaattataaacttttataaattttaatattattctattttaaaactcttataaagttaatatttataaatttgaatattttaaaatgaatatactaattcatagtagaaaattgatactttggaaattggccgttgttaattggaaaacatcacagaccataaattgggatcttgcgtgaatccatcaaagacctttctctgactcttattctttctcctccaatctagggttactccgaattcttcttcgtgtccctctccgattctctgcacgttgtcgctgttgtttcctctgaaatcgtctcgaattgaaggatcttggatcttttttttgctgccattgatcggttcatctttcaaatatg

SEQ ID NO: 21111 - DNA, 3003 bp, Unknown
  misc_feature (1)..( 3003): 2750-1469P.txt file - cDNA_ID_1839338; gDNA_ID_1620730; Annot_ID_49384
tagaatcacaacatcctcagtcaaatgaatgaaaaaatcgtgaggtggagttccttatcagttaaacatattgaaatcagaaacgaagagaaagttcgtaaatatattaatagaaaaatgaaacttaaatccagtttttactgtttacgagtaatatatgcaaaatatacagatagcataaaaaattacgtaccgcacagaatttggatacacgcatgatccataacctacacaataataaacaaaaatagagcgagttaaaacacaaacaatcttatacacaaagcttattgttagtaaaaagtaaaaataaaccgagaaaatgtatgcaacatgaataatgcaaaattctcaaaacgaaaaaaaaaaaaactgcctaactagaaacatcgtcaactattatgacagttttaccgagttaaccaatccggttaagccatgtttctgtaaaatacatactaggatcggttttggcgatagtggatgtgccagcgaagttacatgagccaggagccatggctgcacgttggaagtagctattgaaagcgtaagatgcgtgtgcctgaacggtgttagggagaaaacagagaccattgggttggattggagcacagtcagctccagcggcacatgcgtagtctagagccgcctgaagcgcttggctcgtaacatcgaaccgagcaacgcaccacatcgcagcggaggaacggaagagaagaaggaggaggaaggagagagtttggagacagagagccattgggaagtggtaagagagaaaggaaaggaaggagtgagagtgaagagtttgagtgtggagccttacctctctcactctcttttgcttttgctttgttttctcttttcttttcatttacattaattctttttgcgtttctttgttcttttttttgcttatgttgaatatgagctttccgtgttgattttaaaataaagcttaaataaaagatataaggactagttattatccgaaaatatttatgaaacaaatcaaagtaactagagtgaaaagcatgcaattatgtggaattacattttcataactagaaggattttttagcctctatatcgcgggtctatgataaatagtgcaattttacagctagatgaattgtttcctctatactgcatcgatatacaacattatcataagtgttccgcgaaaacattgttgtcaaaaagcacaaaaaataaataaattgagtacataactgggaaagggtcacacaacacaagcactcatcagtaacacatttaagatctgagatattacacttacacaataacatgtacgtctgttccgatgcatcaaactaaaatgtgcatctccgatacttattatgggatcctatcaagcttttactaccacggtctccaccatattctagaccggatttataccaattattaacttctaagccaccacaccaccactttaatcatatatatgcatatctacatcacaagaacattgtacacaaaagtattgagtaacttacatccactctggaaaaatattgattaccgctctaagtgaaaaattagtgttcaatttatatttaacctatgatgtcctattattagtactaagctggtgatgtattaatggatataaatggattattttctttatttgaatgtcgttgttgataggacaaatatctggcaatattgtatcaaattagaactgtaaaatagtatgatcaaagaaatacatagatatattaattcattgctctgctacaaagaaaatagcaatctaaatttagagtaaacatttaacgttctaaattagcaatgcattgcaagataaatagatatacgagtaataatattggagcagctcaaacgctcgtctctcgtagggtatctcaagaatgattgaaaacagcatgagagaaaaccagataagtttcacattcaagagactttgctagcccatttgagagactcatgcaccatttgtttctttttagtggtagcttttgttttagtactaaaatattagaattatatcattaagaaactcgagtatctcatcattgaggttgttcttagctaaggagaatgcattcctacaagtgacaaccacttatggcctaaggcctattctgcgattaattttataaacaattcttcacaatatctaagataatagggagcaaatagtgatgaagatagagaactagtttttgaagcaatgtgtgctatataatacaatacattaactattgaaaatatgagatatgggatatttcacaaaagctaaattacaactcattacattaatcaaaatctgtaggtacaacgtatcacatcatttgtgcgaactctagcatgttagttttagaaaataaataaagagaataaaatattttgtcatttttctcttttaaaatgggtcaaatttatgtttatggaagatataatctcattgttaaaaagagtaagaaatcctttaatataaaatggtcaaaaaaaatttcaatcttcaactaaaatctttatcttttaattaaataatggatatatatatatatatatatatatatgatttaccatattccccaaaagctaaatttcaattaagaagaaagaaaagactaaattatagctcatcacattaaatgaatttgtaatgtataatgtatcacaagattttgccagccctaaaatgttataaaatttcaggggtttctttgttctattcgaaaaaacatagtcattagctcctctgtcttgttatactactctcaccaaacgtaagttttgcttgtttcatttttctaagtttttgttgatatcaaactagatttgaaggattttataatatatgtgacgatctatggcatgtcgatataatctatgtgacatagaaaatactcatttggagggttttcttatgttcatgcaaatttttttatgtaaattgcatgctaattatttggataatttcgtttcaaaattaggtttttcttggaaatg

SEQ ID NO: 21112 - DNA, 3003 bp, Unknown; identical to SEQ ID NO: 21111
  misc_feature (1)..( 3003): 2750-1469P.txt file - cDNA_ID_1839338; gDNA_ID_2926158; Annot_ID_139586

SEQ ID NO: 21113 - DNA, 3000 bp, Unknown
  misc_feature (1)..( 3000): 2750-1469P.txt file - cDNA_ID_1839350; gDNA_ID_1620742; Annot_ID_49645
gtccatgtgaaagcccttctcttatctttccacaacttgtattaatattgtagtttagctttgccacttagtcaaacaacattactaacatcaacatccaccatttggtccttgatccaaatgtttccccttttgcccttatacgcccatttttgagttcttgcatctcatcttacatgataaattccgtttgaggacagaggattatggttattttaattttgtgtgtttgaaaatgtatgattacaacaaaaccatggtttccttcatttctttcaaaaccgacaccaagagaactttgttatgcatgtatgatgcatccaccaaatacgcaatgtgataagtatagctcaattttcttaagaagtataataatgtttgatttatttctaagtaaataagctagaaacggtcgacatctcataagaatccaagaagaaggaaaaaagacattctagcattgatggaggcaattgatttgaagttaattacatgtcgtaatagaaacaaaagtgtttaatatatacccatgccaccttaattagctgggccttcattgttgaactatttacatgatcttgattgatgtttaattaatattacaccagcaaacttcttgtcgcaagacccggtttgataccaccgagtatgatcttgtattcagttttggtcattcgagtaacaattattaaactataaacgaaaagaacaagacgagggcgggaaaatgccagaaagaatgaaaccatcaaagaatggtcgggacgaacaaaagtcacatggagggtatttcccaacatgctacaaacgtcgccgtcttgacaataactgtattgttcatgataatgatattttgctttcaaacataatctcagtctaatcttttttttttcatcgagttttcatgactcctaaaattaatcccccataatgaagaaagttctcttaatttggatggattttaagtttagagataaaaggatgtatccaaattagctagggctaatattttcagtttgtttttctcttcatttatttgttgcagattgaatcactattcgtttggaacaacagacggtacatgggatgagattcatataaacgtagagcataagtaaccataccttgttaatgctttaagctatttacgttcgaaatatcatttgcttgttgcataatattcgcctcatgcatgttagttttggattatcaacaaatgattttttttttcttgttcctataaaaaggcttcaacaaaattgatcctgttcaaaagatatttttgatttaagtatgcaaatatgtaacatatattaccaaataattagtcaatgaaacaggatcaatgtttgtaggagaattgtttgttgttttatgtcctctacaactcatacaccaaacaacacattattgcaatactttttatatttattttcttcattacgaattacaaaattagtaaaaaaaaagttcttatataaaacatgaagcttttttcgaatgtcaaatgcatgtagaggtaaaaaaaaagatacgaattaaatttttagcagggggagaggaattaatcaagtcacgtgctcgtctgcccaatttgcctgctctctccatttcctcttcacgtgctttcacattatttcccttaatgtctctctctacctctttctcttcatatttacttctgtgccactctttatttaccatggtttttttctttctctaaaacttgattatacaaaaatcatataatcacgtaatcggatcatatattcatcaattaacaaatgtactatctccatccactgtttaattaatacgaaattaaatatggtggttgtcatttcttacatcatgtaaacttaagtcaaatcattttggccccagaaactaatatattcaagattaaatctgattagcatcattgatactctgaacaagtcaaatgtcaaagagattattaaaacagcatcattaccaaaaacacaacatattatttcatttcttttgtcttaatcactttattaatatatataactgtaaatttggaactgttctaaggttcgccagttgggatatattccattgcctgtcagtttttttattttgtttcaatttcctttttttgtcgtatcatttggtaatggtgatgatgatacaacattttatttgaactttcaaaatcatatattataactttcttctgtgagatttaacacgacatccaaaaaaaaggaccgaatctttctgacctacactaagaaaactcaccaatgactatgactatttcttcaaatccaatttagatttttgctatcattatcgaaatagctaaaaatatttgggttattaaaaaataactttcatctaaccaaattaaatttccaatgggacgaataatgaacgcaaaaaatgtagtaaaaaacacacatttaattcagcaacttaaataaaatctgcaaaaaaaagtaaattaaatgaaatatacagatttcgaattatttcgattgtaaaagaaatagagtaaataaatgaaagagaatatttgaacaaactagttagagtttatctacttttattgttgaagaaaatattgcaataatgttctctttaagaccaaaaatatgaatactttcaacattattttccctttaattttttcccaaagtagacactaacgaacaatcatcaaagtatttttcacatatattactataatgttagaacattacattttttatttcgtcaagtagtgtatttatttattgcaatatctaaaagacattaacaaaagcaagattatgaaaatagtaacattatttaatttatttacacaaagtccctcttctttgtaagcatttaaaaacccaaatagcccaaaccgtctctacgcataatcggagaaatctctctgccgccatattcaaagcagtttccacacatttaatgtgaacacgttttctcactaccaacaaaaaaaaactcaaatcggaaaaaaaaatg

SEQ ID NO: 21114 - DNA, 3003 bp, Unknown
  misc_feature (1)..( 3003): 2750-1469P.txt file - cDNA_ID_1839354; gDNA_ID_1620745; Annot_ID_49710
tgaagttctcacttggggaactctatacattatttactcttaaaggcatcaacccttgatagttttggctttccctgggaatgaacctaccataatccactctcgaagacacagcacttttattaccttgatctagctgacataacttagaccacttaaatgacatgaaccccacaacaatcagagaaactcagacgattttaagcggctttccaagaagacaatggtggagtctcagagtttttgaacgtggtcaggatgctaatggatctttctcctttcacaaaacctggttgtgcaagggattcgagctcagacatctcttcgggagtaagtttcactgataaagctccaatgttctggttgaggttttcaatcttagtggttcctgggatggggcaaacatcatctccctggtgatgaacccatgcaagggctagttgtgcaggagtgcatcctttcttctcagacattgcagaaaccttctcaaagagaatcttgttgtggtctaagttttcctgttggaatcttggtagagtctgcgataagaaacagaattgaacagataaacagtgagttgattaccaacagttcatcaatcaaacaagtcatataaagcctgtgtacttgcctttctgacgtcattattgtctaggttctcaacaagcttgggtcctgaagcaaagaaacctcgtcccagaggactgtaagcaacaattccaatcccaagttccctgaagaaagagagagaagatgttacatatttaatagatagtgcatcaagaatgaggatgaaatgaaatctggttacctgcaggttggaattatatcttcttccacgtctctcgaccataaggaccattctatttgcagagcggttatcgggtgaacagcatgtgctcttctgatagttgaagctgaagcttcagacaaaccgatatactttattttaccttcttcaactagcttcttcagctctccaatctttgaaattgacagacaaaagagattgtcaagttcagctaaagttgctggctttcaatataggtcatgaagtgtgagctcagagtcaaacctaaaggagtctattcaaacgaaaaattctaagggagatgataagatcatttcaccagacaatggttcttcatgaataagctagtaatttcagaaagagtgacccaagcagaaaacatagttctgaaagctaaactcttcgactctatattagtcccaacatgtctctagccacatgtgtgaagctcactgagaagtgagaggaactatataacttccatttcatttgaaagttgcaaaaccatgaaggaagattgacaagaagagtgcttacagtgatttcgatagggacacgagtatcaattcgatgctgataatagagatcaatgcaggcaacatctactcgcattaaactagcctcacacgcagctcttacataagcaggatctcccttaaactctactttcccctctgcatacctgattccatatttggtcgcaagttccactttttctctcaccccatccttgagagcctgacaaaaatccaaactttcaacaaaaatccaaactttcaacatccaaatcatttatacagctctgaagctcagcgaatcaaggccagtgttcccatatcacaaggccagtgttcccatatctaaatcacgaactcaaatattaaaaaatatcaatatcaaaaggggaattatcaaaatcgaaccttgctgaggagaagctcgttggtctcaggaccgtagatatcggaggtgtcaaggaaagtgacgccggagtgaatggcgtggtggatgagagcgatagcttcggtttccggcttgggagtaccgtagaaagcagagagacccatgcaaccaagaccttgcgccgatacctcaaggccttggcttcctagcttaatccttctcactccgcaagcttccgccatgagtctctgtcagaagtcagaactatctctctctcttgacttgtctaggtgactcttatagagctgtgaatttaaatggagttggattggtgtgatggtgaagataaattcagtgtcaattttggatggctggtgcagttttttttttccctcttaacgaaaacaaaattgaatttgttaaccaaataaagtaatggaatcttcataagtcaaactcatttttgatgtagttaaccaaataatgtcttcactttctttctcaatcaattattaacttcttgtgagaaataaactttcctaataatttgttcacgtataaatgtttttttaggttgaaaatttgaagtacaattttctcttattagtttttgttttcaagatatatctttgaattaatattatataaaaacgcagcatgtagtagtataacattttgatcttgaaaataaaaaaatatcaatttcaaagtcttgaaaataaccttttttttttttggctatgagtcttgtgaagttaacttggtgaactctcgactcacgatgcatatcttaattgagcaacatgattcataattcatcttttcatgtctcttgccaacttccaatagagtgcattgacattatttttttaatacattatacatatatcatgcatgtttgtttctcatccatggagaatcatttttgaaatttttggatttttgaaattgcttaaaaagaaagaaaaaaactcaatttttattgtcatacaatgttttccaaaatatgtgtacatgttcttgcatatgagttaattagtgagggtttcctcaaaaagattgttgtatttttggaaaacaaagtttatttttggatattggttctgcattttacatctaatttgttttttaaatcataattttagaaaatctattactaaattaagaaatctatgaatggtttacttcattccgtaaaacactataaattgtcctaaactcatattcgctctcaagtcaaaactcttctattttcccctgtcttcatatccaacagagatctcttcatg

SEQ ID NO: 21115 - DNA, 3003 bp, Unknown
  misc_feature (1)..( 3003): 2750-1469P.txt file - cDNA_ID_1839377; gDNA_ID_1620761; Annot_ID_50004
gccacatcgtttcgctctcccatctaccatcccgcagaaaagcagctcgattggtattggattcaagattattatcccaagtaaaagaaagtgagtgtaccttttgaagttttcgagtttggatgcgtgtttctcgtaggcaaaattctaacttcagcaccttcttcttcagctcctgatcaattctcctttgattctccacctgatccagaagaacaaaggctttactacataaaaccaaaaataaatcacagaactaagagatgctaaagcatgacgtgttgttacctgatcttctaattccttggtcttaaacctccagtgagccgatataatcttcagttcatctctcagtcttgcaatttcatcatctttagccgtcaaaagtttgttgattctttcagaattctttggagtatcttcatttagcatgttccgcacctcagagttctccttggtcttgaccactgatacagcccgcataatgtcaccttcaactttcaaaagctcatctcttagctgcttctgtgaagattctctaactcgcagctcctttcttagattctctagctgctcaccaagtctagttacttggtcctcatgctctttcaaagaaccggtcctctcatgcaattgtttcgaaagcactctacaatgagaatgtgctgattcagctgacaaagcacttgcctctgcagttgcatgtgttgctgctagctgtgatttgatatcagccaattccttcacaaactgcacaataggagaacagaaaagttgataagttacgtcggtaaaggacgtgagatctcctgagttttggcagatttaagaccaaagtcaggttcaaaagacaatggaggaccagcaaagtttgaagaggcagacataagaattaagaaggctgatgagaaacaatcaatgaagttgatgctctaacagatctatgtgttcaagcagaatcaagcaaaactagagaaactggacaatcaagaaatgtgaaagaaaacaatcctaaccttctcagtagcaacatccgaagcacgaatctgctcaactttctcgtttagttccttggcaagttcatgcatttcatcttccattctcttaactcttgtttctgcctcctgctcatattgaaaacagctcaacaaaagtctcaacatccaaaccaaaagactaaatcacaaaaaaaagtaatagctgataaattcagaactttgctaacctgcctggacatagcttcttttgaacacgaccgctcctgttccgcaagacgagtcctcgcttctttcaactcagtggccaaagacaccacatttctcctgaaactctgcttcttctcactcaaatccttcaacaaaggatcatcctctcttagactaacagaagttggcattttctgaaactggaatatcaccgctctgttctttaatctagacagataacttctccagaaaaccccaaaattcaaaaacgtaaaaggaagcagctattcatgttcttcacgtgaccctgtacataaacgaatgaaacacataaatgtccaatctcagtatagttaaagaatgtgaaatcattcaaatatgtccacaagaattaaatcctctaaatcttgtttgtaacaatcaatttcttataaataacagccattatcgaggtagggaatacgcaaaagagacaaagaaacttgtgtcgtccctttcacatcaataaataaactctgataaagacgaatactttacaagtatacagccaaaaaaacgtgacctttttaaaaattcaaaatctcttacaggatttttttaattttcaaaccctaaaaatccaaactttctcgcgacccaccagtctccatcgaacggttggaaatattaggtttctgggtttggtaggaagaagaatcaatttgcagatttgttcgagttcgtgatttctccagaggaggaaagtgacagtgaaaatgaaacctggaggatggggtccctatccgttaggttcggatgagagatcatttaaggaaagtgactaaaatatttagcttcggagttaccgagcctagggcttcgaattttgtgtcatttaaagtaacgaatccgtagctaacctacgcatctggcgcagttagctaacttgctaggtttgactgtagcgcggcaaaatctattcgttcaaagttcaaactatagaaagccacgtgtgcatagtgtaaacgtagtcggaccacttttgcagccatatcaaaccgttggagatccgatcgaatacaactacgaaagatattaaaaagcttttgcatgagtaatgtcccgatttgtgtcgtgttgataagtaagttatctttttcccttcatcctttcctcatactcatattgaatctataaacagaacaactttttttaattattgatggacttttattttaggaatgaagagagttagatgatgcatgaaatggcatacaaagtgtgtgtggagaaagtgaagagtttgggaattgagttcactactcctatagaagaaaccctcagagacactattgttagccttatggaggattgtcttcttatatgatcctcatcatatataggcatatagcttcattttctggttgtttctattttttaactataattttgtatggaggatgtctaggctttacaatatgtataattaaaaatatttataaattttaaataatatctataaactcagaaaaggagaaatattctgaacaatgaattacggcaacgtgatttgttgaaaaacttaacatgtggatgttttttttttctttttgcttatgcatataacatgtaggccttatttcttgtttacaaatatcttctaaaactgaagggccagttttaaacaaggcccatattctaattgagccgccctaatttaccaaaccatttactaattgaacactcccatgcgtttgaagagttgattcttcatttaagacaattattttcagataaagagaggtcaaaggagattatg

SEQ ID NO: 21116 - DNA, 3003 bp, Unknown; identical to SEQ ID NO: 21115
  misc_feature (1)..( 3003): 2750-1469P.txt file - cDNA_ID_1839377; gDNA_ID_1620761; Annot_ID_167148

SEQ ID NO: 21117 - DNA, 3000 bp, Unknown
  misc_feature (1)..( 3000): 2750-1469P.txt file - cDNA_ID_1839795; gDNA_ID_2926128; Annot_ID_138689
atgctttgaaaattgtattaacgtaaatttggacgcttgagatacatgtaggttagggctagccttacatcagtaggacaggcgttttagttccttcaaccctagataatattaaaagttccaattcttaaaaaaactttaatatgcagcccaatagaatcctatagcgtcagtgaccacttcatttggtgtcaaccaattaaaaactgatcagttatagaaatattaaactagtgataatgcgcattttgaatgtaagacaagcatacatataaaagttttatgagttatttaaattattcaattttggtttaagattttaaatgatgtggacatatataagaaggcaaaaccatatactgtactgtattatataatccattcttcgtaacatttggtctgttcttggctcggaaattgtctctgaccagagcagtgttctacatgattatgcaatgtctcggagccatctgtggtgccatctttaagactagtgaatatcggcgcatctttaagcctagtgaatttcggcccatcttcaagactagtatggaggcctgttaagggtcttctaatacagctcaacatgcctttttgtgtaagcctagtgaatttctaatacactttgtctctggtcaaacactttcatgcgttttttttataaatatgtttaatgagcataaatgtgcggctcaaagcggtgcaactcccaacggtcaaataaacaaattaagctcaactgctcaagtagtgagaacaagatcaacctaacttgcacaacgaagaatttttgttgttgttgtggtcatatatatttttacactaactaattattttgacaaaagtaatcaatttgtgacattctacaaaaaaaaatataaaaataatcgaatataatttttttattggtcaaaatatcgattgcaaaatacaaaaatcaaggcataacaagttaatctataaattatagtcgtgttttaaaattaagtcgtgtgttttgcggttttgtcctcgattttgttccttcctttgtgtcgaattagtcctacattttatagagaggtcttcttgaccctaatccacgtgggattttgactcgagccaccgcctctattgaaatgataagatcgtttctagaatgaggttacggcccgtattggtccggttcttgtcggttttggctaacactgatctttcataaagctttctagaatatcctttattattttccctattttgatgggttaagaaatttaacagagtttattcaatatcatctccaagatttaaattattcccaacagtaatgcaattaaaatctaatatcaactatatattggtttagtaactaaaccaatatatagttgatatctaagctacattaaatctaaaacttttctaacaacttcacttcaactaaataattaaacccaaatctaagacaaagtctctaaaaagattatagacaattcgactgtgtcaacaatatcaccacatgtatagatgcatataatcattttcatataatgaattcgacatgtggccctacactttacgctcttagtggatatttcatagttaatgacatatacatatatatatatatatatcatattcattcacatagatatagattatagatataacccactgaattaatattacggtcttcaatataggtgcatttaaaacataacgttccctctcttgtcttcttatttttgctctctgttctttagaactgccattaacgagagtgagagagagagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggtacgagatctaacatagagtgttttcttgttagtagatcactttagtttttttctgatgaactttgtttaggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaaggtactgttccaatctttttatccaatcttggtcgattatagggtaaagttaagttgaattattgagtgttgattggtttagtgtaagatgtgttttggaggtaacttgagaatctaagcaaacgtttgatttgcttgttgattaagctagataatctaatttaacttgttgactggtttagtgtcattatgtctacgcgtgaatcttataaaaataatgaaatttttgatttggaagcaattagtaaggttcataaatgtatccaaccaatcacttcacgtgaccctctggattatttttctatccccaaccaccttactagttccaccaacattttgggctgtccatttaatgaacacatacttgaaatatcataaacaatcttctgttgtttaatgcttagttttttgaatcttgattacacaatttagagatatgttacattttcctagtacttttagttataagtttgaaatgaataacgtttttggtattataacagaaaggttacatg

SEQ ID NO: 21118 - DNA, 3003 bp, Unknown
  misc_feature (1)..( 3003): 2750-1469P.txt file - cDNA_ID_1839795; gDNA_ID_1621157; Annot_ID_57047
acaatgctttgaaaattgtattaacgtaaatttggacgcttgagatacatgtaggttagggctagccttacatcagtaggacaggcgttttagttccttcaaccctagataatattaaaagttccaattcttaaaaaaactttaatatgcagcccaatagaatcctatagcgtcagtgaccacttcatttggtgtcaaccaattaaaaactgatcagttatagaaatattaaactagtgataatgcgcattttgaatgtaagacaagcatacatataaaagttttatgagttatttaaattattcaattttggtttaagattttaaatgatgtggacatatataagaaggcaaaaccatatactgtactgtattatataatccattcttcgtaacatttggtctgttcttggctcggaaattgtctctgaccagagcagtgttctacatgattatgcaatgtctcggagccatctgtggtgccatctttaagactagtgaatatcggcgcatctttaagcctagtgaatttcggcccatcttcaagactagtatggaggcctgttaagggtcttctaatacagctcaacatgcctttttgtgtaagcctagtgaatttctaatacactttgtctctggtcaaacactttcatgcgttttttttataaatatgtttaatgagcataaatgtgcggctcaaagcggtgcaactcccaacggtcaaataaacaaattaagctcaactgctcaagtagtgagaacaagatcaacctaacttgcacaacgaagaatttttgttgttgttgtggtcatatatatttttacactaactaattattttgacaaaagtaatcaatttgtgacattctacaaaaaaaaatataaaaataatcgaatataatttttttattggtcaaaatatcgattgcaaaatacaaaaatcaaggcataacaagttaatctataaattatagtcgtgttttaaaattaagtcgtgtgttttgcggttttgtcctcgattttgttccttcctttgtgtcgaattagtcctacattttatagagaggtcttcttgaccctaatccacgtgggattttgactcgagccaccgcctctattgaaatgataagatcgtttctagaatgaggttacggcccgtattggtccggttcttgtcggttttggctaacactgatctttcataaagctttctagaatatcctttattattttccctattttgatgggttaagaaatttaacagagtttattcaatatcatctccaagatttaaattattcccaacagtaatgcaattaaaatctaatatcaactatatattggtttagtaactaaaccaatatatagttgatatctaagctacattaaatctaaaacttttctaacaacttcacttcaactaaataattaaacccaaatctaagacaaagtctctaaaaagattatagacaattcgactgtgtcaacaatatcaccacatgtatagatgcatataatcattttcatataatgaattcgacatgtggccctacactttacgctcttagtggatatttcatagttaatgacatatacatatatatatatatatatcatattcattcacatagatatagattatagatataacccactgaattaatattacggtcttcaatataggtgcatttaaaacataacgttccctctcttgtcttcttatttttgctctctgttctttagaactgccattaacgagagtgagagagagagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggtacgagatctaacatagagtgttttcttgttagtagatcactttagtttttttctgatgaactttgtttaggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaaggtactgttccaatctttttatccaatcttggtcgattatagggtaaagttaagttgaattattgagtgttgattggtttagtgtaagatgtgttttggaggtaacttgagaatctaagcaaacgtttgatttgcttgttgattaagctagataatctaatttaacttgttgactggtttagtgtcattatgtctacgcgtgaatcttataaaaataatgaaatttttgatttggaagcaattagtaaggttcataaatgtatccaaccaatcacttcacgtgaccctctggattatttttctatccccaaccaccttactagttccaccaacattttgggctgtccatttaatgaacacatacttgaaatatcataaacaatcttctgttgtttaatgcttagttttttgaatcttgattacacaatttagagatatgttacattttcctagtacttttagttataagtttgaaatgaataacgtttttggtattataacagaaaggttacatg

SEQ ID NO: 21119 - DNA, 3003 bp, Unknown
  misc_feature (1)..( 3003): 2750-1469P.txt file - cDNA_ID_1839846; gDNA_ID_1620761; Annot_ID_50012
gatacatcaacgcttcatttacaaaatagacaccaaccagtctcaacaatcttttagtttccatcatttattggttaaaaacaaaaaaatgtactcacgcgtcgaggaagaagccagcatcgctcatgcattttactgtggtggtaggaggaaacaagttattgaaatcatcgcatcgtaaaatggcagaaagacccccagaagaacatccgctgagcaaagccttaacgtaataatattattagttattacattaacaacttaaatttaacctgggaaccaagattcaaatgcaaagcaatattatatgaaatatatatatgtgtacctgttttgcctgacgcattcccttttccatcaaatcttccatgacagctaaaaatatacgctttcctctatactgaagttgtgccgcctaattgcataaacaacatatacatatgaatcccaagttaattactagtgaaatatataatgatcatcttcatggttttaattaactaaccttgttttcgctgtcaccatcaaaggatgcaccatcacaataccggacttttactttgttccaattgtaaaagtctgccaataatgatttgaaatcaaagaagaggagaatattccttaaccatttcaccaacacatcacatttctgttctcaataagggatcttgagaaaaacctggattttcagcggctttattgcttagtaatcctaaaaatgccaactctttctccattaaggtagatgatccataaccactccctttacggctctgacagttttgtatgctgtcacaccatgcacctccctttcaacaaaattaattacccttatttatatggttatggcgataattaagtatctctatagtttatatacaaagagcttgctatatcttaagtaagaacctgcaactgaatgatccagttgtttgctcctgaaccatacccgcgacacaaatgatatccaggcactgacccatccagacacactgccacaaaaatttaattatttctccatgcgtcatgaaaatgacaatcaaaaactttgtaataatgatgaaaaataatgacacggtacaaacgaaatttcgtaaaaaaaacttgaaaactaacgtttgaaacattggagatctaacatgcatatcagaaatctaaatctcaatcgaaatgaatggtaagaaaattgttacccgctcctttagcagcagcggcttggacgagcgtgagtcctaccatcaggacatttgcatttgttccattggactcgttgaaggttttcatttccccatgtgcaagaatgctgaagagaatgagtcctgcgagactactccaaccccaatacaaaagcgttttcatttctcctcttaatgaaatttgaatgaaatgattatggagacgtactagagttgtcagtatatacgcagccaagaaaataaagcatccgtcttggtcttttgtagtatgcatatgtttttcttatatagaaactcaattataattgaagaccagagagtgagagagagagaattgcattaaagaccagtcatagtcataagagagatttattaagatattttctttccttaattagaaaaagtacatacatcatggacatgattcatgatcttgccatttgtaaatcacaagatcgtactgaagaatgtgactgatagaccacaactttggggcctaaacctccattacgctccattgatcattaggttaagaaattaagattttcacgaaactgccaccttgtatctttcgttgtatattttcatgtatatatttaaggatgatttgacactcatgaagttgtcacttcatttcatcaataggttaggtttaaaactagttttagaacaagtcagttttgtgattgggcttttatttaagtggtgcaagattatattaatagggtttattaatttcaaattcacactattactcatataatagtcagaagtatagagttcattatataattccaattttcttttcaccaaaatctgcagaacagaaagtctcaggaatcttcaaacattttgaaaaaatggtcctgaaaagtggaaagaaatttcagattttgcttgcaagagttcaaaaagctactagacaaagatttcatacaaaaaagtgtggaaaggtcttcaataattgtgattaagctttcaattaccgtttaaagacttgtaaataaaatttaatcaatcttttcactaataaatttaaccaattctattttctctacatcatgcactagtaaaaaaaaatttgcctcgaaacaaaaaaaaacacacgatgccgtataggaaggaagcaataaagaattcaaaacgatttgttgttccgtcttcaatgcattacgcgtcgtattagatgaggcttttaacactaaaaagcccaaaccaacggtatcgggtattatcacctaaacccaacccattaaagacaacgcgtagcttcacgcgcttcacgattcgcgtgagaagaactaaccctgaaacgcggacgttgcagattaacggtgaggcatgaacgagcgtgttaatatataatgattcttctctcacgatgatcaaaatacagaagccaacaagtaaaattagtttatgcagataagacaacatttattacctgatacatactttattaggtgataataattgataattgttttttataagccactaataattaaataaaaataatatcagtaccgtgtaaaagcaaaactagtgtaaacataaattttcaattggcaaagctctgatccatccgttttagtaattcgttgacctttgacatttcacttagacagatgtgtgcaagaaagaaaaacagcatgttgcttgctttttccctcaacgagaaaagtcaccctctcttcaattcttcaattctcctccctttataaaccataattcattaattctcttctctctcaacaactacttgtttagagagagtcccaccaccaccactaccacaatcccaatg

SEQ ID NO: 21120 - DNA, 3003 bp, Unknown; identical to SEQ ID NO: 21119
  misc_feature (1)..( 3003): 2750-1469P.txt file - cDNA_ID_1839846; gDNA_ID_1620761; Annot_ID_167161

SEQ ID NO: 21121 - DNA, 3003 bp, Unknown
  misc_feature (1)..( 3003): 2750-1469P.txt file - cDNA_ID_1839862; gDNA_ID_1971820; Annot_ID_58307
aaatagagaatatcaccaagcactcttagttttctctttaaccaatatccgataaatcgaggtttaatacaatgctttctgggatataacagaaacgtacgtttggtcatatccatcaggttgaaacactggatcccatccgaaatcagttggtcctctggctggaactatcttaccctaccacatcaatcacaagggacaaaagaatcaaactttgacaataaacaaacagagaaagaacaaaactaataaaagagtggttacaatgttgaacataccggagttttccccaaaaatgtaagaggttcagcacctggaccacgcgagaaagagaatgcgcacaatgcataagctgatttatcttcataggccatcagtaagttgttcagacctgtacatgagtcagaccaaacattgggtgttaccagtgtaagagataaatgaaacaaatgctgtagtgagagaaacaagtgctattacaaaccttcgtgaccaagcttctctagaaaccactttctgcaaatatagaaagaagattaaaagtgctacaaagaagaactctagagataacaacatagctccaatacagttagtcctaggctaattagatctaatatcgaccagaagtagattccaaaaaaaatatagaggccacttctacaaatcagtccagtaataaattatgaatcagaacatacaataagatgactccatttggctactcactcacaccacttagcaaccgcctagaagaactaagaacaggtattgatccaacccaaccagacaattttccaacacattaccactcaagaaagaggtcaacacaacaaagtggaactggagaaactctatccttcaaatgaagtttgacaagcacagaatcaggagaagaatgaagaaacaaaacttacatgtatggccctgaaaaatccaacataaaacgaaatcaacaaaaacttaaacactgtgtaaccatttgctgtacatggagtaaatgaaaaaaactagaatctaaaagccaatcataccaggaagccctttcaaagcattgaaacagagacatgtatcttccacaagcactggtccatccaccttctcatttacaatcaaaacactctttatatcagtttctactatccttagtcactaacttactattactagtccgtccacattcaaaagaaggaaacaaaaatgcaacagtacataagaagcaagcttacacataaacacaaatatgatgacttttgtaatcaattcaagtaatatatctgcagattagaaaaagctaaaagcttgtgaacctgaagagcagccaaacgagccttctctttggaaatatcctcaggctcaccttggagctcaggcactgcaaggaaatacacaatgagcctagtgaaaatgagaaacaaagtaatgtcaagagagataaatcgaaaagggtacgccgtacgcacaatcgagtttgagagacttgaaaggaatggaatttccgatgatagctttgacttcttcgagcttcttagcatttccagtcacaaacgtcaccggccgtggcaaaaccaccgctgctttcgccgccgccgccgccattgtctgtgtctcagtctcagatagcgaaagcaaagtcattttgttaatttttctttgcaaaaaatgggcttaagtccattttaatttaggcccattgaaacttatactcgttcgtccaaagtaaaattacgagtaaaccgatcattggtttaagtaaacccatttttcattcaattagggtccgcagcgattttgtataatcatgactgctaagcgttagccggacggtaaaagagggtctagcgcctagtaaaaaaattataattatataaaaattaatcgaagactagttttatgattatttaatgttttgaaaatatatttatctattataactaagaaatttatataatacttttttaaaaaattgtaattaaatatataaaaataagattttaggttaaatttataattattatgcaaattacgaacataagttgaacattttagattttatatgcaggaaaatataggcatttttagataaatgtttatatacataaggggaaagaaagtacatgtagtaattaaaaagtacataattagtttgcttgtctcaacttttcacatatccttttctagtaatgagaaaatcacttataacaattttttttctttcacaaaatacataaaactaattagctaatttaatttgttttatattgtcttccatgtagcaaaatgacaatgtcagattgaactacacagtgtcgatgcaagaactctctaatggtgcatgatttaatgaggaaaacaatcagacagtagaacctgtacgacaaccagactctcgtacactaccgcttctggccctaggaccaaaaaatatgcaagattctagttcatgtgttacttttacttgtcctcaatatctacttgagctttcgttctaaactacactatgtttgattgttttctaaaaactatagttttcttaagttttctaaaaagaccattgaaaaataatttcacattagtccatagaaaaatgcgtccatggaatattaaactgctgaccttatacacacttaagagattctctaccgttaagctacgataataatttaataatattcgtaacaaagtatatttatatactaacaaatatcactatttaagtaattaaaaacttatgcaataaattaaaaataacgaaattaaatttaaaaagttggctatttttttttacattattccccttccattttacaacattttgattttgtattgttttttaatttttattttaatcatacaaatgaaaaacaacgccctgaccaaagaagacccagctgtaccgggacaagattgcacatttggttcaactttaacctctccgtctccgagtagagaaataaagaaagagagagagactcatcaaaaacatttccaaaatcaaaatccatg

SEQ ID NO: 21122 - DNA, 3003 bp, Unknown; identical to SEQ ID NO: 21121
  misc_feature (1)..( 3003): 2750-1469P.txt file - cDNA_ID_1839862; gDNA_ID_1971820; Annot_ID_176124

SEQ ID NO: 21123 - DNA, 3003 bp, Unknown; identical to SEQ ID NO: 21121
  misc_feature (1)..( 3003): 2750-1469P.txt file - cDNA_ID_1839862; gDNA_ID_2926158; Annot_ID_139597

SEQ ID NO: 21124 - DNA, 3003 bp, Unknown; identical to SEQ ID NO: 21121
  misc_feature (1)..( 3003): 2750-1469P.txt file - cDNA_ID_1839862; gDNA_ID_2926158; Annot_ID_198553

SEQ ID NO: 21125 - DNA, 3003 bp, Unknown
  misc_feature (1)..( 3003): 2750-1469P.txt file - cDNA_ID_1840058; gDNA_ID_1620738; Annot_ID_49513
ttttttttttttgggggtatcgatattgatcttatgacaagtttttgtggtgtgtactaattaacgtatgagttatttgcttttatataggagttgaaacagaaaccttgaggagaccaaataaagttgatgtggggtccaaaataaaaggagttaggatttgatgaaacaagtgaaaagtaacaagcgaaccaaggaaaaaatctccatccaaaacaatatttcaaaacgtacttttgttacgattgaattaccatttgggaagggaatttctaattaaaaaaaaaaaaaaaaaattaagatggttgtgttttgctagcatcaatctcccttgtattaaacatatcgtatccgaatttggtagattaagatgaataaattggtcttactccaatagtttcgcattgatttccgtttcagtattaaaatccattgggatttattggtggaaacgggaaaatcatgtgtattttatttgaacccaaggctatttctaagcaacttcttatgaaaaatgttgaccttaaactacttagtcatgcaaaaaaaaaaagaaggttggggatgtggagaatattatttgattgaattcaaataaaaaggaagaaagttatgagataaaatgtatcagattattcaaaagaatagaccaatttgcaacattgtaatttggtttaataaaacatttggtatgttgtagtctgcacatgtataaacgtacgtcctccacataattccaaaatttgactggcgttaagaaatatctaatctagtcattgataaactactactgaatattcatttgagtgttgaggaatttgatttcaaaatttccgtcttacgaaaaataaattttttgtttgtataaccacaacaattgttagtagatcatatatgaattgtaatgaaaaattatattagtgactagtgagagttagttatttatatcttgatttttttttgtagttggtgggtttggactctttggtcaagtcaatcacatgctctacgtgattttacttgcagttcacgccggaaactctcacgcgtcgaccacgtgactagacctagttcataatttttatcgtctgaatgtcaaaaactcaaatcctcctttttataaccgttttctttgaaaacaaggtattttcttaatcttgtttcatgtcttaagactaaagatattaaaatctgattttggctctacttatactaatgtcgtattacaataactaaagtctcaaacaatattctttaagcacgcattgctggaaaaattaattacaggggggacataagatctcaataatatagactgaagatatcaacttttggctatttggagtcgttacatctacactttcaaacaaaaccaacgaacccattgttttttgggatcctacgaatcccttgtgtaaacaataattaaagacagtcctaaactaatattctcttatcaagtttggaaacattgtagctttgtgaatatattattttgtctaagaagaactttttgtttgtaaatagtttttttttttggatgtgtttctcatgaaatgcaggtaagaaacatctaatgaattagaaatagattatgaataaaagaaaataatttgtaaaagaaacaccgaacaaggagttcgtattcgtatactaattggcccgccaactaccaacaccgacatatgtgctttcggcagttttgatatcattccaaaatttcaattattatttatcaaatttattttcttggtaaaagtttaattaatttcaattatttgaatgtcttaattcactgattacaaattatatatgtaatatatacataacaatttcgttcgtggagtgttattatactccttaagcgaatctgtatattttaaataaaattttgatttatgcacacgtacatgttcaattgaaacgttttccctaactatagatgccaataaataataagttgatttttaaaatgtacaaaacaaaaggtaccgttttgtaaaattttgcaaccaaaaagtacaatcggccgttgaaaatcgtggaaccaaacactaattaaagagaagtgtgaatataatctagtgtttgcggatttatattataaaatttgtgtatcactaaaatgtcaaagcatgctttgactggtcaataagtcaaattaactaacaaaccatgcgaggcgtaggtttgacttcttaacataaatgctgactcagtttttccattccgcagctgtcgactaattggacacgcttcttccaatccctttccactaatcatccatcaacacgtgacatgcctacagtgcacgacttcacagtgatcatgtcaaagttttgtttttaagagaagaagattcacgacttcacagtgatcatagtccagttacaaatttgaatgggcttatggcctgtggcccatttaagtttgaccttaatatccatcagaaacccataccaatacgggtcataagtgcattgtccatatagtgtaccgcaatgcatgggagtactactacattccaccgacgtgcatatggggggacatggtcggtccattaatcccttgcgcatcttattccttacgcgaatacttttccctcttttagttttgtataatactttccatttttttggtattaaatttatcgtgtgactatctaaaaaggtatttaattatctagtttagctataactgcaaacaaaatatctattttcatgaatgatatatttttgaaataaaatattgttgtcatgtaacgaaaaaatcaaaaatcaagcagaagacacgtataacccacgctttcactctcactcgtggaaaaccctcacacgtacacaaaccattataaaatttaatccatttacatcgaccgacttcataagaacatcgtaatcccatccgtttatatatatattccaagttaaacttcatatcatacacacaaacctaaaacaccgaaacaaaaacaaagagatttaaacaagaagagttattatg

SEQ ID NO: 21126 - DNA, 3003 bp, Unknown; identical to SEQ ID NO: 21125
  misc_feature (1)..( 3003): 2750-1469P.txt file - cDNA_ID_1840058; gDNA_ID_1620738; Annot_ID_166308

SEQ ID NO: 21127 - DNA, 3003 bp, Unknown
  misc_feature (1)..( 3003): 2750-1469P.txt file - cDNA_ID_1840079; gDNA_ID_1971816; Annot_ID_58229
acgatctaaagttaagttaaatgaaatgaagagatatgatacaaaccagtggagatattctcgttggtgagggttgcttggactcggcacatctggatccaccataacctttattaaacccatcaacaaccgtataagagagaagatcgattatgaatatattaaagcaatcaagaaattaaatcatgagtttgattttttttttttaactcttgaaaagtgataacacacattaagacgaagaagttaaccaaaagttaatagaaaaagaagtaaagacgaagaagcttaaattagaaaaaggtaatagtaacattttccattaatataagggtatctaaaaatactggctttactattcagattcaaaagtcgttaaaataagtgtcaattaagatatttatgcttttctaaaggtatgtatcctagaataaaaaaactaaaataaaaataaaagcgaaacaaaatcaagttaaccgtctcttgaaaacgtaatatatataatcgagaaagattcaaaattgatttaaaataataatcaaaccaataacagttatgcatgcaagaagttagaggaaacgcagcaggtatatagatgaggctacgaaagaaaagaatgatcaaatctagttacgcttaaatttggatatatctaaggtttcttcgtcaatatatggagcttacgaaaacgaaagagtgagctacgaggaactaaatcaatgaagataagaggaatgaaggagagaagatcaccaaggtgtagaaatttctgaagtcgtctcctccaatctccactattggtttgttcagaacttgagaaggccttagatccaagccattagtaacctctctatggccataagtgaccttaagagagaccaacctcgtgaaaggatcaagaacatctccaacaacactgccgaccacaagaggatctctacgacttaaagacatatttatcttggatctcaagtatctcaatcaaatgttttgcttcttaccttatgaacccttacttgctattctttatataacgttttgggaattgcaataattagctatttagctttattctctccaatgaaatcattaccagggtcttttcgtgtatagtttcgagaatctacaactcgttcaacgtacgtatatcacttataattcatgttttttttttctttccttttttctaaatttatagtattcttattccaaaacccaccagtataaaacagaaataatcatattccaaattatacatcatccacttgtttcttgctagccactagtatgtaatttattctgacttatcattgtaacttcatgaactatttaaaataatgtcacaagcatataatatgctgcatatttgcgtacgtcacgcattttgcgtcacatgtcactcatttaaatagttaaggacactacattacaccgattatgtatgatgttaatgcattttagaataactccttcaacctaaaccatcatataaaagtatatatgctccagataaattgacgccataattgttcacatatctggttggtgtgtacatacgtactagactcttttttttcttttcttaatgtagtactaaacttaattaataccatcaaaaatatcaatttaacaaaacaaaccagtaaaacttttaaaacaatggagtaaatcaaataaaacaagtaaattaacaaatagacacaaggtaacagaagtataataacgacagaaaagtgaacaattggccaaaaaattcgttttcaaacgtgatttcaaaattgtctccaaatcttaaatgttgataaagtaatttttttaaaattcattatacctttcaaaaacaagtgtattacctaaaagctcaaccgtgtattcttacactccaaacaaatttagttccccaagtttggaagacaaaaatttctaagaaatttctgacaaaacacatgagaaataaaccgataaagacttctaaaaactattgcagaccagtttcatttgctgaccacaaaaagtcatgagaatacaattagctcagtgattcttgatatttctggtacctaacaaaaagaaaagtgtgtgaggttagatggctatgatttttgctctccaatttattgtccatttccccaatttgtaatatgaaatgcgcaaattactcttcttccgatatgaataagcaaacgaaaacatacgtgggacgttatgttcagaacatttgattaaagtttatatgcgattttcatttatttattatgaattttttgtttggcagcatgtacgatttttcatttaacacacaaatattatagaattttcattggttcaaaggggtagacaaaaaataatttaatattattacaccatttgcagaaaattagaaaatatatttttacccataattaattgatctatggacgtatgcttggcataaaaattcatatttaattagcagaagccaatcgctgcgtttgtatatacgcgtttatgaccgagaaaaaaacccttacgcgtcatgtaaaaaaaaaagaagcgtaaattacgaaaaacagagagataaatccgggcattgagattttggagatagagagagagaaaaatcgaaatctattgtctatctcctcaatttggattggattttctgcatatcatcgctctagctttcgcgggttttggattcgattccttacccttctccaatcggtaagaacaagctccaaagtttgttcctttttttcaattttcgccaattctgtaatctcatcattgtccttgtttgtttgtttgattcaacacacaattcttgttttgatttggatgcagaagtttttggctttgaattggatttgggtttcgttccaaaatcagctctttttgttaatcaggtgagtttttaggtatttgaatctccaattgcttccttgcaatgactaagtattgtgaaatgtttagggtttcatctgtgtgggtcttgttttgaagcaatttgtgtgtgtttggatg

SEQ ID NO: 21128 - DNA, 3003 bp, Unknown; identical to SEQ ID NO: 21127
  misc_feature (1)..( 3003): 2750-1469P.txt file - cDNA_ID_1840079; gDNA_ID_2926176; Annot_ID_140316

SEQ ID NO: 21129 - DNA, 3000 bp, Unknown
  misc_feature (1)..( 3000): 2750-1469P.txt file - cDNA_ID_1840186; gDNA_ID_1621169; Annot_ID_57228
ccggcttgtgtttgggtccaataataccaatttgtgatcgttggctggccaagtcgtcgatcttgaaattcttgcttcacttcactgtagtcatgttggcggtatcatcacagttctttccttatagcaaagatgcaccaaagagagttgtactccaacacacattcatctctactggtagcgttttctcacacgatatggaactgttttcgcctttcggagtaatcttcgtctgctgaaatgaagtaaatgtttaatgtgcctgttgcaggtggaaatgaaatcacaggctcaagttatgatttagctgtcattgattcaaattctatggagttcatttttaagcatgctccggaggtggcaaaggaacttcatgttggcccttctttttcattgggaaacgctgaagcgtctcctcaagaagcttggatggtacgttcattagattcgtttctatgtacatgctattggtaagatagcaagtgttttcagttttgaagtaaagaattgtttggtatctgcaggcacttttccctatttcatgtgtattaacaacaaacgggaggttccctgctaaagccaacaatattttagaacgatatagccaattcccactcctacaagcgcataaaccgcaaacaacatttgaaaatggaactcgcagagttcatctggagctctctctggggttagttggactccataaagaacttctattggtcttgttggttattaactattccatttgcaggtcgttggaggagatttgggtcacggttttgaacataaccggaccgttatcagggtggtcctttgccgatggcaaacctccaggtgacacacacagaacctctttttcgttctcttaaagcatttactaaaaaccgtaaaaccaaaatgactaatcgttgttgcagcacctgaactcccaccgggtggtcctccctcgtacatattgagactgagtggcaacagcgatgagaagtggaacttctggttagaggcaagtagtgaagaagaagtgagagtagatgtagctgttcttgatcaacgtcttgatgaagaaactatacatttgaagggtcttttcccaaaatggtccgatgtcattgcctacactagttttctttctacttacttgttctgatcgtagactatttcatattctccttttgatatttctaaaacattagagaataaataaatccgttcttaacatgggaaagtttttttttttttgacatcggaaccgcatactctatttatacctaaatcatactaacatgagcaagtcttaagtacattttctttgttgatatagtaattgtgtacatttacttggttctttgataatttataatcttatactttgattggtgcaactatagtcttatatccttaatttaactttatccttaatttaacttcatgatcaaaagatatagtcttgttttttgttttgttgagaagtttcattagcattattgtctaccgagagtaataccacaaattgatagtttctctgcatttttaagagaataagctaaataacggacctaaatacaagtggtccttacaattgcaatttgcaaatgaaaaaatttaaaagagtaagctaaacaaccgtactgacctaaataacaaacacatgaaaaaccacataaataacaaacacatgaaaaaccaatagaagtgtctgttacaattacaaagtccacgtacatgccacgaggtaatgaataagtctaattgcaacaaaataaataatattgtttcatataaataatttttcaaaatattgtttttatttttttcgttatcttttggactcaaatatgtgacaagagtaagactctataaacgacagctattttatcgtggtgcgccatcaaataatgtgtcctatcatttctaagttgagccacgaaggtcaacgtttccgatgcataccaccaaaactcctccctcgtggtgcaccatcaaataatcgtcaatccactcgttaatatgtgtgatgatacgcttatcagcgatatcagtagatgttgaatcaactcttcaggtttcaatgatatcgatagtatacttagctagtttctcccccatgaaatcgatagagcttcctcccaaggtattcaagatcttattggcttctacatatgaagcaatcattactcatgtagcaaacttgttaatcttctatattttcattacatataatattttacgtacaagtaagtcaaatgacatgacatgacatatgatataactgagtaagtaagaaattacgtataacaattaagtcaaatgacatagtaaccattcgtgattgttgtctcatatttatatatataaaacaaaaaatgaagttttaagcaaatgatctacaactaaaacaacatactccaccaatatatacaaaatacgtacacttttttttgataagtaagtagaattctattgaacctgatgagagttgagcataactctattcttagacccgaaaactactcaccatgtttattttagagatttaatgatggattggacagtttttaggccatattacatagtaacaactaatttcaactaaaagaatgcaagttggttagtttaatacaaaacaaaatagtgaaaattggatctctagctcattttccgattaattaacttattttcaaaaaaattgtggttataagaacgaattaatcaattgcatttcttataaaaaaaagtaatgaagagagattttacttacataaaataaatacatctggcctgatgaaacaaaaatgagtaaggatatcaacctttgtaataagtaattgttaattaccaattcatagtcttgatgggcattattagaaagcccattaaaaatggacaaggcccatttaaacctaggtttcgcagggtttattgcttcactcttatataaaaactctcgtcttcacaaatctcacatctcttctgcagccgattcttctattagccgccatg

SEQ ID NO: 21130 - DNA, 3000 bp, Unknown; identical to SEQ ID NO: 21129
  misc_feature (1)..( 3000): 2750-1469P.txt file - cDNA_ID_1840186; gDNA_ID_1621169; Annot_ID_173924

SEQ ID NO: 21131 - DNA, 271 bp, Unknown; identical to SEQ ID NO: 2999
  misc_feature (1)..( 271): 2750-1469P.txt file - cDNA_ID_1840248; gDNA_ID_1620620; Annot_ID_46989

SEQ ID NO: 21132 - DNA, 3003 bp, Unknown; identical to SEQ ID NO: 15588
  misc_feature (1)..( 3003): 2750-1469P.txt file - cDNA_ID_1840248; gDNA_ID_2926189; Annot_ID_140952

SEQ ID NO: 21133 - DNA, 3000 bp, Unknown; identical to SEQ ID NO: 4329
  misc_feature (1)..( 3000): 2750-1469P.txt file - cDNA_ID_1840331; gDNA_ID_1620700; Annot_ID_48748

SEQ ID NO: 21134 - DNA, 3000 bp, Unknown; identical to SEQ ID NO: 4329
  misc_feature (1)..( 3000): 2750-1469P.txt file - cDNA_ID_1840331; gDNA_ID_1620700; Annot_ID_165037

SEQ ID NO: 21135 - DNA, 3000 bp, Unknown; identical to SEQ ID NO: 4329
  misc_feature (1)..( 3000): 2750-1469P.txt file - cDNA_ID_1840331; gDNA_ID_2926192; Annot_ID_141077

SEQ ID NO: 21136 - DNA, 3000 bp, Unknown; identical to SEQ ID NO: 4329
  misc_feature (1)..( 3000): 2750-1469P.txt file - cDNA_ID_1840331; gDNA_ID_2926192; Annot_ID_201118

SEQ ID NO: 21137 - DNA, 3003 bp, Unknown
  misc_feature (1)..( 3003): 2750-1469P.txt file - cDNA_ID_1840419; gDNA_ID_1620793; Annot_ID_50484
tggagaatatttcaataataaaaccatttctgactagaattaatataaatcaatagaaggacgtaaacatcactcaaaaaatgatgatcgatattagaagaaactgtagtgggtaccaagaaaattaaacatacttgtcgtcggcacaaaatattttggattgtgaaactataatgccttgttttagaaagatgtgagagaatataaaaaaacttatgtgttattcaattatagagagatgaaattcaccatataaaacttacatgtgttatcatcagtaattacaattatacacatcaagaaaatttctatatttttctaactaggaaaattgtacttcaactgttgatttcatcattgatctagaatatctaattacttttactatcgtacatattaaaatcggagatatgatgaatcgaaaagattaaaactatataaatttttatttttgtaaactttcctacatggacatacattatactaaaattatataatatgtaatgtatgatcgtgcatgtttaaaattcagcgtttcacacgtgtagtttgggacaacttcggcgtttttttggttgagtaagatgacatgtggctcgacattcataactattgtgaataaaataaattgatttatgtaatgattggacacatttgatgaagtggtttcttgaaaataagactttggatggatgcagtgtggacaaaccggtataatttgtttgcggtttagtttatctggcagacaaaaaaccgttgcagaccaagtttatttgtatgtaaaaatggtctgcagatggtccgttgcggttttcttctattttttttagatcactacgaactataattaataaataataaataaaaaacggtatgatccgttgacggttttatccgccccaaccgccataaccattcaaatcctaaataaaaacggttttgataatataagaaccagcccaaagatgaagttatatatgtgactatgttaacacacatttatagtatgagttaacctagacctatttgcgtctcacttcttattaaatgctaaaaatttaccaaaaggacgctattcatcacaattaagtttaaatctctaaattaattgatcgtttaagtttttaaccaaactcaaataaataaaaaaatatacgataacttttattgtgacgatcgaatatactaccatcaaattttataccaaatttctgtttcgtagcatgtacgaaaattttcactccaaaaaaaatctaaaaattatatttaccaaaaactgtgatttcagaaaattatgtgattttaaagaaccagtgatttctcaaattatattatatgaaatgattattattattttaaaaaggtgaaagggtgaagcaaaaaaatagtgtgcataaacaaataagctaatttgttttctggtacttaggtcttttaaatccatataaataaattcttaaaagattgttttatttcaaatctttaacctaaaattgtaactttaaattcatgattaaattttttgttttcaataatttctcgtaacttcattacataaaacgagaaggatttataataggtaaaggcgtgaagcaaaaaataattgtataaataaataagttaaatttgtttcatagtgccataaaattacactaacatctgaacgtgaaacgcacgcgcttcttcatatcatagatacgttgcgtcttaaaacacaacacgtagcaactctttttaaaaaggaaaaatacatttattattcccaacaataaaaaaaatcaaacacagtcgaagaaggcaacgacctttcgcagccgtcagatcttaataaatacagtcgccactaaaatttaacgacatagatcgaaccatgacgacctactttctttaattaattttctgtcgtgacctaatcttctatttgttgtttcattagtcacttacttttatatttattctttcttaggtctatgtggaccaaagtgattggaaaagaaaaaaaaatacatttttgtcaaccataactaaattatcttattttctcaaatgcactgtttattatgtagcgtactgatttattaaatacttttgctttctatggttaatttatgatgtcggatttttatctttcccccaataataatatcactatagaagaaagtttacaaattcttagttaaatcaaaaaagattttatcagttgatttgattatacgaggtgacatcaatttttgtcttctttaacaaaaaaaatcaatttttgttttctttaacaaaaaaaatcaatttttgtcttactttttaattagcatttagaaaaatatttaacaaataaaagttctcataagcgatttttaaaaaaatgttttgtttttactatctttcagtttttttttttaaattaattttctaaaaaaacacatatattaaaaaacatattaaaactaattataaacatattatcttttgtgatttatatttttttataattctaaaccaatgatattcaattatttatcttaaaattaaaaatttatcaataataactaataaataatgtatagaaaatttaaaaattattttttttaaaacaatttttttcctctaaaaaattaaataataaggaatagagaaggaatatttttttatctaataaattccatataataattcaattatattgataaataggttgcaaaaaataagaaagaataaatatgagaataaatggtcatctctcgatctctcagctctgtgcaactctgaacacacccacacatatatactcagatacatacatacacaccacaaaaaccaattattttccaattttaagaaaagtttctgtgtctttttttttttttttggtgataattgaaacatatgaaacaatcgtcgtcatagaagcagcagagattcaccttctttctttatctttccctctcagaaacaggaaacaaaattcaaaaagaacaaaaaaaaaaaggtcaaaccaaaacgatg

SEQ ID NO: 21138 - DNA, 3003 bp, Unknown; identical to SEQ ID NO: 21137
  misc_feature (1)..( 3003): 2750-1469P.txt file - cDNA_ID_1840419; gDNA_ID_1620793; Annot_ID_168382

SEQ ID NO: 21139 - DNA, 3003 bp, Unknown
  misc_feature (1)..( 3003): 2750-1469P.txt file - cDNA_ID_1840621; gDNA_ID_1621121; Annot_ID_56296
atctgtgttttaagcatctccatcctgatcagcaccatgagatgtccgatatgcttgaggattcattcgatgaagctatgattacttctgcgattgagaaattggagcaagcgcttaagaaagaaggcatctcttaccatgttgtctctggacggcacaagagtttgtatagtatctactgcaagatgttgaagtaagttctcatttcctctctattcgaaactgcttgttggttttctggtttcactaagataaaggagagaaccgggaatactgacacttcattttatgccaggaaaaagctaaccatggatgaaattcatgatattcatggcttacgtttgattgttgacaatgagaaagattgttacaaggccttgggagtagttcacaagctatggtctgaagttcctggaaagctgaaagattacatttctcatcccaagttcaacgggtgggttctgcaaaccgattgtagcttaagatgatgcaggcttctgctttctctaattatctaactttgggctttgtgaattttaggtaccaatctttgcatactgtagtgatgggtgatggaactattccgctggaagttcaaatacggacaaaggagatgcatttgcaagctgaatttgggtttgcagctcactggagatacaaggaaggtgactgcaaacactcatcgtttgtgcttcaaatggttgaatgggcaagatgggttgtgacctggcattttgaaaccatgagcaaagacggatcgtcgatctgctcttctgagcccttgtgcagtttcccgtctcacgcagaagactgtccgttttcatataagcctagtggtaaccaagaaggaccagtctatgtgattgtaatcgaaaatgagaaggttagttattatatatctccttcaaattctgctcctttgaggatgtttctttgcttggagttataatttgataaacccgaaaatgcagatgactgtgcaagagtttcccgagaattctaccgtgtcggacctgttacgcagagcaggaccagggagctcgagatggtcaatgtacagcatcccggcaaaggaagagctaaggccaagacttaaccagacacctgtaagtgatctgaaatgcaagctgaagatgggagatgtggtggagctgactccagccatacctgacaagtctctgactgaatacagagaggaaattcagcggatgtatgatcgagggcttgcgttttcacggcctcaccgtgcagctactggtaccatggttggctggggaagctaactgattctcttaattacctttgttcatgtatatatactatagttgcatatatagtataatgcttcagaagatttgttgtacttcggtattgttgattcccacacaacagtgtatataagatatgcctatatgttctaaaaaactgactctggtcattaatatttgattctcttacattctaaatcttcaaaccacacatctggatctggtccataaaaactggctctggtcattaatttttgattgtgttacatttctacttgttgatacataaatattatagattttttggtctatctacttatttgggtacttatttgggtcgtctagagagtgggaaagagaccctttgaggagtttggcttggaaggtctgaggtttgttgttgctgctgttgttgttcttgagaggactgtccaggatctgtcatttcttcatcgtcctcggtttcttcaggttctgttgaaaccgacttcttcggtatcacgagctgataatttgggctcagcaatgtgtcctgttcaggtgggagtggaacaccgggtcctgctatcgattttggcagaggtatcttgttcctacttgcagcaagctcaagcagaacctaaatcaaacatcaaaaacagaaacttcaagattcaggaaccaaaaggcatggatgtgacagacaaaaacttgaggttctcagtgatacaatttatgaggcaagagggtcacacacagttcataagtcataagtaagagtgataattccctaatgattcacatataccaaatgaccgatcatatcgcatctcttctcagacaatgaagaagaagaaacatggaatcgtcaacaatgcatacctctcttggaggaggctgtgagaagctgaaattaactttggattgaatagcgagcttcacatcatcacagtcaatgttgggtttgctagcatgctctgagtaaacctgagcatctgtcaacacttcgaccacataccggtaccataactccagaaactgatgtatcacacgaggctcgtagtcttctacacccatcgacttaagcagagatttcacaatcttagcatctctaggtacatcttcttcaccttctcctgccatgtttatccctaaacaactaaaaaaaaagtaaagctacagagtcaaattaagaacctttcttatacagaattgatgttgcaacaacacaagtttcaatcgaatctcacaagcaaacatcgtgtaacagcaacacattacataaatcgaataaataagaattagagcttcacgaatcggagataagaaagacaaaggagattctaacctagcttcatcaataagttccaaaacacaagattatatgccataaagaggcgataaatacctaatgcgagagagaaagtttggtggagagctagtggcagaaacacgacggagagattgatgaacggcggcgaggaatcgggaaatactaatctctgccactctagatctgatatttatggttttggtttgtaaatctgctgtaacgttgagggtgtaaatgtaatttaactaaaacgctatttattactagtattttgtatttcactcgtgcataggcccattaaagacccaaattagaacgacggtcgaatgtataatattaaataccgataatagcctcatttctcttccgtttacttgtccgtgtgaccgtgtctacgacgttgaaatcgaaattaccacaatg

SEQ ID NO: 21140 - DNA, 3003 bp, Unknown; identical to SEQ ID NO: 21139
  misc_feature (1)..( 3003): 2750-1469P.txt file - cDNA_ID_1840621; gDNA_ID_1621121; Annot_ID_172092

SEQ ID NO: 21141 - DNA, 3000 bp, Unknown; identical to SEQ ID NO: 7162
  misc_feature (1)..( 3000): 2750-1469P.txt file - cDNA_ID_1840625; gDNA_ID_1621130; Annot_ID_56444

SEQ ID NO: 21142 - DNA, 3003 bp, Unknown
  misc_feature (1)..( 3003): 2750-1469P.txt file - cDNA_ID_1840643; gDNA_ID_1621111; Annot_ID_56090
cctcttatacacagttcaacttcaactgcatcatccaactttcatcacaaccctacatctttaacaaactatcttttcttcatgtgcaataaatatttagggaaagctcgacaaggaatcttcaaatgcaggttatgtgctattgatgttttatcacctttatgagggaaaggtattatcacatactccacaacttattcttttaagtaaatctatgattggatctaactgaactttctttaaattttagaaccgtaatgaatttgagagtgaattgattgagcgctttggctccctcatcaagatgccactattgaaatcagacaggtatacagttgacatcacatgcgagctaacaaactcgaacttagcacagctacaaattgcaacttcatatttaattggttcataagcaatttaattgtcttctctttgtgcatatacaggactcctttacctgatcctgttaaatcagttcttgaggagggcattgatttgttcaatctccatagtagaagacatgggaggtgggtaccaacactaccattttaaatgacttgaaaagttgaattttatgtcaaaccgaagtattttgagcatcgtatgccaaaacttgttcatcgtgttatatattaaacaacaccttctgttctgacgataaaaaatgaaaggcaatagtaataattttagcaaaaactaacaagacatcggatttatttatcctgtgactagatgtacttggatcatgtaactggagaaatcctacacatgagtgtgctcacaggcgtttttatttcttgttctggctgttctctacttcattcttttagctctagctcctgggttccttctgacctgttttccttctgatttttcttgttgtagactcgagtcaacaaaaggaacatatgcagcggaatggaccaaatgggagaaacaactacgagatactctagttgcaaattctgagtatctcagttctattcaggtaaaaaattcctttgtcattgatggctcatgaaaagcaagaaatctgcgattgaattttaaactgcttcaatgttccttcagtacatggtaaaagagtataagaagaaggatgtacatatgatgtctttgttttctggtttgcaactttcaggttccatttgagtctatggttcatcaagtgcgagaagagctaaaaacaatagcgaagggtgattacaagccaccttcggagaaaagaaaacacgggtctattgttttcgctgccatcaacttgcctgctactcaagttcacagtcttcttgaaaaggtaaccaaccaatttcttatactatcatataaaaaaacaaaaggaatattgagacaagaactcttcaactgccgaaaactaaaggttaagtatgggctttgttattaattaatagatgttattctcatcagttggctgcagcaaacccaacaatgagatcttttctagagggaaagaaaaagagcatacaggaaaaacttgaacggtctcacgtgacgctcgcccacaagagaagccatggcgtagcaactgtagccagctatagtcagcacttgaacagagaggtacccgtagagctcaccgagctcatctacaacgacaagatggctgctctaacagcccatgttggatctgtggacggagagaccgtagtctccaagaacgaatggccacatgttacattgtggacagcggaaggcgttactgcgaaagaggccaacacgttacctcagctttacttagaaggaaaggcgagccgcttggtgatagatcctccggtgtcaatctcaggtcctctggagtttttctgaatacttgattaaacatggaagtttctctcttgagggaggttgctcgtggaatgggacacatatggttgttataataaaccattccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagcgcgcttagctcagatgatagagcaccacaatttttgtggtgagaaatcggtttgactccgatagcggctttttactatgattgttttgtgttaaagatgattttcataatggttatatatgtctactgttttttattgattcaatatttgattgttcttttttttgcagatttgttgacagtctctaaccatg

SEQ ID NO: 21143 - DNA, 3000 bp, Unknown
  misc_feature (1)..( 3000): 2750-1469P.txt file - cDNA_ID_1840655; gDNA_ID_1620811; Annot_ID_50597
tcctacttttgcagggcatacatttggagtagttaaagaagattttctcgaagtaaaaaagctaaagaaaattggtgatgaaaataatctaaaaaacagatttataaatgagtttgcgcctactaatccagaagatagtctcggtattgggcatccaagagttctaaacaacaaatttacaaatgattttgcgcctactaatccaggagatagtcccggtatcaggcatccaggagttgtgaatgtttaaagatttaaaatatgacataaagaaagctgaagactaaagaaaactggtgatcaacatcatttcaaaaccggttcaatgaatgatttcacctactaatcctggagatagtgctgatataaggcataagaaaatgatttctaatgtccattacaaaaaacaatataacacaaaaaaattatccaaataaagatatatgaaattttgttctatgaaatttataaaattagtattttggtcgccttcatgtttacgcaaaaataaatactaaaagaacctttaaaatattaaagggatgtaaatatatattgttttcataatctcaaataatattttcgtttgatctggctaaattaaaccagattaattgatagtttataatttttatctaattttgttttaatgaaaaacggtgggaaataaaaattggtgtatatatggcaattctatttgatgatttcctaatgcgataattttgtttagctaacacctttttgatgaaacccctgaattatccacataactgttcttgccttggtgattgttatgatttacccatgttttgaaatacttgtgtaatattgaaaatgtagacaaccctcctattttacaatatcaaacatatttagaaatgagtggagtttaactcttacacattcatgtgttatgtgtacctcgtctaacgttaagtttttttgttattatagtttttcatttttagcgttctttttatacattaagcataattttgaccattaaatttaatttagttgtaaattatttatatttttgacacataaaaatggacgtcgagacaaatataattttgttagaaaatgctagattaaaaataccaatcttaattttgtttgatttggaaatcaaagaaggttcaaatcaccatggctcatatgagtattggtttctataatctgtaacaacaacattgtggtattttcccactttttgtaacaaaatcacattgtccatatacatagtgttgaattatgcagttttttcacattttctatttccgtaaaatctctgcgagtattttataagaaaacttatatgtcatttctaaattgaatttaaatcaatccaattcaatatagtttaatttagtaaactctctgtcaataattttgatagaatgttattaggttgtaaatacgaatgttgaggtcaatataattagactacaaaaaggctagtataataagacttttattattaagatcaataaatactacaaaagtcatcttttaaaatgcggtaaaaaaaaactataacgatcaaattgccaattactaaaagaagtatcaattcctacgatgtgtagcaacaacattgtgggttgtcttcaccttttgtttgataatcacaaaatccatatgcatattgttgacttgtacactcttcgttacatggtctattaccgaaagctatctcacatggcccaatgcaatgtggctcttgctcttgctggattgctgcaaatacacaatccaataatatacatacatataaatagctattaccaattctatattttatgatataaaaatgttcaaacattgctcttcaaatgatcaaagataatttaacgataacaactaacctggtttggccaatgttgtagctagaaaatgaaattgtcaatatccctacaaagaaaataatcacatatgtttttctgatgtccattatatattttcactatgaactctattgagaaaaatagacttttatagttttctatatctttaataaagattctttatgaagatctctatttatagaaaaatagatttttatagttttctatatctgtgatcagttcaaatattctttatgaagatctctatttataagattatttttttttcgaataaaaatatcagttttcacactatatttcagttttttcacaaccataaatgaatattctatatttttaatatgaggttggctaaaatttattaattatcgttcttaattataaatttcactaaaaataaatttaattgtattaaactgaacagatgattaatctaagcatgttttacacaaatataataataaccaattttaatatatttttgatttaaacaattacacaaactgattttgccatagcttttgccgatgaactggcgagatcattgtgtcaataaaaactacgtaaaatcccagtgtaccgtgatcattcaaatccatgaaaatattcgtctaactaaatggaaaatctcagatgagttgatatcgataccaaaggaaattgagcttaatactatggacaatataatacacatgaaattgttactataatcattgcttggttaattcgaagaagaactcaaaaataatttttcattatacaatagtcttgatttacatagaagtctcaactcttaagactttcaatagttaaataactgatacactttgaagtttaggtgtcctgtctgattaaaaatttgccaatgtcatttccttttgaccaggcttggttaagaaacaaactaaaaaaaatcactcgttaacaaaaaaaattgtgtaaagaataataaatatccattttgtgtgatatgagagaaacaaaaccaaagacgagccagagccacctctaacaccatcggcgacttctcctcctactcctccgtcgccgacgtgttcgatttacaacgattcggtggctattggttgtaagatttagaattaaaggttaaaggagacgacgacgagagatg

SEQ ID NO: 21144 - DNA, 3000 bp, Unknown; identical to SEQ ID NO: 21143
  misc_feature (1)..( 3000): 2750-1469P.txt file - cDNA_ID_1840655; gDNA_ID_1620811; Annot_ID_169058

SEQ ID NO: 21145 - DNA, 3000 bp, Unknown; identical to SEQ ID NO: 7003
  misc_feature (1)..( 3000): 2750-1469P.txt file - cDNA_ID_1840670; gDNA_ID_1621121; Annot_ID_56283

SEQ ID NO: 21146 - DNA, 1265 bp, Unknown; identical to SEQ ID NO: 4783
  misc_feature (1)..( 1265): 2750-1469P.txt file - cDNA_ID_1840725; gDNA_ID_1620732; Annot_ID_49422

SEQ ID NO: 21147 - DNA, 3000 bp, Unknown; identical to SEQ ID NO: 3326
  misc_feature (1)..( 3000): 2750-1469P.txt file - cDNA_ID_1840725; gDNA_ID_1620640; Annot_ID_47462

SEQ ID NO: 21148 - DNA, 3000 bp, Unknown
  misc_feature (1)..( 3000): 2750-1469P.txt file - cDNA_ID_1840725; gDNA_ID_2926178; Annot_ID_140418
tcaatctctaacgcggagacataaccctaatattacggatggtttatactattaatcttcattaaaaatcgctaaaataggttataagatttccttaacaatgattataaagagcaggcagctatatttaagtatgtgtgatgttcctaataatttgcgattgataagaagaagatattaagatataatttcatgatgcttacattagatttagtccgtagctatatgtaattaataatattattgatttgaaagtgatgcatacgactattgctctcaatgcaaattaattattcacaaatcttgttattttcaataatttgaaggttttgatcaattattagtttataactatgtcattctctagctagtttatatagtcaaggtatgagatttttgcataactgtctatgtgaataatatgttcggcccatgaaattcaatatttagaaatcgtactatgtatgagtgaaggaaaataaatgaatttcttttcttaagtaagataatttaaatatataataatgatagtttaaaaaaaaaaaaaattaaaataacgtagagaacacgagtcgaaaaactagtggttcgtataagcggccaatggtcctcacatcatggcatcatgccatgcgaaaatataccaccaatctttagttttgttttcgtttaattattgaagccaactaagatataaacttttaggttttactcaatatatccgctatgagttgatcattttgaattggtttagtgttagaaatttttatataggaaaatacatgcaacaatctgaaaatgaaaatatcggttagacttagaatttatatcgttttttgggactgacttttgtttggcttgattagaatcacctaagttataacccaatgtgtatattcagaatctcacacaggaaagctagtaggtacaaaatatttgggaaacagagagcagcagcaatatattacaaaataaattaaacatacacacagtcacaaatttattggtggataatattattttttgtctataaagttatcataatgtttccacaattaatgttttctaatttcggcaaataccaaactccattattgccattcgaattaaatgcgctcccctttctctataatgcatagaaaattgacttttgataaaatttcccctttgaccttgcaatccaagggaaatggttggtctaatattttaactaaagtatttctcttcattttaaaatattttatcatcataagacatatcgaacgtacaaaacaattatttcagttatagagaaacttttatcgaaaacaaaaaaaaatgtatatatagagaaactggttttttttttccgttttttttgaaacaggattgagatttatagagatcaaagttaatcaaattgaaataaatattattgcgatgatcctctgacgacaatactataacaccactaatgttcaacatgaaaactcaaccatttataagttgggaaaataattcccttgaactgtcttagatttttaaagctaagtatatcgctcaaactagccgaaaagagttggaaaacctgaaaaactagtccaaagaaaaatcaggatggaagttgaaattgagaggtgcacacaaaaaaaaataaaaaaaattgaaattgagagggataaacgtgacgtggcatcttcatgctggcaacagctaatgtgaaaccttcccacaaagcttggagagcgacgctttttagtcgttcatcaatcctcaccccattgattgtgttactttcattatcacaaactgtttcctaattaaagtcctcttatttcgaatttatttcagtatagtacttgtgtgttaaacttaacaacgttgaaacaactatttccttcatttgcatttgaatgtacaatgaaactacatatttctacattttagtatgagtttttttagtttagtatatttaatgattatctttgtatacaattcaaatccaatatatataagaaactctcattattaatctcgaataagagtacgtacacattaaatcttatatgctaaaactaggtctcgttttagggatgtttataaccatctttgagattattgatgcatggttattggttagaaaaaatatacgcttgtttttctttcctaggttgattgactcatacatgtgtttcattgaggaaggaacttaacaaaactgcacttttttcaacgtcacagctactttaaaagtgatcaaagtatatcaagaaagcttaatataaagacatttgtttcaaggtttcgtaagtgcacaatatcaagaagacaaaaatgactaattttgttttcaggaagcatatatattacacgaacacaaatctatttttgtaatcaacaccgaccatggttcgatttacttgcttaaatatatgacatttgcacttttgagatgcatgttatttacaccttataaaacttacttgaactttaataatatttgaccatatatcatcttggaaatataaaatgtaaacacgaaacacaaaaggaagttttcgttgtatttgcatctatatttctatatttccaaagactaaaacactatcaatgtgttgtgttcaattttgaacgtttaacatgtaagcataaaaacaaactcagaaaaagaagaaaaaaagaagaaaaaaatcatcaaggcatgtctcgtatagctgccacaaacgtaaaaataaaataaaaagcatccataataatggataaaagcatcgtataaacgcaaaatctattagatttttgtttttatgggacacgtataccaattgataaacagaggacggcaccgaaccattttgacttccctcttcttctctccctataaatactttgtacttccccttacggaccctacgaccttttgtttctctcttctctattaatactatagttttcctcaaactctctgattagctcataaatactaaaccagttgaccatttttttctgataaacaatcaaatg

SEQ ID NO: 21149 - DNA, 3000 bp, Unknown; identical to SEQ ID NO: 4636
  misc_feature (1)..( 3000): 2750-1469P.txt file - cDNA_ID_1840737; gDNA_ID_1620719; Annot_ID_49160

SEQ ID NO: 21150 - DNA, 3000 bp, Unknown; identical to SEQ ID NO: 4636
  misc_feature (1)..( 3000): 2750-1469P.txt file - cDNA_ID_1840737; gDNA_ID_1620719; Annot_ID_165740

SEQ ID NO: 21151 - DNA, 3003 bp, Unknown
  misc_feature (1)..( 3003): 2750-1469P.txt file - cDNA_ID_1840899; gDNA_ID_1620624; Annot_ID_47095
atcataatccatcacagcaacttcatggatttgatgagccttttcttcctccaaaagattcacactttcttcctctacctttctgaaacctacatttatttccacaggattgccttcatgaatatctccatgaatttcccgccgattctcagcactattttttccgccatgaaccgttgcaacctgaaaagcttagctagtcagaaccagaattcttatcgaattttacaaaaagtcagcaactttatgcactctaatgaaacaaaacttaaaaattagttaaaacaagcaaaacccttcgctcagaaatttcagttacctcatcggaagatttccgcttcctgaaagtactttggcaataagcgaaagcaatggcagagaacgcagtgacagcaacaacaataagaatcaaaccagaatcgatagaagctctaacaactaaacgaggcgatcgaattgaagaacgacgagaattgcgtttcccggcgcgagttcgaagatgaggagaaggacggagactatgacaacaaccaagaaaatcacggcggagagtagaagccggaagaatcaccggagagtacgaagttaaggtaaggtatttagaagatctggtagtggagatgaaggtggtggaggtaacctccattggagaggcttagagagaaaacgattagaggataaagcttcagagaaggaagtgaggatatgaaataacgaacgactctcttcttcgcattgtggaccccttgcttacgtggcataaacggccgtcaagtcgtcaacgttgtttatattaaaaaaaacatattttattaattatgctaaaattttattgggcctgggtccgagtagtggataggattcgggtcggatccgggtttttgttttccgggggaaatctagaaatttgatcttgacgaatcgccggcgacggattctcagacgctgctatggaaggtgttatgggtcaggtagagaaacggccgatttctaccatcgtcttcatcgttggtactattttgtctttactatttctcgaattgtgatttttttttcttcttctaatgggtttgtgtattaaaagctatgcaaaaggaagctcagcctctgatcaacagattacgcctcgttgaagaagttaatactccgtgagttctttgacctctttcaattttttattttgattcgaaatcaaatgtgatagcttttttgtaggtttccaaaagaggtgacttggattatgtttaagggaatgtataaagacttgaacatcaatatagtgtgtcctggaaaagattcaactcttggtatgtgtatccatgtggttaagtgattgtaagtgaaatagtgtttcaagatgttttgtgaagttcttgatgttaattcgtttttcaggggttgagagtgttggcacagttcctgcatcactcgtgacttatgcttccattctagcaattcaaccagacttaatcattaatgcgggaaccgctggtggctttaaggtatcaacattacaaatttctctacatagttctcgtttcatgcctcttatgtgtcagaaataatgaacacccttccttgtttttaaatggtcttttcaggccaaaggagcatgtattagcgatgtttatgttgtctctactgttgctttccatgacagaagaatacctgttcctgtaagtgctcctttgtattgttcatgtatcagtatgagttgcaaagtaaacctgatgttcttgagtgttatacttgcattctaattccatatatttttgccctttcctaaacatttttatactttctgcaggtccttgatatatatggtgttggtatgcggaacaccttccccacacccaaccttataaaggagctgaacctaaaggtgtatactttattagttgctctgagttcaccatttgatcctcatgcaagattttggttatttcttgatatggtttgcataagtggtagatttatgatttagttgcaatgttcccaggtgggaagattatccactggcgattctatggatatgtctccacatgacgaagaatccatcacagcaaatgatgctacagttaaagatatggaggtcaacaatccataagtttcctgtgttgatgtacctggctccatactatgtgtttgtctttgtgtctttatcagttactacgacttatttacggattcttggcatttcagggagcagcagtggcctatgtggctgatatctttaaagtgcctacgattctaataaaaggtgtgactgatattgtggatggcaatagaccaacttctgaagaatttttggagaacttagctgcagtcactgccaaacttgatgagtcacttaccaaagtgattgacttcatcagtgggaaatgtctctcagacctctaacaagtcatacgtattaagtttcatctgttcagtatgtgcattgggcgaagaaagcatatgaagattcaagcaaagggcgtaggtagggaataggtttgagcagaaatttcaactcttcaccttttctcatttgttcctctatttctttttgctgtctttctattgatgatccatcatacatgtagaaactcagcaaatttgatacccaacaacagagtcataattctttaatatcaatttcgaatgattgatgttaacagaagaaaaaatttagttagtttctctttcattctttttaagtgtgaagatgtacaaaacaactataactataacacacctttgtgttggcttttaactaagcctaaagactatgtatcaagaaaaaaatctcaaagaactggagttggattttagaaagagccaatgcaataaacatgaagcttctaaatctcacacctactcttcaccaaatatcaactagacagaaataccgcacaatatgcaggtcacaaaactgcaaaagctgcagtgtatatatatgccttcactttgaaccttatttacagacccaagatttgagtcttcaacaaacagatacaaatg

SEQ ID NO: 21152 - DNA, 3003 bp, Unknown; identical to SEQ ID NO: 21151
  misc_feature (1)..( 3003): 2750-1469P.txt file - cDNA_ID_1840899; gDNA_ID_2926208; Annot_ID_141834

SEQ ID NO: 21153 - DNA, 3000 bp, Unknown; identical to SEQ ID NO: 6150
  misc_feature (1)..( 3000): 2750-1469P.txt file - cDNA_ID_1840930; gDNA_ID_1620849; Annot_ID_50980

SEQ ID NO: 21154 - DNA, 3000 bp, Unknown; identical to SEQ ID NO: 6150
  misc_feature (1)..( 3000): 2750-1469P.txt file - cDNA_ID_1840930; gDNA_ID_2214645; Annot_ID_136345

SEQ ID NO: 21155 - DNA, 3000 bp, Unknown; identical to SEQ ID NO: 3979
  misc_feature (1)..( 3000): 2750-1469P.txt file - cDNA_ID_1841049; gDNA_ID_1620677; Annot_ID_48277

SEQ ID NO: 21156 - skipped

SEQ ID NO: 21157 - DNA, 3000 bp, Unknown
  misc_feature (1)..( 3000): 2750-1469P.txt file - cDNA_ID_1841053; gDNA_ID_1620677; Annot_ID_48276
tattttcttctaaatatattaaaaaataaggatctttattttagaaataaaaatatagataagttgaactgaaataaatacaaaaatatagtataaagataaaaatagagttgaaaatactctaatatatgttttaaaatagagtttactctaaaatagaggagaaagataatgtatatctctataaagtaatctaatgtctctcctctattttaaaagaaattatatattagaaatttacattaaagcaaaaaatatctaaaatatagttaattctaaaatagaaaaacatatagagatgaacattagagatgctcttagcgccgcacaactgtgaaacaaaaagtagtttagagatattgttgtcgagtgatccacgaaaacaaaatttcttcttcttttaatatatttgtataatttttaaaaaattagatgtcagtttttttgggttaattggatctccggtctctaagcctctaagactaattcaaatgaaaaatatatacatttggataattagaacattttatagtttgtcacataatataatttgcaaaatgtaaagaaatgttttataaatgtcttgtgaatgatgtatacttcagctctaaagaagatgcctatagctatcaataccgagacggcaaagactcaacactatgaattaccaacagctttcttcgaacatgctcttggaagaaacatcaaatacagctgttgttactattcaaacgattcaagtagcttagaagaggcaggggaagctatgttggctctttcttgtgaaagagctaaagtggaagatggtcaaagtgttcttgatatcggatgtggctggggatctttgactttgtacattgcacgcaagtacagcaaatgcaagttaaccggtatctgcaactccaaaacgcagaaagcatttatcgatgagaaatgccggtaacaaagtttctcattacatcttataagcttcaagttctagctagtgtaagtggaacttaaatttaatctaaaatggtttgttttacatgtcatatttgaaggaaactcgggcttcagaatgtcgaaatcattgctgcggatattagcacttttgagcatgaagggacatacgatcggatattctccatcgaaatgttcgaggtttggattggtttttatttcattatatttttgcctgtcaaagatcagaggtttatatcttagctttggcttgggattgtgattagcatatgaaaaactatggagagctactgaagaagataggaaactggatgaaggaagatagtcttctgtttgttcactatctctgccataagacatatgcttaccactttgaggtgtggatcaattaatgtctaatttgatagcttcttgtttagtcagttacttcaccatgctttcttggtaataattaaatcttgggattgtgttgattcattataggatgtgaatgacgatgactggatcacaagacacttcttcagcggaggaacaatgccatcagcagatcttctcctatatttccaagtaatatacattataacttgtgtatgactcggtagattatcatcaatccaaatatatcaatatgttggtgtttgttcaggaaaatgtttcgattatggatcattggctcgttaacgggacgcattatgcaaagacaaggtaaaaactctgaagaatttgttgtaaaaagcaagtgaagatgataatgatcttgtaatgtttgttacttttatgatacaacattttgcagtgaagagtggctgaaaggaatggataaggagatagttgccgtaaaagagataatggaagtgacttatgggaaagaagaagcagtgaagtggacggtttactggagaaccttcttcatcgcgcttgctgagcttttcgcatacaacaatggagacgagtggatgattgcacacttcctcttcaagaagaaatgatgatttctttattttccttccactttttgaataaagaatacaacaatctcgttctactttgtattctgtgattttatggctttatggtttcctaccaaaagagttgttcaatcttctttaaagtgacaatttatcaatgttatctcgaaaaacatggggatcaagtatcatgaactggattcttttgaatcagcagcttgctttgtcggattcagctaaccatctacttccagataataatattttaatattttattaatgttaatcaaaaactcattccaccaaaaaaactcattttattttattaatgttaattttatatatgatacgattctaaattattttttaaatattttagttaatgtcgaacattgaacatatctattttcgtcaattgaatattatgtatccgtttttaaagttttgaatcataataatttttgattagaataagaactagtgtgtagttgtcatccggaattaaattttaaaaaacttacagagttggttttgattaactacaattggaataacaaaagatataaaagtaattaatctatgttatgatcggttaactaccgattaaaaaacataatataaggccccaaaaaacaaaaaataaaattctagaaggcccatcaaagtcgtaaaccggcccggttccaacttttctttggcatagcaaaatggcgatatctgattttaagcacggacaactgcaaaaagataagataagataaggttttgttaagagttttaaatataagaaaattataattaatagcgatatacgtttttcgaatcgtataaactaaaattaggtcacatggaagtcaaacaaaagaataaggtaatacaggtaaataggtaattaacaatccttagtgggctgaacgttgaattaagaaataaagccacgagtttgatttgtttcttatttactttacgtccgtgtctatttatatgtttaacgttacactcattaagatcgtaccttagggaaaaaaaactcaagagacaaaaaaaaaaggaaggcgcgtcagtgatg

SEQ ID NO: 21158 - DNA, 2381 bp, Unknown
  misc_feature (1)..( 2381): 2750-1469P.txt file - cDNA_ID_1841053; gDNA_ID_2926203; Annot_ID_141619
cctatagctatcaataccgagacggcaaagactcaacactatgaattaccaacagctttcttcgaacatgctcttggaagaaacatcaaatacagctgttgttactattcaaacgattcaagtagcttagaagaggcaggggaagctatgttggctctttcttgtgaaagagctaaagtggaagatggtcaaagtgttcttgatatcggatgtggctggggatctttgactttgtacattgcacgcaagtacagcaaatgcaagttaaccggtatctgcaactccaaaacgcagaaagcatttatcgatgagaaatgccggtaacaaagtttctcattacatcttataagcttcaagttctagctagtgtaagtggaacttaaatttaatctaaaatggtttgttttacatgtcatatttgaaggaaactcgggcttcagaatgtcgaaatcattgctgcggatattagcacttttgagcatgaagggacatacgatcggatattctccatcgaaatgttcgaggtttggattggtttttatttcattatatttttgcctgtcaaagatcagaggtttatatcttagctttggcttgggattgtgattagcatatgaaaaactatggagagctactgaagaagataggaaactggatgaaggaagatagtcttctgtttgttcactatctctgccataagacatatgcttaccactttgaggtgtggatcaattaatgtctaatttgatagcttcttgtttagtcagttacttcaccatgctttcttggtaataattaaatcttgggattgtgttgattcattataggatgtgaatgacgatgactggatcacaagacacttcttcagcggaggaacaatgccatcagcagatcttctcctatatttccaagtaatatacattataacttgtgtatgactcggtagattatcatcaatccaaatatatcaatatgttggtgtttgttcaggaaaatgtttcgattatggatcattggctcgttaacgggacgcattatgcaaagacaaggtaaaaactctgaagaatttgttgtaaaaagcaagtgaagatgataatgatcttgtaatgtttgttacttttatgatacaacattttgcagtgaagagtggctgaaaggaatggataaggagatagttgccgtaaaagagataatggaagtgacttatgggaaagaagaagcagtgaagtggacggtttactggagaaccttcttcatcgcgcttgctgagcttttcgcatacaacaatggagacgagtggatgattgcacacttcctcttcaagaagaaatgatgatttctttattttccttccactttttgaataaagaatacaacaatctcgttctactttgtattctgtgattttatggctttatggtttcctaccaaaagagttgttcaatcttctttaaagtgacaatttatcaatgttatctcgaaaaacatggggatcaagtatcatgaactggattcttttgaatcagcagcttgctttgtcggattcagctaaccatctacttccagataataatattttaatattttattaatgttaatcaaaaactcattccaccaaaaaaactcattttattttattaatgttaattttatatatgatacgattctaaattattttttaaatattttagttaatgtcgaacattgaacatatctattttcgtcaattgaatattatgtatccgtttttaaagttttgaatcataataatttttgattagaataagaactagtgtgtagttgtcatccggaattaaattttaaaaaacttacagagttggttttgattaactacaattggaataacaaaagatataaaagtaattaatctatgttatgatcggttaactaccgattaaaaaacataatataaggccccaaaaaacaaaaaataaaattctagaaggcccatcaaagtcgtaaaccggcccggttccaacttttctttggcatagcaaaatggcgatatctgattttaagcacggacaactgcaaaaagataagataagataaggttttgttaagagttttaaatataagaaaattataattaatagcgatatacgtttttcgaatcgtataaactaaaattaggtcacatggaagtcaaacaaaagaataaggtaatacaggtaaataggtaattaacaatccttagtgggctgaacgttgaattaagaaataaagccacgagtttgatttgtttcttatttactttacgtccgtgtctatttatatgtttaacgttacactcattaagatcgtaccttagggaaaaaaaactcaagagacaaaaaaaaaaggaaggcgcgtcagtgatg

SEQ ID NO: 21159 - DNA, 3003 bp, Unknown
  misc_feature (1)..( 3003): 2750-1469P.txt file - cDNA_ID_1841067; gDNA_ID_1620645; Annot_ID_47584
acaaaatctgatagattgacgtcaaaaaaaaacatgataggtgtctattaataaataaaatgtcgatgaacaagacatcgaacatacaagtattgtgatgtatgtatatatacgtgtgttatatatgtgaaaaatgattaaatgaatgatatattgatatatcataagatcttgtataatgagatggttgtccattgttttgttcatcaaagacaacagatagtgaaggcaacccatgtgcatgtacactgtcatcatggccaccagtgtattaccatttcgaaaaccttataagttgtattcttaattaattacgataaataaagatagcataatgcatagttattggaaaaaaaagatatataaatgcagccgtcaaatttgtttttattttgtcaacgccgtcaaacatatatatacatacaagatcatgtgttttttacaagataaaaaatctcttaatttttatataaaagactcttagcaacctaattaaataagtggatcatcttctgattgattgttaaattaaattaagttatttgatgagtacagaactattaagaaaatcattgaaaaataataattataatatcgtcgtgaaccattgaggttcgttattttgttctctttatatgaagtgaattaagagtgtaaaccatgtttgatggcgatttcctagtttgataaagatattgagggtgggatgtttgtcttgtactataattaattatctgtaatcattttaatttaatataatttttttttgttttttagacagcctaatttctttcaaacagctaagccacgtgaaatactttccttaacttttcagtaagttttaactattttgatcattcggttttaaataaaaaccagtggtgtcaaactatcaaacctgatcaaatagtttcaaacctattttttgactaaaatcaaatccacaatttggttaaaactaaaaatatctcttcatagaaggatggaccattgaagaatactttctcttttctatttttatttgatttagaaaatcatattcattacaaaaggaaaaaaaaaataattttttgtatcctaaagttataacttacaattttccacacttcagtttggtagtattaatttatctatttttatcaaagtttggttttaggaaaaatgtatcttttcatataaaaaatatatagatcttcaaagaaactgaattgggttttcaactattttatcgtttgacactactttgacttatcaaaaagagttcaaaatagaaaaatagaatcgaatcacacgtttcagtgtaagagggatttgatattggtcgacattttaaagagttgttttgtttttttttccaatctgcatggtttttcgttccgttgaaccaaattcaacactttgtataaaccgaatagtaatatactagacgtacgccaataccaaaaataaaattaaaactcaattcacaaattgaatctacaccatatcatgcatatatatcagcaacctagaataatcaatgaaatttaatcgaggataatcaatatccaactcaacgataatcaaaagcctaataatagatcaatgaaatcaaataactaaacatagtaatatacattgatttgtgttaaacagaataatatacattataatagtatgaaaatatgaatataatgagataagaggcgtatatgttacaactacagatcaccatccacaattaacaatccgattggtgcgggccattgtttcgatatttgccaactgtgattgatgtgactgccagctggcatattttcccctcctgattacgtttttaccctttcctcttctgtttcaccgttaattcaattttactatttgtaccgctgtctttcaccttttttaagaaaacccaacccgaaatcataactataccgaaatcacatgtcttcatggtgacgtaacaagacttattttccggttgaatttggtttaacctattgagattgtgctaaccgaaaacagaaacggttatgacgccaacgaggcaagaggggtaaaacgagaaagaggggatggcagaaatcgtaattaacaaggaaaataaagggtggtttcacgataagtctgtctatatgacgcgaaagggtttcttaaattcagagagacaattaatcagtttcgtgtgtttggagaagaagaagaacagatcaaatacgaggagagatctctaaagagatttatcgtttcaagtaagtctctttatcaaactcttaatataaacaaatcaaaacatgaacacgtcgtgtcttcgtttcgattctagatacgattttttagttcatgtgaatgaactctgttttattactactagggttgttcaatatttttccgagaattaccagaggaacaaagttagtgattatattgatgcagagtatgaagtaattatatacataaatcatgttttgttctcaagcatctacgttgaaatatatataagaagtttttttttggtgaaaaaatatgtatgagaagttcatctttcataatagtgaaacaactctctttcataccaaaaaaaaaatttgaaaaaaaattagtgaaactctctttgtccgattaggttaggtttggactcagaatcaaaatacgattagcataacaaattttttggcatggcaattattgtctgcaggtaaaatataccaatagaaacatatttttaggagtagttaagattatgattgaagaaatactattacgataagcataaaattttcttttgctgttcttggtttttgtcgttttatagaacattgaatatgtacttttgttttttttcaccagtagatatgtactatacacacataagtaacatgggtagtttatatagagagagatttgatttttcgtatatttcttttgttgaaaataaatatgtgtaaaatttattgtttattaatttgacagatttgttcacgttgagaagtttaatttagattaaacaacaaaaagatg

SEQ ID NO: 21160 - DNA, 3003 bp, Unknown; identical to SEQ ID NO: 21159
  misc_feature (1)..( 3003): 2750-1469P.txt file - cDNA_ID_1841067; gDNA_ID_1620645; Annot_ID_163203

SEQ ID NO: 21161 - DNA, 3003 bp, Unknown; identical to SEQ ID NO: 21159
  misc_feature (1)..( 3003): 2750-1469P.txt file - cDNA_ID_1841067; gDNA_ID_2926175; Annot_ID_140304

SEQ ID NO: 21162 - DNA, 3003 bp, Unknown; identical to SEQ ID NO: 21159
  misc_feature (1)..( 3003): 2750-1469P.txt file - cDNA_ID_1841067; gDNA_ID_2926175; Annot_ID_199803

SEQ ID NO: 21163 - DNA, 3000 bp, Unknown; identical to SEQ ID NO: 4204
  misc_feature (1)..( 3000): 2750-1469P.txt file - cDNA_ID_1841114; gDNA_ID_1620691; Annot_ID_48581

SEQ ID NO: 21164 - DNA, 3000 bp, Unknown; identical to SEQ ID NO: 4204
  misc_feature (1)..( 3000): 2750-1469P.txt file - cDNA_ID_1841114; gDNA_ID_2926158; Annot_ID_139617

SEQ ID NO: 21165 - DNA, 3003 bp, Unknown
  misc_feature (1)..( 3003): 2750-1469P.txt file - cDNA_ID_1841127; gDNA_ID_1621091; Annot_ID_55504
ttttacagttttatgcacaagtacagggactgtggaaactgaaaagtaagggtattgaaagcagaaagaacttttgtgttgaactatggagcaagtggtgatgaaatggagaggcacgcgatgtttaccaacagcacgtggcaatgtagaaactgcgattgtgccagcgtagtagagtcctcgagagttgcatccgcggggatcgactaataaggtaaaagccaatttatttgtcaagcatacgtttcttaaaggagaggcaccgcaaaaagaaagtaaaaaggagaggaagaacttacgatttatttaaagtcagatgaccgttttttcccccaagttgagacacgcgtacgaaccaccgcagtttctgaagataccattcgatcaatccaaagctagcaaaagttctaatcttgttgtccatatgttaaccagaaaagcaaagcattaagtttgatcgacatcacttgctggaaacatttggaaccggagcttcttgtcgtattcctgtaatccgaggaaccaagcctaacaacattgaaatggaaagaatgaatcaaactggagaaaagggaaagaggggaaagaaaggtaaaatggtctgcagatcttctgatatcagaaacattaactaggatcatatattctcagttacataattatatacttaactgcacaatgcactagaagtctagaacataatcttgtactacagttgtagaatcttctattatcacctagatgaactgcaaagggatcatttgatgatcgtcatacttagcacatgaatctccatcagcaaactggttaaatgtggaaactgcaaagagacaggtactcatctaagtaaatatcaggtagttatggaaatttctctacagagcaaacgcatttaatacaaaacatccagatttgaactcatcagactactgtaattgctacctttctctctttaacgcaatggcttggccttcaattacagcaaatgactaaatgcagcacgcacaagaatatgcttattggaaaatttcgtatacaaactgattggtatgcctcttctaggtgctcgaagaacggaatcctgtgagttactatttggtttcccagctactacgactcttcactaccaaagaggcccaaaagtgggaagaatgtattcagaaactaacaatgtcttaaacccttcttccaaaacccttaagtcacaaatctttacagaacaaaagagaagtaaatagaccaatctcatataaacatcaacaagaagcagacaatgtcacaaaacatccaataaaaccttctatgtagataagatcattatgttcaaaacttaacaagaatgctatagagattgcaaggattttgttctaccaataccaccttccttttagcactccaatcgtttaaaagactcagcttacagaatattaggatctgaaactgtttgcttttcgatctgaagctggaaagcttcagagaattcctttagtaaagactcgtgaactatatcgatcaacctcaaatcatcaaccattccgtgttctccatcttcaagcaagccctttatgtttccaactttccggtctctaatcccacatggaactatccagttgaatggtgttagatctgtagtgacattaagagctaaaccatgatatgttatccatttcgacacacgaatacctatcgccgccactttttggttgcctatatataccatttgcaaacaaaaagaaatcaatctcggaatatatattagatcacttacaaaatcatccatttgaaatatgagacataccaacccaaactccagttaaaccgtcaagacgagaagctttaatggagaaagttgaggaaagcacacggatgacaatctcttcaagcatcctgaggtaccaatgaagatccatctcgtgatttcgaagattgattataggatacataactagctacattttcaaacattcctataatcagcttgaagagctcattagaaaacacacagaaacttccaatgcattgttgacattattacctgaccagggccatggtaagtgacttcgccaccacgttcagttcgataaacattgaaaggagcatcctttatatcgaaattgagataatcctctgtactagcagttcccattgtgtaaacaggagagtgttgtaacaaaatcactgtatcagcgcagtcttggtttctatcaatcaatgtctttttctcctcgacaatgctcttctgccatgaccaagctttcttgtatggaaccaatttgtcgtaaagatcaaaacacaggcacctgcaaaattgatagtgattgcacggaaggtgttcgttaaaatgcctcaaacagaaaatagagagcacaaaaaaggaaactttactttctggggatttcatgattcccggagtttaagatcttgacagatctaactaatctgtttctcttcgcgttagtacgatggtgatgatgaattcccgaaactagagtttctactccattcagcaactccataactctgtactaaagaagaaagtggaatttacttaaaatttatttctgtaaatatacagtcattcaatttttagccaatcaaaaacgacggaaacaacaattttgactctacaaaataatatgtaaatgtaattaattatttgaaaccaaaaaagcaatctttatggataacagatattttacaagcttaatttgaagaagaagataacaaaacaaaaaaaagagcgtggctttatctatcatctggtatccactatccacaactggggtcagcttctggttctctctctcggtaactttctgagctgaagaaccctaattcttatcttcaccggattccgggtatagggctttgtaaagttgttgaatttacaaagaaagatatgctggtttgtctgggttttgtagaagaatctgtgttgttgctttgagattaaagtccgaacaatgttgggtttgattcatgtccttgatgagctcgtcaatg
